United States Patent 9,328,346 (POLYCOMB-ASSOCIATED NON-CODING RNAS) - sequence listing, part 89

SEQ ID NO: 16520 - RNA, 213382 nt, Homo sapiens
ccgcuguugccgugcaggcugcggauuccuccagucccucccucggccgccucuccucccggagcgagcgcgcagcccugcgcagcagcgcccacuggucccguccugugagccccggccccagccgcggacagacccgcggagucgccucccggcccacccgcccggccgccgaggagcgggaggaggacgggaccccggcgcccccaccccauccccgggagguagguagggggcccgaggcagggagaugccaacucacuggggcugccucccgggugggcuccgcggcggcggacgggcgggaggaggggcgcgggcccagggccggaggacgccgcugcccgccugcccugcgcccggggagccgcgugggggcagggaggcugcaaagcccgggcgggggcggcgcggggagcccgggucgcgggugcucauugguacucggaugaugcgggacgaggggcggcaggcucugcggugaggcggcagcagacccgccgugcgcaccgcugccguccggccccagccccggcgcggcgcggcgauuccuccucccugccuccgccggcgccucccugcagccgggcgcggcggccccugacgcggaggccccuggcgcggaggugggugcggagcggacagcggacagccggagggucuauuuucaggugcccucucuguggccccgcggguggggagcgggggcggcggugacagggccgggcucugcgcguagcggugcaggggaugcggccaggcguggucccggcugcgccgcgcugcagcugagccggaggcggcggccccgcgcccccaccuccgccccaucccugcgcuugcuacccucgugcgcccgccccccccccgcccuuucugccguccccacucucccagggcugggcgugagccgccuccgggcgccgagccgccgcugcgcccgcccuucagcuccugccacccucucuucaacagguuugucucagcgcagggacccuccgggccugcuuuggguaggugggcuggcucgucaucaccccccacaccacgcccacggcccucuuuuagggggcgccuucucuuuguuuuugugauaggaaaggugccaacugcugccaucagaugaggaggggguggggaucagaacgcaaaccucuguccauuauuuuuccaaucgaaagccaggccagauaguaagugaggacagggugcgugugggggugcuucggcggagcagaaaauugaauucggugggguuuauuugggcggggaugugcuuuuuuggcaagauggauggcucacggugcccucgccgugaugcagcacaaugcagcaguaucgcagcuuccuugguucucgcuggcggggcuuggcacggccgcucggcgccugcggcccccgcccggccccacccaggcccggggcugcccuuggccgaggccuggagcugcugcuaccuuguccugcagcuucugcuggauguggcgucaggaggaccaggucagcuaggugugagcaggggagagucuuuucuuuugggaugaucccuccugcaccucuucuugggcugcgcucugccggaggggcgcccugcaucaccagugcaggcagaggggagccggccugugguugcggaucggaaucugaucugcgaccaggggaccugagccauagggaggggcugcaggaaggacugggcccaguggugugcggaggcaauguugcaguguggggagucgcagcguuuuucuguggaucguccauaaucuguaaccacaacccagcuaugcauuaauuuuuucuacgugaaaaguugguguuuauuaauuggaccuucacaacugugacauuacaguaccucgucugucuuugguuaauaccaaguaugcauuuuuucuguaggaaaccauuuuuaaaugaaaugauuaaugcauuuuggguuuuaugucacuaagacauuuauaaguauauuaaaauucaguagguuguuuuaaaaggaauuuauauguuuuuuaauggauaguaaaugauuccuuuagcuuguauuuuguuuucaucguuugcuuuuucuaagucaaguacaguugcauuauuuggaugcuuuauuaaggauuauuagguguaugagugucaugaugggggcuaaauugguauucagauuucuauugauugagguagccaaguuaaguguccgggcguaauuaaugggauuaugacaguaacacugcguuuguguuuguuuauauguauuuuuuguauacauauuuuucacagcugugacuggggagaggguggagaagggcagaccaccaaggccucuugacuggcaucuagucagaaggagaugguucccaguguucucauguuuagucucggccaggacacagggaauuucccuucuaaaugccaucucuauaauucauuauucagugugggauggcaaaugggauauauuucaaaugucaacccaggcuuuccuaaaauguuuaggugaaaaaggaaauuucaauaugcuaguuggaagggaaggucaguguuuacaagccaagggcgugccugcuuguauuuuuaaauauuucuaaugaauccaaguuaguugcuuuugauuucauguggcucugcagaauagaacugcauguacauugugugguguaugugcguuauuuugaguuucucuaauagccauuaaaauaugagacuuuuugugcugguuguguaaaaucguguugcguacagauuuuuaugaauguuguucccauggaucauccaaacguuuuggauuuacuuuguuguaagaaauauccuguguugaugucacaggagguuuagcuguucugacuuacacagcaggugcagaauucuguuggguuaagcucuuuguaacucugucauuacuggagugaccaaaaccuucaucugagaggagaaguauugggcagugaaggaacugcugucacuaggucgucucccacaguugagguuuucugugaagaacuucucuugggcaagacuaguaacaacuaucugugauguugcagagcaaaugagaagaccucccucuacuugugacacauccugagcagaggcuuggcauuggcagaguuuccuggaaggguuuguagagugguugcuuugucuugauguuugaauguaugacuuuacauguggaaguacuauuuugacguggaaggauuuuacuacugcuaacauagacaugauuaguggaaaucauucaguguggauuuugucgaaauaauuuuaagcuuuucuuuuuaauagcauauucuuauagaacauuuuaaagccuaauuuuuuuuacgugcaaugacaugaugcuccuuuaauuauguugcaucguaacuaguaucuucauuauaauugggcuuuauuuaauggcagccguaguuucuuucacuacauuauuggaaaugcaaaccauucuuccagaaggaaggggcuaacuaccccuguuagaagagugaacuuuguaggucuguggaagugaguaaagcaucucauggguuuuucuuguaaauuuucagucuuugcuuuuucucagggcaucuuuucuuugcaaaagaccuaguuuaguacucugauuuuuccgguagcacuuguaauuauauuuaaauuuuuauugugugggaauaacaucaucuauuuuuuucuacucagugguuaaaggaaauuacaccaauuagauauaccuguguuucuauuuuuaaacaucucuggagaaggcauuuucauaauguccuuugcuaucauagugagguucacggaccuucaacauuagaaucgccuggaagcuuguugcaaaugcagauucuuaggccccacucugaacucagccaaucggaaucaacauuuuaacaagaccuuuaagugaguuguaugcacauuaaaugaagaaacucuauucuguuccuucagcaaagggaccucaauaucaaaaguuuccuucuugaauuuuccuuucuuuugcugaaguaucagcacauuuuuuuccuugaugguggugacaaaagugaggcucucacuguaaauuauuuguuuaauacaaaauuauuuuauaaagcuguucuuuaauucuugguggaagaguccuauauaccaugguuuauuuagauuaaucaguguuuuagguuguuuuguaaaacaccucuaaaguugaaaaacagucuuuuuccccucuggaagaaaaaggcauugguuuugagacaucagagcuggagccucggaagcuaaccccugagcaaaggguccucucugcucccucugcucuggcaucuugaugucugucaucugauauagucaauguccugcccucucguccagucuuuucuuagaguucuuuuuugaaucaacuaauugguagguacaaaauaauguuccuaaaauauauguuaaagaaucguaaaccagcugggugcaguggcucacgccuguaaucccagcacuuugggaugccgagugggggcggaucacuugaggucaggaguucaagaccagccuggccaacauggugaaaccccaucucuacuaaaaauacaaaaauuaucugggcaugguggcaggcaucuguaauucccagcuacucgggaggcugaggcaacagaaucaguugaacuggggaggcagagguugcagugagccgagaucgcgccacugcauuccaaccugggugacaagagcgagacucugucucaaaaaaauaaaaaucauaaaccaagggacacucaggcagccaccggcuaguucaggaagagccuuauacauucagagcccaccuccaucaucccaucugaaacaacccauauccuugauuuugugcauaucauucccuucucuaugguuuauccuuuuuaaaaaaucuugauuguguaugauuuugaacuuuauaucaacaaaauuauacuuuauguauucuucugacucacauauuuagauuaagauucuauucccaagguuuauccauuucauggcuguauuucauucaguuucaccugcuguauaguauucuaacgugauuuauuuauucauuguacucuagauggagauuuggauugauuccagguuuuuuugcuauugugaaaggguugcugugagugguuuuuguacacggcucuugguacauauguggaggcacacacacccauuugcugucucuagggaaugaaauuuucuggcucacagggcauaugcaucaucagccuuaguagagaauguagaacuguuuuuuacaaagcgauuauguugaucguguucccacuagccauaaguguuacaguuccaaagccuugccagugcuucacauaccaggcuugaaaaucuuguccagugaaacauuaucucacugugauuuuuauuuacaauuucucugauuauugaguuugaaugucuguuuacauuauuaaccauuuggguucuucguuuugugaaguaccuguucagucuuuuacccauuuaucuuauuaauuuguaguucuguauguagauuacuacuaauccuuuguggauuacaugucuugcgacaauuacuucucagcuuguguuuuuuuucuuaacucgaauuugugauuucuuuugaugaucgguuauuuguaauuuagcagagucauaaucaguauuuuguccuuuaaaguuugugaggguaauuuucuuauuucagaaaaguuuuucuuuguuuggaaagagcauucguuuuggagucaaacagguugugggcccaaauccuaaugguguuguauacuagccuuauggcuaccacuagguacuggccuugagcuaguuaguuacucaagaccacaguuuccucauuggaaaaaucaaaauaauauuaguuucucuuaguuaugauacagcaguguacaguuccaggcacauaguacguauuuaguugauaacaguuguuuccuuucuguugggacugccuaagcacuaugacccacugaucccuuuugguaugcuuugcaaaaacuaccuaaaccuuuuuaugucaggagagcuauuaaauggcuuauucuaacuuuuguauuuuaaaaggcugcauuaccaauggcauuuauauauugauuaauacagucugaagagaccacuuacuagaaacccuuaucaguuuagguucugguucuugaaaguaauguaauuacauuuauuuguacacaguucuuuugaccauuaagcauuuauaguauuaaugaucuuccuuuacugcuacucugagauuacuuuguaauauuguuuuuuauuuaaugaauaauuauuggauacauuaucuugccaggacuugaaguuguuaugguuuuguggacuggcuuaaaguugaauaagaauuaguuccugaaugaaaggacuguauacucuaguauauggaauauauuuuauguacuauacacagaagguaaaauaccuuuaacaggcuggaugugugacuuuggcaaaccuuuaacccuccggucucagaucuaauuuuauaaaauggaagacuuagaugaaaucauaguggggguuaaaacauggcacaugccaucacucgcuucuguuccuggcagacaucgaaaaucaguaaugguacucuuuuuccacugagcugagauagucucagucauauucucgacaugguguucuaggcaguaacuaccacucgauuaaaucuggcauucaguuuuuaagcuccuguacacuucuaaauucugugauuauaagauacuugagaaacucaucaccuuggcaguguucagaauacagugagacuggaagaaacuagaagcaaggagacaggagagaggugacuggggguccagaaguaaagggagcaaguuacagugguggccaagggaacaaggagaggagagaugggaaaaugguugugaaggcccaauccuaugcgaagcuauuuguaggguaaauggauggcaggauggaugggagguggaccuagugggugacgagcuaagcuaaggugauaaagauuucaaauuugaauaaugacaaugagcauguuuggugaugaugacaaauagacaagucaagugcaugauuggauauuugauugggaagaguaucaguuuugcuuuaaacauguuugaguuugagguuccagcacaauccucaguggagcuggagagaggucauggcuagagaggcugaugggaggcuuuggauggaggggcccugggccccaggcuucaggcucuuuacacaacccacccaccucgcucacacgcuaagugaccuugggcaaacugccuagacuucuuugugucccucaacaucuucaucuguaaaauagucguaaugagaguaucuaccacauaggauuauuaaagccaaaugagguaauucagcgcuuaucacaauaaauuuuaaugauuauaaaauguggaauuuuugcuuaguuugacuuaauauuaugcuuucuuucaaauaaacaguuugauuuguuuagaaaagguauauucuagcaaauaacaaucauuuagauaaauaaugcuaaguuccaucuguauuaaaccuguuccuauacaucaugucaaaauaauaggaaaggaaaaucugauuuauauauauguauuuuuuaaacaaacaauaaaaugcuaaagccuuaguagcuaaggaaaugauaugagcagauaguuuauaaaagaagaaaucaaggaggucgauaacuguaaguucaaacucaccaguguaugaaauacagacuaaauuaauuaauuuuuccacuuaauggauagauauuaugcucugggcugcugugagaugggagcucugcaucaccuguugagagcauauuuugauuaauacaaacuuaggggaaaacaguuggguuauauauauguaacagaagccuuaaaugcuuauaccucuugaacugaaaucucacauguagcuugguaaccuacaaaaacaauuaaaaauaaggacaaguuuuuaaacaaggauuuucuuggcaacauuaauagagaaaaggggaaauguuuuuuaauggaacauaaucaaauaaauuauggcgcaacuguaggguggaauucaauguagugcuuaaaauaaugguuuggaagaauauuacugagaugggaagaugccgguaauacagggguuaguggaaauaucuggaugcaaaauuguauaguguacuauaauccugguuuuacuguauuaaguaaaagacuggaaggaaauacauuaaaauguuaaugguuugcuuuggaugguagguugaugggugauuuccucucuuguaugaaaggaaauucccaugacuuaauguuucucuuuuugaguuuugaaauauuucacgguagagaagaaugcaguaaauaauauaauagaugaccaugaggaccauuuguuuugguuuguuugaggaacuuuuuuuuguuuuauuuuguuuucuuuuguuuuguuugagacagagucuuauucuguugcccaggcuggagugcauuggcacgaacauggcucacugcagccuugaccuccuggguucaagcaguccuccugccucagccucccaaguaguugcaggcguguaccaccacacagggcuaauuuuuaaaccuuaaauuuuuuuauagagacgagguuucaccguguugcccaggcuggucuucaacuccugaacucaagugaucugccugccuuggccucccaaaguguugggauuacaaaugugagccaccgugcccagccuugggcaccauuuuuuaauaaucaaaaaagcaaucaacacuuuaaaaauucuaauuuuuaaaaaggaaagaaaaaaguaaaucuguccaauuguagaucauuauuaagaaauaguuuuaaauccagcgauuguuauaucuguccuucuuugcaguuuucuaagagcaaugauacaguguguaaguuagcaucuuaaggguauaggugugagauaaauuaguguauucaaauguauuaauucucuacacuaaccuaggcagcuugaaaagagcagaggaccaggguucuuugguauuuccagucuccacacuugagugcagagcaguggaauuccaugacgugcauguucucacucguggaaaccuaaacacugcuacuggagcuaguuuguaaccauuagaccaucagguuucaguggaauuggucagaaaugaagguaaaauuccaagugaacauuuuaaaauaaaaaucacuucagauuuagauuuacuuucagugaaugguaucucagcaucugggaauauuguaggcuaagauugagaggaacuaauuuuaauauucuucguuuuuuguaugaaaagaaauuccugugcaauguuauauuuuuguauauauacauauaugaugcauacauaucauguuuaucucauauauauauauauauauauauauauauaucucacacaugggagagagagguguguguuugauugaguaaucucuaccacgaagggaggcacauauuuuaaaacauuuuaaauggggaauuuuauagagacaguauuuugaaaaggagucccaugaaugagucaaguuguccuuagccaguggaggaaauguuugggagggaauaguacuuucuauuuuaugguccaagucucuaaguguguugguacuuugugaaauguagcuuauaaaaauuaaugaauuuccauuaauuuuguauuuuuucugccaucagcuuuaacugagugguuguuugaagaagcuuucaggauuaauugugcuuugacauauaaaaauaagauguuaucaagauugcuuuaaaacugacccuuguuuauaggagucauacguccauucuuaagaaacucucaacugugacaguaaacaucugagugauuuuuagaaccauuuuaauaucucugcucuagaaucgagaaugcccuguuaguucugauuuuuaauauacaaauuugaagccacuaguuaggcaguaaaauauguauuagaacauaacuauagauuuuuacccaauagaucaauuaguaugaaauuuaggaugauauauaaguacaacagaauuuauuccuuugagguauguauuuucaaaguguaauuuguguaauuaaguauguuuauucuucgagaccauccuggcuaacacggugaaaccccgucucuacuaaaaauacaaaaaauuagccgggcgugguagcgggcgccuguagucccagcuacucgggaggcugaggcaggagaauggcgugaacccgggaggcgaagcuugcagugagccgagaucgcgccacugcacuccagccugggcgacagagcgagacuccgucucaaaaaaaaaaaaaaaaaaaaaaaaaaaaaaaaaaaaaaaaaaaaaaguauguuuauucuuagaaaguucaugagccuauuaacauugguuaucuuggguaauggaauugcagaagauuucaucucuguauauuuuuuucuccauauuuuuuaaguuuuaggaaauaacaaauucuuguucuuuaucaaaaauauccuaacacuucugaccaaaccucauuuuagcuggauacaaacuaaucaaauaauuuaccagcuaaauauacuuucugcuguucaauuuuuuucuaccaaacuuacggaaaagcaguauuaauaaugaagauauaaagaacacugaaauuuuugaaagaucuuuucauuccuuguuuaaauguucauuuuuguuacagccuuggcaguucauuacuuaugcagagugugggaaaagcucuaagaacuggccgagagagcgccugacagaaacauuguccaggaggaaucagccacuaauggccacugccuuuggcucucggugaaguuucguuucccuacaguacucuuggguggcuguuucagggauacauuuuguucuaguguguuugccucaaggccaaauauaaauguugaagggcuguacauuuuucuggaauguucuucaccagcuguaaagucuugggcugggauagggauaggggauuuuuuugggggugggggggcuuuuuucucuuuaucuuauuuacuugaaugggaaggaaaacuuagauucuuccuuaaaacaauguuauuuauuuugaucugugauguuuaaacauuuuccacggcauuuugaaaccuguaaacauaggaguacuuuguuguugcuguuguuggagacaaagucuugcucuuaucccccaggcuggagugcgauggcgcgaucucggcucacugcaaccuccgccucccagguucaagcgauucuccugccucagccucccgaguagcuggcgccugccaccaugcccagcuaauuuuuguauuuuuaguagagacggguuucaccauguuggccagacuggucucgaacuccugaccucaagugauccacccuccuuggccucccaaaauucugggauuacaggcgugagccaccgcgccuggccaggaguguuuuuauagugauuacaauaguuuuaaaaauuaaaauagucuuuguauuuuuaccaccuuagaaucccugauuuuuuuuuuuaaauuucugcuaauacacauaguauaugugguuuuuugaauggcuuaugaagacuauauaccaucauaaaggcauaaguuaguauaaaaucaucauaacaaaauacaaaaguauuuuuaagauaucuuuuuauuacugaaauaauagauguuuuagaucauauggaaacuaaagaugaauacaaagaagaaaauuaaaaucacuagauacuaugugaccccggaaacauacaguuaauauuuuaguguuucucggccaggugcgguggcucacgccucuaaugccagcacuuugggaggccgaggcgggcagaucaugaggucaggaguuugagacgagccuggccaacauagugaaacuuugucucuacuaaaaaugcaaaaauuggcugggugugguggugggcuucucuagucccagcuacuugggaggcugaggcaggagaaucacuugaacccaggagguggagguugcagugagcugagaccgcaccauugcgcuccagccugggugacagagugagacucagucucaaaaaaaauaaaauaaaaaaauaaaaaauaaaaaaauaaaaaaauauguguguauauauauuuauuuauuuauuuuaguguuucucuuuuaagccuuuuuuuucugugcauguuucuucaucucacacauacauauuaagggccaauccuccaaucuuaaacugaagauguagaguuuugacagucucuauaaugacaugaugauguucagcacucuugcagcuuaugcauguugcauggcaaaacauaaaaucuaaugacuggucuauaguuaaagcuguagcaugaacacuaucuguugcccugagcuguuuuaggggugggauguuaaagaaaaauggaaaggaagaaagaauucaaaaauuuguuuauuauagcuguuucucuuuuaugaauaaugucuuuuuacaauggaaaaauaccagaaauuaaauucucauuagauaaugugcuuucuguuuuguucugaagggaauucccaucacaguugcauuaauuccccugagagacaucuccauaugcuucggacaacaucugauuuuacuuuuguguucugauuucagagucuuugaaauaccuaucccauaaugugucgcaguggaauggaugugguuauuauaaucuugguuuuaaguguaauaaauuuuacugggcuggguuugguuguaacugaugaaagcauauacuagagcucagcuuucuuggggucuuuguauuagcuggauucuuuacaauucuaucuugggauuuaggaucuguuucaagaagaaaaagcguuauuucuauuugauuaugcaagccaguucuuuaagccuuuaggacaucagauggauggaggugacuugcuggccuuuguugccuuuaacucuaguauucggcuucuuucugaggaaggugccaaaacggcuuccguaucugcugaaggaaaagagggagugggaagaggggagaaauauuucauuggaagauaaaaaaagcucuuuccagcaauuuccuuuagaaacuuggggguugcuguuagucucauuuggguaaugggccccaaggaaaagugacaaauggccuucuucugggguuuaaacacuaaaggucaguguuggcccuuuucacaguuaagagggaaaaaucugagcugggcuggguggacuuucuccaacuaagggauucuucugaaacuccuaaccugaugggaaucauuuuguuugcagguggccaaagcccaucaagggaaaugcuugaugguuacugugccugagcugccugaagccugguguaggagucucaacuugaucuugaggcagcugcaaauguuaggucuugacacuugggauggcaacaagaccaggcagugcccagaguggucccagcggccuagguuagaggaggguagggggcuggaauguggccuuagccaguccucugagcagaugagaauaccugucacuauuucaggagaugaguuguggucagagauaucagucaggugacuucucugagaggggccugguccuucucacagcaagauugacaagucugugcugccaguugucccuaaauacccaauuuaucuccugggguggaguuggggaagugccucuagccuggagcaaagagaucugccugccauuucggaaggaaagaaaccagcacacauccugucuuucauucucuguuucaaagguagguuuuugucuguuugcuuguuuuuaaaucaacacccagggcuaaaggaaaucccgaguuucccugauaaucaggaugauuucuuauuuugaaaggccuauuuugccuucgaaguguguguuucugacauagguuucauccuaguucuagaaaucuugcuuaauucauaaaagguaaaaguuuaauuagagagaaggcugauguaucgucuuguuucaaagggagacuauucuugucugucauuugaauuuuuuauauauauuuuuuccggcugugaagaaauauuuuauugguacauguguacaugcauuuuuuauucuuaauuauaguauguauuuucacuggacuacacucuuguuaaaggaaacuuuguucacgugaaauaaaccuaucuuuagugagucauacuugagaacugcuucucagucuccucaacuuuuaaagucagugguauuucauguaaagaguguaucgguagcuggccuaucucuggaauguugugcagcugugcagagcgugagucucaaaugugcuaauuaaauauguuuuuuagcaagaauggaauguagcagcauuugaauggcuucaaaaaacauuccauuuuguuucugaagagggcuuuuuucguuuuugccaaauauuaaaaauuagagaguacacugacuuuuagaggauguauugcuauguuaaauuguucuguucaccagaacaggguggcaugugccuguaauccuagcuacuugagaggcugacgugggaggaucucuugagcccagggcuucaagacuagccugggcagaguagaaagaaccugucucaaaccccacacuguucuuuucgcagaguuaauggggcucauuaaauacugagauuauccuuuagaacaaucuuguccaaccuacagccuuugaauguggcccagcacaaauuuguaaacuuucuuaaaacauuaugagauauuuuuugugauauuuauagcucauuagcuaucauuaguguuuuacuuuauguauagcccaagacacuucuucuuccaguguggcccagggaagccaaaagauuagacaccccugcuuuagaauguacucaauuaauaaucuucaaaauguagggauuaggugggguggcucaugccuguaaucccagcacuuuuggaggccaaggugggaaaauugcuugagccuaggaguuugagaccagcuugggcgacauggugagaccuggucucuacgaaaacaaacaaaaagaacagaauguaggcagugguggcaugaguaagguucuaagguuuaccaucuuuaguugaucuugcucauuucccuugguaucaguucuccuuccuuacuuggugagugcuuaaccuuucuuugggcaguaaggcaugacauuucuccccagguugagcaguuuucugauacauauuuuuuggcugagugugacuuguaucuuuuuggacuaagcuccauucacucagaugguggucugauuuuuuuuuuuuuuucagucaggcauugugcaaagugaccugaugggaauaaauggcagguugguuguguaaugcagcaacaucuuacuugguugucuuuagagauaagugggacgugauuccagcaaggcugugcaucaaauguuggaauguguuggagaacugccaagagguugggagcaagcugugugacaagcacuaaugcagccuuggccugccuuaaaauagcugcagguuaacaaauaucuugaaacuuggcauuucuuuugagcaaaauugcuccucugaauguguuaccaagaggugcuuuccucuuuuuuaucgauuuuuuuuuuuuuuuuuuugcuguuccaacugucuuaaaacaucuuaugagcauaugaagaagauauaauucucuguaacaucuuauguugaaugauuuuacuggacuaauuauuagcacauuaucugaaacuucacuuguaguucuucugcucugcucacccaacucacugaaaaauauauagucuuuguaguuugaauaaaaacuggggcccugaagauguuuuuuuuuuuuuuuuuuuuuuugagacugagucucgcucugucgcccaggccagagugcaguggcgcgaucuuggcucacugcaagcuccgccuccuggguucacaccauucuccugccucagccuccugaguagcugggacuacaggcacccaccaccacgcccagcuaauuuuuuguauuuuuaguagagacaggguuucaccauguuagccaggauggucucgaucucuugaccucauaauccgcccgccuggaccuaccaaagugcugggauuacaggcaugagccacugcgcccagccugaagauuuuuuuuaaaaguccuauauuuuauauguuugauaggcuuuuggaaaggaauuauugauguuugaacacuaacacauuagagaggcagagucagaggcauugguuacuuugcuguggaaucuugucuuagcugauucacuuuuagacuucuuaguaagcucauugguaguuugucugcaguacuuaguucuuguuuguaauuaauucacugucuaacuguagucucucaauuuuuuucaauagaaaggcuuguuuuuuaagucagagugguaaaaacaggggggguugggaguggucuuugaaauggguccuguacagacuugagccugauggugaugugaucaagguugcaggggguguggguaccuggguggggcuggggcugccugugggacuaaucuaaacagccaguuaguuugggugcucugaauaugacauuuuuaaaaaugcaguauuuggguuaaugauuggaaguaaacuaagaauuuccaggauuuauauguuaaauagcagaugaaaacagugaguuacauguuaaauaguagauggaaacagugaguuaacuuuauuuugagaggcuuaaauacaaaccaaguuucuauacuaaaggauuuccuaaaagaugauauuaacagauauguuaauuaucccauaacuuaaaguccuuuagacguuuagauugagacuaauugugauaauuucauagcucuguagcguauccugaaaauggcuuuguuucuuuuguuucacugucuucauauguguaagucuugaauuuugcuuugucacuuuccguauuuuacauguauuuuagagguccucuccuuguauagaaacauuauuucugguuuuauguaagugccuuauacagagauuuauaauuuguaauuacuguacuuuuuggucaauagaauugagguuauuugggguauguuuuuagaauauguuaaaaaccauauuuuguguuuuuauaacauagaaaaauauuucuuggaaaaugcgugugugggcagcuucuuuuagauguauugaucuuuucacuuucagauggcaaaugaauucuauauggcauuguugccauguuggaaaauuucuuuauugagccuaugacuucuaaaguaucaaaauucuguuuuugcuuuucccuuuuauuggacaucuccaguuuuguuuuuuuuuuaagcacacacgcacacacauacacacacauccuuggauaacugaacugguaaauuguauugaggagaggugaacuacaggccaccauuuccuuuuuacuuagcauaccauuaucugguccccucaugugaaaauauauuuuggauaguuuucaccucccaccaucuauuaauuuagagugugcauuccuuuaaccuugcaggagaauucagucauucauuauacgauaagcaggcaaaaaguuaaauacucaaauguuccuuuucuggauuauugucugaauuagaaaaacauucauuuuaaauuuuacacauguauaugggauguucugucuccucgucuguaugccuuguacuggcacaagcuuauaggacuaggaacaaauaagcuuagcauuuaaaauauuccagacauaaaaaaucuauggaauuugcuuauaucuacugggggaugcagucagacagacccaggguuuuaacuggcuccuucugcagugugaaggcagacggaaacauuggagucugcugcagauggcagcaggguggacaggugaggcccacauggaaguucauaccacugguagguggaguaaugaguugguguaugaaaugcuagccauuuuagauguuucuacagcuguuguuggcuagcugaaaauaaauugaacuuguugaacugguaaaaguuuugcugucugaauaggcuuagauaaaauagugcuucagaugccuauaaagaugucuauuguaacauuacuaugauuuuuuuaaguggugauaaccuaaaaguccaucauugguaaguuacaggguggacuauauauucuggaggcaauacaguguguaguuaaaagugcugaccguggagcuguggugccugggucuaaaaccugauuucaccaugggcccacuuugugacccugagcaagucauuaacccuucucggucucaguuuccucaucaguaagaucaggauaaucauaguacagaccauauaggguugguuggauuaaauaaguuauagguaaagcaguuagacuagugccuggaaauauguaaguauuauuuacuauauuaauaaaaacuuuaauauuauuauggaauaccuucuaauaacaugggaagguuuuuaacauagggagaaaaagcagaacacaagauuauauaaauggaauuaccguaacuauguagaaaaauauacaaaagggauaaggaaauacuacaaauauuaagguuuuugggggaggggagaauggaugagauuccuugugauuuuugcuuuugucucagagcuguuuuguauuuucugcuguucuacaguaagcauauguuacuucuauaauuugaaaaaguaaacuuuguuuucaaaaguggauguaggcugggcgcaguggcucaugccuguaaucccagcacuuugggaggcugaggcggguagauugccuucaggucaggaguucgagaccaaccuggccacauggugaaaauacaaaaacacaaaaaauuauaaaaauacaaaauauaaaauuauaaaaauacaaaaaauuagccgggcgugguggcacaugccuauaaucccagcuacucaggaggccgagucaggagaaucacuugagcccgggaggcagagguugcagugagcugagaucgcgccacugcacuccagccugggugacaagagcgaaacuccgucucaaaaaagaaaaagaaaaguggauguaucccuugcaaacgguuaguuugucaauuauaagaacagcuuauucuuuaaaagcuuagggccuuccguuuggcaacaguuugucuccuuuugguuccauaauacuuccacauucuuacagaagcuaaugggaaaugcuggauuaaaccacauuaucuaugcuguuaucuauguuuagaaacuuuuaaugaugacagauaugcagucccuucucucuguggucacaugggagaaucacucuugccugcuccccuugcauuuugguggcauguuggacuaguucugaggaauggccuguguccagacugcagccagaguccuugagugagaaugguagagccuccugcuaccaugugacaggcacguaacaugagugggaaacaugcuucugugaguuugagccacagaacggcauucuuacagagugccuuggaguaaugaaacucaaaacuauuuuuuaaauucaucauuuaguauuuuccacuaauucagacucauuguuuagugaaaagaauacagccaucgguaaggcacaugacuguuauuaacaguaugaauuuagacaaauuauguaauagaguuuuaguuuucuugugucaaaggccucaccuccacaaacuacaaacaaaacuuuugaugcuucaaauuaguccauaccagaguguuuaguuuuaauucacugcucuuuagugcuugaaaugagauucuuuagaccaaaguggccuuaaagguucauucuuguuguaugcuuauuccacauuucucuauauauuuauuuugucacuucuggucacuauauauagguuuauuuaagaaaaauucccuuccauaguuuaucaggcagguuaggcuggugcugcaguaacaaagaucuccagaaucucgguggcucaaacucacagaugcguauuuuccacucauguuacuuguccgucacaugguggcagggugcucugugccauccucacucaaggacgguggacugaugggcuagaugcaggccauugaucagaauaaucaaaugccccgcccaaaugcuaggguagcagguaagaguaauccucccauguagccacaaaaagaagagacuggguaugugugaucauuaaaaguuucuaacuaaacauagauaacagaguagguaauauggucgaauccagcauuucccaucagcuucuuugaagcaccaguuuugcaguauguucacauguacuguugauaaagggcaucuccuggucaaguaaaucuggagaaugcugggcuuaauaacauguacuaggccucuuuagugaaggucgucuccgagcuguuguauccuaacaggcauucuggagguggagaguaacauacgauguuucccaaacuuaccugaccuuugaauuauuuucuuacuuuucauagccucucucggaugcagguuuuguugaacaugcuuugggauacccuaauuugucuaacuuguucucauacaaagcaaguauuuggaauugcauuuuaauuaauacuugcauugggaagaagcuuuguuuuuauuguuuguuaaaagaguugacuauuugaagagagauuuuuucuauugcaaaucaaauugcaggcaguguuuuuaaaaauuaguuauuacugguuacaugccuguguugaauccauaggacuuuuucuucauuuaguugccuuuguguucuaaacuuaccauugaaaagagaaagguaaauaaacuuugaccacauaucuuagugguuauaaaaaaauuaaauugguuuggacagaugguccaaacacaccgaguuuuuuuuuuauuggcuucaguguuuuucuugguucucuuugacuuucuguaacaaguuuucuagaaguuuugaaaugagauacuacugaaaugagggcucugauaagaaacagagagauaacuuuugucaagagguauuaaauauuucucuaccagaagacuuuggauuuaaacacaacauuuguugccagggauuuuaugccugcguauguaacaaaucuuaguauggaaguuuucacuuaaaauggcuguaaacuucauguaauaaacuuuagguaagaaggagcagccuccccaacccccguuuuguaacuguacauggguaaaacuugauaaagacuaaacucucuaacuccccagacuuucggauuuguggcauuaccuuuuuuuuuuuuuuuaauuaauuaauucacuuucuauuagaaaucauguuaaauccaggccaagaauucuuuuuucauuuucuguuuuguuugcuuuuuuccuuugugaguaaacaggugcgaaggacaauugcuguuuuaugacaggaaacacacuuuuaaagcugucaguuaccucacagccccacccuacccuuuuccugcugccauuacgauuaagacugacugguaggcugggcgcgguggcucaugccuguaaucccagcacuuugggaggcugaggugggcggagcacgaggucaggaguucgagaccagccuggcuaauauggugaaaccccgucucuacuaaaaaugcaaaaauuagcuggcaugguggcgggugcccguuaucccagcuacucaggaggcugaggcaggagaauugcuugaaccugggaggcggagguugcagugagccaagaucaugccgcugcauuccagccugggugacagaguaagaguccaucucaaaaaaaaaaagacugguaguagacuuugcuuuuuaaaggugacuugggaggauuugaggcagagaaaaccuucuucagagccacaguucccagucuuauccuuuuuguugauaccaguauuguggaaaaagcauucaugacccaucacaaaaacauacauuaagaaaacauuuuucacauggucugaggcugacaggaaucaggcuuaauguauccagggauaugacaaacaugggaaccugcaccaguugccacagagcuguccgauccuggucccagggcccuugucuguggcaggucuuccccggggaagagauuucacucucuuaugagaacgcucguguuucaugcccucagaugcuugugucagguuccagugaugguagccuuggaguaagucugccuuugagagaggauuguuuuuuuuccucacucuucaaggaccuguaguggguccccugaugggccacccucuggaccuggucaaauguuggggaguuucguggaagagcaguguuuucacauuacagggugcagcucacagucagaaagauuguagaggaucauagaauuggaaguuuugggucugggccgaacccuguagaucuuaguacauccacaugauuguaucaaagaagaguccagagcuccgagaggcuaggugcaaucacacagcuucacacaagaguaagggcugaaacuauugcuguuaacagauauguggaaguacuugguguccuugcaacuauuuccagugugcugaaccuugaaaggcaucuuacuucugcuaauuggaaccacuugggaugcauuuuaaaauuauauaaaugaaguaagccuacaaguuuaugcucauguuuacuguuuucauguugucaaacuguuaauagcaugaaugguuaaacauuugcugggaaaauagaaaguguucugaaaauacacaauaccagagauaaaaaaagauguauguacguauaugugaguguguguguauauauauguguauauauauauauguuuuauuacuagggaaaggaggaaagcccauuguguauggaacuaaaagccagaaccuacugcauguccaccuuuguuuuaauaaaaauaacaaacaacugaguguccuggcugccuggccaggcugaaggaaaguaaagguuguuuuaaaauagaaaaagaucugguuaaauauuugaccagauacuuugauuaaguugaaauguuuaaacauuuucaggcccagggaugucagugaaggcugacugcagagucuucucugccugcagaugacuuguguuguguauagcaaugauuuaaaggcaaauaaaguauaguuauagaaaacaugacccuuaccaaccgccucccccccaaguugguuuguaaccauguaagaaaucuaagguaugauugguaaaauuaaauaaauaaaucccauuguuccaguccucuucuguggaagguaggacuugggagggaguauuuuacagugguuagguucuguuucuuggagccacacugccugguuggaacccugccucugcugguuacugacuguggucuuugguaggugaacacauaauuuauuauccaaacuagguaauuuaugagaaugaaaggagacacuuuuaauaguuguaccaguacagcaggcauaaacuaggaaggucugaggcaaaccagauaacauggucacucuagucuuaacgaaguuaccuaaucuuggugucuugguuucuucacauuguggaagggacaugacucacuuccuaggguguuaagauuaaaugcaauaaaacauguaaaguuuugcaauguuguuuggcacauagcuauucaauaguuguagcuauuuaaaaaauuauuuaggguacuuaauucauguaauaaccauuuaaguauucaguucgcuuucuauuaucuuuauauuauuucucccaagcaaauuuugcuuuuuuuuuuuccaagaggcaaggucucacuguguugcccaggcuggccucuaacuccugcgcucaagugaucuuccugcuucagccuuccaagcaaacuuugcuuuuaauaacauuaauauuuacuaauggcuuauuccauuuauggcaccugcucaaacuuaauugcuugcuuuaucugagcccuuuccucagauaaaggcucagaaaguaaaauugacuuuuacuuuuucagcuacguguauauguggcacuuaauuauauaauuagcaccuguggcccagagaugggugcuggguauugggacacucauuuaucagguuguguguaauuagcaucuacacuggaaagcaccuuuugaacagcuggcgcugagauacagaaugguugggagguugaguggguggggaguggcaaagcccaaccucuucugccucuuuuaaaaguuggauuuuucccagaguagugauaugcaggguugccagauuuaggaaaaacaaaaucaaacaaaaaagaagccagaaugccugguuaaauuuuaauuucagaugaacaacacaucguuuuuuaguguaaguuugucuuaugcaguauuugagacauacuuauccuaaaaauucauuguuuaucugaaauucagcuuuaacuugauguccaguauuuaucuagcaauccuaguuuuguaauccgaaagaauuuuuauucuauucaguauaacccacauucagauguauaugaaacauguaguccagauccuuuuauaaguauuguguuaauuuuuuaaaaaauccauguugucuacccuccauuggaauggaugguugagaagucaucacugaguugcugcugcugguucccacaaaggccaagaugaaaaagaauucagucugguuugccacagcagcagggauuuacauuugcucuuugagaacuuauuggcugugaauguggaugaacuuaagccagcucuucuuccuugcaggggaguccauuaguuaaggugacuuauugaagcccuggccagcucuaggaguucucgguuuuauaauugaauuacuuuaguaauauuaaauaauuuggggaggggguuaauuuugggucauuuauauuucacuugucaauguagagggagcuacuuuuauugucauuaagagugacauucauccuggugccauggugagcaccuguggucuuagcuacuugggaagcugaggugggaggaucacuugagcccaggaguuugaggccagccuggcaacaaacaaaauccacaucucuaaguaauaaugaugaugaugauaauaaaauccuagaaaugaagaacagguuuggaaaaaaaaaaaaguaaccuucagauacucuucccauuagaaucucucuugcuguuuuugauuuucagcagugcugcccagaaagugcuggugagcuuuuugccccagcuuuggaacucuaucagcagucaacccugaagggcauggcaugccuuugggaaaugcugauuggaagauuagaggcugcagaaaccugaguguguguguguguguguguguguguguguguguguguguguguguguguuuuguuuuguuuguuuguuuguuuguuuuccaaacucuggauaugaugccucuguuaaaccaagucccugaggaaaagcuucaccagauuaaugauacacuuggugaaauuaguaauggcaaguaaagguugagauuugugccugcuggacaagagugagccagagcaaauggauuuuggaccaauaccggcuuuuuaauugcugccauuuaaagaguuuaauguccccagugaaaaagcacagguuucagauaaucuuuugaagaaaaaugcauagugguaagagcuuacuguuaggcgcagagaguguguggauggguuagccaagggaaggaauccaauuaaagcuguuuguucggaguacuagauuuggagguguguuuuauuguuaacugguaacuuuccagaaaaugaauuauuuguauauaaagauugauacuagccaggcuuuauauacugacaguuauuuguaaaaccucuuugcuuccuccuuuuaccuucuuuucugagcugucucuuuuccuccgcauggcuuccuuuauaaagcagcccauuuuuuggacaugguuuugcuauugaugagccugagguguggcauaguaccacaggauugcaugaugagugggauauuuggccucauuauuuacauggcuuaguuuuugguguuugaagugccuggucggauagggauugacuauuaaugguagacauuuucacauuuuggagcacugauccucaaucuuggcagcgcauuggcauccccugaggagacuuaaaaaaaugcaggugucagccgggcaugguggcucaugccugaaauuccauugcuuugggaggcugaggagggaggaucacuugaguccagaaguucaagaccagcuugggcaacauagcaagaccucaucucuacagcaggaaaaaaaaaaaaagaaaaaauuagaaacaauuagagaaaaaaugcagaugucugggucccacuuccagagaaucugauugaauugucugggauacagaaugggcaccaggacuugcaagagguccucaggugauuguaacauaagccaaguaugcaugcuauccucuggccuccccucaaaauuaugucucuggccugugcuguccaguagggagccaugagcaccaggaaguuacuuauguuuaugugaauuaaaaugaaguaaacugaaacuucauuuccucagucacacuagccacauuucgaaugcucaguagccacacauggcucauggcugcccuguuggauaguauagauauagaacauuuccaucacagcagacaguuucauugggcagccuagaucuagggugucaacaaaacaugggaggagcaugaacauuuaagaagccugacacaggaaggacaggcuuggaauaaguaaucccacaggacuuggcaguacugagucacuccauacuuuuuuaagcagccuuuuucucaauggucuuuuggcaccagaagccccacagcaguuggugcaauggauuaugugucacaucuuacagaaaggccccguuuaaagcaggcuggcccgaagggguguggugaggacugggggcaggcaaaugugacccugaggaggccgggccagggaagagagaaugcagcuuuauucuuucagagccgaggaaugcccuggaagggaaccgaagccugaguauugggguuaaacuaggugagaggagauuuuuaucucuucugcuggagaaagaccugccucaauaguuugccucugcuggcucaucucuagugugugggaaacaaggacagugcuagcacauauuucccgugaaauaaacucccauuaugggcccccauguucuuggagcacugggcaccacgggguuaagaauggaaucaauuauguuccauguuuguucagacauagcacauaagauccaaggaagguagggucacggaaaagcgagggguuagaggaaacaugaaguguauaccaaaggaugcggauuuucuacccguugcuucccucagcaggaccuuuuuggagauuguuccuccugcaggcgugagaaacccucacguggagaggcugucuggaagcccgcagucuggucuguaccauccaggcucuuugcugugccuuccugucuccugcauuucgcuggacauuagcaccuccccaggagcagauuucuguugcuuucugugagcccacuauaaagaaaaugccaaguguuccugggcacaggaaguggguaggaagagcucugagaaugcauggaucaaaggcacuugggugauuuaggggugugacccccaguggcuucacagggccugugagucauuucaaagaguuucuccuguuuugucauugucugcuguuaaaccagggugaaguuuaagugccuguugcagaccuuauugccuucuugcuuuguuccgcuggucagguuaguguucuugacgggguuguauccaaauaucuguauuggggcugggcaugguagcucaugccuguaauucuagcacuuuggggggcugaggcagucagaucaccugagcccagggguucgagaccagccugggaaacauggugaaacucugucucugcaaaaaauacaaaaauuggcugggcauggugguaugugccugugccuugggaggcugagguuggaggauuacuugagcucaggaggcagagguugcagugagcugugauugcaccacugcacuccauccugggggacagagugagacccugucucaacaacaaaacaaaaccaaauaugucuguuggcaagugauaacugcacgguauuaacugccuuucucugagaaauaaauuaucggggcccuccuaggacuuuuauaugcuugggaauuguguuuauuuuccucucauucacuucaguccugcucuugacugccagaagaggccugcucuccuuccuuucccauugucaguaaauuuuagacuuuuuguuaguacucaucugcuauuuuuaauuacauuucacacuuuuauuuugccauuuucuauauucucuuuccucaagcucagagagcaagguaggaaauguuaacuucuccuaagaacaggaauaugggaagcuggaaagccgaaaaagaaugcuaagaggaauaauaggaaagccagcguugaugacaagugucuucuguaguugccauccugguaacucuucagggugccacuauuccucuaugcuuauggauguuugaggccuuuuauaggauagaauuucaaaggacaaguagagaaguguuaacuccugggaguaguucguugguuuucccuucauccuuuugccuguacccggcguggggugguugugucggagacaagcucccagaaaggcgcaauguggcucauuccaggccucaagcaccagaauacguuuagcuucaaaaaugacaaguuugauaagaguguucagaccaagaaaauuaaugcaaaacuuccugauauaguaugucagcgcuauaaagaaguucuugagugucguguaaaauacaaaaaauacaaaccauuaucaaaccuaaaaaauguguuaaauguuuaugaaagacagugaaggauucuuaucacacaguguguagaccaugcgccuaugaacuugaaguuugcacagaauguggaaagaaagaagacauuguuauuccguucaguaaggaaccagaaaaaauaaaauauugaaaacaaucgccucucccucucccucucccucucccuccgucucccucuccgucucccucucggucucccucucccucucuuuccauggucucccucugaugccaagccgaagcuggacuguacugcucccaucucggcucacugcaaccucccugccugauucuccugccucagccugccgagugccugcaauugcaggcacgcgccgccacgccugacugguuuucguauuuuuuugguggagacaggguuucacuguguuggccgggcuggucuccagcuccuaaccgugagugaucugccagccucggccucccaaggugccgggauugcagacggagucucguucacucagugcucaauggugcccaggcuggagugcaguggcgugaucucggcuggcuacaaccuccaccucccagccgccugccuuggccucccaaagugccgagauugcagccucugcccggccgccaccccaucugggaagcgaggagcgucucugccuggucgcccaucgucugggaugugaggagccccucugccuggcugcccagucuggaaagugaggagcgucucugcccggccgccaucccaucuaggaagugaggagcgccucuucccggccgccaucacaucuaggaagugaggagcgucucugcccggccgcccgucgucugagauguggggagcgccucugccccgccgcccugucugggaugugaggagcgccucugcccggccgcgacccgucugggaggugaggagcgucucugcccggccgccccgucugagaagugaggagacccucugccuggcaaccaccccgucugagaagugaggagccucuccgcccggcagccgccccgucccggaggugaggggcgccucugcccggccgccccuacugggaagugaggagccccucugcccggccagccacccuguccgggagggaggugggggggucagccccacgcccggccagccgccccgucugggaggugaggggcgccucugcccggccgccccugcugggaagugaggagccccucugcccggccaccacccugucugggagguguacccaacagcucauugagaacgggccaggaugacaauggcgguuuuguggaauagaaaggggggaaagguggggaaaagacugagaaaucggaugguugccgugucuguguagaaagaaguagacaugggagacuuuucauuuuguucuguacuaagaaaaauucuucugccuugggauccuguugaucugugaccuuacccccaacccugugcucucugaaccaugugcuguguccacucaggggucaauggauuaagggcggugcaagaugugcuuuguuaaacagaugcuugaaggcagcaugcucguuaagagucaucaccacucccuaaucucaaguacccagggacacaaauacuguggaaggcagcaggguccucugccuaggaaaaccagagaccuuuuuucacuuguuuaucugcugaccuucccuccacuauuguccuaugacccugccaaaucccccucugcgagaaacacccaagaaugaucaauuaaaaaaaaauaauaaauuaaaaaaaaaaaaagaaaaucuaaguucuaaccauagaagaagcugcagaagaaaugaagaaagggaugauaauuuagauuuugauguugauuuagaagacacaggaggaggccaggugugguggcaagagccuugccggggucuucugaugcuuguauugaaaaaacugcuuuugcuuuguaacaagcaaacauaaguguugguacuuuugcucugagucauuuacgugagaucauuuaucaaacggcgcugaggaccaguuuuugaggcuagcaauauaauaaugucaucuuauuuuuauaugagcuaguucuuacauaaccaucaauucugaaucugguuuacuuugguauuagguaauauacacaguuuauauuguucauguauaaaauuuguuuuucuauagcuuuuucugauuuccucauuaggauuucuuuuuuuuuuuuuuuuuuuugcugcuuuuuaacuuuuucaaaaaucagcacaauuuuucccuuugaaauuaaauagauuacuugguuuccaacauuuaauuuugucuauuaucagaaaaaguuuucacguaaugaaauuaagcaauauaauauuaauggaaaacauuauucucaggacuaauuacugcgcaccuuugauguguacuuguuugcauuuacuauaugcaugacauacuacuacuguacaaugaaucgcagugcagaguaaugaugauucaauaaauguagaucuauuuugcauauuugcacaacuuaagaaauaccaacaucauuuucucugagaagccuucccugauuuucagccuagguacaauuccucagacauguguucacaaagcugcauacuuuuccuucacaauauuaucuaaugucacauuucuucauuaauaauuauuaaugucagucuacccacuaaacuagaguaccauugcuuuucuaguguuacaauaaaugaauaaaugaaucagugaagucauguaucauuaggaugucgcaguaucuuuuaugaaauacucaaagucaaaaguuggucagaauuucacauucuuaaauuggcuuuuaauauagugauauuaauucacuugauggucuccuccugugucuuuuuuuuuuuuuuugagacggagucuugcucugucacccaggcuggagugcaguggcacgaucucagcucacugcaagcuccgccucccagguucacgccauucuccugccucagccucccaaguagcugggacuauaggcgccugccaccacacccggcuaauuuuuuguauuuuugguagagacgggguuucacuguguuggccaggauggucuugaucucuugaccucaugauccgcccaccucagccucccaaagugcugggauuacaggcgugagucacugcgcccggcccaucauauccuuuaugaauaagaauuucuagucacuagguccaggagucuguauuuugaaauuccuaggugauuuuggugaccauccaaguuugagacccacuggccuuaccgucaugccucaauuuucaaaugaggaaacugaggacuagggcgggaaagugauuuccuugcaauuaaaggcagccagugguaagacgagaccaaggaccuuucggaggucccuugcaccccugagagucagugacucucuguuuucaccuuggacugccgugaugucugacucauacuguagucuucuuccuaaaauccucuucuuuuuauuuuuuauuuuuggcaguguguugaauucuccucuaguuucauucagugagugcuauuucuugcuucauuauaaaagguggugugucacagguccugugugaucacacaggcuaaguguaagcuuugagaaugaucucuuggacccuuuuucucagauuucaguguugugcauuauuaucucaucgugguggcuucuuugugauuuaguuuccccuccucccuucaccauaaaaaaagucuuaucuccugauguauuuuuggcugcagaauaacuccagaugguacauuuuguguagggaaaaaaaauaacagaauuuuucacacucuucugugaauuauuuuuugacuuucaauuauaaugaaguuauuaaucuuacaaaggcucgcuuuguaaagagacuaaucugaauaaacuugcuuguauacaauaagugccauggcaaaaauuaagaguacaguuauuaucagagacuaaaauaacaauuuaauuuucuagaaauagaaaauuaagaaaaauaacuuuuaaugcugggauuugacauuaagaaaugaaugacaaaaaugggaccaaauaaaaugcuguaauuggccagacaugguagcucaugccuguaaucccagcacuuggggaggcugagguggaaggaucacuugagcucaggaguucaagacuagccuaggcaaaaccuggucuguauuuaaaaaaaaaaaaaaaaaaaaaaaaccaggcaugguggugugugccuacagucccaccuacucaggagguagaggcaggaggaucacuugagcccaggaaguugaggcuauagugagccaugaucaugccacugugcuccaaccugggcaacagagugagacccugucucaaaaaaaaaaaaaauaguaaaugguauaacugaaaguaccuugaaaaaauauggcaauaugcaguugcaaguugcugauuuuuagaaucauaauucuaagccggaugugguggcucacaccuguaaucccagcacuuugggaggcugaaguggguggaucacuuaaggccaggaguuugagaccagccuggccaacauggugaaaccccgucuuacuaaaaauacaaaaauuagccaggcgugguggugugcaucuguaaucucuguucuuggaaggcugaggcaugagaaucacuugaaccugggagguggagguugcagugagcugagaucgugccacugcacuccagccaggcugacagagagagggcacccugucucaaaaaaaacccaaaaaucacaauucugauuugagagcugaugacaguugcagaugauuaagagcuuuuacaaagagcgugcauacauuuagcaaucucuaauugggaauguuuuggaaaacacuccugagaauguagguuauuuauagaagauguccuuuacuuugauauaaucuuccuaaugugguuuuuaucaguuggauuuuucuggaucaacgagaagaccuaugagccuaaaauguuuguaauucuagcuguguuucuauaagaacaugagagaaccucggcauuaaccauucuugcuggucucacagaacaccccaaaaaucugugcaguuuugcuggagugaugacagagaauggaaaacaaguuuaugaauuuuuuuuuuuuuuuuugugaggcggaguugcacuugucacccaggcuggagugcaaucucagcucacugcaaccuccgccucccagguucaagcgauucucuucuuucagccuccugaguagcugggauuacagcugcgugccaccaugcccugcuaacuuuuguauuuuuaguagagacaggguuucaccauguuggccaggcuggucuugaacuccugaccucaggugauccgcucgcuucgaccucccaaagugcuaggaguacaggcaagagccacagugccuggccuguuuaugaagauuuuauaaacagauuucuaaauucagaaaguauuuaagggauccccucugguggcacuuuaauucagaugggguccacaaaauaggaaaauauuuacuaggaaauuugaacaaucuugaaaucacugaaaauggugaugugauucuccagaaauuucugauugggaauaagcacuuugaaguaauuggcuaucuuauuaaucugcuguuccugaauuuccccuuaguagcggacaugcuuuauuguauuaaguuggauaaccaccuuaguagcaaagaugggcuugggcuucagucuggucaauaggcaucuuauucagguagaugccagaugggagggauggggacagcuuagugaagaaggaugaggcuggaggugacucuugaaaaaugauuaguguuaguuggaaagauuaaggugugggagagucccacgcaggggaacagcaggcagaaagccagggagagagaaaacaguguguuuugaggaccucuucugcuguggcuggaauaaagagggcuguguugaagagugaagggagcugaggccaggcaaaaacucuugcaugccuugagaggagguuuuacccaaaagacaagugaggaggguggugaaacauuuuagucaagcuuguguguucuucaaagcucguuugagcucuggcauggaagaggauggauuucaguugggcaaaauucagagcagggaaaccagucaggaaguuguggcaauaauuugguuaagaaacucuaagggaccuuacuaaggucaagguuagacuuuguaaauuuugggguccagaaaaacuguuaauaaacuuaaccgacaggaagauuccccuggcaucauagccugucacugugaggauuuaccuucuuuuucacauaguaauagauugugaaaagucuccaaaaccauacucaaggauugaaggucacauuuucucuuucgaccauucuacacuuagguagaaaaaaauuucauuaccaacuagauaauaggauuugagcuguugugguugacauucuugaugaaggacugaucagaaauucuuggucaucuuauguaagaauaacuucuuggaguaaauauguuccugaagagcugccauuuaaaguaaacuuuugaauaucauaucuuaaaugcuuuguaaucauaaacauuuaaauucugugguucaaguaaucauuuuuaaguaauuuacuucuaauuucucucucuuuuuuuuuuggagacaaggcugucacccaggcuggagugcaguggugcaaacacacuucacugcagucucaaccuccuuggcucaagcaguccuucugccucagccucuugguguggcugggaccacagaugcaugcugccauaccuagcuaacuuuucuuuucuuuuuauuuuuugguagagacgaggucucgccguguugcccaggcuggucuugaacuucuaggcucaggcaguccuccaccuugccucccaaagugcugggauuacagucaugagccacugcacccaguuuguuucucucuuuuuuaaauccaaauuuuucuauuaggcuuugcaaauaggcccuuaaagaaauaggcagcauggcugguaaacaaauuuuguucuuuagauguuuccagagaaauaaugugguauuuuaagagcuuuuaacaagagaccucaagauaauuauuuuuaggauauaccauaauuuaaaaaauaacuucugaauaugagaguaauacauuaaagaauauuccuguaauccuagagcuaagccaugcuauaauucugguccaguuuacgguuugcgcucacauauacacucacauuuuuauacccuuuguuuuuauggguuguauucaugcuaaaaaauuguuuugaaaacacuuuuuauggcuguauaaaguagguguacccuauuucuaaaguaggugugcccuauuacuggacauuuaguuugucugcaguuguuuuuuuguuuuuuuuuuuuuuugcuacuauagaaaagcacagugaugagcaucacugcauucauauuuuuaucugaaguugccuuuuccccuagaucccugaaaguggauuugcugggucugaggaguuuuacuuaacaccuuuuucaaaggcugugucauuccugugaccucacugcaggugguggaccuacugcccuuugcaccaacugacugacugcugugguagaugccuucgaacuuaggcaagcuaguaacauuuuauaugggguuugguuuuuacugaaaagguuugcuucuggaacauuuauguaaguuacagcagucuucaugcugaggacacauggacacgucucuuaugucucaagcaaagauacccccagccugauguagaaauguaauugacuacugaguggauuuccuuucauguggaauagaaugagauuuauuggcuuguauaaacuagagcagaaaaguuaauagaaauaauaaaagcuaucagacucuguuuagcucuguuaugcuauuacacucagauccuuuaaaaacuguguuuagaaaauuguugugcaguuuaauaugucugcagaauauugaauacaguguccaucagaaaaucuaauccuuuuuuaaaguuuagauagaacuaaauaacauaucuuuuuuuuuuuuuuuuuuuuuugagacagggucucacucuauugcccagacugaagugcaguggcacaaucagagcucacugcaaccuccgcuuccuggguucaagggauucucccaccucagccugcugcguaucugggaccacaggcacacaccaccaugccuggcugauuuuugcauguuuuguagagaugggguuucgccauguugcccaggcuggucucaaacuccugggcuucaguaauccucccaccucagccucccaaaguguuggaauuacaggcaugaaccaccgcacccggccuaaggagcauaucuugauguuucuaguuuucuuauaauuuccuucuguguucuggguugcucuuacauauauauucuauaaauuguguguuuuguguuuucuuuuuugggggguugggggagacagucuaacucuugucacgcagacuggagugcaguggcgugaucucagcucacugcaaccucccccucccagauucaagugauucuugugccucagcagaguaacugggacuacagguguguaucaccacgccuggcuaauuuuuguauuuuuaguagagacaagguuuugacauguuggcccggcuagucuugaacuccuugccucaaguuauccaccugccuuggccucccaaaguguugggauuacaggcaugagccaccacaccuggccuuauuuuuauguguucugaauuuagguuaaaauugaagaagaggguccaagacuaagugccaacauagauauuugcaggugaaauugcuuuucuuuguguagcccauguuguauuacuuaauagccucuuaaacuggagaccccugauaccuuacauucaaaugugagugaugauagggugucuaucaaagacaacagaaguuaauauaacuuccccaaagucacgugaguggguuacucucuuuacuuggaacacaugcaaagaaaggguccuccuucaacacuugaagauaaucacagugucaugcucuuucucauaaaugccacuguagagaguacagagaaaaaugcaauuaauggugcuacccaaauccugaaaagaaugagguacgguguaggaauuggacagcagacagagugcaaguuuuuacauaauuguaauuaauacagacaugacuuacuugagaaauuuaaaaugugaauauuuuaaaaauuacagaggaugauuauucacauuauaaagugacucaucaucccuuuuaaaaaggacuuaucuuuuaagaggauauuccucuggugcauuugaguccuugucugcucauuguuuuaaacaacuugcaguuuuuuuaacaaauuacaguaugaccugugauauuacccagacauucaauuccgagguauuuaacuagagauaccuaggaaugaaaugaaaacacauauucguacaaaaaaaauacacaaauguuuauagcagcuuuauuuguaguaaccccaaacuggaaacaaccuacauguccaucaugggugaauggauaaacaaacuguuguagccauuuaaugguauacuauucagcaguaaaaacaaacuauugguauauguagcaacaucagugaaucugagaauaauuauacuggguaagcagccagacaaaaaaagaguucuaacuguaugauuccauuuauauagaaauuacaaacuaaucucuagcgacagaaagcagauccauggucgucuggagguggagaauaaggguaagugaggaugggccaggaggcauggacuccaaagaggcaugggaaacuuaggagugauggguaugcucauuuuguugauggcaaugaugguuucacagguauauacauaggucaaaacuugccaaauuguguaauaugcacauuguauaucaguuauaccugaauaaagcuguuuuuuuuuaaaaaaaaaaaaauguccugaaaaaaguucugucuucccuugucugccaauugcaccguucuuuauaucucauccagccugcucacagucaagaacaggggcagaagugggcugacagguguagugcaguguguggaaugcugugacaggugugggcacagaagguacaaugaagacccccuggaggaggugagcuugaggcgaguguagagagggcaucucagaggcaauucugagaaucauaggagguugcagguguguggcagagguuggucuggaggacagcagggaccauacauuuggagcauuguuuugaaagcguuguacaucacugacgggugguaagcaggggacagacaaaaucaacucggcuuugcccacucugggaagaugaagaggcaggaaucccagguucagagcucaaggaacccuuaugugaugccacccccucaaaucuguuuaaaucauauuaggagaaccuuguuguccaagagggcucugucuugcuagacaguucugcguuguccaggaaacugcagacuacauuggaauccuaccuguacaaauacuuaagauguuucauuucaaaaauaaaguguucucuguagaaauuaaggaaaauacacuuaagaaaaauaagaaaauuuaaauugccuuuaaucccaccacccagugcuaaauacuuuuaacauuuugguguauauuguuucagauauauguauguuuuaaaacaaaauuagaaucauaauuugcauguguuuuuaccuuuauuuccucugagcauuauuccauguuuuauguagacauaaaauaucauuguuuuuauuugaugcaugagagucuacauauuauauguauggugauuuauuuaaccaauaaccucuuuuggggauuuuuuugguuguauaauuuuguuuaaaaauucugggaaaaccauaauuacuuuauuaaaaagcaaguaaaucaaagaauauaguuaauuuuuuuauuaacaggugcaguuucuuaauucauauuaaagaaaaauagccuuggucuaguagacauuuuaacuaaaugaagggaggaugguccccuucuagaaguacacaugggcuuauacaguaguucuuuguuacccagugauaauuauuucaucugugcuauucccaaaaaguaaccaucuaugggaacucuguuguucccaaaggaagauuuacuccccauaucagaaauauguuaaaaaaaaguauaaauaggccaggcacgaugacucacaccuguaauccuagaacuuugggaggcugaggcaggguggauugccuaagcucaggaguucgagaccagccugggcaacacagugaaaccccgucucuacuaaaauacaaaaaauuagccaggcauguuggcgggcgccuguaaucccagcuacucgggaggcugaggcuggagaauugcuagaacccaggaggcggagguugcagugagccgagauugcgccacugcacuccagccugggcgacagagugauacuccgugucuuaaaaaaaaaaaaaaaaaaaaguaugaauaacaguaacagcuaacauuuuuuuuggaauacuuuuaucuucuacauauuauuagaagcauuucacauguauuaacuuauuuagucaucaaaacaguucuagauguaaguucaguuauuuuucuguuuaacagauacguagacagaagcacagaauguuaguaacuuacccaaauaaaugaucaacuuauaugaaaacauauccaucaucacuaguaagcagacuugcaaaugauaauaacaagcuaucacuuuggagaccugcagugaucuuagaaacuuaauacuugacgcugauuaagguagaaggaaacaggcccucuguacaagguugaugggaggguccauuucuguagagcaguugguuuccuucuagaaaauuuauccuaugaagauaauuggacaagguuauaaugauauuacugugcucauggaaguauugagaauagugaacaacuauguguccuguaauagggacuugguuaaauaaauuuugguacauccauauuguagaacaccauacagcuauuacauaugaugauaugcgcauauguuuauggaagucguugcucaggaaauuguaaauggagauaaacagacagcauggaacaugaagauacgaaaucugcuucuggcuguuggucuggggcccccaccaggaaaccagcacaccuggcuuccuucuuuuuuaccguaagaccagagaaacccuagaguugcagugaggaacugucuuggguucucugaaaaugagcaucaugaaaaaugccuggcuuaaaagaagagaaggaauuaauacauuuuguuacagguauuauauuggcuucauuuaacaaaugcaggaacaauuuuauaacuggaacauuuagccacugcaaaaaccaugaauuaguuuuuugguuuuuuucaaguuuuccacuaagcucacuugaguacuuucuuccuucuuccuuugagacucacucuaaccaccagggagucaccucuuuauugaucugccucuugaugccaggaauuuccuuucuucuaccauacuuuaccuauguuuggugaaacauuugaauucacauguuacugaacagugacuugguguguuaaccuucuuagguuuuuaaacuuugaacaacugccuuuccucaaaggcaaaacuaacuuuuuugggaauugcagaaaucguaacuccccagggacagcucacccucaguccuccaagccauagaauuuaaagacugccuugaugccaccaaaaaccucaguaccuuuuguuacagaaagaacauugugugguauacuuccuauguuuugaaaaauaucugcaaauauuuugggaacugaauuuugggaagggcuacccucuggcugaacucugcuuacaaaauccauaaaaacaggguuccagcucugcacagcaggacaggugcaagugugcgccaguaaccucacagccggagaccaucucuacaaacauccugccaggagaagaguagagaauaacaaaggaaaaaaacaagcccuccaguuggcauucuuguugaggaaguccaucaagaaucaaguuccugucaacuuguuucuguauucuuuugcuuaaagaaucacaguagagagucccaaucugaaaaaaacuuuguuauauuucuuagguuggggauacauacagcauggaguuggaacuucagucuguggagccaaacccagacugaaaggcagcaagagaguagcagcuaagagcauagacuaagugcuuccacuggguggagcaugaccagugcauucacaagacgggaauguucgguagacuugcugccggccauguguguggcuucugagcacauguggcuggugugaauuuuaaauuuuauuuaauuuaaauuaaauuuaaauagcuacacauggcuugugaugacuguguuagacagcacaggauagacuuagaagcuagacuacuuggguucaaauuccagcuucacuaucguuuaccucugugaccuuggacaacauucccugagcgcuuuaugccacaguuuucucauuuguaaagugauaaaaagauaauagugccuaccucaaaaaagguuauuuugaggauuaaaugaguuaauauuuguaaagggcuuagaccugggcacauaguaaaagcuauaucaguguuuccuaaauaacgcaacuauauauacaucccuaaagugaaaaauugaaccuagauccauacuauauuuuuuuucaagaagcucccaugcauccauugucaaugcauuuuucuuaaacaccccuuaaauauuggggaaagcagaaaagucauuuauuugauaaauaugucuggagcccguacuuuaugccaaaugcuguguugggugcuggagauacauguguuggugcauagagacuugauucauccuaauaaaaggguaacggucccgcaguguuuucaccuagugguuaaggaacuuuauaauacgaagggacuuuaaaaguaggguaaagguguagauguagacggagaaacccaggagacuuugcauuugcuccuagucagcuggcugggacuucacccuucaccuccuguuggcucaugcuuuucccuuugcaccuguggagcacagguguguccugaggcccucaccagccaugcagaagccuucagguaggguuaacauuugcccacuucuggaagggaucgaucuguucucagaugacagugauaauucuuggccuauuuugacucaauaguggcaauauuaguaguuuuuuuguauuuguuuuaauuuuuuucuccuuauuuaaggaaaaguuggaaacuaauguugcuuccuccauuuuuuuuguuuguuuaaacuuugcugguucaugagauugaaaagucugugcuuagaccauaccacccgaugcaguuuguguaagccuuaaaaaauaaauauuucagccccaacauucauguaguacuaaaagugagaggcuuuugaaccauaacugauuugacaagaaauggacauaauggaggaaggugacugguuguuugcguguugauuugcuuucagcacuugcuaaaacguggagccaaggggagagaauccaccagguugcuuuacaugugaaaaauauuaaaaugucagcacagcccagccacugacauaagaaaaaccguuucacaguuaagucucuaaauaauguccuaaaaacacaacauuuguaauuaucuaauuaauaaaggauacagguaauagaaguaauauggaaggcauuuucugguagauaaagcuucagaaaccuucacaucugcacaugauuaugaagccccuguuauuacuuugcuuucccccuuccuuuagcccauguuucucacuaugaacuaauaguacauaauaauaaaacccuggaugucagccaacacagaguuuuggcuaacuuuuccaguguuuguuaaaguugaaaaagcauugcagcuguuaugcuggguacuuuccaauggaggauguguuuuccagaugaaggcgcaaaugguaauugaaauguaaucaguauuuuuggcaucuuggaauuauaauucuuuuuacguuuguaauguuaauuguucauuucuuaggauuuguuuuguguuuuucugugaucuguaaucuacuaaaagugagagaaugaacaaauguuuuaggcgguuuuucauucuuugaaagaaaaauggcaaguagucacguuuguuaggugauggcuuauuuuaaauaaucacaaaauuuauguuugagacauuuuauuguaagacucauguuucaggcaacagaaaacagaaaaucuaaaucucaaauacaacaaaauuuuagagaugaauggaaacuucuagaucacuuggauaggcugaagacucagugggccucagguguucccaggaccaggcugcuggagaugucccuuucuuugagagauuuguucuguuuuuuuuucaucucgauccacuguguuaaggagggguggggugugucugcugaugguuuuauugguauuugagguuucuaaaguuuuuuguuuaagcuagaaagagcucuagcugauuaguagcucucaauccuuggcuggauauuuuauuuuuuguuuuguuuuguuuugagacagggucuggcucuguugcccaggcuggagugcaguggcgcaaucauggcucacuguaaccucugccucccaggcucaagggauccacccaccucagccuccuguaguagcugggacuacagaugcaugccaccacgccuagcuaauuuuuguauagaugggauuuugccauguugcccaagguggucucaaacuccuagccucaagggaucugccugccuuggcuucccaaaguguugggauuauaggugugagucacugugccuggcuggcugcgcauuuuaaagaucuugaugcucacucauaccugagccagcauaauuaaaucacaguaucuccacaggugacagugaugugcagccaagaacaguguuccuuuccaguccucucuuuauagacgaggaaauugaggcccugagcagcuagaugacuuguccaaaguccucugcugggacugacccaaauaaggaauggcugauuucuggaagggaugucagauucucugauuacagaucucucgugaucuucucucggggcucguggacuguccugucaacagucaggcuaggcagcugcagagagcaggacucugggguccccagugaggaggaagcaaagaguccucaucuuccuguccccuuuacccgaguagaaauugcccuuccuuaucccacaugagcuaccagaggcaugauaaacugccucuggggcuuuuuggcucuuuggcucuuuuuuuuucuuuuuuauuccuuuagaaagaaauagguuuguaauuagcuaacuaagacugacaaauaccagaccaguugcuauauauuacaaaggagcuucuugaauagcuggucacuucugcauauuguagaaaccuuccuucucccuuuuagggaacacuacacauuauuuagguacaguguuagggauaacugaucauuucuaaugcuguguauauccauuaaggguaauuuaaagcaauuaaaugcuaaccuggcuggacagccagguguagguuuguggcauccagaaagaggagauggacuugguggauucugaauuggucaguuccaccucuucguguuuuggaggcuuugucucguuacuugcucaccuuucugcucagugcuccuugacauggcgggucagguugaugggaggugguaccuggaugcccuuugcuggcacugggcacugcaccggagaguuaccaccccugccuggggauggagccucucuggggagaggacagugcaaaggugggggacuggggaguugugagaagugggagcuagaauauggagcaacuaguguguauagagacuucgugagaaaagcucgaucacguuuugguaaguauuugcagcucccugaaaauuuguguugggaggugaucauuagcaucuucuggaauauuugcgcuaaagcaagacuagauuaaggagcuuugguucauuuccagaccuguccugacagcaucacucuccaaaugcuaaacucugagagagagaguauguguauuuuucuuuucaggaugucagucaaauaauucacucauuccuuuccccaaacacacuggccuuugaaaugacacccuaccccugccaauagugagacugugguucugaucggggagcuggcgaguuucugcuuucuagccccaaaggccucacccuugcucucaucuggaagcugaugggaagguuuguuagucuucucaggagccugucacaggaccucaggaacguagccuguagugggcagcuggcaucaauuuagugcuguggggauggcaggcugucagagugguugcacuuuaccugcacgccccccaacccagcccucugugaaggguugguuuacaucagggauggcugcuccugacauaauugucuauuuccggcaacagaggaagauaccuucugccauuuagagaagagaaauaaauauucacuucagagaauacacuuugaaguggggcugugugugcaugggugacagcucccugccuacuuuuccugcaagguucuuguacaucaggaaagguuaauggacuucccuugaagucagacagagauguguucauggaaaauccaagugcaaaaccaagggcaaacucuggcuuuccuggggguuuuuuuguuguuguuucuccuuuuagaauggacagugaaagcaaggugaagggcuucauuauuccucuuuuguaaagccuguugagcaggaaccuucuggagcuucuagauggagguuccuggagauugugugaguggugagcagucugguugaagagggccaguguuuguuggcuuugcccucauugugucaggaaugagcucugcacggacucagagagcuaacagaucagcuaggguaccucagagaagaaugcacucgaggcuacugccauguucccucuguggucaugaggaaaggagaacuaccuguguggcuugggggcuucccugacauaguaaucacauuggauuuuacaacuggguacauucuuagccuucaguuuggugaucccuguguuuaaaaagaaaauccuuuuguuguguggagguuaaucugcugagcuuauuuuuggucauccauucucaccugccccacgacacuggucacuggugucuccaugcugauauauuaugcucagcuuuuuugcaugcuccgcauggagauaugaacacaauucucaugggaacuuggcccaucuuucagcacacuaugucagccaguugcugccuuccuguucauggaggacuaggcguagugugggggucucauugcucaucugguuaguggcuuugcagucagagcaagcugagggaacagugcccccuaccugucuguucuccugcaggcccagugugggaacaagaugcucuucagagaaaucucuuugacacuggcugucucacccagcaccuacacucuugaaaaucugagggccuuagcagaauuugaaaguguccaaggguuagaaaugagaagucuccaugagcaugaaagcgaccauccuuguaggucauuauuuugauccaugcucucaucacugguuucacaaacaggccuuuccuuucuagucuuugaacauaccaacucuuuucgaguaacacagcaauauuaaaaacauauacccauugccaaaaagcaaaaccaacccacuucuggcugagaaacugcugaauacauaacuauucaucccucaguagcugagugugguuacaaugaauggcuuucccauauuuucuugaugcuucuaaauguauggguucacuuuuggggggaauauuuuggugcugucauaaucuauauauggaagauguuaaggauauuuccaggaacugcauuaaaacagccauaacaaaccauauucugcagccuucagguguaguauuuugauugcuugguuugguuuaucaccaacuacucuucugaguaucccccacacuauauuaggaauuuguuacaauaugacuaaugcugaauaugugugcauugauuuuuaagugcacugggugggacugacuuguucaaaucuccguuaaagcaaaugucugauuaggagaaaaguaagggaguaauuuguuaggaaaacuacuuucugaggugcccccaccuccccuccuuccaaccugaagaggcagagagguuuguguaaacaaagguccugcaaggcacagcuguuuuacauucugauguucuaugacuuucuuaaauaaaaaccuuuuggauuuucauaucuauuuagcuaguaggaauauuuccuccuuuuucggagaauaaaauccuagacuuaaggauauuccuugggugacugagaagucauaccagccuaagcaguacagcuggcccccuguauccauggcuucugcaucugugaauucaaccaaccauggauagaaaauauuugggaaaaaaaauccacaaaguucgaaaaagcagaagcacgauuugcugcuuacugagaacugcauugaauccaugugaguaaggugauguguaggcguuguauuaggaauuauaaguaaucuuuaggugauuuaaaguauuugagaggaugugugucgguuuuauacaaauacuacaccauuuuauauaagggaccugagcguccauggauuuugguauucauaagagguccuggaaccaauugcccauggguagugagggaugacuguauuuucuaauuaaaagguuuuuuuuuuaauaagcaaauguuuuacuuaguaccuuauaauauuuuaaaaagcguaaaauucccaaauaaaguaauugguuuagugauaaauauuuccaguggcguacuuaaaaugaauguuuucaucagaaugcagaagcuguuuugagaacuuuuugcucauuauuuucagugggguugugaaauccaaugaaaacguguauaaauguuuguagaagaauacuuuguuuauagagugcaaauauuuucuugauaugacaacaccccaaacaaagaaugguuacaauuaaaguaauggugauucaguuaaacauagagcuggaaaagccauuauuuugaaauaucuucugagccucauugaagagagagugucuuacacaccuugggaaccaaguuuugcauauuauaguauuaccacauuguauucgaucacaagaauggugugaauacuuggugguuaaacaaauuauugaugcuuguuaguuggaugagaucuuggaaugcaugcaucccggcuucccacacaguacucaguucuuucuguagcuauccuguugaauauauggagaguacaguauacuuucaggcaagauggucauuuaacaggucauuauuuaaacauuguuucagugugugcugugaaaacaacaacaauaacaacaacaaaucgaauaccucucugcucucugcauuuuuggagcgcucuagcuguuagaaaguaccuccuaaccccuagccacugugaaguuguugcucccugccugcugggaaaucugugccagcucucccaggaaggcuccugaagcugccugcacauaccugccaggugugucuccuggacuuuuccccagggguccuagcuccugggcugggucuccuaggugucuuacagccuggcugccccuucuggacacucuuggcuuggucaguaccuggggugauuuaacuuggcgucuaacagugaagcuuccuuuaguuguaucuucugcuguugcuucacauugagcuugccacguuuuccuugaauugcugucaguuuuucucucuuccaaccuugggaacuuuauuuuuaaaaaucugggccaggcgcgguggcucacgccuguaaucccagcacuuugggaggcugaggcgggcggaucucgaggucaggagaucgagaccauccuggcuaacacggugaaaccccaucucuacuaaaaaaacaaaaaauuagcugggcgaggugacgggugccuguagucccagcuacuugggagguugaggcaggagaauggcgucaacccgggagguggagcuugcagugagccaagaucgcgccacugcacuccagccugggcaacagagugagacuccgucucuaaauaaauaaauaaauaaauaaauaaauaaauaaauaaaaucugaaugcaagacuguaugugugcuugaauaauuugaauccucucuuggcccugggaccuuccccgugcuacaugugcuuucggagguugugaggaaagggcugaccaggccauggaccugucccagagccggcacccuugagcauggcugcucagacagcagugaaaauuugucuuagaaauuugaaguugcuuuugaagcuuuuuggucagugagagaacuuaaaaauucucauguaaauauaauuuaaaaaauauagaugacucaaucuacaagagcuuaucuguuugguuuuuuuuuuucuacuuauaguuuacauuugaaaaaauuuaccacuugaugaacugaguaauuuuuucuucuugauaguagaggaauugguagggaaagugcuucuaauacucuucgaagcugagaaaauuuuaaguauaaaguuuguucauuaaacauuuguguauuguugucugggagcuagacacuauauuuagggauacauugaugaaaaagagagaaauacccaauaguucuuggagaguacaguauacuuucaggcaagauagucauuuaauaaauacacagguaauuauuuaaacaccaucguagugcgugcuaugaaaaaacaacaaaccaguaggaacauagaacaggagaggcccugggcugggacuagggguuucagaagagucucuccagagaaaguaaaguuuagguugaucugguucucucucuuuuuuuuuuuuuugagcaacaagacuguuuauuucaccugggugcaggcaggcugaguccaaaaaaggagucagcaaaggguggugggauuaucauuaguucuuacagguuuuggaauaggcgguggaguuaagagcaauguuuugggggcaggggguggaucucacaaaguacauucucaaggguggggagauuauauagaaccuucuuaagggugguggagauuacaaaguacauugaucgguuaggguggggcaggaacaaaucacaaugguggaauguuaucaguuaaggcuauuuucacuucuuuuguguaucuucaguugcuucaggccaucuggauguauacgugcaggucacuggggauaugauggcuuagcuugggcucagaggccugacauuccugucuucuuauauuaauaagaaaaauaaaauagugguaaaguguugggguggggaaaauuuuggggggugguauggagagauaaugggcaauguuucucagggcugcuuugagcaggacuggggcaacauggaaaccuagugugggagagaugaagcugaaggaagauuuugugguaaggggugauaauugucggguuguuagaagaaacauuugucguauagaaugauuggugauggccuggauaugguuuuggaugaauugagaaacuaaauggaagacacaaggucugaauaagagaaggagaaaaacagguauaaaaggacuaagaauugggaggacccaggacaucuaauuagaguguccaagggggguuaguguaauuacuugcuugguuggcaagcuuuuaggcucuaucuuugaguuuuuuuuaauguugucauauaccaggccagauugauuuagguaaaaauagcacucuucauuuaaaaauauagaguccccuuuuuuuuuuuuuuagcaguaagucgagaccuuugugauuuuggaagaaagagaaaugcaaagccagcaauuguuuguuaaagaaggauuagaaacggcuaggagagaguaacugagauugauagugugauagagauagcuggggagagguagaggguggcauaagaacgggaaugagaauaagaguaaguauaaaaguaaagaauaggacuucaucagggugaaaguauuggaggguaccuugccacugaagaucuucuauccacuuaaagagagacuuaaggguggcaguuugaggaaaaaccaggugccacugaauaccaacagccugagaaacugcuugggugauuugacuaguaaaggccgguccguuaucggacuguauagaggugagaaggccaaaccgaggaacuaugucugacagaagggaauaaaugaccacgguggccuucuuagacccugugggaaaggccucuacccauccagugaaagugucuacccagaccaagagguauuuuaguuuccugacucgaggcaugugaguaaagucaauuugccaguccugggcggggcaaauccccgagcuugauguguggggaagggagggggccugagaaauucuugaggaguaguagaauagcagauggaacacugaaaagugauuuccuugaggauagauuuuugcgauggaaaggaaaugagagguucuaagaggugggcuagcggguucuaagaggcgggcuagcggcuugcaaccuacauggaagagguuaugaaaugacgaauagaaugggccugugagacuggaaggagauuuuucuuugguccaagaaccauuugcuuugugugggaagagauggguggaaguuucagcgagggaguaggugggaguggccagaugagaaggaggaaaacugcccugagggauagaaguuggaacgcuagcugcuuuuuuagcuaucuuaucagcauaggcguuguccagagcaaugggaucugaagccuuuugauggccuuugcagugaaugacuccggcuuucuuuggaaguaaagcagccuugagaagaguucuuauuaaagaggcauuauugauggaggacucuugcauagugaggaaacuucuuucugccuauauaacagcaugguggugcaggauauggaaggcauauuuagagucaguauaaauauugauggguagucccuuugcaagagugagggcucaaguuaaggcagugaguucagcuugcugagagguaauggaggggggcagagcgguagccucagugauagauguggaagauacuauagcauagccugccuuugcuggugaguggcgauuaggccugguggaacugccaucaauaaaccaagugugaucagggugaggaacaggaaagaaggaaacauggagaaagggagugaaugucauguggaucagagagauacagucaugggagucagauguauccggaauagugugggaggcuggauugaaguccgggccaggaacaaugguaacugugggagacucaacaaagagugaguacagcugaaggagccggggagcagaaaguauaugcaucaggugugaggaagaaaauagauuuuggaaguuaugagaacuauagagagugaguugagcauaguuugugauuuugagggccucuaaaaguguuagggcagcggcagcugcugcacggggacaugauggccagccuaaaacaguaaggucaaguuguugaucugguucucauuuauccauuguccuuaucuuuaaaaucacaagauauugagaguuagcagugccauugcuaaugagauuagaaagccuucauuaauuacaggauccuuggauugagauuggaguuuaauggcacagaaggcagcuuuaggguucacuuggugaauuaaucugcucaggcugccauaacagaaugccacagacuguauggauuaaacaacagaaauuuauuuucucacuguucuguaggguagaaguccaagaucaaggagcugucaguugauuucugaugaggcuucucuuccuggcuugcagauggcugccgccucacuguguccucaccuggccuuuucuuugugcaaaugggugggugcaggggaaccauagugucucuuuguuccuugcuuucuuucuuuuuuuuuuuuuuuuuaaugauaaggggucucacucugucacccaggguagagcgcaguggcaugguuucugcucacugcaaccuccgccucccaggcucaagugauucucccaccucagccucccaaguagcugggauuacaggcacccaccucugcgcccggcuaauuuuuguauuuuuauuugagacaggguuucaccauguuggccaggcuggucucaaccuccugaccucaggugaucugcccaaagugcugggauuauaggcgugagccacugugcccggccauucuuuguuccuuuucuaauaacuacaccaguccuauuggauuagggcccuaccauuaugaccgcacuuaaccuagauuaccucccuacaggcucugucuccgaauacaaucacauuagggguuacuccuacaacaugugaauuuggaaggugagcacaauuugguccauaacacucaggcaccacuaaaaauccagcuacugcuggugcccagccccugauacuucucucugugcagagucauagaauacuaacagaauuuaguucccucuaaauguuccaaauugcccugacauccgguucauucuucugugcugcugauuuugacaacagaagcaacugcuuugaaagcauuuugagauaggaaaaacaaagugcauauuauguugcagauauuuugggaaauagaaaacuuguuuauuaguaacauauuucaaggagaugaaguuauggacuugauuuuggucaaguaaguaguugaaaaaugcaguuucaaaaaucacaucaccagggagauuuuaaagaaauucagaguggucuggaugcccugaucuuuucuucuaaguuuuuucccccuacugggagaacgcagaaacuugcugauuccuuuugcucuuauaccugauugaagacuucaccagcuaagaucuuauuuucauuuugcagucauuugagcgauaguaggagccagauaaguuugaauuacaagcccaugcagcuuuggacaggcugugcauuauccugugacuuucuggaaaguguggugagguauccccagccuggguguugggcugauuggcuugguuggauuagggucuggccccacaguagacauacuuaacauacuuaacuuauggcugucaccuaugauaaaugcacuguaaaucagagaucuccuuugugguucuaaacuuauggcaauauuuuaggcaccaucgcucauuuuucuuguauacucauguuuagauauucuggaagccaaagugaauccacauuuacuuuaacugacuuuuguuaccaagcuugauauugaguuccuuugaaaauaagcuuuuaagcagucaugugcaggccucuaauggauuccagacuguguagacuguauuguuaaacaauauuuuguuuuuaaaaauuuuuuucuucggauugaucagguuuaaacaaauuuuaguaauagaauaguggucuccaaccuuuuuggcaccagggacuaguuucguggaagacaguuuuuccacugacggguuguggggaugguuucgggaugauugaagcacauuacuuuuauugugcacuuuauuauuauuacauuguaauauauaaugaaauaauucuggccggacaugguggcucacccuuguaaucccagcauuuagggaggccaaagugggcaaaucaccugaggucaggaguucgagaccagccugaccaacauggugaaacccagucucuacuaaaaauacaaaaauuagccagguguggugguggcgcaugucugcaaucccagcuagggauugcagaggcugaggcaggagaaccucuugaacccaagagguggagguugcagugagccaagaucaugccacugcacuccagccugggugacagagcuagacuccaucucaaaaaauaauaauaauaauaauucuacaacucaccaugauauagaaucagugggagcccugaucuuguuuuccuccaauuagaugguccaucggcaggggugauagaagacagugacagaucgucuggcguuagauucucauaaggagcgcacaauccugaucccugucaugugcaguucacaguaggguuugcgcuccuaugaggcuguaaugccaccaugaaucugacaggaggcagagcucagaugguagguauaagcaaacuauggggaacagcuguacuucgcuugcuuguccgcugcucaccuucugcuguguggccucgggguuggggaccccucuaauagagguuugaucauguuaaaaugauaauuauuugaauguuuuuucuaggauugauauucucuuccuuucaaguaucauaggccaaucuuuacucauuuuguuuauuugaaagguuauggauuucuaaguaagucugggaaacauuuaccaagcauacaaaggggaaaggcuuguugcugcaguguuaaugcaagcgaugguaguuauuugaacagcucuuugagaaaauuuaauaaaguguaaaucucuggaaaucuggguugccaugacaguguaggaccuauuuaggauauuuuacaaagagaaaugaucuuaaaaucgucuacauuuaaaauaaauauguuaaaaggcaaaugcuggugagauugugaaauuagugauuacugcaauccuauccaaauaugaccccucauguuuugcgacaguugaaaauaaauuuauaauuuuauaacuuacaaauuuauaaccuucucugaauaaaucugaguaaagagaagguuguuccuguguaacaaugagaauuuuacugggauccaaaguacauacuauuuagguaggaagaagcacuauguuuuagaguuagauuacucugcugcaauacagcuccuaccaucuguguugcauuucacaauuguuuuugagcaccugcuauggcuuaggugccaugcugguuacuaaugguuuaaagaugaacagaauaggcugggcacgguggcuuaggcauguaaucccagacuuugggaggcugaggcgggcagaucacuugagcccaggagaccagccuaggcagcauggcgaaacccuggcucuacagaagauacaaaaauuagccaggcaugguggugugugccagugguuccagcuaccagggaggcugaggcccuggaggcagagguugcagugagccaacacugcaccacugcacuccagccugggcaacggagugaaucccugucucaaaacaagcaagcaaacaaaaaagaaaccacacuagaacagaacaaagaggaugcuggcccuugcagagcuuguggugguggggggagguauaugugucucacauaucacuuaguauaguguugguuuucaguguaguuuuacauauuuguuucauuucauucccuuccagguaauugagauaugcauuuccacuugauagauuugcagaggauuuuggcauuggguugcucuaggagaagucagauuacaaauaaaaagugcuuuauugcuccuguguuguucaggcacauaugauacuaacuuaugaaauuucacaacaaauagggcagugaaaugccaaacucacugaaauucaggacugguauuuuggcagcagcaccauuagaacuauacucuaauguaauuuaaaacuauuuggaaguaaauguaagaccaaauuguuauuugugguggcuagaaaccccacauuagccauaagaccauggugcuaggucuguauugaguuaauaguuucuauuuuuaaaaauaauuuagucaaccagaagacaucaguuaauuucaguuuuuuaauagcucuucucuguauguggaacagaaacaaggauggccuugaacugccauguauaugagaauagcuguguauuuauuugguaggacuuaaaaaauauuuuaguugguucaaguuaggugauuucaagauuuguaacugaacauuggaaaaauuaacuuuucucucuagaucuaucuacuuucaauauucagcugauuuuucaaaauauuaggacuuacaaaauuauauuuagauuuuagagaguauuauauguaagcggagaagaaguacuuuaaaauuuuaauguacgaguaguaaagaaggauaaauuucuaugcagcagauaaagaauuuucuucucagggacucaaauaauaaauccauuuguaauaucacuguuccuugugcaguuugcucuguaaaauggaggaaggugagaggggugccauguuucugucucauaccguuuuuuguuauagaguguauucaugguuauacuguauaauaaugauaauaaguucuuaaaccguggugaugagaucuauuuggcagaauguuuuaaaauaaacaguguauuucccacgagugaaaucuuaaaaaacaauuaauuuccauuauaguaagggugaauuuugcuccuucaaagaguauagagccugguugaauuugcccauuaagaaaaaaaaaugugucuauuggacuguguuguuuguaaagcuagaaucaccuuccaguggcguuuuccauccuuacaggaaagagguuuaucucugaauauugagaauggagguucauaaugggcauuuuagcguuugaauguuguaggaagaagauggcuaaaucuucacugcuccccuaaaguacacacguuaguucugguggggaguagccacucugagauuuuauaucagagacauaaugaaugggacccaugauaugugaaauucuaauucuuuaguacagagaaaugugcucuucaucuuucugucuucugaggcuuuuuucaaguguucgaaacugccguugcaaaacucuaacugagacaguggaagagaucuguacuaaccaacuccaucuugcuucuaaccuccaagcaguccuugcucuuuccugggcuuaggccaaacuaacuuugagagggacuuaguuuguaguuuaaaacaaagaugauaacaaaacccccuucuugccuggggacuagauugcuuuuguaggacuagcaaauuaaccacaacauuagaaaauaugguuuaggagucaugcugcuggaggcugcaagauucuaaaccuccccaaaugguuccugggaauaacaucacuauugcaaaaccuaagaugagugcuugugacauuuugcagacccuguccucgauggaucauuuggcaccacccagauggauaaacuggcuuaucuggucuuguggcccccacccaggacugacucaaugcaagaggacagcuucaacucuguauucaucuccaccccuaccaaucagaacugccaacucaguggaccccuacccagcaaauuauccuuaaaaacuccaguccccaaauucuuggggagacuguuuuaaguaauagcaaaacucuggucugcugcacagccagcucugugugaauaacuuuauugcaauuccccugucuugauaaauaggcucugucuagacagugggugaggugaaacuguugggugguuacaucuucauuaaaggagaugagcauuuuuuucuuuagcuuggauaguguuuuucaucauuuuuuucauuauucccaucccuuaucaggaauuuuuuagauuauuuauuuauuuauuuauuuuugugacagggucuugcucugucccccaggcuguagugcuuuggcaugaucacagcuuacugcagccuuggccucccaggcucaagugauccucccauuugaagaugaauggcugggacuacaggcaugugucaccacacuugacuaauuuuuaauuuuuuuguagagacgggcucacuuuguugcccaggcuggucucgaacucauggccucaaaugauccuccugccugggccucccaaagcacugggauuacagaugugagcccccucgcccagugugacccuuuuuuuccuccuaauugcccacccaugaaauuuucaugccauagauacauuauauaucuaugcuaauaugaaaaagaauacaauuuuuugccucauccccaaaaugaauuuucauuccuugugggggcaauaucacccccauuguguauguacaaggagaccuggcuggguggguaacuggccuaggcguaauuagacuuugaugcaggucauucauuuccuuauuuauuuaagagccuugagucuuuuugauauuuuucugacauagaccacuauuaaaggguucuugccuuagaggguaggccaauuuguucauuuaaagcaugggcuuuggagucauacccacuugguucaaguccucuugguuucuucauuuuuuuccugugccaccaccagcaaaacuuuaguuuauucaccuguaaaauagggcuaauaauaguaucuacuucaaaagguugcugaggaggauggaaugagaaagcaaauaaagcaccgcaccccagaaagaguaagccauccucccaaaauguaauuuuuagcuguguuaggguuuagagucaucaccucugcauuuuaaagauuagguuguguucuuaugguacaagauucaauagugaugaagauauuaugauaaaagcaucauagcugugugacuugauugaguuguuuaacucuuggggccccaguuuccauauuuuuguuaauuaugauugaaaauacaaaauaaauugacugaaacgucaaauaugguaguaaucccaauaaaugcaaauggauuaugcuugccgacuaagugacagaggcucuuggguuagauugaaacaaagagaggcauaccuaagacaaagugacucuagaagugugaacucaaaaugucugagacaagucucagucaauuuagaaaguuuauuuugucaagguuagggacacaccagugacauagccucaggagguccugauaacaugugcccaagguggucaggguacagcuugcuuuuauacauuuuagggagacacaguacaucaaucaguacauguaagauuuacauugguuugaccuggaagggcaggauaggggcagccuuccaggucauagguagauuuaaauuuuuucugauggcaauuggucgaaagagucauuaucaguagaaaggaaugucuggcuuaugguaagggguuguggagaccuagguuuuaucaugcagaugaggccuccaaguagcaggcuucagagagaauagaguuugaguauuucuuaucccacuuaaggucugaguugauguuaaugcuggagggggauggauagugaggcauguccauccuccccuuuuccaucauggccugaaagagauuuucaggcaacuccgggaugcccuuggccaagagggcccauucagaugguugggggccuuagaauuuuauuuuuaguuuacagaagguuugaaauaaggggauagaaaaauacauaccaggcaaauauuacugucaaucaaaauagaguucauauguuaauagagauacaacaauauuucauaauauuaacagcucaucuggaagauaaaauaauuaugaucuuguaacauacucagggaaugagaaagaaaaucugauaaucauagugggaaauauuacuauacucugucauugauaaauaaaaguuaguacagcuauagauuauuugaaguccaaaauacuuuauuaacaagaguuuaguaauuuaauaauuauuaauaggucucagagaaccuuucccugucaggaugaucugauuuugugaauuuuggcugaacuguauacagcucuauggugccuuuuuuuuuuuuuucuuuugagacagagucucgcucugccacccaggcuggaguguaguagcgcuaucucagcucacugcaaccuccaucacccggguucaagcaauucugcugucucagccuccugaguagcugggauuauaggcgcccgccaccucgcccagcuaauuuuuguauuuuuaguagagacaggguuucaccauguuagccaggcuggucucgagcuccugaccucaugauccgcccgccucagccucccaaagugcugggauuacaggcaugagccacugugccugguauuguuuuuuuuuuuuuuuaaacaguggauauguuucuguaaagcugcaguacacuggauuguuuuaaaagugaaggcuacuuuaauaauagacauuauaugcuugugacuuuucuuguguuguuaauuaucaugccgugacuuuucaugugugucuuuauauuuaugagcagagaacucugaauguuugggaugcaaucucgguccuuuuuuggcacuagccccauguaccugaguaauaauaggucagacagguuauuaagaaacagugguuucuugcauguucucacucauaggugggaauugaacagugagaacacuuggacacagggcggggaacaucacacaccggggccugucaugggguggggagaugggggagggauagcauuaggagaaaugccuaaaguaaaugacgagguaaugggugcagcaaaccaacacggcacacguauacauauguaacaaaccugcacauugugcacauguccacuagaaccuaaaguauaauuaaaaaaaaaaaaaaagaaacagugguuucuuguagauacuccuuuuuggcaacugaacaguugagauaguugaagcaaaauucucagacacacgauuugcaguuuggugccuucagaguccuuagaaggccuuuuuaaagauagcauaccagcauccaguguacacuuuuucaagucuuuuaugaauaaagugggaguguuuuaaguguuugcagaacauuugggucucugaauucugccaaaguaauuguuacauaguuuucuuccucgaaaaggacuggcaaacauuggucaccuucuucauuuuauuuaauuuauuugagccuuuuaagauuggguauuaaggaaguguguguauaugggugugugcauauguguagugccaaugaaaauuccauguauucucuauuuguugcuuuacucucugaaaucugaguaguucagacaaaaaauaauuuuuuuacaaggguaaaaacuaaauuuaaaagggaaaucuaaauuuuauuauguguauggagaggcaccuuauaaaauauucacucuuucauuagcagccuauuuuaaaaaaugugacuuccuugaaagcagagugucuaccagaucuaucuaaaucagaggaguauauguuucaggcguugugacugauggagauaguaccagaguggcagcuccaauugacuuugccccugugcucucaccucccaguccucccucugccaccuguccaggcagcccauuuagaaacaaauaauuagcaagcacuuaauguuaccaggcacccugcuaggaguuauaaagacagaaugaugggaucaugaccucaagaggccauggcuuauugaugguaaguaaauagaagguuuguaauuaugaagcagucuuuuaaugauaggucagcggugcauaaggugucggagggagugcaugugggcacugucuaagguugucuaauucagaccaggugguggugguggugagugauuugaggagguuccuggauguagugauaccugagcuaggauuugcaggaagagcaaagagcuguuccaggugauagguuuggaacugagacaagaacaugauucuucucucucaggaguugcaagagcuuaggacauggauagugggaccaggcuagagagaugggcaagguccucgugaagaaucucauuuucucuccuaaggcuucuuggcauuauucugauggcauugggagccauuugguagauuuuaguuuuuagggggauaaaauaacuggaauuacauuuuagcacggucccucugguagcauuguaggggaauggauuagggauuacaaugagagaugaggagcuggaaugagaaacuccugcuggaacuaacucaugagauuuucaggagguacgaguuaccuuagggccacccuguggagcgagagggagaaaugaaaggugacugcgaagguuugugucuggggcggcuaggagaaguggggaugccauucagcgagggagugguggaggagaugcagggcguagaggucggggcugugaguucgguguucgacaggcggaguuagugauuguuaggagacaccugcaccuugcagggagcagcugucagcaccggguaaccagcaaagacagagaaguggaugaugucaccaaggaagauuuuguagaguaacaguagaggaugcuggaaaguagccuggggauuauuguuucuucauaaaacaaaaaccugcaaguuuaucugauaaccugugcgacuuagauaauaaaugugguaucuugggaaguaagagaacagguaaaguauuuucccucugggcuguuccagguauugacuuuacgaacuuuaaucaauauagaggagaacuaacagaauacuuacaaagccuggcaugguaacauuccaguuucuuuccuaaugguuaugaccugugguagcucaugccagagcuguagaagccucuuuaccucaaagguacaggaugauaauuuccacauccauuucugccuugauccaccuguuugaagaaaugaauuuagugucugcuuauugaagcagaaaauaauaaagcaucuggaauuucugugcaucuuauggaaaauuccaguucauaggauguaggauuagagaagaguaauuugagggggaggaucuuggcuuuucuacauauuccuuuuuauacauacacacacccacacccuaccccaugccaccccaccccccaccccacaauagagaagagcagggaaaguagauaggcacuuuccuaucuuuuugaaaccuagucacaaagaacaugggcauuacccuugucacacgcaggguauuacuguuuuuauucauucaaaaguuauuuaacgagcuccuacuguggugagcaaguccaguggaauccaggcccuugcucugcuauuagagggaugagggccuuucucuucaaggggagauucccuuuccuugugucagccuuacauaguccuuucuggguuuccuaaugguggaaccaccaggcagaguuccaagauggccaagccuuccucccuucucuuccuaaacuucccacagcuauuuaagaaguacagaugacuucacagcccacgggaggcauggccaauagcaccuugagaaaacccagcccuuuuuagauaaccuccugggacaccuguaugugugauauaaacuguccucacagcuggcccuagucccauguggaaguggguuagaggaugaugauguuuguagcaugcuggaguuuggagucuccaugccaugggcacacucuuccauacuguugcccucacucugacuucuucacccucacgucacucccuugcugcuguugagugccuagaagggaccuuuccaugauggcuauggugggagcgagggauguuuugccgugaaauugccuugaaaauaaaauaguggguucuaucacuguaaauacucagcuuucuuuggacaaaggacauugucuuugaacagauggagaauauugaagaaaaaagaugucucuaccaucaaauucuggacacuugagugaaacaguugaauaaaaagaacucagagcauugcuuuuuuuuugagacgaggcucacucuguuguuugggcuggagugcagugacacgaucauggcucacugcggccuugaccucuugggcucaagugauccucccaccucagccucccaaguagcugggacuacgggcacgugccaccgugcccggcuaauuuuuauagagauagugaagaaggguugggagggugucucaccaucuugcccagguuggucucaaacuccugggcucaagugaucuggccaccguggccucccaaauuguugagauuacaggugugagccacugugcuuggcauauauuuauuuauuuauuuuguacacagacuaguggauaauuuggauacuuugacuucccauucaccuuucuguuuuuuguuuuuuucuuuugagacagagucuggcugugucacccaggguggagugcaguggcacaguuaugguucacugcaaccuccaccucccuggcucgagugguccuccuaccucagccucccaaguagcuggaaccacaggcgcaugccaccacagcuggcuauuuuuuuuuuuuauuuuuguggagaugggggugucacuguguuguccagucuggucuuuaacgccugggcucaagugaucugccucccuuggccucccaaagugcugggauuacaggcgugagccaccacucuuggccuaaccuuuccguuuuaaggaacaauaguaguguuuuuaaggaauaccauuaagaaagaacauuaggaaaaaaggugcuuuaguucucugagugacuucuuuuaagcuuaagacaagaauuaucacuuacuuacuaaguaaucugugggcugggcaagguaggcucgcaccuguaaucccaggacuuugugaggccaaagcaagcagauuacccgaguucaggaguuugagacuagccuggccaacauggugaaaccccauuucuacuaaaaauacaaaaauuagucaggcaugauagugcacaccuguaauuccagcuacucaggagggugaggcaggagaauugcuugaaccugggagguggagguuguagugagcugagaucaugccacugcacuccagccugggugacagagcgagacucugucucaaaaagaaagaaagaaagagagagagaaagagagagagagagagagaggagagagagagagagagagagaaagaaagaaaggaaagaaagaaagaaagaaagaaaucuguggaaagcaguuguugguucagugauagaaagagagauucgcaggugggggcagggcaggggccaggcugggcuucugcaggagucaggugcgguggauguugcagcgcagguauagcagcccuggggguuucuucucauuggucagcagguggcaccaaauagcuaaaacuuaucuggggagaggcaugccuugcuuggguuuuaccuuggguuggguuggauuaaauuuuacuuucuguacuuucagaauuugggauuaauagcacuuucacauuuucucccuagagauagaauccuccaaguuugaauuuuauaaaagucucugauauugauaauagucaugaaaguuaacuauauucaagaucagaugauugcaugacauuauuaauuuucauuuuuuggaaggguuuaugacuuugaauguuaaaugccacuguaagaucauucaauggaauauacuuacucgauuagauuucugaaguuuuuguguuuuuaugaaaucccauaaauaaauugcuaacguaggugugaaaauuaauacacccgugaauguacuuaauugagauugaguaugucucucugaugagaauccaggauuuuacuuccauucaggauuuuucuauuagagcagagaugggugacaguuugagucacagauguuguggcucagugguaaaguggauucagugcuucuuccucaggaacaugugggguguguuggcuguguucuuggauagcaugugagaaaacagccaugacaaaagagcaggcaguugugugcugguaccacccaagagccuacuguuuauuuaaggugcaguuaauuuguuucagcuuauuuacuauggaaacuugguugcauguggcaugugugguuaugugcuggaacuuuuaaaaagcugcauuucaagcacgauaaauguuucuuuucuacauauauggguuuguuuauuuuuugugugguggcauaugugagggggaagaaucaucucuugaaugauccuucuguguugcugaguggugucugguuugguuagcacgcaggcuguggugaggaggccugcugacucuggccuaggugcacaucuuggugcacacugaacaaggcuuucacuaagugagcauccagcuacaaaaaccugacaauaaauuuuugaguuuuaagauguugauaacagccgggcaugguggcucacgccuguaaucccagcacuuugggaggccaaggugggcagaucacaaggucuaggaguucgagaccagccuggccaauauagugaaaccccgucucuaccaaaaauacagaaauuagcugggcaugguggcucgcgccuguagucccagcuacucgggaggcugaggcagaagaauugcuugaacccaggaggcggaggcugcagugagccgagauggugccacugcacuccagccugggugacagagcgaaacuccaucucaaaaaaaaaaauguugauaauuuauuuuuuuucuugggauagcuucauaccacuuuaaaagggguguugucuuuucacuccuuucuuccuacauuugcagauuaacaacuuacuuagauagcuucauaugccugacugagccuguuuccccccagugaaauuuaaaauaugcgggaauuuaaccacauuuaaccacacccauaggcaucaggcauagcacuagcucaguuucucaaugucucgggucuagucaguccuucaccaggcccugucaguucucccuccaaagcacauccaccucuaagcacauccaccucuuaaccauccccgcuucuccacccagagcugcaccgccaucauuucuggaguagccucccaaguggccccugcuuccauuauugccgccuagaaucuguuuuccacacagcccugggaagaauauuuuacaaauacacucaaggguggugucgguuauuagcuuaaaauccugcaguugcuucccgccacacuugggcucgcccaccucccucccuaaccuugucuccgagucucucccgcugcccacuagacucagccacauugaacuugccguuccuccugcaugcuaugcugcuuccuuugccugaaacacuauuauucuugaucugugcgugacucauuccucuugacauugaguucucaguuucaggacccacucgagaggccuucccugaucaccagaucuaaaaauagucacaugacucugcugucauuuuuuuuuauuuaaacuaucuugccuuuucuugugugcuuuuuguccagcuccuaccacuaggauauaagcuucccuagagccagguccuuauugcguucauuuuuaucccuagcaucugguccagcacagaguacguaguaagucuucauuguauuuugguucaaugagugaauaauagcuauauugaagggagaagcuguguuuaaagcuuaucaguucaggauaaagaauagcaagcguguauugagcaucuaccaugcacugguacuguccuugguugccauacacuuacaucuuaauuuuuuuuuuuuauuggaguuuugcuccuguugcccagguuagagugcaaugguaugaugucggcucaaccaaaaccuccggcuccucgguucaagcaauuuuccagccuuggccucccaaguagcugggauuauaggcaugcgccaccacgcccagcuaauuuuuuauuuuuaguagugauggguuggucaggcugaacuggaacucccgaccucaggugauccgcccgccucagccucccaaagugcugggauuagaggcgugagucacugugccuggccuuacaucuuaaucuuaagcaucaguuuucuaauauguaagugagauguuuagauaaaaugaucugcuaguucucuuauauaacauuuuaugaauuuccaggagaagcuuaaagauuauaauuuauggugauacacaaugggaauaaaugaguucauucagaagccccacguagguguugaucuaccuccgauaacauuucuuuuuuuuucuuuuugagacggagucucgcucuguugcccaggcaagagugcaauggcacgauaucggcucacuacaaccuccgccucccagauucgagcaauucucccugccucagccacccaaguagcugggauuacaggcaugugccaccacgcccagcuaauuuuuguaucuuugguagagacggguuuucaccauguuggccaggcuggccucgaacuccugaccucaggugaucugcccaccucggccuccuaaagugcuggaauuacaggcgugagccacugcaccuggcccucugauaacauuuuuaaauugcagaguuuaaacuuuagaaagaaggaauaaacccaccauuuuggggguauccaucaucucauucaguccugucaacaaccucugaaguaucuucccucuuuaaugguuggggaaacugaggcuuagagauacuaaguaacuuggcuaaggucacacaucuauuaugagacagugcuaaaaccuaaaaccagcauugcuccagaagaccuauucuuggcaagcacuguuuuuauuuucugcucacucuuaucccaguugguuccguggggacuguauacacuucagacgucuaaauguuuuuccuuuucuuucucauagaacucuaagaaggagcugauguggaggagcagcugagacaguucaagaugacgaccacaguagccacagacuaugacaacauugagauccagcagcaguacagugaugucaacaaccgcugggaugucgacgacugggacaaugagaacagcucugcgcggcuuuuugagcggucccgcaucaaggcucuggcaggugaguccuucacaccugucacagaggcccaggaugccuaaaaucaggaugccccuuaaaaucauccacccuguucccaugacgcugucauguucgaagguugucucacuucuauuuaaauguguccuugagagccagcugaccauuuuauaagguagucaguuccauauuuggagagcugucaacucuaauggccaaaauuauucagagcacagaguguuauuuauagcaauucaagaacagcugcccuaaguuuguaagaauucuuuuauuuuugacaaaucuuacauuccaaaauaucaaagcauacuauuccuuauacucaaaaauauacaaauuaaccuguguacuuagugccugugauacauuaacuggccugaccuguaccaagauggguuaguauuacacgcaaggauuuuacaucugaaaagcaaaagcugaaucugguaaaggcacauuuaauacaguaacgaguaaguuugccauugguccauuaguucguggaacauguccuuacuuugugauuucucauucccuuguugcuggugaacaccuagagcacacuuucuccauggccccagugagggugaggaguguuuuacccuaaaauugcccugaaaaucaggaaagcguucuguggcucugaaaacucagcuguacugaauauauguaaaccaaguaucaaaaccgaguuuuuucaagguccugcaucuguacuuugagauuucaaaugaaauuucagaugaaguuuauuccaaaugauuuuuuucuaaugucuuuaauugugacaaguaaaucaaagucaugacuugagaaguuaaguuuacuguuaauucuaacuacauaacucacauuuuuguugccuuuauaguggaaucugauuaugaagcaugcaucauuuagagucaucuugauuguggacaaaggaaaccuaacccagagugguuuaagugacaaagaggauuuauuggucacacaguaggcaaauucagucuuuaagcaagacuuacuccuggacuuaaauggugugaccaggaucuaguuucuuucucucuacucuggcuuuauuuucuagugcaggcucuguucacaagcaggcuccauccuguagucccaagauggcugccccaggucccuggcccccuuggacuauggacauccagcagaaaagaggaugcuuuucugcuuaccauggcccggauauaucagucucacuggcgugauugaucaugacuuggaucaugugcuucucccgcugguguuggagaaucucaugugcuguuaacuucuaaacaggaugcaccccuuagagugaaaguuuggucagucucaaccaaacaaguuggcuagaaagauuggaauauaacagaaaagaggaagaggagaauggauguuggggguacagcuaacaauguacuacagaaaaacuauucagcugcuuuaggauaauuugucucuugagugguguugauuuaaagaucuuucuugagcuggccugaaugaaugauuaaucagucacucuagaauuggggcuucauuaucauucauuaacauggaacucuauggagaucaugacccuggcuugugcuaguaaagugauuuguauuuuaaucucucaccucuuuuucuuguauuuucauuugagucuuuaggccaguaugcuagugauggccaguuaccuuugaucuugagucuuacuuucugauuccaggcuauguauuaucuccuuucuaaaggaccauuuuguuugcaaacuacagaacaguuccuuguucuuugcauguggucuuuccuacaguuugagaggagagccuccagcuguccuuaguauccaucauuugucuuaaccuuucuaggauguuuaccuaggucccucaguaacuguagucauaauaauagcaagcacucaauauaguacuuauacugugugccaggcacugugggaaaugccggcauauauuaacaguuaaucccauaacaaucauaugagagagauuauuacugucuacauuguauagaugauaaaacagguuccagagagauuaagaagcuugcccaagggcuuacugcugcuaaguggcugaaggcauacuaacucugcaguguauacucuuuuucaguauucaguaaaguaaaaaaaaaaaaaaaagauguaaagcucauuggcagagagcauugcuagugagguaauucaaacauguuaaaaagaucuuuggaauucucaggaaugcauccuguggucuagaagaaaccagggcaaaauauugaaaaggaaagaugcugcuuccagguuaaaugauacuggaugggggggcaggaauugcauucagugaauuuacaagauaccaggaaacccaucuguuggaggaagguaaugaaggaaauuaucuuauccuacuuauuauuuuacuuccuuauucugugggacagaagaaucucuugaguccucuaaaaaacuauaugcugauagcaggaguuacagaacaauucaguagugucuggaauagaacagugguuugaaaaguagagggcuuguuaaagcacgggaugcugauucaguaggccuugaguggggauaauuuacauauccaacaggccaggugaugcccuggcuuggggaucacauuuugugacugaugcagaguacugauggucauccaguccccuuccuucgguguuugagaccacuucaucuggaccgagcuaaagucuaggaagaaauaaaguuucaaacccaguagaguuaccucaaagauacacuugagacccuuuucagaagauggcaccgaaagugaagaaggaagcuccuggcccgccuaaagcugaagccaaagcaaaggcuuuaaaggccaagaagguaguguugaaagguguccacggccacaaaaaaaagaagauccgcaugucacccaccuuccagcggcccaagacacugagacucuggaggccgcccagauauccucggaagaccacccccaggagaaacaagcuugaccacuaugcuaucaucaaguuuccucugaccacugaguuugccaugaagaagauaaaagacaacaacacccuuguguucacuguggauguuaaagccaacaagcaccagaucaaacaggcugugaagaagcucugugacauugauggggccaaggucaacacccugauggagagaugaaggcauauguuccacuggcuccugauuaugaugcuuuggauguugccaacaaaauugggaucauccaaacugaguccaucuggcuaauucuaaauauacauaucucuuuucaccaaaaaaaaaaaaaaaaaaaaaaaaaaaaaaaagguccacuugaugugggaguggugugguaggcuaaccacuugacuuugaggaaagggagauaucuuccugucccuuauaggggagugauacagugauaggcccaacaggagggagugcuauugugggguuucugcugaacaugcauguucuaaagcgagacauuuugcuuagagccauaaaaauguacauaucacauuuccugugucccucuagggcuuucgguagauacaaucuaaucuagguuucagucugaauucugaggcagaucugcaaaacauguaggaauucaucuuuuaaugguguaguucaucuuguacugauaguggaaccaccaccugugcccuuuacuaagcugcuuucaggguuuauguaucuaaggaaauagggugagguaaacuacuuguuacuaauucucacccaguugacagauacuuccuauuauuagguuaucugugaauuguaaaaaacuuuuuuuuuuuuuuuuuuuuuuugagacggagucuugcucugucguccaggcuggagugcaguggugcaaucucggcucacugcaagcuccaccuccuggcuucaugccauucugcugccucagccucucaaguagcugggacuacaggcgcccgccaccaccccagcuaauuuuuuguauuuuucguagagacgggguuucgccguguuauccaggacggucucgaucuccugaccucaugaucugcccgccucggccucccaaagugcugagauuacaggcaugagccaccgcgcccggcuuaaaaaacauuuuuaaaauaacuuuuacuuuacgugucuucaucuuauucacccucaggaauugcuuuuaauucaaugcaguauaauaagaaauauauuuggucuuuguucuggguuccuggcauagagcuccuaaaaccaauggagucugccgagugaugggagugucuuuuguuacccauaaggugucccuuuucugacaccugaguuugugcuaauuccaugacuuuggguggggauagucucccaucccuagcuagccucaggaugaugcugugcacccaagacugagcaguuagagaauuggaacuuucagcaucauccacucaucuguggggggaguugguguagguaggguggggugcccugagaggacauggaagccccaccucaccccaguaccuugcccugugcacuuuuccauuuggccguuccugaguuguaaccuuuauaauaaauugguaaacauaaaggggaaauuguuuuccugaguucugugaguuguucuagcauauuauugaaccugaggggguucuugggaaccccugaauuuacagccugcggccugggacuuggaacuggcaucugauaugggggcagucuugugggaccaagcccuuuauccuaugggauuuaacaauaaugucagguagaggugucagaauugaauugaauuguagcauacccaguugguacuggggaaucagacuacuaagauauuucacaggggagauagcaucucuaguauaguaggcagggugucagcugguuuucuuguuuguuuagaaauggggucuuucuguguugcucaggcuagaguacagugguagagucauagcuaacuacagccuugaauuccugaucuccagugauccuccugccucagccucuugaguagcugggacuauaagugugugccacaaagccuggcuauaucgguuuuuguuuuuuguuuuuuuuuuuuaauguagaaaucaggccugugaucacuuguccaguaccagcuuaucauuacaacaaugaaucggccagcaaucagucacuuccagugccuaguucuuucauuuuccuuaaacucugcugcuugaaaaucagucugauucauaucugcgucacucaucgccacccccagcuccuuaguagccagaaacaucagcgugaugaucaggaggaaauacagagaacuugaccuggagcaccuggcaggauugaaagcaacagcuuuuucuccaagcagagaaaagcuucaucugaaagcuucccccucaugcaaguugaaugauaagaaaccucaagucuucagcuuguaaaaauuuaagacuuagauguguuuuaagaaaauaauuagaauugccgggcgcaguggcucacguuuguaaucucaacacuuugggaggccgaggcugguggaucaugaggucaggcguucaaaaccagccuggccaacguagcgaaaccccaucucugcuaaaaauacaaaaaauuagcugggcgugguggcgggcgccuauaaucccagcuaguugggaggcugagacaggagaaucgguugaaccugggaggcggagguugcagugagccgagaucacgccacugcacuccagcccgggcgacaguaugagacuccgucucaaaaauaauaauaguuagaauuaacauugaguauugucauauacuccaaaauuuuauguuuauauccaagaauauuuauagauauccaaaauauauuaacaugcaauccucaugaaaaguuauuaaugagacacuuuacauuuuuuauacuacgucuuugaaauauacaucuuuuguauauguaacagacuggcaagauauauacuuauuccuaaaguggaauguggagugaaaacaugguagaugguacuuccccacuucugagguguuacuguuuacaguuuggaaggaagcugaggagagcguuggucaauccuguuaacuagcacagugaaguaguuuuuauguuuucuguaaaugauugcuugcaucccgugauugcaggcccacuuuccugaccucugaccaguugccuugguaucauggaacaugcagugauucaaacuaagcuggacuuuuuggaaaccagcauuuuauuugaaguaaaaagaaaacaguuacacaauuuuuuaaagacuacgucuuccccuaauuuguguugauucuacugugagacaagaaaaaugcauuucugcuugaggugcaguaacaaaacuagcacaaauuucuuuccuucuuaacuauuucucggauagaagauucauucuuaacauagaccuuaucauuauaggauuuuuuuuucuuuucuuguugagaacuuuuacuuuuucacuuaaaggaagcauuugacagucgcuucuuuuuagcauaucugaauugccagcccagggccauuauuaagucaaauaaggguuaccugacaguuaaucugauaaucaagacggcugcuaagugacuaacagggagcgucugcagugugugucugcuggacaaagggaugauucacauaccaggcgggauggagcgagauggcgcaagauuucaucacagugcucaggauggcaugcaauuuaaaacguaugaauugccuauuucuucaguuuuucauuucauauuuccagaccaugguugacugaagguaacugaaccauggaaagugaaacccaggcuaaaggggacuagugugugugugugugugugugugugugugugugugugugugugugucuaaaccauuugacuucuagugaacgaacagagccaaccucuuccugaauauguaaagaaaucuauaaaacauggccuagaaugaucuaauuaggaggaggaaaccuauuuacaugagacuauauauguauacaagugccuggaaguuaguauaggcaaugauugcuguaguaagauggaguuucgcucuugucacccaggcuguaguacgauggcgcgaucuuggcucacugcaaccuccgccuccuggguccaagugauucuccugccucagcuucccgaguagcugggacuacaggcacccgccaccacaccuggcuaauuuuuguauuuuuaguagagacgggguuucaccauguuggccaggcuggucucgaacuccugaccccaggugauccgcccgccuuggccucccaaagugcugggauuacaggcgugagccuccacgcccggccugcuguaguaauuuagggggaaagauugaucucucucucugucucucucucacacacacacacacacacacacacacgcacgcacgcacacaaacacacacaccccagucauuuuaagggguagggucuagugaccuaaagagcacuggaacuuggagagaggaaucugggaccugagucucgucguggcugcuucauuuuccacugcagcaaaauugaagaggcuaggcugcaggucucugagaacaccucuccuuaaaacagaaagucugcuuugggcugcuuaagauaguauaugccaucucacgccuggacucauugucuaaaucauguuagggcucuucuuguucgcacaccuaacauucuguucagaggugacacuuuccugccccaagggaaagagaacagcuucuugcaugguggaauggguuuuuacagagaggauuaacagggauuuaauagcuacccauuauuuuccucaucuacucuucaggcuguaucccuaaauuaugcauuauuugggacuauuugugaaagagguguggccccuagcacacaguaacuauacuaccauuguuugugaaaucugaaucugaaagagcauuuuauauccaaguuguucaugaaagcuauugagagaaagucuguugaggucuuugcacguaguccuagauuauacccucaauuuauuuuucacauauaaaugguuuccaugguuuucucaccauagagguggaagaaucuuugcuuuacuuuuuuagguguaguuuuccucugguuccuucucccuccucugucuguucaccacuauagacccaguuucuccccugcuucugaaaucagcuuggauuccuucuccuguucuaccucagacucucuucucaccucagcaauggcugaaaucucacagucgcugaggugagugauccaggcaugggagaacaugcagauggaagccucgugcucccagaguuucugacuauucaccaugcacucaucccccuuccuggcccagccccuauuccugcaccucacucuuugagagcccagguucuccuuccucagucaccucagagaaccucucuugauccucauuccccuuuuugucuccuguuccaccccuagccuuugucugaacuccucauucucuccacuccaccagaauucuuucccuaagucacucacuuacuuuugaggcgcuccguucuucugugaaaaaucucauagaauugagaguugauuuaugacugaauuaaaggaauacaauugcucuucauuuggggacugccuguguaagcaaaagaggaaaaauguaugugaccuuucugccuucuuauccuuuuccuggcucugucugcauacauguucucucacacacacauaucagcuuuauugcaguacaauuuacauaccauaaaauauacccccuuugaaguauaccauucagcaguuuuuaaaauauacucagaguuaugugacaauuaccacuaauuccagagcauuuuuauuacuucccaaagaaaucccauguacguuagcgguuacuucccauuuuccuuucccccagccccaggcaacuacuagucuacauucagacccuauggauuugccuauucuggacauuuccuaaaaauugaaucauguaaucuguggccuuuuugugucuaacuucuuucacuuaacaaaacuuuuucagguuucauccgugcuguagcauguaucaguaccuuauuucugucucugcucucuuagauaaguaauagugguagauuagagagaaagagcagaaaauacucuguaaaagcuacuaguaccauagugcugugauuuuuauuuggugguugccuggaaacagauggcaaaucuguuguaggcaucagaaacuacuguaggccagaugcaguggcucacaccuguaaucccagccaaggcaaguggaucaccugagaucaggaguucaugaccagccuggccaacaugguaaaaacccaucucuacuaaaaauacaaaaugagccggaugugguggugcacaccuguuacaugugaguaaccaccuauucaggaggcugagacaggagaaucacuugaaucugggaggcggaaguugcagugagccaagauugcgccauugcacuccagccuggcugggugacaagagcaagacucugucucaaaaauagaguaaguacuguagacuuaggaaguuuuucauuuccccaaauguggucaucauaaaggccuauugguggguguuuggugucucagaugguucuauuuguugccguuauuaaauucacuuacacaguuaaccccuuugccaguuuucuaccaaaguggaccugugagaaaguacuaucauaggaugauaaaagguauaaauuuaauuuauauauaaggcacuuguaaaguuauguguauuuuaaaaauaaaacaugucccaugauaaaagcaaacucagaaugacacaaaguauauuuuuaaauuuaacagugcaacgcagcucucuagaauuuuauuuaaccuccaucuucagugauaccauucaauuuaauuuucuaauuaggagagaaaauugaugcuagguagauguuaaauaguuucuuaaguugcauuugauuuuugauaccaagucaauuaaagaagauaguugugauuauuaagcuauaaauucaccaguaguuugacaugaucauauucaauagcaguccaguggagagggguccaggugacagcagagcuaaauauuuggucuaugucuaaugauugacuucugaaaaaaaucaugcuuagaaaauuauuuuugguuagguccuucugguuguaaggaauacagauucacuugaguucucugaacaacaaagauaugugugugguggauaugggguaaaagaaggagaggccgggagcugugguucaugccuguuaucccagcacuuugggaggcugaggugggaggauuguuugaguccaguaguuaaagaccagccuggccaacauagugagacccugugucucugaaaaguaaaaaaaauuagcugaacacaguggcacacaccuauagucccagcuacuugugaggcugaggugggaggauugcuucagcccaggaggcugaggcuacagugagccgugauugugccacugcacuucagacugggugacagaacaagacccugucuuuaaaaaauaaauacauacauacaagagaguuauuacaaaguuucaugcaaaugagcccugaaaaaucuaugugacaguggcugcuguggaccuggaggcauuacuuauauuuccgaugggccaugcgccucauucauuggaacccucugcuuaguaucugcuccuccuugacucagcucacauguggcuuugguauacugucauuccaaccccagcucuugccuauccuuugccuuuuguccucauugcuaaaugacugaauauccuuguuuccuguaguucaaaugucuguaagguuggguacagagaugggguuuugauugacccggaagauccuuuuauaccagaucauggccaaccggauacuuagaguggauaccuucagaagagguguccccaaacauuggugaggagcuggaagccauauguacagaacacaucagcuccauccauccauagcucagaggcaucugacuggcaguuggaggauacuguuggcaugccuaaugcagaagaauuguggugggguggaggaaggcauuuuauaguaggacuuuuggggaaagagacuggaguaucuuggaugaucaagggaagggcuaaauagccaaucugaagaaagggugaagggccccuaggacaacagaaauuaaggcuuuucaucucuccaucucuuguuguuagugaccuuguguaagugggcuucugucucugccccuuguagguagucuucuagaugacaggaaacauggcugccaucugcuccugggcuucacucucuaccaccuuucauuuuuucugguuccaguuggaaauauuagggguguuugggagaaaggcuguaauuuaccaggcuuuacucaaaugucuagagcagugaacuggaguauggaguguggagggacauaagagcauggcagcucucccuggaaccacauggaacuguuucccccaaaggggaaaguuugcugggaagaugacaguaaguaacaaugaauguuuacgacacauuuucagauagacugauguucuugauucagagauaaagacauuuuauaaaaugcaaggugauguuuaccauugguugguuacuuaaaaaaaaggagcccaauaauggacaguuucauuuaagauuuuugaauaaacaaaauuaacaaagagaaacaaacauuagcguuucagucuuuagaauaugccuuuaacaugguguuucauuugcauugaaguuauugucuugugaauaugugugguugauaacuuggaaacagucuaucccaagcuugcaucuuuggauucucaagaaccaagcaucacucuuagagcaugacaggugcuuaguacuagagugccauucuagauucuuuagcaguacagugauauaaguacucuauuaacacuuuguuccuuacucacauguaaccucuuuuggggaauagacaauguguauaaaacaagcaaugaauuaauaugaaaguguugugauacuuccugaaaaccugaaucuuagccuuuucauccucugguugagaaauacaucuguuuucuacaauucuuauuucuucuguauuuuuauuaguuaaucuucaagggaauuugcagagcucugaauuuugaccucuuugcugcaagccugugaauuuucagaacucucagauaaugacaucauugacugauggguaccuguuauugggugaggcugauaagaauuuugccauucagguuuaaauuucugcagacgccuuagacuuuuugaacauguaugugaagucgccuuauuagucacaagauugugucuuuaggcauccuaagaaacagauggacugaagucggagaugccgggccauuugcggguucucagcccuucccuguguuacauguuuaccuauugguucacucuaaguuugcaggaaacccaagcucuccccacugccuccacucugagcuccagcccuggccaggagcccucuugccuguaugguucacaguaaccuuuccucuucaagaaacuuccuuggcccuugcuauucuguaccccauguucucugugucuuauuagugucauguguguacuuagguggguguauccauagucucccuccagcugaugacuaaauuccuugaagacagugacagugguaacauuuguuuccacauucccuacaagcaccucaccuaagucugaaugcaccucugcuuuuuauugagugcuugucagacugaagaacucauucauggucagagcuauuaauuaucacuuucaucuggggaaaauuuccuccuaauuuuugugauaccuauuaaagauuucuuuguguuuaauaauuuuacauuaaaaugcauuauaaaaucauguauuacauuguacauuacagugcaugcauugcaaaaaaaaguucaaacacugcagaaguggacaauaaauguuucucuuuccccaaagccuuucccaucuuucucccuaaagauaauuccuuuuaaaaguuugauguguaucuuuugagauauuuucuguguacuuuuuuguugagacagggucuugcucugucauccagacuggagugcaguggugcgauuuuggcucauugcgaccuccaccuuccguacucaagucauccucccaccucagccucauaaguagcugggacaacaggcacacaccaccaugcccagcuaauuuuuauauuuguuugguggagacgaauuuuggccauguuguccaggcuggucuugaacuccugggcucaagaaaucagcccacguuggcuucccagagugcugagauaauaggugugagccacugugcguggacucuguguacauuauugaaaacauuaugagcugaauguuuguuccucccacucaaacucauauggugaaaucuuaacccacaccaugaggguguuaggaggugaggucuuuggcggguaauuaggucaugaaaguggagcccucgugaaugggauucauguccguauaaaguagacaugggaaaugaucuuucucccuaccaugugagaaucugagaggauggcugucuguaaaccaggaagagguccuucaccaagaacccaaccaugcuggcacccugacuuccagccuccagaacugugagagagaaaugguuguugguuaaucucccagucugugguauucuguuuuagcagucugaacuaagaugaauuuuucuuuucuaguaauaaacagaaguaagaccagcugauugauagaauccuggaguuuaaucuuucuccuaccagaauauuugucuuagauuuucauucuggcagugucuguaugauguuaacaugcugcaauguuaacuugguagagauggguuugggaaauuuaaggcauuguuugcuagcuuaguagaagccauuacacagugacucacacguccuuuacuguggauuuggccccugccuucuuuugugcuccagguaucucacccuaagguuuuuacccuuuuugguuaaaagaacuaaagcuaaagauuucuuuaguuuucucuuccuuccuuaggucacugggauguuucuggagcucuucccccuuugccucuuuaccuuccauguuccuuggauaucaggggcacucaguagagggcaucucuaaagaaacuaucuccccaagguuggccugcaguuugccuguguuauucucugucaucauuagccuggaguacauguuagcaguugaaguuugagaauuucaugguuaauuuuuccaaacguuggccacaguuuuccuggagaacuguauugugacaaggacauacagaguauuaggugacuauagugaccaagcaagauagggaauggaauguuaaaauuguaguaguuuauacguagauuaccucuauuuugcugcaacagccaaaggccauucaucugccccucacuguagagcacaaguggaggagaauguugucgucguuuuaacugauguguaauuuaagccuuuuuuccugugguuaauaacaacaaaaacaaucuaguaacuuccuaaauccaugccacuagcagcauguuauuuagccaguguggcucuccaguuagcuuuuaccuuuuucucuagccagggacauguauuugacaguuccauggauugccagucccaaagcuguuuuauaugccgauuuuggagaaguaagccuacagaccaaaucuauuagccccauuauaugucucuacuaugaacauacacacuuuuaugccuagaacugcagaggauuugugugugcuuccagcauuugcccugggccccuauacacacuguccauggaauuauacucauugucuccaagcauuugaaggaaggccaguguuaguauggaugcuuguaaauaauguagaggcauucaagacuaccuugagaaauacaggauggagaagaggcgaggcuggaggaugcacuugauacuaaugugaaaucuaaaaccccucacacugaauuaacaguuguucccgugcagcuuuguuugugcauucauuuaaucagucguaaucuucaggcaugcccacauguggauuuucuuuuuaacucccucacauucagggagccauuuuaauugacauacgcaacacaauuauuguccgaacugaauuuuaugaugggggaugauguuucuauguuuuaaaaaacucaauggaugacuucagaguacucauggagauguaaccuauaacugacuugugauuuugaaagaaauaauuuucaaccauuucaguaaggaauauauuuuauauggcaauauaguacacauaaagguauguauauuugagaauauacauacacauaaauguauguuuauggguguauuuguguguauccacacacauuuaaauuucacaaaguaguguuuacguguaccacaugagaugcucugauacuuucuauucuauuccauuuuuuaaaaugcuagcauugaucuauuaauucaauuuuauuacaugguguuggaauauccugugguaguuagguacauuucaaaguacaccuaagugaucuauuuuuaagcuuuauuagaaugagugcuuauugauuuuguuucauucauuuauuagugaaugaaugaguaaaauauuugaguacuuaacuaugugccaggcacugugaucggugguagaaacacaguuaggugauuaagugaaaacaagucuguggucagcagaaaagauuuucaguuuucacagaggagaguuguugucaguagaugaaagggauuucaggccaagcaagcagugccaugaauggccugaacaugcauggcuaugucgagaugccaugagaagagcugcagaaggagcucaaggcaggacuauaggagugaacgaggagugccguggugccaaagaguuuagccuuuauccuguaggccagugguuuccagaaucuaucucaggagaauuuuuauuuucaaauagaaaacuguuaauuaaucucaauauguaaaacuaccaacuuggaguuacgcuagaagcagcagaggacccuccccuagauuuccauccccagggggcucaaggccauugugacugccccugagaaccacugauguggaauuugucucagaaggaucccucuggggacacugugaaggaaggcacagggaggaacgccauuuuaggggacuguuguguucuuccagggaagaaacaaggcccugaagcugagauuguggcugagggcuugagaaagcagggccuuuucaacuguugaauuagacuuccuaggacaugcucuccaaggggaugggaaagggaagaggaaggaagaggaauuugguuuggguucugugaagccucuggauguuggaugcuugggauagaugagggucgugagguauuuuggucacaaaucugcaagguuuccccuuucuaucguguggccucuaguuuuuaggauuauguuuuucuuagcucauauuugucuguauucuguccagccuuuggaaacuguaugggcccugaggcucucucagucugccugucugaauacacuuuggagguccucccacugcuggagcaccugaauguuccuggguuuggauucagcuauccaggacuguccaucucggggcugaugcugaggaaggaaggauggcuucagaggccuggagucccacaugaggucccugcucugucgccuacuagcuaugcgauggugggcaagugacuccuuuaggaugaggauaauauccaccuuaugggaauguugcaggaacuuaaaauaauguggaagauuccuagcucggugucugcacacagugggcaugcaugugaaguguuaauuauaacauuucauuauggaaauaaaucuuuugaagggagggcuucuauuuccucccugcaaaaaggccuuccauauugagaaauauugcauucaugcaagggaagaugaggagaagccaaggaggaggcaggaacauucaaaaggcacauguucugauggccugacgacacuggggaccuguggcuuuguuugcugugaaguuuagagggcauuugugacccucaguccuucuccugggaagcaggaaaagcaccaaaaaauacuuguuuuuuuuuuaauuaaaaaaauuaauauggucuuugcauuuguaucuucucucacuguacuuuccuguuucggauuugcacucaaugcacauuaaaaugauccugcauaauccuaaacauuuauugagagaaugauuuaauggaaaaauacaauaaaaauauuuuaaacuuuugauaaauugguccccccucccaccccaaaaaaaaugacugagguuggaggaagagacagaugggagugggagaugcauguucuuuggagggagagagacauggucaguguagaacaauccaagucagacaggcuggcucuuaccggaagaggguugguccuucauggggguuauuuagcuuuagugcucuguuccucuuuguugagacagcuguaguuagguauaaggggauaauaaagaagaaauauuacuaaauucccgggaggauuauuuauaauacuuaaaauguguguaucacuuucaucuuggagaacauuauagaacauuacuauaauacuaauagaagucuuuggaaagcauuauaucccguguuacagauuucagucugagauuuucugaaucagguuguuguuuaccccagcuugcucuagugguaauauaaaucagaggcuucuggguuccaggcaguaauugaaagcuucugaugccuaucuuugaccugccuuuuccaaccuucuuggaaauugccuuccuucacauaaguauuuguagggcucugaauacucuuuaauuaauggggggaaaaucuucuaccucucccuacaauuacuccauauuagcaaauuaugaguaagacuuugagauaccucagguaucucauuugugaugucagagugguuauugaacuuacuaaaccuuucccagaagagccagaccuugccuaaacuuaacgaaaagguuuagaguugagaaucagauacuuuuacagggucauuuuugucuguuuguuucugacugucaagcacaagagauacacaugacuaauuuaaaacaggaggccuaagagaccuauuaaaaaaugucaaacauuuauuuguacuaaauacuacaucaaaaagauauggcaauaugaauaagauauagagauauaaaauauauccuagauaggauuuuugguaggcuauacaaacuugaacaaaguuuuaaaaaggaguaaacuuuuauuuuuuuauuuuuauuuuuuauuauacuuuaaguucuaggguacauguguacaacaugcagguuuguuacauagguauacaugugccauguugguuugcugcacccaucaacucaucauuuacauuagauauuucuccuaauacuaucccuccaccagccccccacuccccaguaggccccagggugugauguuccccgcccugugugcauguguucucauuguucaacucccaccuaugaguaagaacaagcgguguuugguuuucuguccuugugauaguuugcuuagaaugaugguuuccagcuucauccauguuccugcaaaggacaugaacucauccuuuuuuauggcugcauaguauuccauuguguauaugugccacauuuucuuuauccaauguaucauuaaugggcauuuggguugguuccaagucuuugcuauugugaacagugacacaauaaacauacgugugcaugugucuuuauaguagaaugauguauaauccuuugaguauauacccaguauacuguuggugggaguguaaauuaguucaaccauuguggaagacaguguggcaauuccucaaggaucuagaacuagaaauaccauuugacccagcaaucccauuacuggguauauauaaaacggaguaaacuuucauuuaaggaaggaugaaguuaaauaagcaaagguacccagagaccccacuaagugauagauacuagcugaaugcuuuauuuaacaagccuacuauucuauugcuaaccugccauuagaaaaagcuggcagauggacauuaaaauccagcaaaacuauuuuuagguaacaaagcuuuuugauggcauauacaaaaauggauucagauggugguggguggggggcauugucaguacuguuacugcaaucaggagcucugggaguccacuggacuucucuaacuugacuuuagagaacuccaucuagccucucugucucaguguccuuaucugaaaaacaagggggugggcuggauggauucugagggcccucagaccucuaagauuguguauaugcucuuagggaguuagcaugcuaacgggcuguugcuaccaagguaaguuuuggcauuuuuuuccuggugguuucuguguacacagugagacacagaguguguauugguacagggaugauagcaaccuuuguccuucuacaggaaauaaugcccugugacucugacucaagaccuagucucuuguuaauuuuuguuaauguuuuaugcuugaugagucagaaaugcaggcucuuguagaguguuauuaacaagaacuaguguaacuuugauuauaaucacuacaaauuacagaccucuuuccuguguaaugauuuuugccauuugcccuuccgugaucucuaauaggccaacuacaaggacaauuuuuugaucaguaagaaccuuggucuguugcuucauaagcccuuauuauggcaaaauuauucguaacagcaaacuauguauguacccacauugacagaauaucaguguucuuuagcuggcugggcaaagucuaaguguuucaggauaguugaugauggggguaucacaaaaacuucagaguaagaaaaacuugucugauaucuguuaaagugaucuguauacauguaggcauucuccuguauaugugcauacacacacuccuaaguuguguaaauguguaccugccugcuugaguaugaugcauugcuacuauuucuaaacuaccaauuuauuuccccuguguuuugaggacucaaucucaaagaugcugacugaaaaauaaaguuuuugaacaauuucaugaagguuggguugucgagaucaugaguucugacucuaaugacaacucugugggaaauggauaaacucugauaaacucuaucgcacugcacacaaaugugaggcuggaaggcaguacguaauuuaugaggccuuuuguuguaaaaaugagaguuggcaggauuccgaguaaauaucuuuuuuccuaaggguggaagauaggacuuggagagaucaauguguugguugacagcauuugagaauguuugauuugagcuucagcaucauagguggggaacauguggcuuuauagaucugcuguuucuuccccugcccaguggugcauuccuugucuuuacugaaguauguuuuuaaaauucauuuuuaauggugguaaaaaaaaaaaaaaaaccacauaacauaagguuuaccauguuaaccauuuuuaaauguaacuucaguagaguuaacuauguucauauuguugugcagucagaucucuagacccuuuucauuuugaaaaacugaaacucuacacccauuaaacaauaacucaccacguuccccuucccccagcuccuggcaaccaccauucuacuuucucuuuccaugaguuuaacuacucaacauacugcauguaaguggaaucauguaauauuuguuuuuuuucuaacuggcuuauuucauuuaacaugauguccucaagcuucauccauguuauagcauaugacagaauuuucuucuuuuuaaguaauauucaauuauauguauaugccacauuuuguuuauccauucauccauugauggacauuagaguuuucaccucuugcuauugcgaaugauacugcaaugaacauaggaaugcaagugucucuuugagauccugcuuucaguucuuuuggauauauauccagaaggggaauggcuggaccauaugguaguuauauuuuuaauuuuuugcagaaccuccauacuauuucccacagcagcugcaccauuuacauuccuaccaacagcguacaaggguuccaauuucuccauauccuuuacugaagcuuuuagaauguuauucaaaauacgauauaauggaaaaaaggcaccaacguggucucaaauuguguuuuucuugguagaugguaauuaaaaggguaauggugauuaagguaucggugauaaaaauaguaaugaaaagaggugaguggagagguaguuauaggugagcuuggcagguauuagaaaagagcuuagucuuucucuucuuucucuucauucuucaccugucauuaaaauucuaguuguggccaggcgugguggcucacaccuguaaucccagcauuugggaggccaaggcgggcagaucacgaggucaggagaucgagaccauccuggcuaacacggugaaaccccgucucuacuaaaaauacaaaaaauuagccaggcgugguggcgggugccuauaguuccagcuacuugggaggcugaggcaggagaauggcaugaacccaggagguggagcuugcagugagccaagaucaugccacugcacuccagccagggcaacagagcgaggcuccaucucagaauaaauaaaauaauucugguugugaugaauaaauccauuugucagguauuuuuuuaagugccuccugaguaggcuauuccucaggacaccauaagaauaauaaaggaaagaucaauguauaaaacugagaaaaaggauuuuuaaacaacaaaguuugcugaggccaacuuuguguaugguucuacacugggcuggaaagaugacauggaagcugugcuuguaccgcauccugggcugucauucucucugagcuggugcaaguuggacaucagagaacauaaacagauaucacucaucuagcacucaggacaggccuuuuggcuccaccuuugugguggaugcuggaaggcaguggggaaaggacauuaaggugaguuuucccugauuccaagcccugggcccacuucauugacuggcaugagaaaugcacgcuacuuccuuugugcuuagcuuccucuuccuucagguuugcucuagaaauggcagcaggaauucagaaggccugcuuucuaaucuccagcaugccgguagcuugcuuuguaacucugggcacacggcucugugccucauuucucauuuuucuuacuauaaaugagauggguuggcuuagauagaggaauuuuuaaaaggaacuucugacaccuguuaggacuuucagcuaucaucuucugacugugaaagauuaagguaugcaugaggggguguuaccuaggcuggcauaggcucucugagucaccauauggugccaccucccucacagaguccuuguuuucaucaguguucagcuuucaaaaauggcuaaaucauuuuuaacuguuccuuaaagauacugggcuggggguauagggugaagguucuguaagacuugcauuuggcugggcacgguggcucacgccuguaaucccagcacuuugggaggccaagaaggguagaucacuugaggucagaagccuggccaauguggugaaaccccaucuguacuaaaaguaccaaaauuagcuggugugguggugcgcgccuguaaucccagcuacucggaaagcugaggcaagagaaucgcuugaacccuggaagcagagguugcagugagccgagauugugccauugcacuccagccugggcaauaagagugaaacucugucucaaaaaaaaaaaaaaaaaaaagacuuguaucuguccuaaaacaguuuauaauauuuuccaagagcauuauguccuccaugcugcagcauaugacaggauuuccuugcuuuuaaguaagauucuguuguauguauauaccaauuuucagagauuuucuauuucggauccuuugguuuuagggaaaacauuggaaaagccaagugaauggcucauggucacauagccagucaguguuaaaagcugagaauggagugugcccuucacuucucuugagucugugucugguguacuuuccauuauuuuaauuaagcagauaagacugguacacaagaagagauaagcaaugcucucauagaguguaugauaugugcuggacgacggaggcugacagugcugguguagaguuucuaagaaggagccaucaucccagcuggguaaucugggaagccuuccuagagaagggaaggcuuugagcugggcuugaaggaugaauggacuugggacuaaaaggugaggggagggccaagagcagaggcauggaaagcccaagacagguggggcacugaucaguuuggguguagcagaggggacaguuaggaggaagagauggggacagacauuuauugaggaucugucuuguguugggcacaguaucuggucuuugcccaugccaucucaguagccugagcaugggaaugccauccuggucaugcacuuguuugaggacaucacuuucucccuaccccuugggacuuaucuuccuuacaguaaaagucagguguacuuugauccugccagaaauuaccugguuuaaaauggggagauaaagcaaagagggaaggguguuuuauggugucuguaaagaaggucucagagguagcuauaguauuuauuuuacaguaaucuggagccugccuccuacuuacgaggcagcuggcaggccuuggcgcuccugagugacugggcuguccaugaauuauucaggggcugugcccagcgaguggcugccuagcaaaguccuauggcagggaggcugugcuaucucagugagagaucagcagaagcucaggugcugaggaggaagaaaugacugcacccuuaaaauauuucacauuuuaacacaccagggcugcacauguuguuccauaucucugcaacuggguaaucgguaccuguuuuucaaagagcaagaaacacaccccacacccccaacuauauuaccuacacucucauguuagaauggcacaugucagcagggauuugguuagaagcaacauuaaaauugcauagauaagaccgaauaggaacagagaguguuuguguggaagaaauccugcucugauauuuucucagccaaguagagaaauguaguuguugcuuaauuuagaaugguacuuacuguaacuaucaauagcuguuacugucacuaaccugucauuuguuacauauuacacccuuguguuuguguaugcauguguccuagugugucugauuuccucagcuagguugaaagucccugcagagaagaaaucaguucucaccaugucaugggucccuccaauagccuaugcccauggauggggcugagaacgugucagaugaguugacuugggcucucuguaggggaggaguaugucuugacgaugagauuugcaugucccucaccuuucucuuuucuccuacccucuccaagugccugcccuaccugcccuuuucacauuuucuuuucacagcuccuggaaaagguaauaugggugugaauauacuugagggcaggacccagaggccuauuuucacaaagaauagauuuguauuuauuccuuacccauuucuuucucaugagcucugcuacccagggaacaguaucuucucacugccccauaucacucuuguaaaacucuggccuggauggcucugaacaccugugugugucagcuguuccccuccauguuggaggugaaaagcagaaccaagaacucugggcaagagcaggccuggccucaacugcauuccucagauguucuuuuccuuuuaaccacucuaccugcaacagaggagcccagcccuggcucuggcugcuguuacauucacaggcauagcaccaccuguuuggcaaagccagggccucuggaccggggcauucuuuugucugugcagggaagcuuugcauguguagauaacagacacgguaagaaugcagggauaagguuuggcugggguagaagauucaauaaacuacauucauuccccaggaccuugggugcuuguuuccaguguaacuugccguuuuucuccucagcagugaucucagguguuuuguauucaggucugauaugaccaguuaggcaagaaacaggaaaaggauauaaauggaaaccagcuuugcccuguuauuucagauucggcuguauacuuagaugguuuuauggguguggggggaauggggggaagguguaaagagagggagaaagaaccauccauaucuuucauggaacagagauaauaauuccuauggauagaaaaauaucuuuuguccucucuuuuuuuuucuuguuauuuugaguccugaacuaucaaaucugacagccccaccucaaauaaacauuggcuuuucuaaaauauaggacuucuguaacuuguuucauaguaaguauuguguucugguuaucucugaggugucacugcuauaaaaugugauucugaguaugccuuucccagugcauaaugggcugaguuaaagagaagggaagggagggguaucaguacaucccagagggaggacugguccugccacugagaaaugcccuuugccaaaaauccagaggaguggucacccuuguucccagccuaaguucugugauuccacaugaaacgcaacaucgugcagcugauagcuuccuuggugaaguaagagauggccaaaagugggauagaauuaauuuuugaaauuucuccuaugaggagauaaagccuagcaauuauagccacgaggacuguacuauaauaguaucuuuguagacauguaucucacuuaauuuauaaauuaauugagauaauuuauaaauuaucucaaccucugugagguuggucccauuauuaugccaacuuuuuaggcacagagaaccaagguuaaaaauuggcagagccagcuucuuaggucccaggucugcuuuuuucuuuuuuuuuuugagauggagucucgcugucacccaggcuggagugcaguggcgcgaucucagcucacugcaaccucaaccucccagauucaagcgauucuccugccucagccuccugaguagcugggauuacaggcgcccaccaccacaccuggcucauuuuuguauuuucaauagagacuggguuucaccauguuggucaggcuggucuccaccuccugaccucgugauccaccugccuuggccucccaaagugcugggauuacaggcgugagccaccacaccuggccccaggucugcuuuuaaccacuuuuucuccuguagcuucacauguccaagcccugauucaaaugcuuacaugggcgguacucuguaaguugagaaguggucucacccaugguuuucuaagaguagugugagucgugaggggaggggaagugcuccugacugcuucuagcugcccaggccaugggccuugagugggaggugccacuggggagaaaggagauguucuaaagagguggcaggcagguagcaauggcauagaaauaccagugucaaaugugcuaugccaguagggcuuuugaaaauuguucuuuuggggggaaaaggaggcuucauauaauuucuucugucuuuucuuuuuugcuggauuucauugugguaugcuugguuaguugguugaguuuucugguuaguggggaaauuuccauugaaaaaggacuagguuuuuaacagaggcagguuuuagggagaaaagaagguggcaacuaguaguuagggagugggaggcucuuugggaguuaguggaaagaaaagaaugaucucaguuaaggauucaagagugggagaggugggcaagagguuccuaggaagggagugggugggccagagagguaagacagaaagagaacuagagagaugagauagaaacauaauauaaaccagugcuuagugcagcauaaaugcaguggcaugguuuggagccgcuucucuaucuggccacgcuaauggaagaggauuauuuuagcauuauuuugguuuccuguaaagaaaugcuuaggagaaauuggcuguggucauccaaugccaagggacuugacaccgaugaagaaugaaagacagauguggagauggcaguagaaagcagcagagaauuugacaaaacacaauccuauaugaaacuuuguuuucugucccucccuguucccaucacuucuuucccagcucucggauugguuuuucaaaucccaagguugaauguguacaaaucccaucacauuuugucauuuuggacauccucucccagacacacugagucuugauagugucuggauguucaggaaaugaacaucuaaaguuuacccacucaagcuugcuguaaugcaggaaaagcauucaucuuucuuuccccucaagacuguguaaagccucuuagaacaaacagaggcuuaaucuuaccuugccacaugcuaagucauacagaaucuuaguguacagguccaccaaguaugagaagaggaacaaaaccaaacaagaccuaauaaaacccacucagaaccacagaacacuucaagcagcaagcucuaggugaacuagcagagcaugugccuaauccugacucaaaacuaaauguuguagagguucguguagaggccugcuuggguuuuagguuaaucuugauaccacuuacugaguucugugauuuuucagaaaagcuuagaaacccauaguaagcuggauauacucugagcauaugggagaaacagcagagguggggagauggggagcacgcugacuugguggaucugggguccauguguugguugugccacucaccagcuggggcccugggcaaggcacuguauuucugugaaccucagcuaccuugguugcaaaauggugaccauaccugccucacaggguuagucacuugagaaaauauauguggaagcauucuguaagcuaccaagugugaugguucugguuauuacggccauucaguuuaaguggagauugaugauaacugggacugcaguuagaagugggaccuaagcagggugaacccaaaucacuaauacauuuaauacuaaacauuccagaaggaauuuuuuaugaccauagauuccaaacuguuugguuuauagacgaagauugagaggcccagagaacaucagaaacaugcucaagauuacauagcuccuugguacucagaaauuaggguaagccugagucccugacucuggacuugagucuuuccaccagcccacagcacuuuugaucuguuccauccauaucuuugagccaucuucccacuggccuuuuccuaccuaugccaacuuagggcugaaaccugugcacagaggacauacucaguugggcccugccuuggaacaucuuccccugagucugauaacccucauucacuagucucaucuucauagcuucuucuucguccuccuccuccuccuuucucguuauuuucuaacucccuguaacccagcuuuugcuuuuauuaacccaguugaccugcuaauuggcacaccacaugccuuuucucuaaguuuuauuuuuuaguuuguuuguuuugcaacacuuaagaccaucuacccucuuuccucuuugagucucucuccuuagauuuucauucugcaacucccuggcaucuccacugguuuuucuucuuucucccaaacccaggccuuccccagggcuccaugcuuagccccuugccucuuacuuccuuuccuagauuuaaccccacaacuaucucaacucccaccucugcacucaggacuguaucuucaguuuugagcucuaguuccacaucccugacugcuccagacaugucacccagugguauugcagguaacucagauuccaccugucuagaaggaaaugugcacuuguccccugcaccccucuagccagauguaaaacccugagagucuucuuugucccuuuccuuugauccucccacauacaguuaguuaccaaaguccuuuggauuaauuuuuacgucagcccauucuuuuucauuugauugcuccuuugaccuggacuguugcacuaaccacccaguugaccuugcugccuucauuuccucuccuuucugcccauucuuacauaccacuuccagauuaaucaucucuagaguccagcccacacccucuacuccccuggcucaaaagucuccaguggcuccagaccaggcuuaguucuaacuugcuuuucggggcuuuccucccagccugacgguuccuuauccuccagccaaacugcagcacuugcuggugcuguuuccugggcauccaugcuuuuacugugcugcuugagaggaggcuucucccuuguuccagccuguugaugucuaccuguguuucaagguuugaucaaaaugccagucccuccuagaguucuucccaccuaccuuucuccaaaaggcagauguguccuccuuguccucugaauucuuagagcuguccuccccuggcccuuacuauauucuuuugguacuuuacuguuugcacauuugucccauuuccuuuggcuagcaacacuccuggucacuucugaaucuucuaaaacaccuggcagugugccuugcacacauuaaauacuguaaauacagaacaguaaacacugaagaaauaaagaaugaauaccucuggccuuccuuuaccuccuccccacuucugaacuggagguggucagaugggccaucagggaucugucuuauucuucccuggucccaucacaccaaauggauucccauuucuuacuucuuauccccgugggguuauuaaacccuuccccaguguccaaaccuuucuaauacuugcauguguucacucugccugguucauucaguguuggcuucacaggauugaguguggcuacguucgucccagcucuacugccaucauauuaugugcaaccugguuaauuaaaaauuauuucauguacuaacccauacuagagggagcugaaagggagauacugaguggugacucccuuucuucauuaaguggcccaaugauuaaaacguuauaaguuggcaaagcacuuuguaaucucauuuucagugccauagcuggacacuuagagacuuaucauuucaccaguauacuuaguugugaaaaagggcuuguuaaaaagaucuucauugagacgguucccaauucaacuucucuuguagucuugaugugguguguguguguguguuugugugugugggcggggggugaugaaaggaggggugcauuuugaagaauauacucuuaauuuugaaaguaugauaauuuuuagaacauuuccacaucaucuccucagugacccuguggaggugggcauuaauuauuacucagucugacagcugagguuuagaaagaauccaggguuucuucuaaggucauaggguaauuaagaggcuuggccaggacuagcaacucaggucuugggaauccuagucaagugcuuuuuccaagaccaaguguuuuguaaugcucugccuagccucccaucagcauugugaauuggcagcacuuaggggcuuuaaaaaauguucuacaucuuagaugauaagaaauguugucuucuucagguugggccuggcuuucaaaagccaaagguugacauguggaaguauuaaaaaccuaguuauguggcuggaaggaguuggggguuguucagcguugagcaguuagcuaggcucuggguuuaauucuaagccuggacaggaugcaguuacuucaauuacaagugcccuggggacugaggugaaccuggggugggggaccacgucuuuacuacauauugggaucccugaggaaugaaauuaccuucuucagugaguauugcuguagggcuccaaacuggaaaugccaaaaguguaauuuguugucugccuguuuagguagugaggaaaaaggggggacaggaggguggagagagaggggggagaucuagagucaauuucccaagaauacauuuugaucauucucuuuucuauguggaagauuucauuuuugguugagauuggugggagaagaagcugggaaggagagauuuaaaauuuuggagaaccacaaguuuagaggccuuguuuuacaaaucagaguaggaauuugaggguaguuucgguucccucaucuccccuccggaucauaaacaacuccaggucagggaucucggcgguguuuaccuguguaccuuuuucccacaaugccuugcaaaucggugcucccauaaaucuuccuugcgucgaauuccuaucauaggcccguguuauuccaggaaaccaccgccuucauauccccugauggcagcguaagucagccgagauucuucacugagcccgaacuuacaccuccccuggcuguggcgcugcacagcgcccugagagugacuuugucugacuucuucccgguggcucgccgggccgccgccgcgugguuggcgccagcgcacuggggcagucgcgcgcgcccaggugcgggccgcguuaccucagcagacgcuagagagugaaugagccgcgcgggcccgggacccuuggggcucuucacucuccaggccgucccgugggcgcgcuagccuuuucaagugauaguaaucggagacuuuuccguuacaugaggcucaacaaaagauuguaauuccagcagcucuguuugggaaggcacuaccgcggcgaguccagggcccggccgggggucggcggcugccgggcggcuggggcgaccgcggaccgugcgggaccgguagggggucgcgggccggcuaggcucccccgcgccccuccucgugguauagccugcauuucuaauacaaugcuguuaugcuaaucaggugacaucaccgcccagcacacggcgaguggcuccugauaaaauuacaaaccggcggccgccgcgggcagcugggaggaggugugcgcgcugcgcccgcgagcucccgggcucggcaaccguggcaugcuuaggauuggccauauuuaaaaguucugaaguagaaccugcgccuccucucugcuucucccuccuccucaguaauuuauuucgagcuuccaggcaagggccacggaagaagggaaagcaagaaauuagaugccugugugguaacuccucgcggagcuaagguggacucucuugcagccaacuucccaucagaucacccugcuggacuugcagaccggaauggggcucgccuaaggagccgagcgcugcggaggcugcugcguguuggaugggagugggagggggcuggagcgagauuuccagggcgcaguccuccggggcguuacgccgggcauaauggaauugcagaggacgucuaguaucuccgggccgcugucgccggcguacacggggcaggugccuuacaacuacaaccagcuggaaggcagauucaagcagcugcaagguaagcccccucccaaaggccgggccuguccugggugccaacggggguucuuggaggcuuuauuugugacccuaaugaagacgggcggcuucacagcucggccccagacccugugguuggcugcgggcaccccauucacgacuuagggaaggcaguugcucauacuccacuccagaagagcuaccauuuggagucccugucucuccagcaccuuuuuggcuuucuagguugucagauaacugcugcacacacauuuucuuuacuuuuagcuaacuuuaccuccuaguagaucagugcucauagacuuauuaguaugcagguauuugauuccgggucgccucuggcucccagcccccagccucuuaccucugggaagcuuuaaagguguaaagugccgugcucagacccaguccuguagaacaauagcaaaggggaggagggaggggucuuuuuguuccuaagccuuugguaaauuacaguuuuuuauucagaagcuuaauuuuaauuuuucugauguguugggaagagccuucccaucuauuuagugggcuauauaauuucuaaugaaagccgguuauugucauuucaacccuauggguuggauuaguuggaucaauuacagguuucuuggagucuuuuuaaggcucagacaauugaaugaguccaauauuuuacugaacauauuuuuagggagagcagaagccugugugugcaccagugugcuguuuucccugcggccccugcaccccucagcugucccugcccagccagcaggcccuggccagcagugucucagagcuuauacaugaaaaaagguuccuaacugaaaacagaacuccuuccguuuggaagccccuggagucaguaguaggcugggaauggcucuagcacuguaaaaaaguaguauucgaggacuguguguuucuuauuuuaaccuccucagugcugcaaaugugguuccugugaggaggaggaaggaaggaagccgcucagcccuagaauguuuuucauugggaagaggggggaggaugucuuucauucauugguuuauuugucuugugaaauaguugacaguaaugacacuucucuggaaaacgaggcagaacaggacgugauuuuaaacauuugcugggcugugccacauuccucuggcaguuagcucagaggaagcucccuucgcucuggggaacgguucugugucucuuugguucauuucucuugagcucuucggcagucaaauuugcuuuuuugaaaacuuaagcugggggcgcuugcaaguaguaaauagaggaguuggggugggggggggcguucauuaucuagguuuguuaggggccucacgguuuucgggucggagaauccacugcgugcuccuccucuuccccuggcccggacucccagcuucauugugucaucccgccugggggaaagcacccaccgggaucgucagcccacuccaccgccagccuagccuggaagucucagaaaaaaagcaaaacugggagaaaauagaaggugugagggaggagugcaccccuaggcccacccauaacaaaaggcuguuauuccgaaagggcugaggaagguuuuaaaacugcucgccgagaaggguggagccuacacacaggaaaugucuuaacuguccucucuggacaacguaaaguuuaaauuuaaaaaaaaucaugugccccugauauuuuaccucauacgcuguuucucaaggaaaucccuucgaaagggguaagcuucguguuuugugugguagcuuuaaaaauaauuuuuuuuagugugacccuugucuccuaauuuagccccagugacuuucuuauuuuuaaauauugugguuuaggaguugcacaaguuuaguguugguauuucuguagcagaaaaccacccauguugaggaauugagaaagggugaauuaacuuucaaguaugguggaccucaggagaauuacacacauuugucagcauccuucagaacaaaugaaccgauugcauuuuaaacaauccuaggagaauuuugauuaaacacacacacacaaaaccuuucuuuaauucccaucccugguuuuguguuuuguuugguauuuguaguucugauuaucacauauuuuugauaacauauaauuucuaucugcugauuuaauuuuguacauuccugcaagggugccuuuuuuuacucuucugaguauaaucuuuccuagcacauaaucucugaauauuggcaaaaugcuccucugaaacuguauuggguuuuuuguuuucguuuuaagagacagagucucacgcuguugcccaggcucuagugcaguggcacaaucacgacucaacagcagccuugaaguccuggcucaagccauccucccaccucagccucccaaguagcugggacuauaccaugucuggcuaauuuuuaaauuuuuuguagagacagagucucaccauguugcucaggcugguguugaacuccuggccucaaaugauccucccgccuucacuucccaaaguguugggaucacagaugugagcuaccuugccaguccuguacuggguuuaaugccucugauaugaacuuauuuauguauugucugugccugauagugcuaugauuuuucuggaguuguuucugcauuuuggcugguuucaaguuacuuuccacacuggguccuaaaaauuucaggaggugugccauagaaugagauuuggaguucuggcuaaggagaauauaauuuuaaaaugagucuggucuauuuagauaaaaugguuuauagcgauuuauaguuuauaaauuuauagagauauuauaaauuuauaguuuaaauauaguuauauauaaauauaaaucgaguuauauauuuauauauaaauauaguuauauauaguuuaaaauaaaaauaaggauagucauaaauauauaguuuauagagauuuaugguuuguagagauuuauaguuuguagagauuugugggucaguaaauaagugugauuaaaaaaaaaaccucauugagauacaagagugauggcuuuaucacacgaagccuccuggcauaagaagacaagcccuucaaccucugauggcuguagcauucaccaccaacacccaacacccaacacacacacacccaccccuuccucuuuuucuuuuucagauuuucaccugcaaaauuaaguuaucacuuuccucagaaucaguucauguaucguauaaaguuguauuugauguuuuuuucucuguuaaauaaaagaggaauguugaaauacagcaaaacccaaccucccauauuuagagaacuguguaguaacagaggugcagguucaugauaaccaucucuccacuucacaucagccagcuuaacuccucaugagagaacacucaucaugccacuuucccccucagaaacaguugcuugugccauuguguaaaugaaguuccagagucuagcuuggccuucaaagauucuccguaaaauggccccacuccacuuacuucuuauucuaauauauuccauucaaaucugguaggcaggccuacagcuuuuuauaaaacccaucccuggguuucacgcuuaucuucuacauuuugccucaaaugccuacucuuccauuucaucuauagaaaugcuuacuuuucuuuucuuuuucuuuuuuuuuuuugaggcaaggucugcuucuguugcucaggcuggagugcaguggugugaugaucuuggcucacugcaaccucugccucccaggcucaagugauucucccaccucagucuccccaguagcugggacuacaggcacuugccaccaaacccugcuuuguguguguguguguguguguguguguguguguguguguuuuguagagacaggguuucaccauguugcccaaacuggucuugaacucaugagcucaagugauuggucugccucggccucccaaaaugcugggaucacaggugugagccacugcacccggccuagaaaugcuuaccauuuuuaaauacuaugccugcauuccaauuauuccauaaaguuucuucuuucuugucaggguuacugggaaaaacgauuuuguugagugcuuaccauguaccagucagagcuuucuauauggaauuuugucuggucuuuauaacauaccugugaaguuuuagaggugauaagauagaggcaaauaacucauccaaguucacaggcauuguugaguuuaggcugcacgguguucuguaacuuucuccuuucagacuucuagauguucauauuuauauauauauuuucuuuuaaaugaaagaaugacagugugaaaugcccacccuaaccugguucccucuccugccaaccugccccuggagaacugauucuauuggcucuggcugugaaguuguaauguagacaggaucuaguuaaaaagcaucaaaaugaaguuuuucugucugcuuugcagccagaugcugacacuccgcaucugaucuuucuggagaaggugcauucucuagcuauucuggcucagugcguuugcaccaggagagguaugaagugcucugucuuccuugggacauagagauuaaagaauuucaggucaugaaaugcauuacuaccaaguuuauuacguauugagaguugucuuguugaauuucuuaauuuuuuaaauuucuuaacucuuagaaagugaagugcugauuuuauaccucugaaucaugaagaaaauuuauucuuuuuuuuuuuuuuuuuuuuuuuuuuuugagacggggucucacccugucgcucaggcuggagugcaguggcgcgaucucggcucacugcaaccucugccuuccggguucaagcgauucuccugccucagucuccugaguagcugggauuacagccaccugccaccacgcccggcuaauuuuugcauuuuuaguagagaugggguuucgccauauuggccaggcuggucucgaacuccugaccuugugaucugccugccuuggccuccccaagugcugaccacacccggcaaggguagcuauucucgaacuuuuuguagauaaagaaauagaucguuggauuauuauccaucuguaugaggcuagcuuuccagaauucagguuuucugacuccaaauuugaugcucuucccguaguaccacaaaguguggguuagauguggaucauggcgcccaaauaacuugaauacauacugcuggcauggaagauuaauguguuaagggagcugcccagauuucuggacaugggcugcucucgguuuuuguugcauuaagaauauugacagucaagggaauaccaacuuuuucuuaaaucuaauauuuuacuaggaagaacauuaaaaggauucuuggaggcuaguuauauagaagaggaaggugauagauaacuccuuuugaggaaaagauagcacuuuucuuaggagagucagccuaaaaucucccuggcugcugagaaagcuuucuggaugaugguuccaugucaucaccucuccucacuccucauucuuggaaaaaggggucugcacagccucacugcugcuucgucugcuuuagucucuuuucauggcuuccuaaaguguccccaugcaguuaucccagucuccccacagcagggcccugagaagagugcuccgugcaaacaugucugggauucaucuuugcugggauuugacuccagucccagcugcagcugcugccacaccuguaccccacagaaguugugauuccuuaaaccugcccugcauuuuggcacccuugacacccugcccucuugguuucuucugcagggaaucauuucaugugucaggaucagucuuuugagguucaguucagaugccacuuauucuaggcauuccaggagguuggggaggucaacaucccugcuuggacucccuuccuuuuaagauuugaaguuucagcgcuugaucauucaccugugauuuuucauuacugccuuuuguuacaguuccagucuuugucuuuuuguuuucccuguauuucgugaagucugggagccugaagaccaaagucugaauagucugucuuacacauacaagccgcuaaauauuugcuaaagagcaaaauuaaugaagucaguguuauagacucccuuauugcugugguucccaaauugagguucucaaaaugagguccccaggucagcaucagcaucaucugggaauuggcuagaaauguaaaaucucagaucuccacuucucaccuacugaauaagaaauucuaggguggguccuaccaauaaguguuuccagcuacucugccaggugguucuggugcacacuaaaauuugagaaauagucccuuauuggaucauuuguacaaucuuugcaaaauuuugugguggggauggagaagcagacucuuuaaguugcucccaaacaggagcagguauuauaccugauuucuuauagaagaaugaagaguugggggaaaauauguuuuuuagaacaaaauugugaaacagugggaaaaacauuagcuacucaggaauggacucuguccugcuuaaauuagagaagccguugaacaucugucucagccaccucuucugccucagaugacccucagguggggucaguuaccugccucaguucucccacaguuggcucaagagccacuauagaaagagauauaaguuuagaaaaaauagagauaaaccuaauaguguguguaggcucuaaggauaguucagcaaggcaucaagguuaguuucacuuauauucuuaauaaauaaucuauugaauuuaaccuuaaaaaacaaaaaucccagcaacuuggcaucuguaagggagacagaucaauaucuaggcugcuuuccuuauuugaauaacugccaggucugcuucacaagauuguguugaccagcaaaugauaugaucuauaugaaguuucccuggaaacauccauguacuauuaaaaugugaaggauggcuguuguuuccaugacuguauuccuuuuaaagaaaacuucuacauauaaaugaacacugacaauuccaguauuguugauuacuaguaaauauaguacagcaauucaaguaaggacuucaggguuuguuuuuucuuuuaaccuucuggaaaauaauguggacagugacagagcauuaaguuuuuaguuaaugauagcuccaccucuugugcacauaaucaaaacagaccaggugggguuuagccacuuguagauccuagugccuuuucucucuugacaacuuucuaucaacucugaaacccagcuaugaaaaacaaaugaaagggggaaauaaaggauaagggcauuguaagcauuuuucuuuuuucuuuuuuuuuuuuuuuuuuguugagauggagugucacugugucgcccaggcuggagugcaguggcaugaucucagcucaccgcaacguccgccuccggguucaagcaauucucuugccucagccucccgaguagcugggauuauaggcgcccaccaccacgcccagcuaauuuguguauuuucuguagagaugggguuucgccauguuggccaggcugaucuccaacuccugaccucaggugauccaccccccuuggccucccaaaguccuggaauuauaagcgugagccacugcgccuggccccuguaagcauguuuuucaaauguuuaauauucucugcugcauugacuuaaaaguuugacaggccaagcucagugucucaugucuguaauaccagcucuuugggaggucgaggcaggcagaucaccugaggucaggaguucgagaccagccuggucaacguggugaaacccugucucuaauaaaaauacaaaaauuaccugggcauggugguacacgccuguagucccagcuacucgggaggcugaggcaugagaauugcuugaaccugggaggcagagguugcagugagccaagauugcgccacugcacuccagccugggcgucagagugagacuccaucucaaaaaaaaaaaguuugaugauuguuaaaucauuuuguuggugcagagaaccugccauuuaaaauggcaguuguuggcacuaacuuagacuacuuuaaaagcaggaaggauccuaggaaauaaaacacuaaaauaaaacuuuaaaaaauacagggcuugcucuuuugguauucuacuuacuuauuaacaaauauuuauugauuaccugcuuuccagugagcagcugucgucugguuaaaaagugcauggguguguuucagcugugcugggaaugcuggcuaagccaacugauuaauagaagcaaguggagaaauaaacuugaucuagguaagaggugaggaacugagguaggggaaucugugcagguucaggguuacuggaccuuaaaguacagagugaggauggggugguaggaaggauucuagaaggauaauaaaggaugcaaggcccuguuagguaaaggaguuuggacguaaggcagugggaagguacuggaggauuuuuauuuuauuuauuuauuuauuuauuuuuggaaacagggucucugucacacaggcuggagugcaguggcacaaucuuggcucacugcaacccucuaccucuugggcucaagccauccuuccaccucagccucccaaguagcugggacuacaggcaugcaccacccaccaugcccagcaauacuggaggauuuuaaauaggagaggauuuuaaaucuggauuuuuaauuuaauuuuauuauuuuuauuuguauauauucacggauugcaagugcaauuugcuacauucauguauugcauuguggugaagucaaggccuugaguguaucuauuacuggagcaaugcacaugauacccaccaggcagccucucauccacuucuuaaauauaaauauaccuauuuacauuuauauauaaauuucuuaacucuggucacugaggcaugcuuuauucucucucuauauauauagaaaggcuagucugacugcugguaugaugaucguuuuggagggugcuggucaaggaaggagacagaagaccaguguuuuauuugcuggagugagaaacuuagaaacgacauaaccuccuagaauuuugaaagugaaauaggggacuuagaaccuuguuauucaguauagauagaugacuugggguuuguuggaaauacagcaucucaggccgaccuccccacagaccuccuaagucagaaucucgucuuuuaaaaauccccaagugcuuuguaugccuguucaaguuuaagaagcacugcuggcagugcgugguggcucacgccuuaaucccagcacuuugggaggcugaggcgggcggaucaccagaggucgggaguucgagaccagccuggccaagauggugaaacuccgucucuacuaaaaauacaaaaaucagccgguugugguggcgcacauguguaaucccagcuacucugggaggcagaaguugcagugagucgagauugcaccacugcauuccagccugggcaacagaguaagacucugucucaaaaaaaaaaaaaaaaaaaaaaagaagaagaagcacugccuuggaaguaauggugucugccuucuaacuccuaugaacagacaaggaaauaguuucauuaaauggaggaguuuuugguuuuuuugaauaaacuggauuauuuuaacuaaauauaaaaauaaucuugaguauaauaguuaauuaaaggaaguuuaguauugcucuagaagauuacagggcuuuaaaacauaguuaacuaauucugagcuuuagaaguaagucuuuuauagaauuuggcugggauuuuccuauuugcuaguccugcaguucuagaaauuugugagguaaaaaaacaguuucuuuucauauuuacccauugauauuaauggagaaucacaaaaauacccugggucaguuucucuaaauuauuccagaauuucagcaugauguccugggaaguagaaauuuaugaguccauaccuguuuuaugacuuaaaccuuuuaaauacuuuaaaacuauuuuuuucagaaacaaagcacaaauacucuucuucagccacacuucaucuuaguagaaugauccuauauuaaaugaacguuccuguucuugcaguugguuagacuucagucuaguuucaugcacaucaaacuuaccuaguggugccuucagguuuuagcgcuaauaguggauuugaaguaugugaaauaucuguuacaugguaagugcucauuuccucugaguuuguaggugaaacuuuaaaauuacugguuauugauuggguaggggagaaaaaacaccugcugaaacuuguuggccggaaguuuuuaccccugggaagaagaaaggaacggggugggggagauaagggaauucaguucuuggcuggcaacacuccagaaccguccugauggaaggguuguggccaguugaaagcagcaguacuggagaggggacuggggguuguucuuucaaaggcaggguugaagguuauuaauggacuaaguuaaauuucuagcuguuccuuccuguuacucuagauacuuuuuauauauuuauuaugucacagcaguauugacgcccugaaaagaaagaaaagugaaagaauaguucacguaagaucccacaaguccuacaaauuuuaacuuuccaauaguuaauauauauaagcacacacauauacacacacgugcaguuuagaaguguuaauauagacgaguuuugucuuggcuuuuuauuuuuuacuuaacaucaucuuaagcuuuucauaugugguuauuucugugccucuuaccaaauauuggcaauucacuuuccaaaucagacaauuacuuaccagucugagagccugcuucucaucuaugggaugaaggucauacaaauucuguguaaugagauuguuguaagaauuaggugagauucuguguggaaacuguguuuggcacagucccugguacauaauaagggcucauaggauuauuacagauccuaguuaaauggcaaggcagggcccagcagggugagccuuguaaacuugagugccucaacucccacccccacccccaaaccuguucugggugugguuuccuuuagcauguugggagaguguuuaguuugccugaaaaugcacccaacugaaaccauuccccccccccuuuagaaagauuagaagguucagucacuugggccuggugacuuuugauguaguuugaaggucacaaugcugguuccucucucaaguucauaaaagccucuggagcagcuauugcugcagccagcgagcauccagcacuuggucagagagccgccuuugucagagagcgcuccuguagccagacucauauuaacugccccccauggguguguugaaugccucuacuguguuugccuuugaaaggcccuucuuagccuuucucucucccccaaccccauuuucaagaggcacaagaccuuuaaguagcaaauacaguaaucacaguagcauggagacacaggcuggccuauauuugguuucacaaaggccuugugaaagaucuggccuuaaagucccuuuuuaaugcugaaauuaugcaaguggaaaguuaauuugaggaucacugaggcacgcuuuauucaugaagaaugugagcaaaacauaaauacaaagucuggaggcucuguucuacgcugguggcaaggaaauuacauaggugguaucuuuauuuggcugaaucccccucccuccaccaagagugcaacugugauagaauuuuggagugagagcuauuguuuuaagcacugacugguugcaggugugugugugcauguugccugaaacucucuacaaaccauagacaugauuuugguggaauuggcgugccaacagugguuacagcuaagauuguagaagaccaaacauucuguuggaaugugaccuuaacauuuugaauuauguuucuuaaguaagauaaauuucgaaggucuauuuuauuuuuaucuuuauucuuugaaggccugcuuuaaaguuuaccgugucuuugaaagucuagucuguugaacucuuaaaucccagugaguuccuauagauugcuagcuugaguguauaguauuugagaugugaauaaagucuagugcaaaguguguuucuugugcuugaaaauggugcccugauuucuguugagggagacguuuauuccuauaaagguuuaaacgacuugcuguacaauucagucuugcaaugacagagagauuacacacuaucugcaaacaacugccaagcagaugaaauccuggcugugggaagucugcggugaagagugguggggguggucaggagagcaguggaagggaaguggcucagaacauuguaguggugguuuggcgugccugucaagggcugugggacguuuucucucucauuucagaaacaaggguggugggaaacacaugggccguggauuugcauaaaccaacagucaaauccuagcucuaccagugacuucacugagccucauuuucuucagggggaaagaauaaauagcccuuggggugauuguaaagccuaauuagguauguuauaauuguauuaagaggaugacgaguucaccguuugccagggaguuuuccgguuuuagugccaaacauuccacauccggggaaucuuccucagucccaggcacacuggguggugagucccccaguuauauaugaagauaccuauuacuguucccuaauuguauguacacacacacacacacacacacacacacauacacacacacacacacacacacacauaucuauaaauaaagggcuucuggaagcuggcugccuauuacuguguaccugauacucaguggguauuugugaacucccaggaggauaguguguuaguguguuugcguguaucucuguauuccuucuuagggauggcauacaaauaaauguuucaugaauaaagggaugaaugaguagguaaaguaauauaagcaguaaugcauauguuuuaaagugauuuagcugguuuuccuuccaggggccucuucccugagaaaagagccacuuaauaaaugaugucuugaaugaaagaauacaucaugaaaauaauuuuguccaugauguggcuaaacuaaaacuccaggaagggcuuaggcugggccuaucuacuuuuuuugauaaaaugaaguuuaauaugacccuagugacaaccuccccucauccccuuaaagcucaaauuuagggaacucuugugguuggacucucacauacucccuaggacucugcugggugcuggggaauuuacuaaacuuuggugaggagaagaggagaggagagggaagccacgguacuaagguacuuagggagacagaaacaguuccccuagaaauuagacaucacauugucuuuuuccccccuuucuuuugaaugagauggggcaagaauauuuggaccaggauaaaguuuuaagaugcauuuacacuaauguaaucagguuacauagcaaaaaaauguuaaaaauguacccugggaaauugaaaucuauccauucuucuagguguggcagcuuauucagauuuuuauguugugugaccauaaaacgaacacagcuuuucuaaccgcgagugucuuuguuuacagagauaacagugugaguaaugcuuugcuagaagccaggcaguuaaaucacacucugagcaaauagaggcugggcuucagaaacuuagauagcacacgaaugugcaaacuuggucuuuuaaacugaagacauaucugaaagaaaacugcuuuuggcccaugaacuacuuucccagcccuuugugccucccaaucucugccccccuuuacaaaaaaucuuuguuuuuccucuacaaauauacauauaugauuucaauuuggaggugggauguuauuuuuuucacuugaaacacaaggaagcaauuuuuaaaagucauacucguucagcagugggcuugacuguagccaguuugacuaggaguucuuggcuacagaaccauacacuugcagucuuuaucaggguaguaaauucagauggguuuuuggaaagggagagggcuggaguugagggaagggcacuagagcagugugacccacggcccaggagcagugugagugggaaggggcucuagaagcugacugccuuuguguuugccacagcgugcugggaaucagaugagaaggcgggcccagaccccaccagauacucaucucagccauuguugucauuaaaugacucugaaaugaccuuucuuaccucaguuuccugugagcucauaguugucugcagaugugaauuaugucauugaucuuugcucccucuuugcuuauaaggaguagcuguucugcuccauguuucuggaagaggaaagugaugcacaggucacuuaguaaagcgguccccagccuuuuuggcaccagggacugguuuuguagaagacaauuuuuccacagauaggguggaggaaauggggaguugguuucgugaugaaacucuuccaccucagaucaucaggcauuagauucuuauuaaggagugguaaccuagauccuuugcaugcacaguucaugauaggguuuggcuccugugagaaugcugcugcugaucugacaggaggcagagcucaggcaguaaugcuucccauccaccacucaccuccugcuguguggccgguuccuaauaggucacgggccaggaccaauaccggucugugaccuggggguuggggaccccugacucggugauucagcaguugauuugggauccucugucuuuguuccuccucccucagcgggaauucacaguguaacucauuugcuaagguuuucugcguuagaaacagaacuccuuuuggacuacuaggagacauggucauuagaauaauuaugauucuuaguaugacucaaccccuuuuuaauauucagccuuauggagggccucugccugcggcucuuugcucaggcacuagggccacagggguguaauuucuaucucugcccucaggaagcucacaaacaagucaagagacaggaaaacggauccuguuuuucuaaugggauuugaauggauguauuuaugggaggggggugcuuuguacaccugcaaaacagaacaccagcccucccuucuccucugggguugcugugagaaucaguuagaauaaugugcaugaaccccguauggaaaauacaaacucauaauuaaaucuaagaaauuuuuguggggggacacaaauguugggguugucuuuguucucagguccccucaacuggucuaaugaaggaaacagacaccuuuccaguaacaauagccaacauuuauuggacacuuauguaccagacugugcuauuuaugacauacauuaucuaauuucacaaucagaagaaugcuagagauagggucaggcguuaucucuguuuacagaugaggaaagcaaggcuuggagagaaugccauacaguuauuaguguggcggagccggccuuugcaccuggcuguugaccacgcccuagcauuaaaccauuaccucacacugcuucuccgagauaguuaucuucuugggaucauuuagguguggcaggaucuggagggagcaguuggacccaagucuccuagcagcagccuacacguuucuugagucuguuuugaaacaacuuccuuagcccuagcugcgcagaaagcauccuccccucagagugaugauuuuuaucaugugguuuccuuccuccugccuuuggaggucaggucuucucacccagggucagaaagcccaucaguugcugauaagcugcagcacuugagucacagggugcaggccuguguuuagaaugggucaugcucaugucaggcacguggggaaucagugaucccaugagagcucgaucagugcagucugguuuggaauugcaggucacacccuuccaccacuuugcucaugugucuacugaugccugugauguaguuaguuaaaccacugacuucuuucuccugcaucaaacaugacuuuuugaaaaagugugugggggcuuuccagcaugaaccaggcauaaaccagguaccuucaugaacauauuauuuaucccuucagucacccugugugcuaggugguaucauaacugcuuuguggauugaggaaccugaggaccagaaagaugacuugagguggcagccucauuuagccagcaaguaagaaaaugggugauggugaacuucugcagcaagagggggccguuuucaacauuucugugaauucaaggcgugugcuucgucuaaauagguggagacacguaggaaggcauaguguauacauccaucagcacauggguagauuuugagguuuuuuuuguuuuguuuuaaauccagagcguuguguauuugaucauucuuggagauucagccacauucacagguguuaagugucacaccuaaccuagcaauacaauacacagcugaaagaaaccagucagguuuucccaauaucaauuucuuuuuauuuucuuuucugcaacuccagaggauucaauaaugucaauuucugauaaagcuuuugcuauugaugaguaaauucuuccauuaaaaagauaacagucugcuaauuugcuuaucauugauguugcaagagcguaacauuggagggaugaguaaugcaucugcauaucucgaaggacaaaacugacguccacccacuuguggauacgguauuugguaaaaguaacuaagguaaaauugccuaagggcauuuaacuugagccauagcuuaaauucaggugauauugagcguugacauaucaggauucuuuuguacacagagacguggauguagacccacugguagcaauugcaaaggcucuggauuuuuagcugcuggaugaaauaccugcagcugaacaucuguuaugaugcaauuaagcagugacucaguggcgugaaggcucaguuucgauguaucgggaacuccuuugaaucuguccacaaacuucucaaccaaaaggagaggagaaauguguacagacauuugagaggcugggucucaacaugccucugccuaggcagucaugggaaccuggucuuuucuccugagacaggaauuaaccuguaguacgagaaacaugguuggaugagugguuaaagcagggcccagacuuugguacaguuuagguuaugguagcagggauagggagagagguggaugaugguaauggucuguguuuuuuuccuuuugucacucagauccagcuuuuuuuuuuuuuuuuugagagacagucuggcugugucucccaggcuggagugcaauggugcgaucucggcucacugcaaccucugccuccuggguucaagcguuucuccugccucagccuccccaguagcugggauuacgggugccugccaccacucccggcuaauguuuguauuuuaguagagacaggguuuuaccauguuggccaggcuagucuuaaacuccuaaccucaggugauccacccaccucggccucccaaaguguugggauuacaggugugagccaccgcgcccggccuucagcucuucuuucugcuauugcuuuggccuaauuaauaacuuaaagcuggaacguugaugucagguauguguagguccaggaaaacagcuguuggcucuguuacuucaauuuuuuuuuuacucuauacuuugaagaaguaguacuuucuagaacuuguacucaaaacucaacugacaaauccuggaaggccguugcuuauacgcucuaguugaugcgccacagcugccuggcugugagaauggaguagcauguaccucuuaauuagccaagaauaagugccguggaagaaggcaggaugacuuuuuagaacccauuuuuagcuugaagaucacugagggagccaucaaauccauccaccuguucaaucaauauucagccagcaagugggugucaaggugagcagcuuacagugcugagcacacuggaaacacagguguguaagggacagccacggucucaaauuacauucugaaagggaauacuagguaagugaucccaaacaugcaaauaucauuccuugguccugggaugugggggaagcauuuuggaggaauugacauugauugcaaguuuuuaaauaugaccuggauuagauuaugagaugaugggugcuuggggguagggguguacagagggagucaugaaaccauggaggauguuggggaauggcuagaauucuacuugggacaucaugcaaguuuuuuuuccccuuccauuucauuuguuaaugcuuauuauuaguuggggguuuugccuccuuuuuguuagccaacagccagcuaaucuuggcacaggucccgggaaucaggugcugcuuagcagcugauguugguuaaaugaccuuggacaagugacuugcauuucaguucucuaaccuguuaggguuguagauugucugauacagauuugaaggccccugcaaauaaaugcauggccguuuacucuggucacuuucauuuuaccgaaugugcucccccaaggcucuucuggguagaugcccacugccaaaacauuaagcauuuuuggcuucucaugcuuugagcucacaaaaucaguccugugggaaaccuaacaagcuacaaaggagagggaaagcaaaagaaaagguauauggauucucaugcaaagagagaaggaaaguaggucccuaccuaaagucuagcccuguauugguggugguacugauaaugguaauagccaccaaaacuucuugauacuccccuugugcaggcauuguccuaaguacuuugcaguauugauucauaugcuccucauagcguccuugugugauguguuauuuccauuuugaagaugaggaaacugaggcacaaaggaagcugugcccaaggacacuuaacuaguaaauggagccaggauuccaacccacgcagugcgcuuugggacucaauuuuuaaccaucuugcugugcugccuguugagcauuuuucaccuggugcuuuuguagaucccacauuaggauuuuguuaggacccugggcaaccuugauuuagugaaagcaguuguugagagguagaaauuccugauccuuuuuucaaucuuaaaggauuugcugagacucucacucuucauuggugaugguaacaaggagcagcauggugaaugccauguaaaauucaagccuugccuuaucuuggaggacuuuauucccuuuucuuugaugguacuuuggagauuccagacuauaaaggacucagcugacaguacagacucucuugaucuguauuuucccaguauaugaaauuauuuguaauguacccgugagaaccuggaauaaacuguacuggcacugaaguagaaucuuggauuuaaaaguacaguguucacugcugcaucguugagcauuugcuacacagagaauaaccuuggagcaauguucaaaggugauggcauuacccagaaacauggaguuaggccaggaaaccacaucugaaguucagauuauuggagauugcugauuuuucuugacuuuaaauauuuucgacugguugaguguuuguugguguuuuugggcuaaguguuagccuuuuguucugugaugucccugugugaauaaaauggauaaucccuguuuccgguuagcugcugcugcugcugcugcugccaaguauaagugaagacuuccagcugcgauuugcauuguguuuucaggccaccuuuugaguuuccccauagcagauauaaaaacuguuucuaagaguucauccuuacguguucagccuuacuuguauccuaaaaccacaaacuugauuuuguucccauucauuaugaucuauauuuggcaucagugaggcaaguuauuuauauuuauuauuuauacccugcccacuuccagaaaugauuuaauuuggccuaggcaagugucuucugauggggugugugugugugugugugugugugugugaugauaauucugauguguguguguaugaugcuacuucugccacuucaagaguccagaaucauaagauuccuaauaggauuguuggguuggugaaugcuggguuuguucucuucuaugcccucucuguccaggagaaaucugaguaucuuucuuaggaaugccuaacacugcuagacugaaaggugccaugucaccauuuuucccaagaaauuuucuuuugagggugcuauagagaagcccucugguaugaauguauuaggcuggugcaaaaguaauuguggcuuuugcaauuaaaaguaaugacaaaacuacaauuacuucugcaccaaccuaauauauauuauauauucccauuuuguucuuuucagaauaaagcuuccuaggaguuucucuagcucaugaccucuuuuaccuuuacuuucaguugcaguguucuuagcucauagaaggagcuuugacggcacauagaaugaaguauaacagcuuccguuugaccugaggcaucccucagguaugagaaugucacccagagaucgaauacagugccagguuaucaacuaccauuuuuugggacugauucucugcucaugugugaccauuauuuggggaaaucauacaguaccacaaaccagaaguuucugaaaacaccuaaacuccccaucuuucacacucacccauagggaccguggcccccaaugagggguaguucgucucuguauugguagcauuagcgcacgugcuauauagcucucuuaauaccugaacuguggacagaccagauccucacugagcugaagcacauuggcauauuaagggagcccagcauugcuguuuggcccugcuuuugaacugggaagauauauugcugcauggaguucugaaaaguaccuuuguaagucccgagaacuccuguugaccuuuggauuuagguaaaauguaagucuuaggagaauugaugagaauguaggaaccaguuuuagccaaugcauuaagacuaaaaugacucuauuguuugucaggcuuugccagaaaguauagugagagagagagauccuaaaacucugaaagcaaauagcccacagcaguuaacuguauugacuuuggaaacagguuauaaacccaaaccucugugcugaacuugaauggguguuucuucucuccuuucugaggguaaaagcugcuggugagaacggcucucugguguugcuaggacagaccuguaugaccuucuuuauguaaauaauuaacaggggaauauuuucauuuacguuaaagccauauaugagagagauuuccgggcuggcucugacagccucuggccccacuggagaaggaagccagcacugaaaaaauucaagcuuccggccacacggaaccugagaauauucucuaugacagcaguggcugugaagcuguuucuuuaaaguaaaaccccuuuugaagguuagucuggggugacuuuacuguuacauagggaguagauuuuguuucuugaugguucguugagugguagagagguuaaagguagaacuaacauauguagaacuaaaaagcaucugaaacuuuuagcaaaccaguaauauuuagaggcuucugcccacucuggguaggcauuuuuaucuuguauacccauaccagcuuuucacauccuguuucuugagaauacauaaagagcacauuucuccacauuaucaggaaaacaauuugaagcacaggucuugugaauugggaagaccacuaguauugccauuagcugcuuauuuguguguguguuggaggauggauuauaauccaaguguauucauauucucacacuuuaaccaaaaaaaaaaaaaaaucuccaaaaucuucucucuugcauuguuuauugauagaaugggaaacuuacugcugguaacuaguuaauucugaaaggguuaggguuucuacuguauacuuccaaaaguacaggccugggggagccaauaugagagacacacauaaccaaaaauuuguaaaaacuuuauuuuuuaauaaaaauuauaaauaaaaauuauaggccgggugcacuagcucaucccuguaauuccagcauuuugggaggcugaggcggacugaucacuugaggucaggaguuugaaaccagccugggcaacauguugaaacccugucucuacuaaaaauacaaaaauuagccaugcauaguggcacacacguguaaucccagcuacuuggguggcugaggcacgagagucgcuugaguccgggugguggagguugcagugagccacgaucacgccacugcacuccagccugggcaaaagagcaagacuuagucuuaaaaaaaaagaaaaaauauauaaauauauacacacacacuuuauauauuuuuauauauaaucucauacaacauguuuugaaauacacgugcauuguggaauggcuauauugaaagcuaauacauaacaaauuuaaugauaauacaaguguagaauggacaacaaagggguugugcauaaucaucaaguacuucucauuaguaaaaacccuuuucauuugcuuagaauugaggaggaggggaugcucuaaauugaggauucuccauagggucguccgugagacacaagauguugacugucccacuuacccaggacauggguauccuuuugaugcugacagcauuugcugcugcuuuccagggaaucauggcugacauugaacuuccacugccucugggcugcuuugcucacuccuccuaggcaggcaagccgacccuugggaagcucagcauuuagccuucaugcuuugguuucuuugcccuuuuuuuuuuuuuuuuuuuuuuugaaacuuuuauuugcucugggaccacuuugagguugaagguacagcccacaguuuaagaaaacugucccaaaccugagcuaauaaacaagaguaaaagccuuuuucucuugucauuacuacuuccuccucacugacuaauuagccagcugcugcaggucucauuaaacuucauuaauccuaagcaucugucuguaggaacugccucaagauaaaaagaggaagcuccgcuaaacauuuuuguugcugcugcuaauuaccacaagcuaugcuuuuuauuaauuaauggcucuacuugccuccaaauccuacugaagaacuuugcgagacaacaggcacuucauucuucuguagcugcagacaugcugcucugugguuuggugcaugggguaccuguaaauuaucagcaccgagaauacgcuagcucuggaaaccaagguagagaaaaaaauacaucuggaagucugguuauguguaacuugaacuugcucaaagccuucagcugacacugaugcuuuuuaaaaacauggcagugauaaauuauuucaucacuuugcucaaauacauuaaugcaaaacauuacaaaacuaguuuucuugacucagcuuccagggucuaagaaagcauuuuauugggggguugugaugccagagcauaagggauguuaaaggugacacuuaaaaaggaaggugucgaucuugguucuggucugguggugccugagagcagggacuccuugaaggugcaagaugaauuacacuccucccaggugucaggcaggggagagaagcacccuccauuuagaaauauggaggauuagccaggcauaguggcgggcgccuguagucccagcuacucuggaggcugaggcaggagaauggcgugaauccaggaggcggagcuugcagugagccgagaucaugccacugcacuccagccugggugacagagcaagacuccgucucaaaaaaaaaaaaaaaaagaaauauggaggauucuuucugaugagggcuucugcacugaauuacguaaaacucccauuucggaauuaucaggaauuaagguggcaggauaccuuaagagauuuaauucagugugguccauuuagguuggggggaaucuuacugagcauuaaggcuugaaccccauuucauaucaguuggagccaaagguccuugcuaauguagaacucucuguagaguggugggggcuaucaagucaaacugcugggacugugcuugcuucgugacugugggcaaauaacugaauuuuucuaggcuugaauuugcucuuauacaaaauauguuuggugguaagaguaccuacuucacagaguaguugugagaauugaguuuuaaugaagugcuuagaagaguaccuggcccuaguaaacacucaguaaacccugacuauagggguggacauggaagaagauaauuuaauuccuccgucaucuaggaccaugcuggagcccuucccacuugcguagcugaagcacugguggaugaacccccauuugccucugaucuuauuccugccgcugcuuggugauguccccuggacucaguugucagcucugaagcuuugaccccuugacucaccucuggucaguuggucccacagugcuuugcuugauccucucuguugccaucuguucccaugcgguauaauuaccuguuaauaaggcuggugucaguaaacuguaaacucuuucugcuucugcgucuauccuuauuuccuacugcuuaguagagcaauuuaaaaccuuuuuaagaauggauuugcauuuccuguagaugaaaccugagguggaaccccaguaaaucaaggguaugaaaugggagcuuuucugaccaaaguguaggugagaagauaccuggaggcugacccugggcuuugcucuuucugcaucccuugcuaggaacaugguuugaaaacuacuccccuggcauccuguagaccccaguguuucuucagugaaugucacuuuuuaaaaauuaauauccuuagugucuccaucuauuacaaggaaguauuaauguuuguuugccguauuaugcuuacaaauguuauauaaaguuaacuaccaauuuaguaugccccagaagaaagacaugaaaauucaggguggcauuuuauuuuagcauauucauugaaggcagcaguacacauaggaccuuuugugaugccccagaagaguauguuuuccuccagugagugcucuuuuuauuccuacucaucagucccagacccaucgggugaaccucaauucucuuaucaaauaaaaaaucauuucauauuuuccccuuuaaugggaacgcucuuuaaauuuuucaaaauuaauaugugcuccuaaaaaaacaaaaacagaaaaccagcaguguauucauagaaauacagaaguggaaaugccuccugucugcuucuacucccuugagagaagacgguuaauaguuuggaagauauccuucgauaucuuuuuaugcaguuacuuacauuuaaacauauacauucguaggaucauacugaauauuauacacuguucuauaagggacucuugcauucaguaauauuauauggccacuuuccgaagccuguaugcuguagguuuuccuuacucuuuuuaaugcauacauauuauuuuauaaggaugucccguauuuuaauuauucaaccuauuaauguauauuuaguuucuagucuuuucuguuuugcuguugcuauucuuuuugacaauuauuuuuuaaaucuguagugcacauucuguacaucuucguuuucuugcacaaauauuucuagaaaacaaauaucuauagaugugauuaguagauggaggaaauacauacuauaaauuuugauaucacuacuuaccuucucaccaaccacaugugaguguccuaguuucuccacaccuucaguaggugaaaggauuugucuuucaaauguuguauagaauaggguuauaguuuauuuuccccuacuuccaccuaguccugaaaguggauccucugcuaucugccaccccagcagaacaucuauaaguuuccagcccuucccacccagauccaagauuauuaucuuuauggaggcuguugagaagcagccaaggucauuauuaaacaauaaaaugccccugaagaacaaaucagcaagagcaagaagcuuccuaggcuaugucaagguagcugaacaauaagacuacaccuaagacaauauuggcuuacugucucccuccuuacacccaaacugacaaaacuacaaacagccagguccccacaccuguuggaagcaccugacuuuuuggagugggagauaaaggcuugcguguagggacaagggagagguggggugggaggcuugcaaguggaugcauucauggauguuauaaagaucuguauuccguuuuaugggaagagauuuacauuuaaguuuagcaacacugcaagagguuuacauuuccaaaauuaauagaacaacagaaaaaucagaucuccccauuuaugcccucuuguucaaaacuuuccuuuuucauuugaagaaaauuaaauuuagacagaugaccaguuuuaagcuuagaagauucaauaugaccaagaccauacauugucuuguauaaaaguguguuuaaagcuuugguuaguguuccuauaaugcaaaauagguuuugauuuaaaguaacaacacagaauacucuuguguucuaugaacugucaacugcccugcccucuucugaugagugugagggaucuuauggugcuacccugccuguuggcuagucaucuugggguugaaucugaggucauuuuuuccuccaguuuuucuguccuccucuauuaaaacaaggcaauguacauuggguacuuacaggauuuguccaccaaaacucuguaguauuuggcuuugaaagaaaucuuguauaaccauuuuaugugugagguugaggaaagccacaaaggaaauuagcagaaguguuuuucaguguuugacccuauguguaauaacuuucucuuuuacauguuaagauaucuuuaaaauaauugaaugguagcugaguaucaauugucuaaugcugugagcucucauggagucagaaauuacuccuuacauuuuuaaagagagaacucuuaaugcuuuuagauguccuucccaguguccuuauauuaguuacucgauaaaugguugcuguggacuaauccaagaugaaaaaaugacaggcgaccuuuauggcugaauguuggguauuaguguucugccuggaauaauuuuucaggcaguggaauaguuggcugaguugaaaauauaaccguggauugggucagccuaucauucaauaaauuacuuccugaaugaagaauacucugugagaagugaaauuuugaguuacacauugggauaugauaucacuuagaaaauagugcuaaacuuuaaaauucuuuaguuucagaauuuucuaaaucagggaggggcuugucaguauaaaauuauacauuuuguuuuuugaucuugucacaguuguucgugacuucugaaauccaagugugguuuggagacgacuuuaccccacuccuccccaaacacacauugguaguccguggcuuacuugcguagacaacugugauuguggaguuuggcacucgaauugagacagucguauuuaauuuaucaaucugucguuucaacccugaacuuuucuacaauggguuauggucacuggccaaaaaggguuuaggugacucauguguaauguucuucagaacagaagccaauuuuuaaauccuuuuguauuuauguucauuuauuuuuaaauauaauuccucuucucauuaaguggaaucuugucauaauucuauaguuucaagugauaacuuggcauugcuguggcuuucuuuauuccaaaaugcuaauccuuugcagauaaauuuauacauucuguauagucugauuuggaggacuucuguaucuuagcuuaucuuagaugggagcuuccauaauucauucagggauuagucagugcuauacugugcaugcauaguagacagcucugugugguggcuuuaagucuuuugacucccccucuuucuggucuuugugucuuucugguuuaaaagaaaaaauaucccucagaccuuagcuuuuuggauucaaugaauuacuguuaacuuugacauccucauuaaauaggagagcugucggaaacugucaagaacggcuggaauugguacuguuaucuuguuggcgacgucagcuucugugggcaucugugcaaaaacauugagguagagcagaauccucuucuaucuugaaugucugaaaauaaugugacugguguguuugaaagaguucuauuuuucccucuuugcccuuaauuauuuuggccuuaaggauuccggaaaccuggaguagauugaaaaccauaauaagcaagggccggggagcauguuauuugauuuuuuaauaaacuaccucugacuagcuuacacgccccguagaacauuaaggcuacuuuuuguguauauugcaugaaauaagaaacaucacaaauuugaauucucucucaauaccucugcuuuauccaaggcuccuacaacaaaagccuaccuuuagcccuugaaaaugaaguagaggauuuuaucuuuacuggugaauuugugugccacaugguagacuaguauagaauguaauauuuacugcuucuuuaauguuccuuaggaagaauaucacacagacaucucccuucuccauauguugcaauuauacuacuuucaugaagucuugagugugccuguuacgguuggugcgcuuuaaaacauucuuuucuacuuagucuguauucguguuaacguucugccauucuguguuaaguucugccguucuguguuguuuaguaauuaaguguaugguaucuauuuaguucuaaguuuuuccuaacuuuuaagggcauugcaaguuacccucagcccaccuuggauugaaguccccuuccauggaggacuggaggagaagaggugaugguguaugaaguguccaucaaaauaagagcugaagagccuucagcuuguggggagggcuggaaaguuggaagaucaggccucaagcuguuccacccuucucauccuuugaaggugagggugcagccuugaggucuagccuguggugauuaccauaguuugucccuccugccaaaugggguggcacacuccaucccguaagugaagguaaccagauaaauacccacuccgcuggggaguggaaggggccccgaguucacccugugacugaccugacauguggauaucacuuaccagaaaaugcuuguggcuacugagcauuaaccuggcaacauauucaauagcaaaauuuaaaauaguacccaguguggugccuugcucauagcaagcacuuaguaccuauuugcuaagcugauuuuaauuugaaguggagucuaacaaaugggaugugggaucaacaguauuauuauauugaaauguuuuaaaccaggacaugccaaacuuuuucuauaaaggaccagauaauaacuguuaggcuuugugggccacauggagucucuaugggguaucaucagccuccuccccuuccucuuccuccuccuuuuaaccacccucuuaaaauguaaaaccugugugucucccaggcuacauaaaaagaggcuacuggcugaaguuugcugacuccuauuuuauauuaaucuuuuaacucagucugaaggaacugaccagacauggaugguuaugaguuuuuucuucuuguuuuggggaggugaugucuuguuuuccucaggcagugugggauggugguuggaacuaaauagauaccaucccacacucccugugugggauggagugccucaggugcuuugggauucuguaggguucagauaaaugugggcucuaauucuggguguuuauuugcuagcagcaugcccucggggggaucccaaaaccagucugugccucagccaccucaguuaguuagaaaucacaggcuguaaugaaggagggaaagugagugaagauccuaaugcagcaucacuagugcacaccugggcuuacuucagccuuugcccuaacugaucagucacccugacugcaguucccauccuguagagauggagaguagcagguuaaugggcucaggauaugacuuccuguaugugaaagcaguuuggaagcaugcuacccauuuuuagucaaacacagugaacaguuacugagaauuuuaucacaagguccuaauucuguuuuuuuacauuugcuuuuuccaccugguuuuggcaccuuacacuauugguuuuuuuuguuuuguuuuuuaaaaaauauuuuuaacuuuuguggauacauaguagauguauauauuuaugggguaugugauguuuuaauauagguaugugaugcuuaauaaucacaucguggagaaugggauauccauccccucaagcauuuaucuuuuguguuacaaacaauccaauuauacucuuaguuaucuuuaaauguacaauuaacuuauuauugauuaauucacacugguucccaccuuagcucucaucuuagaagagguaguuguguugcuuugccucuuauuuucggagaaagcccccaucauaaccucagcucccuccagagucuuggcuucuuauggauugugacuuuaugcggcucaccuugacguacgacugugacagaggcaggacccuggugacagagccucauuucucaguuauugugggucuccucucagaaguugugccugcagugccuuggucuccacauuggcaaacugggguugugccgcucagaagaaaggcccucuggaagcugcaggagggacugcccagcagaugcaaccuguaggugccaggucauagagagcucaugguggguuuuguagucggcccaucagacaguuacuagcagacaauugcauauuugcuucacaugcauuuagagcaaauauuuacauguguuuuguccaugaugcaaguuaaacaguuaaggaaacuauuguaacucaaauucuauuuuuauacaaaucagcaaacaugaauuuaaggccuucagacuaguccgucacagggaggacuucagucaaaagauuaguuuccuuccuguugcugccucaagauaacaguuggauucucuguuaucaauacagccagcugccuguuuccggcuuccugcucuguguauuuugcauguuacucaugggaaaugauuuauuuauuuuuucaagcuaaggcauauagggggacuccacccuaccacuauucuuuuguuuugaguuaagauccuuuuuuauucuuuauuuuaaaacaguucaagaauuaaacuuuaauauauaaauuguuaaaguugcaacaaauuaagucuugugacaauugaccugauugggucauguuuaaauaauguuguaauauguuacaaugauguccuaaucacaccguuguguauuuugcaacuucacuuuaccguacagguaugugguggcaauugcccaaagauaaaacaagcaaacaaaaaacagaauuugucaaacauuuuaguuuggcucuggacccauuuuagucugaaugacagcaccacaaaauugcauuuuuauccguauuucagacauugaggaauugcaagaagcaguucaccugucauauauuuuuagugcuauacaaugacaacauuuaacugccuagggccugucuuugugauaugaaauuucccuccucaacaauuucagugagaccaccaccaacaauaagauuuaucgagaaccuaguuguuggacacuggagguuugcugacucauugaacaaauguuuauugugcaccuccuuuaugucauguauaugcuaaagcucuaaacaugaauaggauugagccuuugccucugagccaacugcaaguuaauugaagagauaggacacaagacguauaauaaaagaugagagaccacaucccaucaaaugaugauugcugacaucugauaggagagggccucuugguagaacuaaucuuggcuggaucuuaaaggaaggguaagagaaaacugccuucuagguuagaagaaugauagaagcaaagaugggaaaaagcagugugcaaggugagaguucagagcaugagaguaagaccuguuagguuggaacaaaagacggcaugucagggaaguucccagaugaagcugaugccuuaggagagcccguuugggaccuuuaaaugccagguucagagauuuggacugucuucuggauagcugggguccguugaagguuuuggugcagugcugcaacuuugaaaaaccacugauugaggaacauggcuaugguagugauguuuaagguggauuagaaugcggagagaggcccaaggcaggggaguucaguuggggucugaaaccacccaaauuguggugagcuuuguucaaaacacgcaaaaauagauugucaaaauuauucucuuagcaacugaucuuguacuucuuuguaaugucuuuuuguuauuuuuuaacuuuuuauuuuguauccccagcuagauuucuaguucauugaggguaagagacuuuaucuuagacacagaguucuagguaaaguaugcacuuuguaauauuggagcucacuaauacucucaauuucagauuagucagcuaacacaguauuauugauuuaaauaguggggauauguucaugggaugauugcuuccuccccuuuugauuucuucuuaacuuccaucccuguaauuccuuucuuucuuacuuugaacccaagacuacaccuaacuuaacuauaugucugugcaaagcaaaaacuacaugauugcugucucuuacuuaggggguaggccauuaucuuagcacaauugaagagccugauagaaaauauuacuggguuauacgugcagguucagacuacuugaaaaguaaaagaaagauuccuucucuuaagccagguauaaauucagucuuuaggggaacaaugaauagggucuuuugacaguuccugauucuauguuuccuuuuuuuuccauccggagauguuccaugccuucaggcuuuccuucauuccuggcucccaucccuuuccauaaccagaacuguggcauauggugaauauaguuguguuuagcacucugugcugaggguauugcagaaagaugccguacaaucauuuccaucaugcagugcccuucugcucaucaaagcuauuucuguauccuaacuugacucacgcuaacacaguguucauuuuuucaguuauagcaaauucucuagaguaaauaaauauggggcugggugcaguggcccacaccuguaauucacuuugggaggcuaaggugggaggaucacuggagaccaggaguuugaggucagccugggcaaucuaaugagacccuauuucuacaaaaaaaaaugaaaaagccaggugugauggugcaugccuguaauccuaguuacucuggagguugaggugggaagauugcuucagcccaggaguccaaaauuacagugagcugugaucacaccacuacacucuagcuggggugacagacuccuucucuaauauauucauugguuaauuaauuuaaaaauauaaauuaaaaaauuacauagacgcauuacagccuuucaguauuuaucacagucauucccuaaaaagaaaagaaguagauguuaugcuucuagaagaggaugaugguggagaggauauucacagcccuuuuuuuuaaccauuaagcaaauguguuucucaguucuaaauauuucauacuuuuuuuuuucuuuuuucuuuuuuuuuaucugagacagaguuuugcuccuguugcccaggcuggagugcaaaggcaccaccuuggcucaccgcaaccucugccucccggguucaaacgauucuccugccucagccucccgaguagcugggauuacagacaugcgccaccacgccuggcuaauuuuguguuuuuaguagagauggggguuucuccauguuagucagacuggucucaaacuacuucugaccucagguauuccaccugccuuggccucccaaagugcugggaauuacaggugugagccaacgcgcccagcuaccucauccuuuuuuucuaauacaucuucuaagaauuucaaguuguuuaucagaaaccaaacaacaaaagauagugaaucucaguauaugacaggagaagguguagcuaugcaucuuaaucccucuugccuggcuggagugggagagaaagagccgaggaccucaccacuacuggcuggugacacuuagcagcccuuaaccucacugagccuugggcuuugcuagagauaacucuagcaucccaccuaccuaauaguuugcugugaagaucuagugagcuuagagaaaguaugaagugccauucagaugcauggcaauguuauugcagacacaccaucuuauaaaauuccaucuggaggaaggagcaccauacuaggauuucccuuauaauuuacuccuucugggaaucagaaucugauguaaaugccacucacuugaggguggguuucuugucucaguaguucucauugacaguaguuagcuaauuuacuuaucucugagccuguggaacuaaaggcugagcugguugggucuucacacucagaaccauuucugguuccuagguucucggggcuccaaggucauuuugguagaauuugugguccugagaagcuuauuuugagaccauuguuaggagcccuucuuucugucucccaccccugucaugucacagagacagccucaccacguuccucccacggagggcugcugguucuuuuuguccuuuuuucacuuuguuuuccacuuuccucccuggacugccagagcugcagcugccucgaguccuggguuguguugguagguaagugauguccaggcugccuagaggugggguccucaggugugaucuuggaucccacuuguaccacauuguacagcauugcaaagaggggauggugagaaguguuugaaccugagggccuuuacauggagaagugaggagaccuauucugcauacucugaagguggugcaagccauagugggccacagagacaggucuagucuugauggagacaccaucccaacagauggagaguuacccaauaaugcagcagacccuuuacaaaauaaggacuugcguuaguuaggauggugagaugguggguaauucuaagucuuguaucauggaaacacuuuuuuuuuuuuuuuuuuuuuuuuuuugagacagagucuuaacgcugucgcccaggcuggagugcgguggcaugaucuuggcucacugcaaccuccgccucccagguucaaguaguucuccugccucagccuccugaguagcuggguuacaggugcgugccaccaugcccggcuaauuuuuguauuuuuaguagagacgggguuucaccauguuggucaggcuggucuugaacuccugaccucaugauccgcccaccucggccucccaaagcugggauuauaggugugagccacugugucuggcagaaacacuuuuuuaaauguugugcgugaggcauuauugcauaguggaugagaaccagggcucuggagccagccugccuggagaguugcuggcuccugccucauggggcaguuguggggauugauuauaagugcaguuagcccucuguaucugcagguuccucauuuguggauucagcugacaacagaacgaaaauauuugaaaaaaaaauuaacaauacaauagaauacaaauaagaugcaauauagcagcuguuuacacaauauuuacauuguauuaguuaugaauaaucuagagaugaucuaaaguauacaggaagauguauguugguuauaggcaaauacuauauaccaugcuauauaagggacuugagcauaaggaguuugguuucugagggagguccuggaacaaauuccccguagauacugggauuagauacggaaggacgacugugccugggacauaguaagugcucagugaaugcuauaauuauauuuuaauaaaaaagaaaaaaagucauuuucuuuccauacaacuauuaaacaaccuucugccacacacacauaauuuccucauauucugggauuuuuaaauagcuggcccagguguugaagaagggauuuuuugaaagagaagugauuuacauaacuucuaaaucuuguucaguccugagauuuuacgauuccaugacccucugguaaguuucuuuuuuuuuuuuuuuuuugagacagaguuucgcucuuguugccaaggcuggagugcaauggcacaaucucggcucacugcaaccuuuuucuccuggguucaagugauucuccugccucagccucacaaguagcugggauuagaggcaugugccaccacaccuggcuaauuuuguauuuuuaguagagacagaguuucaccauguuggucaggcuggucucaaacuccugaccucaggagauccaccucucagccucccaaagugcugggauuacaggcaugagccacugcaccuggccaauuucuuaaaugauuugaauuagugagacuauuucuuugcuggagaaaagacggaacuaauuuagagcaguuacaacacucugggcacuuugaugugcacuuuaccuccucuuguuuggugcugggcagucuuuagaugaguccuuauaauacguaagcuuaguaaacugcgggagggugggggcaaauauagcugagagauacccccagagggcaggggcacagaagugcuuguuccuuggaggcaccacuuaccaaguuuggggcagggcugguugggaaccuacugaaagguuuagcugcgucagcuucuuggggaggacuugauaacagcgauacaaggcccagaaaagguaaacggagaauggaaauggugugaggcacagaagugcccaccucacaucgcccagacccagcccgccccagcuccaugcugcuggugcugcugcuccucugccuugcaaagggcgugcccuugguggcgugagugggccugaaggccggccauuucugcugccuucgagcugaccugcaggucaucaaagagaaugaugaaagaauagcaacccaccuuggaggggugcucucuggggagugucuuccaagauuucucaaccuagcaccgcugauauuuugggccagauaauuguuuguuaugggagccauccuguguaccgcaggauguuaagcagcauccugggccucuacccucuaaaugccaguagcaucuacccaugaaucgugaccaucaacacuguauguagacauugccaaacugcuaaaugugccgaggaaucaaaauugccccugcuggagaaccuugggucuaaauaaccaaaccaguauggagcuuguaagugcuaccuuuuuguaccuuuuuguaccuuuuguaccgugguuguaagaagcaaccacgguugcuucaugcucauaggccuggaagucggcucacugcccucugcugccccaacaccuccucacgcagcuagccccagucacagcagcuugagcuuggaagcacuccuggauugccuuucaucgucagugccaagggccuccugcuccuccucagacugucuggcccauauccccaagccuugcuggguggggagugcaggggugaugucauugugccuucccaggauagguggaacaaaggagggaguccccaaggacccgaagccugauccucuacugagccaccaaauagauuucuuuuccccucugucucccuccuuccaacuucauaagcauuugcuguucuccaagugcuccauuguaagaggacacgcuaguugacuggggcuuugugugucucuguugaguccguuuccugccccucguguguuaugaggguguugauucuggucugguccccggauggaaucuucugugucuuuuccaacgugggggugugaaccugaggaacuuagacccugcgugauuuuuccagcacucuugcacuucguggggccugcuccugacugugaggagaguucgaagggaggggaacaggaagagagggcaggaacacaagagcuuguuuuuuuauuuuugacaucucuuccuccucuucuuuccucccaccuacuuugaguuucuaagaaccaugauagcccuggggagcccucccggcacagaucucagucuguuucagcucuguucucugcacccacccaugaccucuccauuugccucucuguagggaggaggguugggauugggcuguaacucuuuaggacagggcacuaaggaaguauauugacuguuguuucuggcaaauccucagaguuuccuugugaaagaaccuguuaauucaaaaccugaaagaagucugggugcuccuuuagugagagauucacccaaaagagugacaauuggcugaggaacacauuuugugcuuguuuauuuagaaauauuuuaauccaagcagguuuucauuuugaucuugcucccuugcuucauuaaagacauuuucugacuccaguauaacgcauaaaggauuuuauaauucacaaaaaaaauuguuaacccuaaauacauauaaacuaugaguuacuugccuccuugauaagaggccaucugugaaaugcaccuuacauauucugcucuagaccugcucuuucagaauggccaagcuuagccccagaauuacagcuccugagucacuguaguaaaguugccauccaucacaaugauuacgugaucaauaaugcauguggucuuuucugugggaccugucaugauguuauuggugcagcugcuucuccacugcagccugccccuuacugucuuuuucugcuuccucuaauccuguccuuuuugauccuguguuucugguuggccuuugucccuggggaagggcccuccuucugucuggauggguagguccuuuuugggaaaggcaggaccucaaggagccgcugacuguagcagguggccggggaucuuggcaggugccccagcugauucuccugccaggucggcagcuguaaaaccucaaccaaugucaucucugccucauucccucccuguggugggugguggagugaguuuagcaaagccuucagacagaccuucccaggguguugggcuguuugcuguccuucuggccaaccugagaacccaguacucucaggcgacugggcacaugccuuauuagcaaggguggcuuuuuaguuguuacccccacccagugguuuugaaauacaugccaaauuguugagcuaucugcuuuuuuuuuuuuuuuuuuuuuuuguagauucguguguaauuauuuuugucauuuggguuugcacuaggaguaggucuuagauuuuuggcauaaauucaugcugguggaacuagauauaguguauguaacauagagaacagagucagggaguaagagugguuggguccaggguacguucuguggaugucuguugaaggucuucagcaaccuauguuuagaacauucugcagaggcaagaaguuugaaagccuauuuguaugguaugugaaggccaguucugggcaaauaugucuagaguuuuauaccuuaaauuggacagaauuugauuacugagcuuugaaaaaccuuuaacacuguuuccuggaugacuugaauguacaacaaucacgcuuuagaccauaaaucagcaguugccuuuucagcgaaggaucacaguauggagauuauauuuuucuucuccuuuuauagaagagaacauugaauccuguguugagucacauuuuuguugaaaccuugggcccagacccugcuuucccgaugccugcaaagacuucccgaugccugcgaugucuuugcacucuaccauguugcuugccauuuucuuuuguuguucauggugugugugacugagcaggugaagacggucauugccaaggucaugaguuaauuuaucuuguccaguguugcccaauccuuuguagaugagggaagcaguuuucugcugucucaugagauuuccuacccuacacccuuuaauauacucaccuuuuggaggaauaauagcuguaacauguauguaggaagcuuuaccagucaaguauuaugguauagggcaggacugcaaaggacccuguugucaucugcauccugcugccucuucagcagggaugggagaaaagaaaggggagcaaaggauguucugcuggcagugugccugggagcucacauguuuaaggacuggacaguuccuacacagaugcuccuugacuuaugagauuauaucccaguaaacccaucguaaagucaaaaaauuguaaguugaaccaucaguaaucaguguucuuucucaaagacaugaccgcaguuaaggggcgcuaaguagagguguccuuggaggucaguuuugcugaccuuccucuggcuggggucuuguggcccugcuagcaugugccugcuccugccaguucuguggucaaugguaaaacaaguucuucucugcuugcagaugagcgugaagccgugcagaagaagaccuucaccaagugggucaauucccaccuugcccguguguccugccggaucacagaccuguacacugaccuucgagauggacggaugcucaucaagcugcuggagguccucucuggagagaggcuggugaguggagaccuuaggaagugccguguguuguagguggaaaauauuuuugaaaaaucaagugugacuugucuccuguugaauucugcacuuaaugguugauaguuuugaggagaaucuugagaagugaguugagcgcuucagggagagccuuagugucacauucugagcguggaugauguucuugagcuguaauaaagccacuuuguucugguaauuugcaagguugccaccuuuggucagaaagaacuuggcugggguuccugccaagaacagggcauggugcuggaauuugaagggccaggcuugggcgcuggcuucuagaugaaccugugucccacaugcgaugauggaauguuuucuaaauuugugucuuucugguugucuagaaaaucugagcugccaucuuaagguggcaagcauugaauucaguggccacugauguuuucuucccugcacgcuuuuuauuuugggaguggagggagaagcugguguuuugucaucuccuugggaaaggagcuucugaugaauucacccugccuuuucaggcaggaaaguugucagccugcaaugaaaauuguauccccaaucuguuucccagagcugcugcggcccucucugaugugacucuuguuuaugcaccuuauaccaaagaagcuuaaagcagucacugugacugauccaacagguuuugucucaccuugguuugaaaaugguugcuguauccucccagagcacauguagugccauagguggaaguggugccgagccagaagccaacgcccagaauggagaccacaucuguacugacaucaccaggaaaauaugaugcuggcaguuggcagggcugccagaaagccuuauuuuuaacuugaucuccacccuguagcuugccagccgcaguaggccugugugcagaccugccccacaccucugaccgcaggcaagggucuaagguugucccuuguccuauuuguuaucagcucagagacagacugccucuuugagucuggguugaaauggagccagaaaaguauucucuucccugcccuucaguucaagaacagggcucuccagaagauagugaagcccugucuucucuguagugaguuucauccaugcccuuuguuccugagcauguaggucuuguggccucauuuucugugaggguuugucggucacacuagacaaacuagacaaauaacggagaccccugcucaaaaccaugauggcuauaagaaggcaguugauuuguggucugggggugagggaguggacccacauggggaguuugaacaggccauuuauugcauuuugauuugauuuuccaaagugagucuuguuugagagccuagacuagaauuauugugauaugcagcuuuaaguauaauuuuuauaaccagacuuccuuugucuaccucucaaccuuuuuuuguuucuuaguguuuaaccuaguauguuuauuuauugauuuuuuuuuuuuuuuuguggagugggggaaugguguuuugaaaguagcuaaaaaaaaucauuaaaggucacauggauaggaguuagucugaacauuuauuuuugugguuuuuuuuuuuuaauuuauuuuuguuccaauaggguccaaucuucuaggcuguagggaguaaacuguucaccuuuaaagacccauaauuauuuuauaccaagaagauuguguccuugauaauguccacaucauaaaugggaucaggcccauugccguuuuuucugaacagggcaagaaaaauauaaguagggagaaaaaccaguaaagcauaauucuuagaugugugugaguaucucccacuccucuccuuauuuguuagcaguaaguuuuuuuguggcaacccagagaccuaggagaguaaggaugaagaagaugguacaguggcuaccaucuccaaccucuuaggcagucgauaucaguaguuuuacagaacuuuguaaagccccuagugccuucauuuguauuacccauucuucacagccaucuuggauuauauagguuggccagucuaauuuucuuauuccaaaaauaaagauaccauagauagagugcucuuaaagcucuuguucaucugggcuggagauuuuaagucucuuuggccucguagucuguuugguucauggaacuuccuggaaaggaaacacaccacacacugccuuuggccguggagguugccaggaccucaaguuaaagauccucccugcagaagaccuccaugagagcuugccccaaagguuccuugcauauucagauuccagaacuaaugaggugguuagagcuuccaggccuggguaaaugaaugucccagcuaagugugucaucagauaacauuagcugggcuuucugcaccagugguccaaaacccuggguaacauaaauguuugcacucuaucuggagcccagucuuugucagccagcauuuuagccccagcacuuaaccaccagcuuggcaauagcuagcagauaaauguuugagggacuaggugauucaauuuacuuaauuaauagauucuuagagccacuuccuuuacagaggaggaaaucugugaaugugugcauguguguuuucugaguaaaguucaaagaaacauuaaugacccagacaauuccacccucaccccacccuggauuuuggcucaauaauauuugaguuaaauaugagcaaguaucauguaggcauuugggaacuugauuuugaacuacucagcaacaucacaaggcagagaucucugguccuggccugguuaugaucuguguccagaagugucugcucccucucggucucagguguaucagcucauagagcagugagaaggcugagagcugggccaggaagcuucugcuagucaggauuagauugauuagaaauaaaacuauucuuuucucauuucuuauucugaguucacuauagucuauaacucuccauaaaggucucacuugaaaaaugccuuagaaauacagacccacccuuuacuuuaacauuggauuggcagauaaaagugugagcacagaaccugugcuggccacuuaguaauuagaccuagaucucaggaccagaguagaaugaggcuugaggggugaugguuugcccugcagcagcguugacauguggagagagaggagccccuggcauacgauaggccugcacuucaaugguaauguucugcccacagcucauaauccacuuuagaugcuccccauugccugccaucucccuucaugggcgucugcagugaagauugauucucacuaugguggccaguuuuuugccuugcuccuggccagacuaagcccucgccucugaccgagauagagugagguuuuccaaacaacucugcccucccccaaaccccaccaagucaguuaucacugguuuuugcuucccuguuguuuccugaucuguauucugucuucuuacuccaucagucauucucugagaaagcaacagaaaagagugugugugugcgugcauguguguguguuuguguauguugccaccauuaauuucaaagcaggcugagcuagguggagaagauagauuuaacaugagauuuguuaagccucaaaucccacguugaacugcucugaguuuuuucauaaagccuuuguuuaagagaaccauacugguacauauuguuuauugaaauaguguuuguggacuggccauggaaccucguugggguuucuuaaaaacgucauuuguaugggagaauuuacuuuuguuuuaaacaaccagccacagaacuccuacauuaaaugugggucuaaucacacaaacuugagaagugaacuaagaguccuaagugccacaugauaaagugccagaugaauggccccagagcccuagaguucagaaggggagaugagcccucuggacaggaugucaagaaaccuuaguaggaggguaggguguggguaggguuccagcuggguccaggagaagagcuucacaggccgggcagccagagugugaaagcucauaguuuggacuaagugaagagagcauuuggagguagcaggcaucaggaacuggcgcagggcaaguuucccagccaaacuggagggguuuuuuuugaaaggaguggugaugguaacuucccuaucacuuguguuuacagaguacucuccuacucuuuucucauucaguucuuacagucuaaugaagugggcaaccucugcuuuacagaaaacaguuaccagugacuugccaaggccagugcugcuaguaggcgauaugguguggacugcagcccacccugcugacucuucagcgccuccuuucccauggagcccuuaggagugggucccagcugggaacaagacaggcaggaagucaugggacacagugugguauuccccgauuaauuguaauugggccaaaauaacuaauacuccucugaaagcucaaaguuucauguguugggaggaguuuggggacuagugugaagugaguuuggcuuuguagcauauuagaagaaauuuuggaauuagugcuucccauccuacccuauguauuccguagaggccuuuguuugugaauguguauagcaaaaaucuauguuuaauuaaaagaaaaaaacauaagcaagugccugucacacugauuugcugagaucagugucuucuguauuuccucuucaccugaacaagagauuggcagacacuguagacuucagcuuuggugcuagugaguccucuguccugcaacacccuguagauuguuaucauacagcuguaagugacuucagugaccaccaaguuaaauccccucacuugguagauaugguaagucagggaaaauaagugaccagcaaggccacccagcuggguuauggcagaucuaggccucauuggccucucucagugcccggggcugugcucugcccagcaccacaacccuugauaguugucacuccagguagcugcaggguuucuuuggacacguauagagaaagaaggggcagggaguacaggguggaacagggcaucgcagcaccccagagaccucccaaaacacccugccagaaaccuucccuuauaucuuccucuccuauaaaaaaaagaggccaaauuagcucucagaagcuuuuuuuuucuuucuuucuuucuuuuccucuccaucucuggagugacaaaaccuuugcgguuguaauuacuccauaguucugcaaauccugaugccuugcagaguguaaaugacccaaacucaaggcugggcaggcaggugggacagagccagugccccaggagggaucacccagcccccuccuuccucucuaaggguuuuugguccaugcgaaggaauugcccaaggccauacugcuucuuaggcagggccuggacuggacucuaauaagcaauuagaauuauguugucagauccuagagauguuuauguagccccuuaaguuuccucuccuguuuuagagcgagaaagaagaugggccugggauggagauauggcugguaaagguuuaggacuagacgggaccuugggagggggaaacagaaaaagugccugugaaaaaaacacaggaauccacggacuguagugugaggggaagggaagcuucuuaaaaugauuuaaaggaggaucaguaaaaauaggcauuuccucagaggaacugcucucugccugcagagccccgauagucacaggagucugguaucgacccuuggccccacguuaagggcguuucagacuuuccugucagaagugacacagaagugcacauguugcuguggggacggaagcaugccgcacuagggaauccgauggccaauaauggaggcaagacagaggacgcuucuuuccuuugcagaauuagcugcucuuggggcaggcuucagaaaguguuuacugcugagaggcgcccccucccucugcuccauuguguuuaauucucuauuguuaccucuucuuccuuuugagaagaugaaguuuggcaauauaaaaauagcucuuuaaaaaaaugaaaaccagccaccagaugggaaccgagucccucacuuccuuucacauggaagcauguaccccucuucccuguauucuggguuuuuccuguacuguaaagaggacgagcuuuaaguccugguucaccacauccuaacuagcugguagauugcuucaucucucugagccacugugucuucauguauaaaaugacaggaauaguaauuauuauaaugcaggguuacugugaggauuagaugugaucacaguugucaaccaccuagcagggagaggugaacacacaguaguugcucaguaaguggcagcuaugaauuuuuagaucuugggaacuuugaaguuuguaugaccaacauguuucuauggauagcucugugagaucaugaucaccucuugaaauuaauuucuuguaauuacugcuuccuaaacuugcccagguauugugcuuuaaaacaugugagaagccuacucugaagcagauagaacacacguugugggagugugugguguacuugaguuuuagucucaauucccacuccucucguauaguaccaccaggaggucaucucaccuugcuguaucuuguuuauucuuguuauucuguggcuugcugguuuuugaguugcauccaggucuggaaugaaccaucccuuaguucaucuggcacagccagucgccaucagcauggggucccugugauguggcauugaacuucuucaaccugcgugaauguguuugggccccaucaccacccucccccucccacacccuggaccccauguucauguggaagcacacacacauuccauugagauuuguagagagagaauagaguuguggaaugucucauacauguuuccuguuuguggggaggagauucugagaggaccacuuuuucuaccgcauucauuugaauguaagucagacaagugauuauuugagaucaagcuuucaggauaaagucugaaagaacauugguuauguccugcugguuggagccugggaagguaccgacaguccccaucuauucauuauucucuuccuuaacuucucauaauaccauccacacugucgccuccacccucuuggagggagacuuaugagaauggcugcugcaguuagaaguuucugucccccuugaucugcaguucccaucaugaagacacuuuguuugugauggaaacagcacauguagcuggaccacucacuaucucacugcucaggugcacgaacugacaagaaaugagaagaaaaggccccugaacagcaaaaaugucagaagccccugcaccuuucuuagaggcaguuaauccccaucccucaaauuugaacaguuuugaaccaggagcuucguucaauccagaaaccaccuggaugugagaagaaaaggggcugcugugaauagucacguuucagcaugagaaaugauagcugauccaggagacaaaaggaaaaacuuaaagagcacacaugagagccauaugcaguucugugacugcuggcggggagagcugcuccacccaccucuucuagggcggcaccgauuacacaggcaucccuuucucggauaggagcguaauggugucugggccagcuuuaggaggcugacggguguaccguggagagagagcaccaguguuaccucaaacagcacuugcagaaucagaguuacagaauuuuagauuaagcccacccguauuuuauaucuauuuuuuccuaccucguuagauugcuugauuuugaugcaaccuggcauugcacaaauagcaaauucuagcauuucccacauaaccgaauuaaaaucauuuugaaguuucuaaaggcaaaauccaccucuuucuuuuuuugggguaaggaggauaucacauuaaugugaaaagcuuaauguuuaaagacauuucuuuuuccauugcuauuauggucugguucugcaucugcagauuuaacugacugcagguagaaaauauucaaggggaagaacaaugaaaaauaacaauacagaaauaaacagugauacaauuuuuuaaaaauacaguauaacaacuauuuacauaccauuuauauuguauuaguuacaaauaauauagccaugauuuaaaauauaugggaggccggggggcuggcucacgccuguaaucccagcacuuugggaggccaagguggauggaucauuugagaucaggaguucaagaccagcuuggccaacauggugaaacgccaucucuacuaaaaauacaaaaauuagccaggcguggugacuggugccuauaaccccgcuacuugggaggcugaggcaggagaaucucuugaacccaggaggcagagauugcggugagaucgugccauugcacuccagccugggcgacagagcgagacucugucucaaaaaaaaaauuaauaaauuaauuuuuaaaguagaugggaggaugugcauagguuauaucaaauacugugccguuuuauauaagcgacuugagcauuuauggauuuugguaucauuggggguccuggaaucaauccccuguggauaccaagggacaaauauauuugaaaauaaaauuuuucuacuugugguaggccucugcacauaaucuuauuuccucaaggucaaccacauucuucuguuuuuacuuguccuuuuuuauaggagaaaagaaagugaaaaauaauaaucugagacuggacagacuuaaaauggccgcuuguuacccaaguaaccuuccuuucagacguuuuccguacagcacauagcugaggaucuuaacuacccaggggaagagcagggaauggacaagauacuaagguagggcuggcugcugcccuuaauugcguguaccuggguugcugcagccuggcccccuuuccccugugagguccgcucagcacacaccaagcccagucugucugcuggcauucaguucacugugcacauaacucugugcucagaacuggaccaaaaaccccugagaauauagaaguauaaagccucauccuugcucuuaggaagcgaacagucuaguuggaaguaauaagagcaauaaaugaaacaacagcaaaauuauaaugaugaguuccugggcucugugguccagccuguuaguuguagaguugugaggaaaagaagagcugugagaaccagaaugauuggaaaugggaaugucuccgggaaggaaagaugggccuuggccugagccuuggaagguagguaggugugaugaggugaagagauugggaagucaagaugaugggucacaggcugagugcguucuucuacauguggaugugugcauccuccuggcaucuuuaugagauggugacaucagcuccaggugcagccucuacuagagggggagugaugggaaauaggaaggagagaaggauggagccagaugggcgagggcaugagcuugguguugguacaacagauaauagaaacccauuuugugugcgugugugugcaugcgcgcacgagugcgcgcaugcacacacacaguggauccuugaacaaagcaggggguuuaggggcaccaaccccaugccgcugaaaaucuuccuaugcauuugauucccccaaaacuuuuaauagccuacuguugucuuaucaauaauauaaacagucaauuaacauauuuugcauguuauguguauuacauuacuguagucuuaaaguaagcuagggaaaagaaaauguuagaaaaggaagagaaaauauauuugcagauucauuaaguggaaguggaucaucauaaaugucuucauccuugucuucacguugaguaggcugaggaggaagguggggggauuggucuugccaucuugguguaguagaaguggaggagguagaaggggaggcagaagaggcagggacacuugguguaacuuuauggaaauaacacaagcagucuugaauaauuggaacccuuggaacaaauucaauuuguuuucugguacugcuuuuacauccucuuccgcaucauuugucaucuuuuuggagacacucauuuucaucaagucgucuuccguuaauucuucugauguggugucugauagcucuugaauuucuccaagauccguaucaugaaaaccuucaccccucuaccuuuuugccauauccacaaccucuuucauaauuuccuucauuggcucugucauaaauucugugaaguccuguguaacaucuggacaucauuuucuucagcaggaauguauuguuucaggcucgauggcuuucacagcuuuuucuguaacaaugauggcaucuucagugguguaguccucccagauuuuccugauguucucucuguuggggauucuauuccauagcaucaacaaaucuuuccauagaguuuuguguaguaaugagcguuacaaguccuuaugaccccuugaucuagaggcugaauuagggauguuguguuuaggggccaguagaccaugucagugccuucaguguugaacucaugggguucugggugggggcauuauccaauaccaaaagaacuuuaaaacgcagccucuuacuggcaagguacuuugagacuucaggaaccaaaacaucaguagaaccaauucagaaaaccgguugucauuguccaggccuucuuuuuguacaaccagaagacuggcagcugguauuuauuuuuucccuucaaggcucaaagguuagcagccuuaugaauaagggcaguccugauuauaaacccagcugcauuugcacagaacaguagaguuagccuaucccuuuaugccuuaaguccuggugcucaccucucuuucucuuacugggcuuuugugaacagggcacuuucgucugcauuaaaaacuuguugaggcaagauacacuuuuccuucauugauuuucuuaauggugccugggaacucaucugcugccucuuggucagcaaaagcugcuucucccaauuccuugacauuuuuuaagccaaaccucuuuccgaaauuaucagacugggagcucugugaaccuuuccugguucugagggcuacccaauuaaaaauuaauagucaugccauccuuugcugguguuacauucuccagccuuagauccuucaccuuccuaugccuuuaaauugucauaugaugacuucauuuuuucucaaaucauauuaguccuuagguaugccucucuuauggcaauccugcacucacauaaaagaugcauuuuuaauuaauucauuauuuauuuauuuauuuuguagagacggguuuuugccauguuguccaggcuggucucaaacuccugggcacaagcagucugcccgccucagccucccaaagugcugggauuacaggcaugagcugcugcacccagccaaacgcugcauuuucaauaugagauaaaaagauauuucacaaaaaagugcaaggucuuugcaucugcugguguagcuucagggauggcuucacaaauuuccuuuucuuuuuuuagucuucaaauggugggccaccacaacuguagaccucaaucuacaauacauagcaagcaguucauccuuuucuuguaaugucaugacuucucucugcuucuugggaguacuuccagcaucacuaguggcacuuugggucucaugauauuagucaagguuuacaguauugcacuagacacugugaaaaauacacaagaacugugagagauggcuuuuuacugugauacccaauuuacuagagagaccacguggagaugauuagcaucauaggcauuuuaaguaggcacucaacaauacuugagcucaucacaguaggaguuagagauggcucugaaauuacuauaguaguacaguacauaccaagauuuaauacugcucaaauggugccauuacaaucuguguuuguguguaugaguuuugauaauuuuuaauuuuaugacagauuuguauauauuuugcgguaguaaauuauaaaauagacuaacaucuauauauauuuuaugcauucaugacauaccuuuuucuuaauuuuucugguauuucuaggcuaggccauucaucugaaucuuuucaaauugucaccaaucucuaaaaaguuuuccaguuuauuuauugaaaaauauccauguauaagugcauuugaauaguucaggcccaacuaaaggucaacuguguauauuuacuauauuuuuauaguagaugugugugugcuuuuacaggagacguauauauacuucuauaauaguauauuuuauaguagauguauauauacacauaugcauuaucuacucucucucuauauauauauuuuuuguuuguuuguuuuauuuaaaauguucaccuuccaagggccucuuuuacguuuugauaaaacuggguagagggaagaaacauuugggguauuuaaauugcacuacacucauuuuuuucccuuuuccccuucuuuucaguaaguuauacuucuuuacuuaaccuucaccccaucccuccacacacaaccaccacuuggaaauucuucugauuugaugguuguguucccuguuuucauuuugagccaagcuuaaggguugccagcagguggcaaaccuaauuuuacauuccaaguaaucagaaaauccucacagguguuuugucaugcaccugcaaaaaaaaaaaauuguauggauggcagcaguagcgcugaaauucuccaugaaaauuggauucucucuucccugaacuuaaacaaaugcucauuuguaaacuauauagcuccacaacuauucucuaaagaggaaucaguuaucauccccuuaaguaaacuuuuuuucuguggccguuagguaaauaccguccuuggacuuaaugaguacauguguuuguuaauguucugcucugagcgggagagcauugcaugaaugggcacaugugacuaggcaguaacucgggguucaucucuacucuguugggugaugugucucuaccucugcucuccuguuucuagccuaaacccaccaagggacgaaugcgcauccacugcuuagagaauguggacaaggcccuucaguuccugaaggagcagagaguccaucuugagaacauggggucccaugacaucguggauggaaaccaccggcugacccuuggccucaucuggaccaucauccugcgcuuccagguaagggucucugcccaggguugcucagaacuuaggccgaccucucagguaugagcauuguuauagagcuggccucccuguaucagagggaucgggaagaccagguugaaagcaugucucagagucaugugugucauauccagcccucagaauugaaugcugccucguaggcacguggaagcuacuacauccuccugcaauuguacuagcccugguaaucuuagcuuuccugucagacacaucucagcggcccaggggcuucuaggcugcaucccagcccgccacuuugcuggcaccugcucuaaacaucuggucucugcugcuuggcucucaggagcaaagguauaaggacguggccaaugcuagguuauuagcuuagacugccucaacuucacucaacuaugacauguguuacagaacauuuuuuggcaaagcuguugaggguuauggcaugugugugggcuccauuuucaccuucucauucucuuuggaugugaggaagcaguuugcaggaggaaaguacaaaacucuuguguuucuuugaauugaugaugcuuuauggguuuuguuauacuugaggaggaaggcucuaaguauagaaguauuuuaagccggaagguacucucaaggucauuuuguccacuucuuucacuuuaugaagaaaucggggacccacagaaauuugaaaccuugccucugaugacacagccagccagggcuauagugggugccucugaccccuuaagagagagcgcucagccuuuugggacugugcaccaccacgagccugauuauugguucuuucuccaggcucaugcuucguacucaugcguuccaauuaaaauuggaaaggcaggaacaacuuuguaccauagugucagguuucucugcgaacaaauauucuaacaguccugucuccucagugacuguguucucuugccauuccuuccuguucugccccuuuaauaaagaucuguuuugauuuuucuggguaaacaaaaaccucacacaaaaaggaaaaacgaaaaaucaaauuauaacuugcuuuguuuucuuauugaaacucugaaaucagccugucaacagucccuuuuccuucucacuugcccuacgauugggcuucaguuagugucgugauuauauaugugggaagaagggguaggggacuagaaugaguuacaggaagaaauaucuuccugccuggcugguucccaagcuggcugaucaucugaugccuuugggaaacccuuuuaauaauucagguucccagggcccagcccuaguaguucugauuaaguaggucugaagagagaaccacuguugaagaugguacaacaucauuaaaggaguuaauuacagcaaucaaggacauuuuuccccagauagaacucuuacauuucuguuauuuaguuccugaaugauuugaaaauggaguagccauugaauccacuaauuacugcucuugugucuuauggcaacagaggugaaauuauuagcaguacacuccucuagcuucaccccaguuuuauggaguaaaauguuguauuucuguuagcuuuggccugcaauaaucagagcguggaaggccauccugacugugggcuaucuugacagcgggucagcacccaggucagggagcuggcacacacagcccuuuucaggauucucagcgugaauugcuuugagucauugacuaauucgcuuccugccaguuugcauauuccuauaauucaacuuguaaaugcugauguguauuuucucccuuucuguugaggugagaggcauaggcugcugauguuaccgcguggccugcaguguuguugucuuaaaugacucagcuuucuccagcagcuuuauuaaaacauuaccuauucuacaaaaauaauaugauuaugaaucagccaaggcccagcuguagauauccagcauaucuauaaggauacuccacauauccuuguagauacauagggucaagcuucccuguguaccuacaacggucucuccuuccaccagcuccugaauauacgguuuuacaaguucccaguguguguguaugugugugugugcgugcgugugcucucauugcuaccaggauauggccuacccuauaugugcauagaaguguccauuaaauacugaugaugacacagauuuuaugaugcugccccuuuaaaagagaguauaagggccaggugcgguggcucaugccuguaaucccagcacuuugggaggccaagguggguggaucacuucagaucaggaguucgggaccaaccuggccaacaugacgauacccugccucuacuaaaaauacaaaaauuagccaggugugguggcagacaccuaugaucccaguuacuugagaagcugaggcaggagaaucgcuugaauaugggaggcggagauugcagugagccgagaucacaccaccgcacuccagccugggcgacagagacugucucaaaaaaaaaaaaaaguaaaagauggugagaaacuggaguggaagucucuaaguuugccuaguuuaaauagggagcugucuucauuucagaaggguaggcuuuguuuccauaugggcaaaucuggaaacagauacccuucacacagaaguauaagaaagccaauggguuaauguguguaaaguugcagccugacuuuccuggugagccugucucucaccccuugagugaggguuguucuuccacauucccuuucugcacuugagcuaaugauccuaauauuagagacugggguuuauacagacucaggcuucaccuucuuaacacaauuaaaaauagagaauuuuuuuuuaauguaguuguuucaauucccagguguuuuuccuaguugaaaguuucuaacuuuuuaauccuguauuuauauauuuugucuucauuuucucuguuuuucaaaaagaauucugggaaguguuuguagauugaauggagugaagguaguggggagcaugacagagcagcgaagcuuaaaauggcuacagcuggaggcaauggauggacuccuggccagcaccauccacuccugacuccauuccacauuuuacucuacaagaggaaacuuucauauaauagacaaaaguguauuuggagcauuugucuaaaauuacguagcuggcaguuggcgccuaaucuaaaaacuaacauucacagacccuuauuacgagcucugcacuuuauuauaucauuuaagugcauaacagugcugugagauuagccacugucauuauuuccauuccucagauggggaagcuggggaaccugcccaaggguacaugguaggugauggagccuggauucacauccaggcagucugacuuuggugccagccgaccaggcuuuguguauaauguugcaaauaugcugccucugagcggcuuaugaaggcacaccauggaagcacagcguuuaagcccacacuugcucuaauaguuuggaaauggugcacacagugcccucaucaaugaagguugcacguggugugaaaaauguuuacuuacaaaaaaaccgaacucaguauuuuucugggggucuggugagauuccagaugcacuguaugaaccccugugcuagauucucacuggaaagauggguugucucagggguaaaaaugaccucugauaggugcugggaagucccgucagccuucugucugugugacauagaaaauguaguuuucguuguguuucugaagugagcccagacuucaggaagcaguuuucauugacaggguagaucgucugcagggcaaggcuaugaucuacaguuuauucuuuauguauaugcagaccuguucuucagugguucuuuuaggcagcugacccaucuauuugucuaauauuucuuuguaaaucuuagauccaggauaucaguguggaaacugaagacaacaaagagaagaaaucugccaaggaugcauugcuguuguggugccagaugaagacagcugggugagugugaaugaagaggguauuggggcugcuucuuccaggacugaauuccacugcagucaucacuuagaagguguugacagguaucuuuuccacugcuuccauugggaagucuuguuaacucgcaagcaguugauaugacuuuucaauuagcucucagaaugaaaggagcucuaauuuauauuuuagaccugucaugucuucauaaucaguuuccuucucuuuauuaaggaagcuccagagagcauuauauuuugaauuugaaaacccuggaagcaugcuuaggaaucauauccaugauauuuuaagaauacaguuguagguuuucuucacccuuuaauuucuguuuuggggagcuuucuuugcacaguaaacaacagcauaaccuuuuaauauuaucugugucaguuucccuuuuauuuuuucauugaaauuucagugaaguuguuuuuagagaaccacaucuuuuuuguugcuuacuauuguuaggacucaacugaugcuaagccuucgaguucuuagcaaauugguuuaaggucauagguacuuacugagacccaauuuuagguuaauuagauuuacugucagaacuacuuuagguguagauguaacucuaaugaacauuaauucagaauaugaaaaucagaacuccauccauucugagagcuagcugaaaagucaucaugucuauaaagagcuuauggccuaauaaaagggucaagucagguaugaaccuuuaaucagcuacugauauaaaguuauuaauagucaauaugguauagaauagcugauucauuauggguaaguuucacacauaaauuuuucagggagguacuacuuuuacaaacuucauccaauuaaguggcguauggaagaaagaaagcugagugucacuugaacagauagucccaccacuucuugucccaaaguaacgugugacaagggacugcagguccuggugucuuuguagguagaguagaaagccaauggaagcagaggccucagaggugucuagguugucgucacuuuuuccuaaguaagaguaguguuuuaaaucuacgacacaguucacaucuuuugugagacugaauuaccaagcaagaaaagccacauggaugcauguuuuauuuuuauuuuauggcaggcucgaguugacggauuauuuguucugacuugauuguccuuagugauauucacugcuuuagguuuuacaaugcuuacagacuuuuuauuaacaaagcacuuggcaaaaguauaaaccuccaugugguaauuguguugcuuuucccuucugcuuuguccuuggcagguaccccaaugucaacauucacaauuucaccacuagcuggagggacggcauggccuucaaugcacugauacacaaacaccgguaaguccauacaaaucauccuagcaaucgugggguaaaagguugcuguccuuccauagcagauuugggugacuuuuccauauccguuggcuuaacugucucaccgugguggaaauuucugcauuccaugugaggaaaauaugggagaauauauaaauucuuccaaacagaauaaacagguucucccuuaaucuuuuuuuucuuaauuaacuuugaaguguuuauucaaaaaucagguuucauuguuugaugauuccaugauaguauauuuuagaguuuuacuccacuaauuggugauuuuaaccuuuuuggaguaacagucauguuucauuagucauauuucuuuucaagccaugauuuuuguugugucccacuguuguucugcacaggccugaccugauagauuuugacaaacuaaagaaaucuaacgcacacuacaaccugcagaaugcauuuaaucuggcagaacagcaccucggccucacuaaacuguuggaccccgaagguagggacucaagggauuacaggugggauuuuuagcaucuguaccauccagguguuaauguaaaaucuguuuugugucagucuguuucauuugggaguuaucaaaggaagagcuuaauuuugguuaugggaauuuuuugaggauuuauggaaaggaugacacucaaaaaggccuugaaagaugaauacgauuuaaacagagucugaaggagagcgugugcgggcagagcuacuagcaugugcaaaggugcagaaccaggaaagaagaagguaugcuugagggcuaacaauucaaugggaaugguguuuaggguaauagcagggaauaccacuauucccuucuguuaguggaugggauccccauaggggcaacaggcaacagggagucauugaagguucuuagcagcugugcucgaaguagaaaaguagaaaaccuggcauaggcuguuaaugaauacuuguuggcugacauuuaucugaagguggcaagcagguuggauggggauggguggagauugcaggcaggggccuuguuaggaggcugugcuuugcuuaugagcaaguaagaguuuaaaugaggaaggcaccuuugggaaaggggaguguagggguggaaggagcagcagucauaguccuuucuuacagcugcaucccauuaucugcacggaacuaaucccucuuuacucugugagucccuguguaacuuggagcugaccuguuuggagcaguuccccagguuguaguucccuugcuuaauaaaauccuaauucuggguuucauuucaacaugagcucucauaggaacuuuuucuaauuuugagaagcauuuaaaauaucuggauuuguuugaagugcuggagauauauagauccucucagcugugaacaaauauuagagaggaaaaaaacuguguguaugugagugaaaguuuaaaguucuuuuaaauauagaacaggaaguuuaacuccccaaaggcagaucaaggucaugaggcugccaggcaggcuucuugcuauuuuccaaugcaucagauucacugauauguuggcuacaggaagcugagauaaaauuaucuuuguacuaacccauuaaaugguuucucaauauaaacagaaaacuaaaauuccuugggcuucgauaaaucuucaugcuuaaccccuaucuuacuaugggaaggaauuuuuccuuagcccuaguucuuugugcuuugauaaagaaccuuuuuuucccuaucgcagugacaacauuuuuuaauaacuugcucauuaguuaaucuuucaaucaccgcccaguaugaaaagggggauugauguuccccagaucacaagacgaggagcuaaaaauggcagcugauuucacuuuuauccuguggguuugaucuugauuauuaguuguccagggcuccaaagaacaucaguuaaaaucuacuuguagacaaguuaaauaaaaaguuuuaccuucucacuucuuugaguuuuguugacauuuuguguugauuaaauuguauaccuacacuggcauuuuuucuggcuguccuccaguucacucuccuuugugcacacuuugacgggcugagcggacacaggagcccugggguagggaacaguagcugugauucuggcccucacaaccacgggcugccuuagugacccugggcagggagcaugccagcaguguguccugauguucucuuguuuaaauuaagagaaacaauuuugcuccauacaaggcugucaggggcggcgauaggaauggggguguauguaugaauguauauugaaaaagagccugauaauaucuguuaagagcuguccuuuguguucucuucacaaccuaucccaaguugagugcuuacucaauauugccgaacuucaaagacuugccauuuuaaguuguuuguuccuucucucaguaccuauuuauugaccaccugcuuugcgcaggacagcacagcgggaaugugguagguggaguggcauaggggcuugcccggacaggcuucugcccuuggggacugaauuuuguaaggcaaacaaaacaugcauaaaaaaucauaaccuggcaaaaaguggacuauguguccauacaaagccccaagggaauagaggagggagacaauaaugucagcuguggggaucauaaaugguuguauugggugguaacuuuugaaauggaccuugauggauaguaagaaaguuauggggucaugaaggccauuucagacaaagggaagucauaaguuaaggaaggcguauuggaaauuauguguguauagggaauggugaggucaaguuugauucagagauacagugcuagguacaguggcucucaucugcaauuucaccuccuuaggaggcugaggugagaggauugcuugagcccaggaguuugaggcugcagugagcuauaaucaugucacggcauucuagccugggugacagagugagacccugucucaaaaaauuuaguaaggaauacaguguuugagagguaguaggcuauagaauuuagaaaugucuagaccaaugcuugacacuuaaaagaagccuggugaauauuugacaaauugauggaaaaaagggaaggaaaguuauagccagauucuggaggacugaagcgcuuauaguuuauucuucagacugaguaauuuugagcuaggagaaacuguguucacagcugugcuucugaaagaucagucugggugcacuaugugaaggaaaucgggaaagcugguggagggagccauuguuucagggcugguuaugugacaggaugggucugaaacaugagugacaauaaggauuccauaaauaagggucaucccaacuuagacucagugacuagcugcuggauacugguaacaaagagauaaagauauccaaagacugauugacagggggcggugcugguccuguaggcagcaaugaggacucaagcagagcuaacccaguaugguaguagggcaaggagaggaggaacuaugugucuguggaaggcguuucaugaauauucacauaauggggaaucagugagaugguuuaacccucauuauccuuguaauuaaugcacggauggcagaacacucagguacaaacaugaagacgcugaacuguuccauguugaccagcagucguugcauuuguuccugcuaccuggguggggcacaguagcaugcaacacacugaacagagucuucucuggguuacagacaucagcguggaccauccugaugagaaguccauaaucacuuauguggugacuuauuaccacuacuucucuaagaugaaggccuuagcuguugaaggaaaacgaauuggaaaggugagcuggugccaauuuugugaguugugagacauaauuaagguuaauugagcccucauucucccaugcacucauaaaauuugccaauagcaauuuguaguggacucuccggaugguagggaaaucggcagaagccucuucauccugaaggguaacaagaggugggagagauggccaccauauuuaggaaaggaucugggggcuaucucaaacccagcaacaucuuucuccucaacugcuccaggaaauuggguauuggaaaucugaucgaguugccuaaugucaugggugugacauccuacuuaccacaguugaaaaggccccagcaucgugcuuuuuacuucucauuuggcugauguucaccugccauguuuucaaaacaccucagaccagaugacauuguccucucaaugcagugaagucaaaaauuaaugggcauuuaugggacaggaucaagcuaaauugagcccuuuuuguuucucuagggauuucagauguuaggcuacagaaaucauucagaaucucuuugcuuggggguuggaaaguuacagaaccaauuacaguuaagcugucauugcucacaaauaauaaucacagucugggccccucuuagcagaugguuccuugaguuaaaaugcuugugcccagguacagcugaacuguuucagagcuggccaaacuguuucaaagccggucguuuugugugcaugcacucguauaggguuacaaucguauuuaacuuauggagugacaugaucuuuucaauuuuucuaucccuuguugccaggugcuugacaaugcuauugaaacagaaaaaaugauugaaaaguaugaaucacuugccucugaccuucuggaauggauugaacaaaccaucaucauucugaacaaucgcaaauuugccaauucacuggucgggguucaacagcagcuucaggcauucaacacuuaccgcacuguggagaaaccacccaaguaagaugcauauuguagugugaucauuaauauggaaagacacaucacuguagccaacagaucccuauguucugauuucuguaaucucaucucuuaacugaaugccuuucaguaguguguccuacuccuuuucaucugacucuguuuugcugagauuuaugauagaucaugcucucucugagcccuucccaauauaaaugugccacugacauacaggauauaugagaauuccaagaaaugguacaaguccccaaccccuuauccaaaaccauuguaccuaguguguuucaggauuccauaauuuuuggauuuuaaaaaaacagcacagcucauauguuguauauuauaagaccccagaugggacuaaggcaauagcccauaagcccaguaaguaucuguagcaaaauguguaaauauucacauugcauuagauaaagaaagauaauagauaauuucauaacaguucagaacagguuuugcaacccaaaaaaaguuugauuuuuuuucauaucuuuuuuaaguucauaauuguugaauaaggauuguagaccuuaucuauugcuuaccauaguuccaaagucguuuuuucuuuucugaaaacucaguugcauauaucuugguaaggucucuaaaacccauugaaaauuauauuagguagacauuugaaauaauccguguugaaugcauucagcuacacugaaugaaugaaguaaguccauuguccaggauuugggguuuaaaccuugauuuaagugaauacaaaagaguauugcaugccuuugacacccucaaauauaaaugucagcaacaacaaagaaauuccacgguuugguauguuucaagguuuguaauagccaauaagcaaccuacugaugucucuuugacaugcauuucauguaagucagaccagaguuaaaugguuuuuaaaaugcaugacagugugaaauuuuuuuuucuccaguaccaaaugaauguuuuccccuguguuuagauuuacugagaaggggaacuuggaagugcugcucuucaccauucagagcaagaugagggccaacaaccagaaggucuacaugccccgggaggggaagcucaucucugacaucaacaagguaaaguggaucuggacucugcaugggcccugaccuccuggaggcuucagguucuaucacuaggucucgacugcuaagaggacaagagacuggaaggggcuguccccaccugccgaauugacaauuggcagcuggugcucagguguggcaaaggaccaagcaagcaaugguaccggguuaggcugcuggaggcuucagggggcaauguuagauuuuaucaaaccagcuuuggcguaggcuauacaccuugcuacucagauacauaucacuuuacuucucaucugaggcaauuguuucaaacaucuuuaaauuacagaaaggagaaauugaaaccuuauuucauguguuucauaguaguuguggggcuuaggauguuggcuucuugcauuagagaugcugucaaauaagcaauuuuaaucaucaugccuauuaugccugcaguuauagaaauucacagcaggcauuauuuccaacuagaaagaaauuugaaaaauucuagaacuuuggucacuuguacagaacuacauuccuuuaugcugcucauuaaaauuuuuuuuuuaauggaggcagggucucacuauauagcccaggcuagucuugaacuccuggccucaaacaguccucccaccucggcuuucaaagugcuggaauuauaggcgugagccacugcgucuggccccacuuagauuccuucgaguggaagguuugauuuuuuuuuuuaggugaagaaauagauuuccuaggaaugaauuuaauauggacaguaggucaggauuuugaaagaaauuucagauguguaaauuuuuuaaaaguggcccaggguggaaugaaugagaaauucauaugaauucuuagaagaaucauuuaucuuuuuuauaugaucaaagcuauuuaagauaauuuauuuccucuuaaaguaagagauuuauaauuuacuuauauugcuucauagcuacaguuuuguuuuccaaguacaacacagaaucuuuagauuuagaugacggaagaguguucccaugaggauacacugagagaaaaacccguuuuuuuccucaaggcuugagagucagugagagugggaaugggauuucccauucaagcugucagguccuuuugagaaauauuagcuguugacuguaaccacggaaguuuccuugaacacugcaggaaacuguguuuguguguguguguauuuucauuuuuguaggccugggaaagacuggaaaaagcggaacacgaaagagaacuggcuuugcggaaugagcucauaagacaggagaaacuggaacagcucgcccgcagauuugaucgcaaggcagcuaugagggagacuuggcugagcgaaaaccagcgucuggugucucagguucugcucuugacauuauuaaaaagacuguugcuaggguaaucuagaaacacagaccauccccaggggcauagggccagaggacagcugcuuaucgacauucauuauucuggaggaacgucaggucaccuuggccccuucccauuaagaggauguuuauaauuucuaauauacauuucuauuuaucuaacuuuucauagauuuggaagcagcucaagcagaguuuguuuuagagccauugagugugugugaacuguucacauuuauaaguuuuaacaguuucucucuuuucuuuaaucuuugaccaacuaauccuacgaggcaguuagacugguugugaaauaaacaaaaauggcuugcuuuuccaccuggcuugacauaagcuaucaccugcucuagcuuuucaguaagguacuagauacgaacugggcccuucugcaaaaugagcaguuacuaguuugcuuugaggagggcaucuaagcucaaggcagagaccaguggggugggggacucaggagucagauuuggcuuuaagaccaccagggauuaaugugugcucaagauuucaugucuguucuuuuuccuuuuuuggaggggggguggcgcgggaaauagguuuuuugguuuuguuuuuguuuuguuuuugaggcagaguuucacucuugucauucaggcuggagugcaguggcgcaaucucggcucacugcaaccucugcuucccagguucaagcgauuuuccugccuuagccuaccaaguagcuggcauuacaggcacgugccaccacgcccggcuaauuuuuguauuuuuaguagagacaggguuucacaauguuggccaggcuagucucgaacuccugaccucaagugaucugcccgccucggccucccaaagugcugggauuacaagcaugagcuacugugcccggguggauuuuuuauuuuccuucuuuucauuccguuucucuguaggacaacuuuggguuugaccuuccugcaguugaggccgccacaaaaaagcacgaggccauugagacagacauugccgcauacgaggagcgugugcaggcugugguagccguggccagggagcucgaggccgagaauuaccacgacaucaagcgcaucacagcgaggaaggacaaugucauccggcucugggaauaccuacuggaacugcucagggcccggagacagcggcucgagaugaaccuggggcugcagaagauauuccaggaaaugcucuacauuauggacuggauggaugaaaugaagguaaaaccugaccgaaaggaaggacgacagagcugauccaaccagggcucucuuuucugugacucauucacuaaaccccuacguacagcugugugccuugucuaacugcccacauguacagcuagagaggagccacaucacccaugggaagauugcuagcucaggaauuaaaugagacgugaagugugaaaaaguuguagagaccaguucaguagccagagcucuguuucugugacuuagauauauuccaguguagggaaucaaucacauugugguuuucuuuauuuuuaaguuuucaggguuaaacuaacuuaccguuucauugaucugugagugagugguacuacuuugggcaggggucccggagaggugguauggggagaagggaggagugguaggugccauggacagaggagaggucaggaaccaggcagccagaguucugauugugagugccugaguugccuaauccucuuugagcccucuuucuuggucuuuaaauggagauuguacuuacuaucuaccucauccaauuauugcaaggauggaaugcgguaguaugugcacagaucaugggaugggcuggauggcaguggcuggucaugccauuuauugacugcucuuagcauagaguuccaaccuuucccccuucccaggaagagaccugcuaucaugccauggcccuguaccuguucauguccuccaaugcaggccauggaaugcucagccaugccaagcaguucuccagcugggaggccuuuagccuuguagacagaagaaaauaggacaguuuucagacagucccaugaagcuuccuuugucucagcacgcuguguucccaagcuugaccuuaugcaagagauucccuucccaggauauaagcugucaucuguugccuaccucuuggacuguuccugacagaggggcaaagucaucugauaccaucaguuuucccuccuauuguuccagauuuacaguguucuuaggucuggucucucuugaccucucaaaauagaaauguucguaaaauguagcagagagggacuuuucauuuuauaaaucaugaugcacauuguaacucaguugguccagagacuuccucagaaguaagagugaaguagaaaucucaucuggcgaggauguagaaugaggcccccaaauuucgcugguugauggaagaaacaagaaaauaucaguggguucaaacuuaaacucuagaaguugcuuggggucuacuaagcaagacagccaccugacccugcucuccuuauugguuuaaagauguggcuuguaagcuuuucaaguagauuguuuucccauugauuguguaaguacaguagaggcauaccaauaagcuccuaacagaggaaaaacauucacuuacaggcucagcaacuucuaaaagauuucuuucaacuuugaagugaccaagucuaucaccuuuauuuauuuauuuuugaguaguuguugcagcgguuucuucuugaagcuccaguuuauauuuuggaaucuuucauacagcacccccgcccacgcuccccacugcccccucccccccacccuggccccgcuggcccucaccaucuuuuucuucuauucugcacuuuuuaguguagauuugacuuacuuauuccaaguuuggugauccuuaguuugugauagcucuccugacucaggccuucagguaugauuuguuuuguucugguuuguuggccaucaucuuccccugaaggugugggguccauggcagacuagagggaaggcauagcuucauugcuggcucucugcuugucgaaagaugaugugaugcugaagucaaggcuauagucacagauguccuuuugguugcuucuugugcacaggugcuaguauugucucaagacuauggcaaacacuuacuugguguggaagaccuguuacagaagcacacccugguugaagcagacauuggcauccaggcagagcgggugagaggugucaaugccuccgcccagaaguucgcaacagacggggaagguaaggauggcccauuccaagcauuaccuccgggucaccagagauucauauuuauagaaacacaguggggcuuuugaaguuacugugccacuauacauuccugguggguuugucaugggagcaugaaauacgguggaguggccuucugaacacuaacuccaucuuguuuuucuggaauugauacauccuuuccuuaaauacgcaaaugcugccuuugcuuugaguggcuugguguuuggcagugagacuuugucauaccucagucucucuggccaugcaccgacacccugguguggcuguuccagcagcuccuggcuuucacagcugguugcauauaccucucuuuggaggauguuuagaaugauuugguuaugcuucguguauuucuagaaacaauuauaugcagcugccuuuuucauaugauucaagugcuuucuugcaggaggaugaucacuuugucugcgguuuggccaaaaaaaaauaauguuuaucauugcccucacuccuguucuagucaaguuguuagaaggugcuccauugccuuaucgcauggcccugcauuuacauuuagcagugagcugguaaucauaagaauaugggguguagcuuacugccugccagugagccugcacccaugcugagcucccucacacagccacguuccuuccuugauguuaaacagguuacaagcccugugacccccaggugauccgagaccgcguggcccacauggaguucuguuaucaagagcuuugccagcuggcggcugagcgcagggcccgucuggaagagucccgccgccucuggaaguucuucugggagauggcagaagaggaaggcuggauacgggagaaggagaagauccuguccucggacgauuacgggaaagaccugaccagcgucaugcgccugcucagcaagcaccgggcguucgaggacgagaugagcggccgcaguggccacuuugagcaggccaucaaggaaggcgaagacaugaucgcggaggagcacuucgggucggagaagauccgugagaggaucauuuacauccgggagcagugggccaaccuagagcagcucucggccauucggaagaagcgccuggaggaggccucccugcugcaccaguuccaggcagaugcugaugacauugaugccuggaugcuggacauccucaagauugucuccagcagcgacgugggccacgaugaguauuccacacagucucuggucaagaaacacaaggacguggcggaagagaucgccaauuacaggcccacccuugacacgcugcacgaacaagccagcgcccucccccaggagcaugccgagucuccagacgugaggggcaggcugucgggcaucgaggagcgguauaaggagguggcagagcugacgcggcugcggaagcaggcacuccaggacacucuggcccuguacaagauguucagcgaggcugaugccugugagcucuggaucgacgagaaggagcaguggcucaacaacaugcagaucccagagaagcuggaggaucuggaggucauccagcacaggugagcggggcgcuggucagccacuggccuguuccuugugaccaccaguggcccaggaggugaccacccugucaaauugccauuucagauuugagagccuagaaccagaaaugaacaaccaggcuucccggguugcaguggugaaccagauugcacgccagcugaugcacagcggccacccaagugagaaggaaaucaaagcccagcaggacaaacucaacacaaggugagcacguggccagcagugugccagccucccacgugugggacuggggagggugaggucacucaucgagcuuugcuguugggaauuucccacauggggucaucgacauugcaacacugaugucauggcauuggcaccugccuuuugacauguccuuguuuuguaagaagugucucucagggcaacaucauugguugcaggaggauuaucugagucagcccagcaucugccccucgccacaccaaaguuagggccuugguuugaccuguguccaguguagaagguauuaagaugacaccugugcuauccauuuuauaguaacuucaggaacaggacucuagcauguuuaacacuuaauuugccaaugaaaguccugauugucagggcagaccuuuguuccagucuuaucuuucuguugaguaaacauguuugaguagguuauggcaccuggccccaguuuugaagguuaccaucagucuuagauuuggaaaacguucauuagguagaguucagagauguguaaaaugugucacagacaugaauuaauugacucugggaauggauaucuuguaauugcucacauuggagcucuguaacacauuccucuucgugacaggcuuuuuccagauuacauugcaucccugagcuauuuccauuauauuugguguucacaguuugagugagaugauuuuccaaaaaagcauguagucaaagcacagauggagaaaacagauaagcagcauuaacccaucacuguuccuuuugcaauccagccauggucagucuucccuuuuucacacucgcugucugccccugcacucacagguggagccaguucagagaacugguugacaggaagaaggaugcccuccugucugcccugagcauccagaacuaccaccucgagugcaaugaaaccaaauccuggauucgggaaaagaccaaggucaucgaguccacccaggaccugggcaaugaccuggcuggcgucauggcccugcagcgcaagcugaccggcauggagcgggacuugguggccauugaggcaaagcugagugaccugcagaaggaggcggagaagcuggaguccgagcaccccgaccaggcccaggccauccugucucggcuggccgagaucagcgacgugugggaggagaugaagaccacccugaaaaaccgagaggccucccugggagaggccagcaagcugcagcaguuccuacgggacuuggacgacuuccaguccuggcucucuaggacccagacagcgaucgccucggaggacaugccaaacacccugaccgaggcugagaagcugcucacgcagcacgagaacaucaagaacgagaucgacaacuacgaggaggacuaccagaagaugagggacaugggcgagauggucacccaggggcagaccgaugcccaguacauguuucugcggcagcggcugcaggcccuggacacuggauggaacgagcuccacaagaugugggagaacagacaaaaucuccuaucccagucacaugccuaccagcaguuccucagagacacgaagcaagccgaagccuuucuuaacaaccagguaagguuuguuccugccuuugcuuccuuucggugaaagcagcccuggcugccuuuugaaauguuuuggcuggggcagcugguuuaaaccacaccuguauggaauuauauggauaauuuagagacugauuuuuuuuuccccauacucuuaaggcauugaaauccaucacguuguaggggacaggaauugaaaguugccauaagagcugcuuugccuuacaaaguacuguuugauuucaacugccauugaggaucucuuauguguucauaguaugucuucauaauugagguauugauccaauuuaaaagauacagugagggccaggcaugaugacucacuccuguaaucccagcucuuggggaggcugggacaggagaaucacuugagcccagcaggucaagggugaaguuagccgugaucgugccacugcacuccagccugguggcagggugagacccugucucuuaaaaaaaaaaaaaaaaaaaaaguacggugaggauuuuuuuuuuucuugagaccagucugucuucuugcucuagaagggucagggacuucaccugaggacacaaaguagagauuagagaaauaaaaacagcugaggauagucaccaacuucagggcuguuacugucucaaagagagaguaugaaggguacauugcuguugccuugauaggcacgugagaggacccuugaggcugauacacaaagcuuugguuccuuuccucacucucuuuggaaaaaaaaauuuagagcauuaaccccugagggaaauucggucaguuacagugucccacuggguuuuuuuccuccuaacuuuuaauuugaugugauuuaauuauuucauguaaguguaaugaagaaaguguugugaacuauguugcacggaaauguagaacacaggaaaaugagauccuucauugaucugcuaugauuuguuccucuuuuuaaauaaggaguauguucuggcucacacugaaaugccuaccaccuuggaaggagcugaagcagcaauuaaaaagcaagaggacuucaugaccaccauggacgccaaugaggagaagaucaaugcugugguggagacuggccggaggcuggugagcgaugggaacaucaacucagaucgcauccaggagaagguggacucuauugaugacagguacaguuuucugagguucuuaagggagccuugcaccuuggggcucucaaacuucugaaucauuggccagaagcccuugggaguuuagguauaaauuucccagugggcagaauaugggugcccagcagaaguucaucuacccauacagaaaauuagugagcugugcaugacugccugagaaugugggucuggugagacauguacaaguguccacaaaaggaaagaaagccugagaagccaagcuaauucuuaaccgaggaccuguaagagccguagugcugcaucgcgaucagguguaagccaugcccuuugaggauuaacacacgcuugugucaccugauaggaccccuggcgccagguauucccagccaagcccguguuccccuucauccaugagaaagaagccugucaggagagugggaagggagggugaagcuugcuuguucugaguaccuggcaaagcuacaaaggaacauuaccuggacuuuuuuagaaaauuggcuuggauagugcuguaauaggaucuuuuucaugauggagagguaaauaagagcaaagguuauuuuccucuucugccagggcaucuccaggauuggauacacuuucuucauuucuuguuuaaaauuauuuuuuuauuuacgugugugugugugugugcgugugugugucugucugucugucugaaagauuuccuccccggcuggaggccaguggacucuguuugacccuaacucuuugacucacuccuuacucuugccuugccccgguuacuuaaguuggagguuggggcagaucagggguuggaugcacuagcacaggccagucugggccagccacuggaucaaucacuagccccuguuccaguuuggguugaauuuaagggcuugcugugagacugauguaaucaaaaaacaagcccuuccuuucugccucucuucuggccuucaaguguguuggaaaggaaaaauauuccuuugcuuaccacaucugagaggguuuccugggaccccuggucagguugacuuaaaauaagauggguggagaggggauuacucuguuuccaauaaagauugagcuccugucuuuaccacuuccaaucuuuuuuucugagcugauucccaggcugaacuauauguucuagggugguauuguggaauagagaauaacuuauguuaauuauaauuuuguaucuguugcuuuuaaaacagcugcaaaaaagaaaaauaaauccaccaaacccuccuuaaaugagcaugagaaacagcaauugggcaaagcauucauaaccuagggaaaaagaauuuccuuuuuuuguaauauuaacucugaguauuuuguaaauaagauauccuauguacuuccauguuagaugcacacagcugguuuccugcaggcgggcuuggcuguuagggaugugugcauucaggcaggcaugcagcugccuugcugcuuccucgguuucuuuuuauguccccagugcugcaacugcacaaagcuguuggaagcagaugaugcugucuagacuccuggauaugauaaaacguuucagcagcagcagcccucaguuguggcuuaaccuucauuuugcccuugaccaagagccugggcuacugguguuccagagcuuccuuaggauuccucaguuuuaaaaaugaaacguaaagauaacccuguacuaucaauaagcauaauaaagauggaaggagggagcuuuccgaugaccugccaucaggagaacuacauuuucuuauuuuucuccauugauguuaacugaauucugauuucacuuuaauauccccagaggcccacagaauugaaacugacccuagaggguacuugucaguuaugaaaacacacacaucugugaguuccaggugcuguaggagcacaaacuaaguaaacaucuaaaccuucagauauaauccccgcuccucgaaacauccugacacuguggugaagcgauucuccuagaauguaaagucauuauaaugugcuuacguucaggaaguuuccugaguuguugaaagaguaccagaacaaagacacugacucuaacagauguggguggggcaugaguggccuucaaagugccugugagugggaagagacuguccucagccugccccaggggaugugaacagggagggagggagcuccugaccaagagggaaauuccagccacagcacaguucauggggagcaaggaacaguauccagcuucauaaagcaagacccugucucacaccggaaaacaggcucagaaguuacccagcuguuucacucaggcaccugggguucuugacuauucacagaaaccagaacacccgcaucugcuucaugugaugagggagcuuuuuugagucuuauuacagggagagaaagugagagauggaaaagcacucuuuaagacuguggaaacuacucccuaguuuuaaaagguccuucucaggcccuucccuguaauugaauccgugauccaacauggagagaauuuccugaguuucacuucccacgaaugauguccguugcacuaguaaaccauuaagccacacucacuucuuuuaagcgucuucugagucagcggcagucccagaugccuguguggcuguguuucacaccacacgaaggccguugucacaccugcgcauagaucggugucauuuggacaugugacucuaaauccuugccucuuucuucccaucuugauggucccacuauaggagaaaggcugccugggccgguaacugccgggcaugcaugagaguugauuauauaagaaauacauucaggauucuguauggucauauuucucccuuaaugaaucuuuccaguguuugaaguuacuuucauuucuguuauuuccgugagaggcgaggauguguguccuguuguuaauuuccaguaucugggauucuucccugccacuguaggacuucaaugagaugccaugccaaagggaauggaauccuuuaucccuuugacuacuggcaggacuccugcauuugucacuaaacuccaacucauauuaucuccuuucuaaagauuugcguucuugaacuccccuagaaauagaacuggaauuugagggaagggaauuuccuuuugacauuccuaacccauccacauucuuagaugacuaauucuuuuuagcccaaauucacuaacaaucuuuuauuuuuuuaaauuuaauuuugguuucugaugauagauggcaauggcauaaaaugucucuggccuuuauuauuuuuuguuguuguaaaagcaguaaaugucugacauuuucaaggggaaaacuacugcccuuaaucccaucuguagcauaugccauuuaaguguuugcuuucuaacccaugccuuggaguuuuauaucauuuaauauguauaaacuauuuucauuuagcauuauaguauaauuauuuuucuacguuugcauuuugccuaugugguauaagcauauuaagaucccuuuuccugaugcuauggaacuccuuucaacuuaaaaaaauuaaaaaggcauuauuugugucuaacauaugccuaaugauauuuuuauuuacaauaauuguauguaauacuguaauuuacauaauauaaauuauauaugauguuauaacauguaaauauguauaauuucuacuguucuguagccacugguaccugcaggagcuauaggggcagagggcuuuucccuuugauucuccaggcagacaauggcuaugacacugcauugucagcagccacugagggcccguguggugcaugcaucucuacucuaagaucuuucuuucuccuggggaaguuucuucagacaccggucagcagcacguguucaccaagcugcucuuacucagcguguuggagaauccaaggcuauguguucuuccucaucccugccucaggguuugguggauagaggagagaccuugugcaggcacaggcagagagaaauugcucuaagaaucgaaugaaaacccagcucuccucaguugcacucugccuuuauccaucuuaauacccugaauauagacuggcuuucuuguuuaggcaacucaggaguaucaaggaaguguauguguggcagugcuuuugaauccucaguggguccuccccuauuggaaaugaagcucuccgcuauuguaguggagccacuggaaggcaauccuuugcuaggcauucacgcugcuauuucucaguuuccagucucuaagccacugggugcaugaaggaaguuugccaaagagugcuggcaccuucacagcagauggggaaggagccaaguagggagcgagcacccccuuuaccuuagcguuuaccaaauucagcagcucuuuccaguucuuacaaguuauuuauuuaagguuuuguguuuuaacuucuuugagcuuuaguuacccuuaucaauugauuaaaagugggauugaguuaguauauagucuuacaggucuaaaaauuuucauuccuuuuuguuguauuuuuggugaguuuuuuucaagaugagaaacucuuuaucaggaaacauuuguuuaaagccaguuacaugauuauauauauuuucuuagccuuguaugugucacccaguuaugagcuucuugaaaauaaguuuccacuucucccccggugccuaaaauaaggacuuguacaaagcgugugcucauauuuuuuucuuaacaccagauuaggaagcaacaaauuuguauagaucauuugacaguauguucggccuguugugugguuugggcagauuuuugggucucucugggaccauggcuuacuccuuuggaggaugcuaaaaucucuuuaucuugucuccuucacauuauugagaacugcaagcaaacucuuuuuagcauaguuaggaauucaggaaauaaauugauuuguauucuguauuucaagauucucuacuuccuuuuuuaaaaauuauuuuuguuaccauucuaauagacauaggaagaaucgugagacagccagugaacuuuugaugagguugaaggacaacagggaucuacagaaauuccugcaagauugucaagagguauguuacucuuuaaucccucuauuccuguguuccaguaauagcaauugccagccagcauuuagcacaagagccuuuugaauuauaaaauuaaugaaaccagaaauccauagcacccauuugacucgcaggcagggauacguggcacuucaucaguucuccagccuacaagguacagcuuaauuagaucauuauaaucuagacuauuauauuaauaguauaguacugcacuguucauuacaguagacaccagccacaaugucuuuaugguugguuggcuauuucauuuuaaauuaacuauaauuacauaaaacuaagagcgugguucuuccaucacuagcuguauuuuaagugcucaguagccaacuuugacuaguggcuaccauguuggacaacacagauauagaacauuucugucgucaaaggaaguuguauuggauauugauguccuagaauauugugcaaccuagaaguauuuagugucaugcuuucacucuuuaaagcaauguacauuucaaugauauggaaggaaagaacuaaagggaacugaaacuggcuaccaaguaagaagcagagauuuucaaaagacaaauuaguuucuuauucgcuuaagaccuucaucuauccaucuuucaggcuguucccauguguaucuaacaugcaaagagcaguaaugcugauuccaagcaccaaguuuuaauguggcauuaaucugaugaucauuguacuauuucaugcucuucugauacaugcacaaacuuugaaaacuaaaguuggccagaaaaaaguaguuucucugcacgcuaguuggagaauaguaucuagcugauuucacgugugaguucgugagcacaccauauuucucugucugccggagaauaacagacucagcccucucugguuuauuaaaauaaaaauccucaggcaaaaauggggugaggaauauccacaaaaagcugcaggaaccuugauggggcuaagaguauggggguagaaucaggucauacgcugggaauacaacuucaaucaucacagacacccugcaugcaaaugugugacugugcauuaaaagaaauacggcuccagugacagcugcguuagaucacguaugacagaagcaauccuuugcauccguuaaacugcugucuuacuguaaaucuuguaauaugcucuugcagcaaaaccuuaagaaggaaagccccuaaacuaugaagcuuagggucugucaacuuuaagcaccacauugaugaaucuaggucucugggggauuugcccggagccagacaggcugaagacaggagugccucuucuaagugacacgcaagcauuaguaacccauuugaguaggauacucacuuacagaggcauucaugugccaagacagggcauagaagagaguaaugggaucuaaaguuagcuauguggaguugccuagugugcugcgguaauaccaguugccauuuuucacuggagggaguaaaagggaugaagagguguuuguagcuugggcugggccuuccacagauugguagucccuguuucaccuugagaaaccaucugugacucccuguaaccucagcccauauuccuggggguaggggguucaaugggaucccacacuccugcuuuuaaagggcaaguuaguaagaugaaauucauuuaccuaaccaugguaaagcucaguuuaaaucuaagaaaaagaagaccagggagugagcaaugaguggccaggggaacccuugagagaaaccuauuuguauuugaaauuuccagucucuuauuuuccacugacauaugucgauuucguuaaguagacauguaugggaaaaguaaguagauaaaguuacgguucuucccgauagaaucacaggaaauggucagucuuaauaggucuuuagaucuuuguuuccacuugcucuaaaugagcaucccugguuaugaggaguucucuccuccacacacaccuuggcugaguuccagugauuaugaggcaugcccaggggcucugucuucugugacuucuccucaaaggacacaggaaaguuuggguggggcuuuuuauguccaggagaugauuugcagaucucugugugacugcucugcgaaaucauccugguuuauccugucuucccuuguccugccugucucuccuugagccacauuagaaguuaguacagccauagugucugugggaggugucgggugucccacaccagcauguauagucucugcaugguugguggaauuuaggucaagcuugggggcucuaaaacacuugguauaguacuauaaucaaaagggugauacagucauuggcuauaaacuuuuccaucauucagccuuauuaaaauacaccccuuuuaagccagaaucuuuugagaauggcguuuguguguggaccagcccuacauuugauaaucuaccugucauucugguagauauuuacagagcacucagaggucaaauuuaauacuauuacaggauguugguauuguucaagguauggggaauccagggguuugucucuuuguucagcuuccuuccuuguugggugccuugguuagagaagguguggauuguaagauccgccccuguuaccacccccauaaacaccaccuagaugaggacagcuauuguaccagcaauacaguaugcuggcauauacaguaugcuggaaugagcagggacccuccuauucccaguuacaguggaaagauagagaccaucaucaucuuuguagugguuuuguuuuguuuuguuuuguuugagacagagucucacucuguugcccaggcuggaauacaguggugggaucucagcucacuacagcccccaccucccggguucaagcaagucuccuaccucagccuuccaaguagcugggauuccaggcaugcgccaccacacccagcuaguuuuuguauuuuuaguagagacgagguuucacccuguuggacaggcuggucuugaacuccuggccucaagugacccacccgccuuggccucccaaagugcugggauuacaggugugggccaccacgccuggccgguaguguuauuuuaaugugauauccugaaaaacgaaugaaugauuuuaaagguauuccuuuuguguuguauguccucacauuacaccaccuauucucuggaacugauuuuuauuuuuccaggaaggcaguauaucuacaugugucugguacagggaugugaguuaguccuuuacuguuagcuugauucaacgaucaaagcauuuuuuccuuaucuuuuuccagucugcacaguguucuuuucugcagagaaugaguaaauucuuaaaugaccuuuguaaaugcccacaaauaauaacuguagcuuugguugcagagugcugaugaacuagcaaguuccauagauccauuucauugugcuguaucgcaugaugcuuuaucuguaggaugauguguucagcaaagagcagauuuguuuauaagccucugauuuuuauguagcgcgcucucucucucucucuuuuuaaucccucuuggguaagugguuaugaauagcgaaaauaugugaauguccuuggcacuuugaaucaauaaaugccuucuguuuuguguguauguacagaauacugggaaaaauuuugucauuaaguuuuacuuuaacuucuuuuccccuaagauugaauagccauagucuuucagauuuuagcugcccagauaacuggaacauagauaauuuuuuccaaguaggaagugcgugccuuuauugucuaauagauccauggucuuugaugacaaaggacuuuaugagauuugcuaguuuuucccucaacaaagagugaaaucaaaaaucucacuaccuuuugcuuuuaacccccucccacccccgcccccugccccauucccuguguggugaauagccugagaauagggacagugcccaagaguucacccacuuucagagccagagggcuccugugacccacgucgcucuccuugacaucauuuccaaaaaacaaaucucggggagccuuuccuggcagcagcccacagugggaguggaagggccuuggaaguguuaauucuguaaguacuucuacugguuuuaugugucacuucuagaucuuuguugguagaaccaugaaggauuuaaggugccaauuuguugugacaauaacugguguaaaagugggcuucucacggucacucaggagaagggacauggucccuucaguugguuacuucugauuccaggcuggcucugcauucuuuuguguaucuucagccugggcaaacaaaaagcucuuccuagguuagcaaagcaaauggggcgggaaucaggacucuggcauggcccuuacaggcaggcaguaaugagccagggccgauucgggauggaagccagcaaaagugggucugggccuggcguuuggcugaccccgguaagagagcuccuuucucaggucugucagcggccagcagccuuugugcggcucucuagaguucagauccaagcagacauguugggucucaaaaucaaguccugugaaguguucuuggugugaaugaaagguucuuuagagaacuagaggcuauagaaaaagaggugaaggugacucaaacuugaaggaaacauugaaagggcaugauuguugccuuagcccuacagugagcaaguuauuuaugccuuuuugcauucccuucgaugcacccacaaaaagggggagguaauaaauaaguaguuuuuuuuuuuuuuuuuuaauaaaaagaacuaagagaguaagaaggauugccaaauggaguaaaagucaaucaugauuaacaugguauagcugacacagguauuuggaagagaaaaagagucaugucuuggagugguuaggguagaauuuuaaacacgggccuuuuguggggaaagccaguuaugagugccaaacaguuugaaaacuggcuuauagagcuuuuguacuucuggaaugaauguuagauauaguuuggagcagagcucagguacaagcuccaucuaauggacaccugucaugacgggucagaguugugaaguuaaauauuugguugucugucaccauggaaacguguguaguaugcauaauaugacauaaacacaacccuuuccaggcggaaaaaaggcugaugucuaggaucacaaucucugaauccuucugaucuuucuguagcugucucucuggaucaaugagaagaugcucacagcccaggacaugucuuacgaugaagccagaaaucugcacaguaaaugguugaagcaucaagcauuuauggcagaacuugcauccaacaaagaauggcuugacaaaaucgagaaggugaguuaaaacauuugauguggccauggugagaaaacaaacaggguaguaauaaacuccuuuuuauuuagcacauuuuccagcauaucugaucuuaucuguacauuuacguaaguuacacagccaguaauagcucccuuugcacguacggguuccugacuucaacccaucaaaagggaaaaaagcagaaacccaaccaguuaguagaaaaugcuugauuuaucguagaacgaauacuaggcauuuaguuucuguugugccucucaucugcuguugcugauggacugugagcucucaugcagggauuccacugucuugaucauauuauuuguguuguacugugacagauugcacauaauuuuaaauauauacauauuuuuuaaaauugcuuuuuccuaugagacuacuguauaccaggcgcuauaauaauuacuaugauguguuauucuugcacagagagauucugggcagcauaacugaagaugaauauggagucccccccuuccccccgacuucucuccuuuuagacuuuuuauaguguuucagauucuucacgguuaaaauaauguguuggcagggcacgguggcucaugccuguaaucccagcacuuugggaggccaaggcagauggaucacuggaggccaggaguuucagaccagcuuggccaacauggugaaaccccaucucuaugaagcauacaaaaauagccaggccuggugguaugugccuguaaucgcagcuauuggggaggcugaggcacgagcccaggaggcagagguugcagugagcugagaucacgccacuguacuucagccugggugauagaacgagacucugucucaauauaauaacaauaauaauaauaauaauaauaauaauaauguguuguauaucaucuuuggucauggaauggaggagauaaagucacguuauuagcauucaguauuccguugccccaguugagacuauuucagcauguaacauuuauugcuuaauucccaugaaacccuuguaauguacacaaccuaggggucguuguugauuuuauugagcaguaacuucauguggaaagacuguguguauugagugaaugguuaaaucacagaucaaauguccuagguuuguuuuucacagugacauuuuuucuguagcaaacuuguuuauuuacaaccauguugguuuuguuuuccaggaaggaaugcagcucauuucagaaaagccugagacggaagcuguggugaaggagaaacucacugguuuacauaaaaugugggaaguccuugaauccacuacccagacaaaggcccagcggcucuuugaugcaaacaaggccgaacuuuucacccagagcugugcagaucuagacaaauggcugcacggccuggagagucagauucagucugaugacuauggcaaagaccugaccagugucaauauccugcugaaaaagcaacaggcaaguggacaagccaucauggacuuggguguauuucuguuuuacagccauaguccuuagagucuuuucucacccacugcauuaucaggaguccaccuuccaugggaaggcauuuuuaacccaaaauauuacuugcucuaacagcaucguagaacauuuccagaauagaaagacacuuguccaaacuagaaagacacaguauuaggaguauuggguguuggcugucuguguaugggauugauaauuuucuuaguuaauggguauuaucaccguuuaacaguuaaauaaauguucaucucauucaauucugcauuuuacacgaaagaaauauucucauacuuuguuguuuaacaucgugauuugugacaguuaucugaguuguucaaggcacuuuauagguaauaaaaauaacuguuuauauuauaucaccguagagggcuuuaagggcaaaugaauuuaccucagauuuacuugaaaacaguuccauugauguugaaaagcaagucaguggcaaaauguuugaguggcucccauggcuggcuuugcgguguggccaagucccaggcccagcaguucugcuuagagccagucacugcaaaagauagucugugcugagcgcugaggcugcuucucugcccucagaugcuggagaaucagauggaagugcggaagaaggagaucgaagagcuccaaagccaagcccaggcccugagucaggaagggaagagcaccgacgagguagacagcaagcgccucaccgugcagaccaaguucauggaguugcuggagcccuugaacgagaggaagcauaaccugcuggccuccaaagagauccaucaguucaacagggauguggaggacgagaucgugagucgaccccuacugcacacauggcuuuuccacgagcccccuugccugugcuaaagcccacauucucacuucucagucauccucaccuugggccacguuggcaagcugagcugccaaaguccacgcucuggauggucuaaaguuucuuucccuuuucacccuaaauguaacuccauugguccucucacguuaucuagggauacuguaggauuuuaauggcccuaaaacagacuuuuuaaaaguaaugaggacucacagugaguuugaccuugaggaugagguagaguuggaaagacucucccuagcccugucucggagaacaagggcgugcuuccccagacagcccucccgagggggcugagcacucucugaagcucacccuugcugucccucacugccccucacugcucguuugugucguauauuuguuccucugaguggaucugaccacuuauuuaaaauucuucccaguuguggguuggagagaggaugccuuuggcaacuuccacggaucauggccacaaccuccagacugugcagcuguuaauaaagaaaaaucagguaagccuuucugcucgagcuaguucugucugauaaauaauugcucuaaauuaugagacugggaauggcagagagcuuugaagccuugcuauuucuuucuggcccuaacagcuugacauaagcagcagacggcugccauuuagcaagccuuuguguguauuuuccgcucccuccagacccuccagaaagaaauccaggggcaccagccucgcauugacgacaucuuugagaggagccaaaacaucgucacugacagcagcagccucagcgcugaggccaucagacagaggcuugccgaccugaagcagcuguggggucuccucauugaggagacagagaaacgccacaggcggcuggaggaggcgcacagggcccagcaguacuacuuugacgcugcugaggccgaagccuggaugagcgagcaggagcuguacaugaugucagaggagaaggccaaggugagaggaggcgggaagcaucccugucccaggagagccucagauucaaacccugggcacacuuucugcuggcggcucugucuguauaaaaacuucccuuguagccuuugaguguuaaggggacaccaugugcaugaaggugucugaaauccagcugcugguuucccuuuggugcagcauuuucuuaucugaauccuagugugccauuaagaacagguucauccuuucaucuuugaaauaugccagaguccuuccugcugucuauuuauagguucccuaaacuuuacaaaauacaggauggcuuggagacaauuugaaaguauugcaagguuccaggaaugcugccauuuacauacuugagggaccuugaggaauuccagcgaaccaggcacacuuggucugcccaagcuuuucucugagaggggcccugcucauucugcguucuccuuguguuuaucuucugcacaggcuucugugguccaguccauauggaagcucuuggaacacuucuguguuccacuguccguacugcaccucuggaguuuuucuuucuacugauccuuccuccuacccugcugagcagcuggucugucacuccuuaagggguagggccagaggggaccgcuaugguugugauguucuccugucuuugcaggaugagcagagugcugucuccauguugaagaagcaccagaucuuagaacaagcuguggaggacuaugcagagaccgugcaucagcucuccaagaccagccgggcccugguggccgacagccauccugaaaggugagcgcugcuucaugagugugagacccggcucucgauuccucucaguuagggucucuugcuaacccccaccaaaagaaaaugucagcauucaucaugacuugcugguaaggcaaaucuuugagaagcauuuuuaaaacagacccaucauuuaaaacauccuaucaugauuaggaugggugaacuguuauauuaggaaauugcucuuguggguuaaauaucucccguuggccaaggcucuccugaaagaauauuggugucgugagucaaaaguacagguugacuaggcugggcagucaacguaaaguggcuuacacuuguaaucccagcacuuuaccaagccaaggugggaggauugcuugagcccagggggccaaagaccaaucucggcaauguggcgaaaccucaucucuacaaaaaauacaaaaaaucagcugggugugguggcacacgucuguacuacucagcuauucaagaggcugagguugggaggaugguuugaguccaggaguuugagucuacagugaaccauguucacacugcugcacuccagccugggugacagagugagaccuugucucaaaaaaauaaaaaugaucagaaguacagguugacuugcaugguggauacagauagucauagcacuuacacuuggguugaaaaagucauccaguuuaguaaaguaauuacuaguuuuaagaggagcauuagacaagaaugcauagaccuguaaaaugaaggggcucccaggaagaacaaagugauaacaccuccuaacucuucgauaucaagugauuagaacaccuucgaggaaaaagaagaggugagugugugguacucaucaggccccuguauuaacuuccaaagcagucauuuuaggauuuuuguguaaaugccuuuuaugacuuggaaaggaauuggccuugugcauuuaaccagggcagguuaggggagaugaggucaguggcucuguugguguaggagguucuuaagauguucaugaucaggauucccaggaaaguggccuuccuagucuccagggauaggcaccaacauguccuuugucucugauauucugguuuguagaccaucacucuggggagaaguuggagggagggggauucagucuccugacugcgcaccugggaaucaugagauggagcagccgguccagcccuccuaacaaggaugggcacucugcccagagaagguagagggccuugcgugccacacuggcugugucauuugucccucuggcagcaugguaccagagaaugcaagaccacucuggauuuugcauuaacuuauuuucucuuuugucaccuuccugacugggaagauuuugcauuaacuuuuaacaucaaaggaaauccugauuugcagagccagaggugcagagagaauuuuccccuuuccccgcuaaauucuccugcccccacuauucacugcagcagaaugaggcacuacccaucccuaguguaauaguagggauaggugaauguaguuuacauauuggcucuuuuguuuacauauuggcucuucacgacuucaaauuguggccaauuucagaauuuuauuuuucaugcuaaguggguuaaccagaguuuccuuugagaaauaugauguaauaugcucucccauuaucuccaccucauuuguuuuuccccugaagaaacuugacauuuaagauccuuuuucuccccauugcuccuuuucuuuuucagugagcgcauuagcaugcggcaguccaaaguggauaaacuguacgcuggucugaaagaccuugcugaagagagaagaggcaagcuggaugagagacacagguuauuccagcucaaccgggagguggacgaccuggagcaguggaucgcugagagggagguggucgcagggucccaugaacugggacaggacuaugagcaugucacggcaaguacuugaggcagugcaugaguugguugugcaguaagcgaugguguggaaggccauuugcauuccuugucugugagcagauaaaaugcccuggacuccaaucagaggucuugggguuuaguuuuaaggugguguuucuuuuauaagcuggugacucgcauuuagguuggcuaaccucucugugcaccccuuccuccgguaguaaaaggagguggagguagugccucacucugcugcagugagcaagaaaggaaacccaguugcuaagagguucucgagcuaagaucuauuguucugaagucaugaguauuauuggcuacaucuugcuuagaggcaguuucuuuccaaaggguauucaugugaucaagaaauacagaguucacagugggcucucugauuuccuuacccauccccguuucagauguuacaagaacgauuccgggaguuugcccgagacaccgggaacauugggcaggagcgcguggacacggucaaucaccuggcagaugagcucaucaacucuggacauucagaugccgccaccaucgcugaauggaaggauggccucaaugaagccugggccgaccuccuggagcucauugacacaagaacacagauucuugccgcuuccuaugaacugcacaaguuuuaccacgaugccaaggagaucuuugggcguauacaggacaaacacaagaaacucccugaggagcuugggagagaucagaacacaguggagaccuuacagagaaugcacacuacauuugagcaugacauccaggcucugggcacacagguggguauggcagccacccaggggugcuggggaggcuuuuucuccauagaacaucuuugggcaucuguaaguaucucccuguuccuuggcucuucaaaagaauugccccaauuaagcacauacauguacccacuuuguaauagugcuccauuugggagaacuuaucaguccauaaaggucuacguuugccacauuugugaacauuagaugagugcccccaugauuaaaauaaauaaaccagaugcauacacagauguuugcaaguuauaggccucagcaaguguuuuuauuauguuagcauauccauccagaacaauuuccaaaauaauauuuuacuauuuuucaucaaccagguucuaaguuguaugucuggaaaaagaaaaaaacaggauucugacauuuuaucaugccucguccccaguaugaaaugacuggcacuaagacuuuguuuaaaagauguuugacaaaguaguaacaauauaacagaaucuaguguaaucacucucuaguuuccuuucugaucucugcacaguuucuuguuuagucuuaugccuuuuaguugaaaaacaaauuguauuuuuuuucuucuaaguuucauggcccuagagaagaagccaauuuuauuaaagauguuaucccugauuaugucaaggguucuuguuguuaagaguauauugaguaucuaaguuaucucagcuuuuucuguuaaaggccaaauaguguuuuucgcuuuaugagauacauacucuguugcagcucugcccucugucauuguagaauaaagcagccauagacagugagaagaugaaugagcguagcuguguuccaauaaaucuuuauuuacagaaacaggccacccagauauggccuugggcugacccagucuagugccucagccucuaaauagcuuugguauacuuugggauuuguucuaugaagggaccaccuugauaguuguucucucucacuuccccuuaauucuuaauuccugucacuaugauggcaaguuuaauuuaccucucuaagcuuugguucccuaauaguuuaaggauugaggugcaaaacauaugacauagugagaucucuagaaauguuuucuaauuauuauuauauaacaaaaguuuagggaaacaugggauaucuagagauagaauuagaaaacaccuugacaacauaggucuuuccucugcaccucuaaaaucauuuacuuuuagaacugcaagacacuugagagacaguggaguugcucucucauuuuuucauuaaaucccuucaccucauuagacuuagagaugaggaagccaaagaagggucucggaacauccagggugggaaucucgucccucgagucugauagucugcaccucaccauacccacugggcuaugauguuauagcagugaaaaggauguguguccuacugcagguauugaccugaucuggguuucuuuucacagaauaacagagcaaaagggaaggcucauggugcaggcucccaggaguacauggugcuucuucuuugguuguuuccuuuugugccaacuugaagugccacugucuccauucugcacgggagcugugggaaugacacauagcacugauggaggucuugagugguuaugcaaagcaauaguucauauuuguggaaauuuucacuuuugcuguccucuuguaccuuacauuuuauugcgagcaaauugaaaacagccagagacacagaaacagguguuuugaaaaauaugguucauuguguaggaaaauuagcuuuucagauaauuuccuaggaauuugcucauuguaauuugaguuaaaccugagccauaaucaaagaauauuuccaaaaauccuuuaggauauggaaaucaaaucacacuggaaaccaaagccuguugguucuucuuuguaucuuuugcagaaacugcuuuuuuucuuuuuuaaccuguuaucaccuaaagugcuucugugcaaucaggggucaguaauccaccuccccacaagcccuacugcuguccguacccccccgccuuuuaccccacuuagcauuucuccauauucuacucucauagacaucuaaaagcucucauaauccaggacaguugucugcggacuucuuugaucacgcagcuuuaucaguacgugaugauuguguguccauuccccuauauguguaugccuuuaauuagacauuguacacaaguauggcacuacugauguuacauacuuuauauaaggcauguaagaggagaaaauuuaacuauaaaauuagcugcaguuauuagcuucaguuuuaaagacauauaccguuccccaaaaaaaagguaagaauguaaucuuauuuuuguuuuuacagaagaaaaauauuaugcacguugucuuccacuucauugucaucuuggugugcuuuucaugugacuacacagaggcccuuccucauucuuuuucauggcugcacaggagucuccugcuggaugcaccaucauuaauuuaaccaguccuucacugauagucacuuuauuuucagucuuuugcuuuuacagacacugcugcaguaaauaaucuaugcauauuucguauccuaaauaugcaagaauguauauguaggaucaauuccccaaaguaggaucauaaaaucagaagguaccacauuuauaauuuucauggguacugcccauuuaccuucuguaggagcuguagucuguuacacuccugucuacagagaaugagcucacugacaaauauaucaucacacuuggauuuuugccaacuaauagaugacacauuacaguaucuccaugaagcaucuuuucauguuuaagacccauuugcauuuccugcuuucugaauguuuucuucaugccaguuucuguguugguuuguugguuuuuuucuuuucuuucuuucuuucuuucuuucuuuuauuuaugacugucauagcugaaaaagauaacucaaccaaaauauguagauguaaguagaaguguaccauuggcuccauuuaccaaaucacaauucucaauguauauuuuuaguuuugcaagguuuuuguugaaauuuggcuauuucaaguuucaccuucuuuaacguuaauuaguuauuuuaaccacauagggugccacguuuuuauacuuuuugaguguaaaugucccacggugagaacucuuacaggcgauacauacauuguauucacauagcaaugagaagucauuuucaaaaugugcucuucauggcaguuucccauucaucauaaaaacauuuaucuuuaccccgagauagcagauuagguauuuauuuuuuggacuguaucugaauaugucccacucagauaucccaggcugccuccaggggacuuucccugacuaaacucuccugccugucuuccuguagcauuucauuuguuuuaucauucauaaagaacuuaauaauguaguugaacagauuuauagaaaacggguuuuugugacuuggaucuccccagugaaauugagggcuccuuaaggggcaugggccauauuuugacucugugcucccuuuaguguaugagcagaacagaauagggcuuggggugauggugggaaggccgccaugggcugaccuggcucauccccuacauggcuucacaggugaggcagcugcaggaggaugcagcccgccuccaggcggccuaugcgggugacaaggccgacgauauccagaagcgcgagaacgagguccuggaagccuggaagucccuccuggacgccugugagagccgcagggugcggcugguggacacaggggacaaguuccgcuucuucagcauggugcgcgaccucaugcucuggauggaggaugucauccggcagaucgaggcccaggagaagccaagguaacgcuuucagcccaaaggaaauuggacuuauuggcgcuugguuaaaacacaggagucuuccagagagaagcaggagccuugaaagcguuccugccugagcgcuucaaggccagaguggggguggggcggugcuuggagugcggcaccacugcuugccucgugcacuuggcucgugcacaccaucaccagggaaugugggagccugggguuaucaaagccugucccauucucccuacuccuggcucccuugacccacagucacucaggcccucuugcccacauaugugcuugaaguaggaccuugggcuucaaguagccacguaccuuggacaugacuaacugccccgucuuugcaaugagaugacuuuucugaguuauuuuucugugccugcuuuuuggauuaaagaccacucuaucccuuuccaugcacauuacuaaaggugucacccucaacaucugcuuuaauaugguguccuuggguuauuauuuaauauuuguccuauaucuuuggcuuuguuucaugcaaauuagugaagagaaguuaauagaggaacacacagguacauauuuaaccuccaguucaccccucugccagcuccagcccccacuguaauugagaaacuaugcugcaauaaaagggauuuuuuaugauauauauuuuuuugaagcaguuguauuuccuggaucaggaucaguagguuuugauccaugcuggucacugcugucuaggcuaguucccauccuguguaucuuuuugugucugaauaaggagaccguauuagcugcucuuugauauggccauccugaaucuuugacagcuaacucaucaaggugcgauugcggcaccucuugcugcuucucuacuuucuagaagagagucuuucugacuugcauuucaaaguaaaaguuugaacagaaaaccauugcuuuuucuggcacccaccuagcaaccauuuugaauuauucaggcacacacacaaaaacaaaagcagccauauucuacaguuugguuaccuggcugguacugaacugugcugucacugugcuuuggcuccaguggcccagccuaagcucagggagugauucagaccugaaagaccaucaguuucuuucaaggccaucaguuucuuucaaauuaauuguguguuuuaaaaccuacacauuuuuugaaaagcuugaucuccuaacggaggcaucguuugucuaauuuuagggauguaucaucuguugaacucuuaaugaauaaucaucaaggcaucaaagcugaaauugaugcacguaaugacaguuucacaaccugcauugaacuugggaaaucccuguuggcgagaaaacacuaugcaucugaggagguagguugcuacuuugcuuuggagcugcagcuggcgucaagauguaaaaugacuuuguuuuauauguuugugugugucagagauacuguguuuacauucuuauacacacacacauauguuuuaaaacuccuuuccugugcgucuagaauaaugcaauuaugcaagacucuaggcccaggcugguaaaucucuggcacagaagacaauuuuugagggcuacaaaauggacuccgcauccuccccaaucaguacucuuucuaggugacgccaauguccauugacuaugcccuagaucaguuugcuguugagugcaugguuggugauucugguuaggauggugguaauaaagagguaaauuauuaggugcguguguggcccccugcaugggaaugggcauccucuccaagaggucagggcuuuguccgucuugcugucccucuccugaacguguuugccgcagggagccuccucacgacaaaacagcuuuggcagggcuuccgcgccuuccuccagccccuucuggaaggagcagugcuaugcuuuucuuuccucucccaguccucagacagacugagcaguccuuagauaucucccagcuuaaugguggucuuugcagaaaauguauuuuucuaguauaaaaugaccccaucaagaggauguggugcauuccauuaagaugucccggggauccucuuuuucauacagaucaaggaaaaauuacugcaguugacggaaaagaggaaagaaaugaucgacaagugggaagaccgaugggaaugguuaagacugaguaaggauguaguuuaucuuucugcucuuuuggguaucaauggaaaacaugcacguuuauuuucuugcuuuaauucauuaauguuaucauuuaaagauuguucgaguuguagaugccuuuuuagugccccguuucaccauuucaugguaaauacuacuuuuaagaagcuuccuauggcguagucauuuuucaccucuugauugaucucagugucauaggugggauuuggauguucuuuagggaugacagagggcaccucccugggagaauacagauagaagcccucucccccauuugucuucaagaauucuuacuacagaaucaaguuggaaaguugaucucauuaagucauauuuggugcucuuaguggaauguugauaacauaauaaaaacuaacaucuauuaaaauuuugcugugaaugaggcauuguucuaagugguuuuuuaauguauuucuguguuuauuccccaaagugacccugugaauuagauucuauuuuuaauucucauuuuauaagggaauaugugagcuaauacaggguuuauaauguacaguauuaggaauagcauuucauaauugguaugagcacuaacagcgcaauucuagcauugcuuaccaugcuuugccauucucuguuggaguucugggcucuguccuuauguucuaacuccaucuaugcauguuauggggguuuacuagaaaccaaaugcaagggccuuuucugagagguuugacggcacacucuguugggcccagagcccucagaaaucccacuuuuugaccauucuuugcaggaggauuuggucuguauguuuugagaauuguggggcaguuucauucagcucagcaaaacccacauuacacacugaaccgggcaccagcuuguacaccagggacacagugauaugcacagucccugccuugaaaagccaguaagucccuagugcagagguggcaucuucuucauguagucauguugggggcuaccgaggugcugaaagcagauagcuagccagcuccuugggacaccaacgcugcccacaguccauuuuuuaccucaaugaucccaggcuuugcugcaugaaaugaagugaaaaucaguguuaacuauagcagaaagccugguucuaaccuaccuucucauaacuauguuggaacuaguguuccauuuccucacagguggaagaacagaaugaaacagagcaaaagccuugguccccaccaucuguaguguucccauauccuucccucccucuaaaccccccaaaauaaaacacacaacuaccgcccaaaagagggcgaguuaagaaugccugcccaucuggcuacguguagauugugaauuccugcaggucucugaaggcuuagcucaugaaguggggccgagugaacagagcguucacuguagaccugcgcugagcaguaugauagcugcuuucccacguguggcucuugagaacuugaaaugucucaaauugagaugggcagugaaugugugccguaaaaugcacaucagauuuagauuuagaagaaaaaagauuguaacagaucucaauaguuuuuuucauauugauuacauguuguaauaauuuuauacauauuaugugaaauacacuauuaaaguuaauuucaccuauuuauuuuuacucuuuuuaauguggcuacuggaaaagucaaaguugcaaguguggcucacauuacauuuacauuggacagggcuaauuuagaguagacgauagacugguuaugcagguagccaucaccagagggcagcagugccaagagguaaggccauaugacugcccggcaccuccuggucaacguguacuaacucaugguacccugugcaguucuggagguccaucaguucucaagagacgccaguguggccgaggccuggcugcuuggacaggagccguaccuauccagccgagagauaggccagagcguggacgagguggagaagcucaucaagcgccacgaggcauuugaaaagucugcagcaaccugggaugagagguucucugcccuggaaaggcugacuacaguaaguggccgcugggcccuuugucuguuggugcccugggcagccuuuucuuccugcuugccucuuagaccagggaauucacacgauugcuuguuuuuguuuuuuggguuuuuuucaaguagugaagaucaucuuaaaauggguggcuccuguggagcaggaccuagggagagggucaggacuguuaccuccucagucacauccugggcaccuggauuuaugaucccuuauaguagcuuccugccuggggguugauuggugguguuugcuuuuuucuucgaaucuuucauucuccccuaucucauaaaagcuuuguucucaagggggcauggccucaaaauuuucuucagaauuucagaauuagaauucccaucaaauggaagcuuaauccuagccuguuguuaaguccccaguccugauccccucuucugucaacauaaaggccuuagaauaggauuugugcacugguguuuccucucccaagacuuuugcauuccugguagaaagcugauccuuugcaguguacaaaaaugguguuucugguuuccaguucuggguguuuaaaauguaccugcauacauuuguguuaaaacagaguacuucugguacauccauaugacucaugaaauggcuuuguuucaguuagacuauucuguggcuuuuuaauguguuguuuggguuuuggcugaacacagauccccaccacagcacaagcggcuuccuugagaauuauugcagcucugucccugguguuugucugagcucuccuggggaguccagcaugaacccucaggcucagguacuuuucuccucagcagaguugagaguugcauaguuacuuuagaaauuaaacccaagcucccagggguccuacaaacaacucacaggaauuuugccagcccauggaauagacuauuuccuguaguuuuagguuguagcugcaguuccugugaaccuaauuccauuuggcucaggauguuagagcuucuuguccagugugguccaguuuagcaaacuagacaggaggacuuccuggguuccuagaaccuuuuucugaaaagaggcagaguuugggacucuaccaaacaucacucuauuuucucuuaguuggaguuacuggaagugcgcagacagcaagaggaagaggagaggaagaggcggccgccuucucccgagccgagcacgaagguuucagaggaagccgagucccagcagcaguggugagucccagcagcuccagaggcuggacccuuagccucgguggccaaugagguuuauggggcaucuuucugaagccuugcauugcuaggccuaaccacaugcccugccuacugauugcuuccauagacuguuuaaaggcuguacaguuaucccuaaauaaccuuggagggcacugauuuguccacagucacauagguauguagguggcagaaguagaauguagacagugcccuuucucauccugugugcacacacacaggaugcucagaacuuccauaugauuaaaugcauggagugaacugcccagauuuuaggccagugauuuuguggugaugcguuuuuugagaguucuaaguaacuucacacagagggcagcaauuauucucuacuuccaaagggcuaauuauuuugcuaugguaagaguuccauggcaaccucuaaugcugccuuuaugugguggagcggggcauagggcauuccuguagucguauuuuucugucuagagucuauuuaaaacacuuggaaguuucagauuuaaaaagaauuaaauuaugugaaaagguugcacguaauaaaauugagugaugauguucucccacccuuucuuacuguuuccucuuucuccucuucuuccuuucccuuccuccuuuuccccucuucccuaacagggauacuucaaaaggagaacaaguuucccaaaacgguuugccagcugaacagggaucuccacggguuaguuaccgcucucaaaccuaccaaaacuacaaaaacuuuaauagcagacggacagccagugaccagccauggucuggacugugaaguucacuaccauuugucaagaaucacccuuuccaaauccucuggguuuugacuuuuuggcuuccacuucacccaaaauguuaaaauuuuuacuuaauucauagccuuccuugguuucauauuuguuugcauuuaauucauguuugagucucuuaacugauggaugcccacuugccuuaaagcagcauacuuauuuuuuguuuauuuauugugagcuuuuuacuuuauuaagauuuuacagcgaaacccuuacaugaguaauugaaaugaaauuaaaugagauuacagcauaaugaagaagaaaacuagaaucuaacagguaugacacauucaguuauucuaacagggcacaguacugugcuauauguagccgccuuuacagauguuauuaaccuauaguaguuuacuauuaacuaggaagacugguguaugaggagggagacauucuguaauaagauuaaaaccuaaagucagcuguguaacauuccaugaaagaugcauucauuuauugaagaugacaaaaaagggagucagauauauucuggaagcuauuuuaauuuuaggcacacaaucucauacauuuugagacccuugggucauuuauuacuuuuuacaaacuaguuccucucuuuuuuucugccaaguccugaauugaaaacuguaggcuuccuugcacagauguugcagccagccucaggaguaaagugcccgcugacugcugccgccaccucugucucgcucccugucagugcugcuggcacgugggacgcggcaggugacagccguucucagcauguuuuagaagcuugccucacagacuuccaugccucuccauucagccgaugacuucagggugucaaacuguuuuaauuuuucaaacaaauggaacagaagccauugugguucauccugauuacuugaacguugcacuugguggaccgugccugggagcgcucgcaugcccccuggcuucagaagucaugucagugucucuguagacaaacuccacuguacaucuuggauuaaucuucugauucauuguucauuuucucaagacuuuuuguggaauucucugauaaaggaagcuuuuaggaugguaucuaucaggccaccagcaggaauugaaaauguuuucacaaaaauccuuuuccuuagaaauaaaagcuggugacagagaugguuuccuuguaccgauaaaaacaaaaccaaauccauauuauacaucaaaaccuugugagacauucacuugcucuuuugccauauuuagaugugucaguggaaucagaaaccuguuuugauauguguucucuaugaguuaagucugauuugucuuuuuauuucaugaugcaugucuuuuuuuucuuuugucaggauaacgucauauagcaucuuguuuguuuuuccuuaucucuauguacauaucuaucuacuucugacuguagauggguauauagauagaugccaagcuucuuauguucuggggguaguaugcaucauuauugggucucugccuuaaaacacaucaaaauucauuuuagacaaaaaaacuucugcuuugucuuuggucauuagggagcucuaauguguguuuguggcuccaaguuacauuuuguguuucauugaucuauauguauauaugugauguuuucauauauauauguguguguguuuaaauuuuguaucaucaggacugacacccaauuugacacuuuuuguaucuagaagacccuccaaaaaaggaaccacauaagcacacaagaaaagagugcuaugauguucuuagcauuugcuaucaugccuauuuuuaucuagauuuuuaaauguagcuugucauaacaaaauuuuaauuacaauuggcuuguaugagaagaaaaaguauuuuuauuguuuugagugaugacgcagagacucagugaacuugaaaauagcauugcuucgugcacuuugaauaccaaucagguguuuucugugcuacuaguugucacguugcauucauguucaccuccugauuuaaguaucucgggugugcccagccacuaaagcacucuggacuaaucgcuaaagagaagcaacguggggggugggguugcgagggauguguucacauguacccaucauuugaucauagcacugugauugcuuuugaugugugucucuaguggugugcugucuguuggcaugcuuaaagcacauguccauuaaaauucauuuuguuccuuuuauuuuccuuguuuucuugguuagugauucauuugcauaaacauuaaugaucucugcauacugguuugggguuuucucuuuccuucuaacucuaaagaaaaaauuuuugcugcagaauuauccucagaagaggcuucccuggccuucaucuaccuugcagucugaccaaguaugauaaauuuuagccguuuucaaggaaacaucucucuacccaggucauugcugucacuagcagcuuucaagucaaaccugcagcacuaaauuuuuuuuuauccugguuucucuacauacuaaccccaugucucucuggacucacaccuggcucaggccuuccagaccaaacucauacuuccuccucaccagaaguuuccgaaucucacacuagagaagauuugucaccuuuaaaguccacucacauuauuuugacucaggguuuuguuuuuugucuauuuccccuccugcaacucuccuuuaaaagugaaaagagagagaaugguuuaaguagucuguugcucauaagcacgugucugcagucugucacuugcaaggccuuggugaucaccaugcagcacuugugcgcacacacacccccacaagucuuuuuuccuaauaauccauuuuccacauugccaugaggguaaaggguuccaaucaaaaccaccauuaaacugcauaguuucuagucuucccucagcccugaugcuaauuaugauaguuugcauagacauaacuuaaacuugugauucucccuccuuccagagcuuuuuguagcccuuuuuccccccaaaauuaguuuuguucaaaaucaagcauugggcccagccauuaagauaagaccuaauaagugagagauacaguucccaagaguuuacagauccagguguucacauggugguggccagucuaccguuuaucuugucaagguuguuacugcuaauuuggugucacuuuggucuugggcagcaguggugggcgacguaucuaaugagcgugccauugacuucuccauguuugucuguguacgaggggugcagguugucuguaauccacuaaagugucagccacacccagcuuuaguaacucgcuaaucgcacacccuggguguaucagccaggggcugcuacaguuaaugguacacaguugaugguacacaggcugaaaaugauaaugaaucaagacccuacuacauuuccaaagccgaaaagccaugaggguuacaauuuaaaugagcuugggaaggaacgcucccgaagacgucuccagccugaagggucagagccgcuggaagccuggcugucucugggcuuucucgucucagugcagcaaggcaccgugaucaaccaacccgugauggggaaggcccugguucugucuuuguuuggggguaaauagcugugugguguugagugacugugauuggcuuuuccagcuccuuuaacacaaacuacaacccacucacgauacaacuucggcagauguggucaaauugauguuuguugacuugccucauuuccuuccagcucuuaaguuccaaagucuaacugggaugguagaugugaaaugcaugauugucguccuaauuucugcauguguuuaugacaauguguugaggggagggggaggagagccagagagcauuuucaggaaccgaggucuuuccuugucuuacucugggggaaugccauguagcucugauagaguugucuaucggucuguuugugaaugcccuuucgcuuaaacuuccagcccuucugguggcauccuugguuguaagguggcugcuguauaacguccacucucuuucauauuuaauaugugugauuguuacuguugucuuuuuguuuuaaaguaaccauaagaggagaugaucugaguuauauuuauugaucagaggaauagagugcaguaaaacucauacuggcauuucgcuuuucucauuucccuguaaaugggcggguauuaauccauucccaccuucuaauguccuugauguccagcuggcuuugugggugugcaaugguuuuacuguacugccucgaucugugccaggcauuuauacacagccacaugugcgagucagguagagcguauguggucacccccauggcucacggaguuagcugaauggccucuccgcugucccuagauggcagaaacgguggacacaagcgaaauggucaacggcgcuacagaacaaaggacgagcucuaaagaguccagccccauccccuccccgaccucugaucguaaagccaagacugcccucccagcccagagugccgccaccuuaccagccagaacccaggagacaccuucggcccagauggaaggcuuccucaaucggaaacacgagugggaggcccacaauaagaaagccucaagcagguaacagcagcagaggcugccacaguaagaugggaagucagccugugaagggauaaggcgggccacucuugaauuggaagagaaguaugugcucauguaguuuuauuccuuugguagcuuccuggacauugcauucuucuugggcugacgcuggaaagcaggaguagaaugcugguuauucacugagagaagaagaguugaguuuggaugggaguagcuagaaggggcuuuaguaguucaucuagagaaggaauuugcuagauugagacugaagagucuucuuuacuuuaagugauugauuucauuuaggacuccuuguggguuuuuuguaaaaagccauuaaccauuuccccugcccugaucuccauaucagccuuuauauauauucauugucucucaacagccccaauuuuuuuauuuaacagauggggaacagaggcucugagcgguuaacaaagcuuucuuucuguggaaaccuaguaaauggcaaagcuggaauaugaaacugcaaagccuaugugcuuaacuaguaaacccaaccaccugggaccaccauaucuuacugugcaguuuguugcugugugaggggaucagaacaucuaagaacugccauucacguugaggacaacauagggauuuauauauuaauacaugcugguguaauacaggccgguguucuguuaaaauuaguauauuaggacaguuugccauaccauaggggaaaagccacuuuauucuaauucacccaaagguacuguaagugcugauggcucugggucugucuuucugucaaguugccaagucacauaaguaaugaauccgcagcuggaggagcugcugcuggaggacaggcauguuuucagacaggagcauggccuuuagcucaugaccauaagagggcgcuacagcaaagaguacuaaauaccaaucaaagugagcucagaguacaagaggguaacuugcuuuucuccgaagugaaagagaagacauaguccucaaacacuugcccugugcccugucccugaacucuccauggaggaauuuuuucuguuguuuaguguuagcagaauuuaggaagggcuuguaauaaggaagguugaggguuggguggggucacacuguguugugugaggaucauuuucauguuaaugaaauguuuaguucuuuaaggggaaugugguagagccuuuaucucccccugcccuuuuuuuuaaacugcacagguccuggcacaauguuuauugugucauaaauaaccaagaaauggguuucuacaaagaugcaaagacugcugcuucuggaauucccuaccacagcgaggucccugugaguuugaaagaagcugucugcgaaguggcccuugauuacaaaaagaagaaacacguauucaagcuaaggugagagucgccgugcuucauggcugccagaguggguuugcauuuacuuccacucugggguuugguuuucuuauacagcugcugugauuaguugguucugucuucugccauuuuaaauccccaauaaagugaaaaaccaguuuggcacgugucucgguuaggcugaauucuuuggcaacuguggccagccaccagcuucccugugguuaacaguacaucugagcauugaaggauaaggagcuuuugcuuuuauaaccaggcacuuacuguucccuaagacuuaaagagagcuagucacauuucacaguuuaagggaggcuuugaaaaauaguuuccccaucuuuucagcuuaucccgacccaggagaugcuauucuuugcucaugaauuaucuggagaugggucaagugagucauccuggagcuggauggagacaaacaggaaauguuuggguggggccugggacccuguccuccccugacucucccagcagaugcuccagcugucucagaaccaucuaguuccaaaugucucuacccuguaggauacauguaucucccuacagaguggagcuaagcucagaauuucuccucacacuuggaaguaggcagaaaaauuauuuuaucuuguaaaaagugguuagaaugcuuguuuacugauuugugcuguugcuuugggaucugaaaagcuuuggucuuccauuuauuuguauguuucaugccaguuggacuaggcccagggcuccagaggagagagugucagaugguuugauuuauuaagcucugcugcugcgcagugcaggcaggcucuuuggguccuggaacacuuuacauuuuguaggacaaugcaccggcagccuggcuccuuggcugcuuuccccuuuguacucccuucaugcagcuucagagagcugggauauuagcgaacggccccuacccuguguuacacaacaguacccucguccucuccgcagccacagagugaaccugugacccuuccaagccuggggaccucccagugucacacuaauagggcuucuuaauucugagacauacaguagaagaaaaguugaaggacauuuucuguuugccuauucugaaacucuggaacaugugaauguaggggauacaagcucaguagcagaauuucaaaagggcucauuguguucaaaagcuuucuccugaacucaguuuagaccaguaagugaucaggcauccacaagugauuuuugccacaauaaacccaaauguuauguuuggggcuuuuuaaaauccuuccauuggauugaagcacaggcucccuguguguaucauuggcgcgauuauauggcuucuugaucuccaggggucuguugcugggccugggcggguccccaggcuugguggugacauauguagguugacgcuucuguugugacuccuguggucuacuucuguccugcaugggauaugggaguugggggauuuuuauuucucuguaauuaaguggugacuaacuuucuuccuugaaauuacagacuaaaugauggcaaugaguaccucuuccaagccaaagacgauguaaguuucuaaauguuauuucucuccacuacuuaggaguuugcaaguguuugugugaugaugggcuuuauucagaaaguucuucauguaaaugaugaucagugaugguuucuaucacugggcuccagucaccagcacuagaagguguuugguucugucucuagaaggcagugaauaugaucucacugucccuuugccgaggcaggaucccuuaaagucgauggaaucuuugccuguccccucccagggaugaggcauagugagguggucccaggacugguuguggaucaugaugggacccccgcugcacccuucgccagcagccagcuguuuaauggguguguaccucaccucaaggaaagagagaguccauugauggaaaaacaacaccuguaaugcuuuaaaugugaaaaagcaccuucuagggugggaucugaccaccucacagauugagacuggucuuccagcuguuacaaguuuguagggccacauacuagggugaugaguagaacugaauucucaugagaagcugaaccagguucccucuccuguacugauaaggcagaggugcauuuggggacagugcccagaagugacucugcuuaccccucaguuggccagaugcgccauucccaagccuuggagccagaaccccucaugccuacucuuaguugagucucaccugugucccuuccucuguccaggaggaaaugaacacauggauccaggcuaucucuuccgccaucuccucugauaaacacgaggugucugccagcacccagagcacgccagcauccagccgcgcgcagacccuccccaccagcgucgucaccaucaccagcgaguccagucccggcaagcgggaaaaggacaaagagaaagacaaagagaagcgguucagccuuuuuggcaaaaagaaaugaacuccuuuccuucaccuccugcccuucucuuaccuuuucagugaaauuccagcaugcaagcucagaaccaacacauuacucucugugccuaauguuccucaaugugguugauuuuuuuuuuuuuuuaauuuauagagcauuucggggggggugggggaaacacaccuaaacacuuuaucuccaaguuacaaaaguuugaggugcagagggaaggccagauuuuuuuuuuaaugaaauuauauagauuagaucucaguauuuaaacuguuccucaauuuugugaggcuguguuggaaauaacccgccucuagugcuguugguaugcaaggcagcggugcuuaaucaauauuuccugugcucaccagaggcaaaauguaccaauauccugacaccauucucucuccauuuacuucuggugguuacccugacucuugacucuuagaagugcccgagauggggcuaaccuuuauuaaacagaucgcauauuaugaucuugcugcagccacagugcagcuccacauuaacucuacagaccaaaccauuuguaucuggcaucacuuacuaacacacgacaugcggcuuuucugcaucaacugcuaugacgguuaagaaugucaguauacaagaaggaauagaaaacugauacuguuuuaaauaaucuguaauuucaauuuuuuuuuuuugcugaaauacauuauauuguacguuugagauaauucuaguacaaaguauaauaaaacuagauguauaauaaacccuuuaaaucauugguaaguguacaagugguggaacugaagcauuuacuggacaaaguaauguuacucuaaugguuacuugcucgugcguugccacacuguguuauaauuugcuucauuuccuugcuauuugauacauagugugcauuucucugucacuguaacuauuguaaugacaaauuuucaucuuacugcacaaucaaaaugacauugauaggaaugaacuccagaggcugggccugaacagggagguggucgcucaggccuggugcucagucguacgaccuguaccucucaacuuuugcccuaucuguuaaauauaugcuaugucauuaaaugcuuuuaaaucuag

SEQ ID NO: 16521 - RNA, 7390 nt, Homo sapiens
cggcggagggggcggugcccucggcgucuccgugacugcgccucugcgcccgcgucuugccgcggcucccgggaugcgcggaggcgguggcgauggcgaugaugccucuaguccugcaucauccagagcggcaggcggagcugggguccggacugcgagauggaggaggggcggcgcugcggccacccggcaggugagaggccgcgggccccuggaggaggacaaccccacgaugccggagacggcucccggaggcuggcgggauagcgaggagcgcggcugcgcugggccaggcccggcuccgcguaccugucuuccuggugcggccugcaggguagccuucucgcccgucccugccgguucccaggcucugcucggccguggaaccccccccacccacccacccaccgccccuacccuggcugagcccuccuaacccaccaccccucugcggcauucuuuugcaagcuuaccuggcccggccuaggcccuccuuaccgucaccucacccuucuccgggaagccccuacccaccgccagccccucacgggggggucgaccuucccugcccgcaguuucccacucuguccucaggcugggggcucccuggccucuucaucccucccaucaaaugacucaggucuucccaucccauuagcugcuccggguucaauguaguucuacuggauagaaagagcaagggcuuugaaaucagauaaugaccuuggggaaguuaucuaaccucccugagguuuuccugaucgauagaaauacaaugggaaucacaauaauacagaaccuugcucucugugaggauuaggcuuugaaaaugcuaaccuaagacauuuuggggcgcgcggggaaugggguuggaagaauucaggucgugaguugauuuaugaaagccccuauagcauguuuuaauguucacuaaaaauuuaaaacagcacacuagauauaucagaggcuguucacauaucuuaaugaaaaaucauugccacucaaauuauacaauaaauuuucauccauauucuuugcuugcuaguuacuucaggaugucucauuuguaagaauaugcaugugaauucauucuuacugcagcuaauaugcaugcuuaagacugguguuccagcuuaaaaucuuucugauuuugugacuuuaaucacaucuucuauaaccuauucuccgucccagagaugaagaguagcuuguauguuugcauugcaaauaacauggguaaucuuuauugaauauuuaugaguagcaaagcaguauuaauuuauuccccuuccaaaaccacuuuuauuuucugccgucaucaugucauuccaaauuauggucacagccuccuuuuucuuaaagucucaggaguuacuacuaagaccugaguuuacuuucccuccauuuucuugauuucuguuauacuaaaguuuuucugcaaaccuuuucgucuuuucuguccucugcuuuuucucccuuuucucuucccagcccaugauuccuuuuuuucuaauuaucucaauaggagugauuuaugauuacuuuauaugugaacuacaguuagauacauagaagaaugugugugugugugugugugugugugugugugugugugugucuaucuguaucuacauagauguagauauagcuauauagguguaucagaauuucggauuccagaaaguuucaguggggaagggauugcaauaccuauucauaggauuauugugagaaugaaauaaagcuugauaauuuauguaaagccucuagaauaggugccugguguguaauaaccacuuaauacuucugaccuggggaugccucccaaaaagguuuuuuuguuguucggguuagcaugguggugaagaguguggaagagcaacugcuuagauucaaauccauguuccaccacuuuagauaaccucucuuugacuugguuuccucaucugcaaaauggagauguuauaucaaguauuucaggguuguuaugaggacucaauaagcuaauaguguggaacauugagaaaaguaccuggcacaucauaagcacuugauaaaauuaauauacuaauaaugaugcugauaauuauacugccauuguuauuuccugaccuggaauucuuauuuuuuuuaauuuacugaaggcuggguacaguggcucacaccuguaaucucagcacuuugggaggccaaagcaggcagauugcuugagcccagaaguuggagaccagugagggcaacauagugagacuccaucucuauuaaaaauauauauauugaaaaauuuaaaauuuguugaaaaaauguaacuguacaaaacgugaaaguugccucuccucuaccccaaaucaccuuuuuuccuccugccuccuauucuugacuaauguuagugcuucaucaucucauuuuucuccuaaucccuuuuuccaaauaucucuuagccugaggucuucauaacuuccaucaucccgcuucauuauuaccuaguuacuuuucauuugucuuagcauccuaauuccagacuccucauucuucuaauuuccccaggccaaauuccugcaucccucuucaccccucuucaucucucuaccuccaaagaggaaacccuuggagauaaggggguuagagacaccaguaucaccucccugcucuuccugccuccucaaauuguuuucucuucuacuucccuuuucauaaauuagcuguaauacuccuguuagcaacuuuuaaaaacaguaaaaaauugucuuucucggccgggcgcgguggcucacgccuguaaucccagcacuuugggaggccgaggcggguggaucaugaggucaggagaucgagaccauccuggcuaacaaggugaaaccccgucucuacuaaaaauacaaaaaaaaaauuagccgggcacgguggcgggcgccuguagucccagcuacucgggaggcugaggcaggagaauggcgugaacccgggaagcggagcuugcagugagccgagauugcgccacugcaguccgcagucccgccugggcgacagagcgagacuccgucucaaaaaaaaaaaaaaaaaaaaaaaaaaaauugucuuucucauuauauagguaucaaaaguguucagaaacaaauauacagccuuuaaguggaaauagagcuaucugguacuauuuuuaaaaaauucuaaccaucaagaaacaaaaguucaggauuuucuucucuuauggaacuuuuauuugaaaggaaaguauagaaaaguuggucucacuuuccaguggacaaauucaccauaucguccugaucuguaccauaugaauguuaagaauauagauuaaguuaucuuuuuccuugauuaaggacaccagucaauuauauggauuucccaggacugguauaugucugauagucacuggcauggcuguaucuguuguuaaauguggagagacuucuguauuggguaguccauagcugcuaauuggagccccagguaaucccugacugaccugguucauuccgcuguacccccuugaucuggcaacuaaaggguuaacagcuggaggcuucugggauccagcuugagcuggugguuaaguacacugaacaucagcccuggaccucugcagugccacuuauuguuccuaaaauucuagauuaaggcaaacccuuuuugguugucaagaacauagugcugucuccaaggaacagcuuagucggucccaccagaagcaucuguugggagcagguugggcaccaacccuugcaggacuuugggauuugggacaauguagauuugugugagugcacauuaagucucauugcaaaauagaaaaaaaaaaguuaggaaaaaggagcaagaaguuauucuuuuaaaguagagacugccuuacucaucguagcaccuagcaccuggcguaaugcuggcauaugguaugcacauaauuaauauaaauugagcgaacgaaugcaggaaugggugcaugccuccugcuucaccaucaggauauucuuguugggauaaugguaacucacauuuauauagcaguuuagacuuuacaauguggugcuuugcaccuuguaaauuucuaauauaauuccaacauccuugguuacuuccaguuuuccgucucacauguaguccuacacaagguuuuuuuccaaaggagaauauguaguuaauuggccaagaaauugcaagcugggggaaaaauuauaaauacugggaaauaaaggauucuucauagggaacgaaacaggguuuguuaaugauuuaugggaauuaugugaagggccacauuaugcaucaacaauacccuccagccuauauuucaagcacaugcaguuuuuugccgcagugcuucugcugcaaagaccuacccccacuucucuuagccugucuguccccacuccauacccccgaccuuucauccagcuggccugugcuugcuaaagcucccuuuauccuuucccagcucccuuuccauguuggaguagguuccccccuuccaugcucucauagcacccugcaaccuuauuaggcuguaauuauuacauaguuagauugaucuccaacuagauugucaucucuuugguggagagauuacguucuuguguaucuucagugccugacacagaaguguuucuaaaaguaacaucugcacaccccucaaacagaaucacaaggggcgaggccaagaaaucugcucuccaagugauaacuuaaacuuuuuaacaugcucuucaggugacacuuaaacuuguuugaaaaccucugugucauaaaacuaaauauuagcuggaugaauguauuuguaucuuuuucuguguuggccuuugugaggagaaaugcugucuaugcaccaaaucagagcugaaaaauucuaguguuuuguuaaaaaaaaaaaagagagagagagagcuggguuugguggugcaugccuguagucccagcuacuugggaagcuaagccaggaggacugcuugagcacaggaguucaaguccagccugggcaacaugguaagaccccauugcuaauaaaugaauaaauuuuucucucaaggugagagauacuaguacuaauacuacuacuaauaaugagaucacuguaugaauuccuuucuguuucuacauuaaucccuuucuguuucugggugugcauuuuuguguguaggcuuaucugucuugggccucuuuugucacauauugcucaucugugagcugaggcccugacucacugaguauuuuuggggagcagaagaaggagacauuucucuccgaaaaugaacucaacaggccaccuucaggaugcccccaaugccaccucgcuccaugugccucacucacaggaaggaaacagcaccucucuccaggagggucuucaggaucucauccacacagccaccuuggugaccuguacuuuucuacuggcggucaucuucugccuggguuccuauggcaacuucauugucuucuuguccuucuucgauccagccuucaggaaauucagaaccaacuuugauuucaugauccugaaccuguccuucugugaccucuucauuuguggagugacagcccccauguucaccuuuguguuauucuucagcucagccaguaguaucccggaugcuuucugcuucacuuuccaucucaccaguucaggcuucaucaucaugucucugaagacaguggcagugaucgcccugcaccggcuccggaugguguuggggaaacagccuaaucgcacggccuccuuucccugcaccguacuccucacccugcuucucugggccaccaguuucacccuugccaccuuggcuaccuugaaaaccagcaagucccaccucugucuucccauguccagucugauugcuggaaaagggaaagccauuuugucucucuauguggucgacuucaccuucuguguugcuguggucucugucucuuacaucaugauugcucagacccugcggaagaacgcucaagucagaaagugccccccuguaaucacagucgaugcuuccagaccacagccuuucaugggggucccugugcagggagguggagaucccauccagugugccaugccggcucuguauaggaaccagaauuacaacaaacugcagcacguucagacccguggauauaccaagagucccaaccaacuggucaccccugcagcaagccgacuccagcucguaucagccaucaaccucuccacugccaaggauuccaaagccguggucaccugugugaucauugugcugucaguccuggugugcugucuuccacuggggauuuccuugguacaggugguucucuccagcaaugggagcuucauucuuuaccaguuugaauuguuuggauuuacucuuauauuuuucaagucaggauuaaacccuuuuauauauucucggaacagugcagggcugagaaggaaagugcucuggugccuccaauacauaggccuggguuuuuucugcugcaaacaaaagacucgacuucgagccaugggaaaagggaaccucgaagucaacagaaacaaauccucccaucaugaaacaaacucugccuacauguuaucuccaaagccacagaagaaauuuguggaccaggcuuguggcccaagucauucaaaagaaaguauggugagucccaagaucucugcuggacaucaacacuguggucagagcagcucgacccccaucaacacucggauugaaccuuacuacagcaucuauaacagcagcccuucccaggaggagagcagcccauguaacuuacagccaguaaacucuuuuggauuugccaauucauauauugccaugcauuaucacaccacuaaugacuuagugcaggaauaugacagcacuucagccaagcagauuccaguccccuccguuuaaagucauggaggcuauaggaucuuauguaaacaguuuuuguuucugauaguaauggacuuuauucuaacuugagaucaguggcggaucaaaaccuacaagauucaacugaaaaguuggcaguuaugguuuucuuucaucugaugugucaguaucuguugauuugcuuuguaguuuguugacaucuuaagauuugaugugaaaguuuuagauuuuuuacccugcucuuugccucagucuuuuguaccgagccuuuaaauagaugccaggaaugaagcuacuguguuaaaguagaaagucaaccgauuaucaugauuugagucaguguuaugugacuucaaaauaagguauugacuggauuuuuuuuaaagaaugugaaaauaugauuuuugcugagguguuauuuuuauuaauugaauuguaaauuuugauuuuuugaaguguugaaaucgggaacacuacaccuuguugguagcagguugauuugaauaaauaauauauuguua

SEQ ID NO: 16522 - RNA, 7390 nt, Homo sapiens
uaacaauauauuauuuauucaaaucaaccugcuaccaacaagguguaguguucccgauuucaacacuucaaaaaaucaaaauuuacaauucaauuaauaaaaauaacaccucagcaaaaaucauauuuucacauucuuuaaaaaaaauccagucaauaccuuauuuugaagucacauaacacugacucaaaucaugauaaucgguugacuuucuacuuuaacacaguagcuucauuccuggcaucuauuuaaaggcucgguacaaaagacugaggcaaagagcaggguaaaaaaucuaaaacuuucacaucaaaucuuaagaugucaacaaacuacaaagcaaaucaacagauacugacacaucagaugaaagaaaaccauaacugccaacuuuucaguugaaucuuguagguuuugauccgccacugaucucaaguuagaauaaaguccauuacuaucagaaacaaaaacuguuuacauaagauccuauagccuccaugacuuuaaacggaggggacuggaaucugcuuggcugaagugcugucauauuccugcacuaagucauuaguggugugauaaugcauggcaauauaugaauuggcaaauccaaaagaguuuacuggcuguaaguuacaugggcugcucuccuccugggaagggcugcuguuauagaugcuguaguaagguucaauccgaguguugaugggggucgagcugcucugaccacaguguugauguccagcagagaucuugggacucaccauacuuucuuuugaaugacuugggccacaagccugguccacaaauuucuucuguggcuuuggagauaacauguaggcagaguuuguuucaugaugggaggauuuguuucuguugacuucgagguucccuuuucccauggcucgaagucgagucuuuuguuugcagcagaaaaaacccaggccuauguauuggaggcaccagagcacuuuccuucucagcccugcacuguuccgagaauauauaaaaggguuuaauccugacuugaaaaauauaagaguaaauccaaacaauucaaacugguaaagaaugaagcucccauugcuggagagaaccaccuguaccaaggaaauccccaguggaagacagcacaccaggacugacagcacaaugaucacacaggugaccacggcuuuggaauccuuggcaguggagagguugauggcugauacgagcuggagucggcuugcugcaggggugaccaguugguugggacucuugguauauccacgggucugaacgugcugcaguuuguuguaauucugguuccuauacagagccggcauggcacacuggaugggaucuccaccucccugcacagggacccccaugaaaggcuguggucuggaagcaucgacugugauuacaggggggcacuuucugacuugagcguucuuccgcagggucugagcaaucaugauguaagagacagagaccacagcaacacagaaggugaagucgaccacauagagagacaaaauggcuuucccuuuuccagcaaucagacuggacaugggaagacagaggugggacuugcugguuuucaagguagccaagguggcaagggugaaacugguggcccagagaagcagggugaggaguacggugcagggaaaggaggccgugcgauuaggcuguuuccccaacaccauccggagccggugcagggcgaucacugccacugucuucagagacaugaugaugaagccugaacuggugagauggaaagugaagcagaaagcauccgggauacuacuggcugagcugaagaauaacacaaaggugaacaugggggcugucacuccacaaaugaagaggucacagaaggacagguucaggaucaugaaaucaaaguugguucugaauuuccugaaggcuggaucgaagaaggacaagaagacaaugaaguugccauaggaacccaggcagaagaugaccgccaguagaaaaguacaggucaccaagguggcuguguggaugagauccugaagacccuccuggagagaggugcuguuuccuuccugugagugaggcacauggagcgagguggcauugggggcauccugaagguggccuguugaguucauuuucggagagaaaugucuccuucuucugcuccccaaaaauacucagugagucagggccucagcucacagaugagcaauaugugacaaaagaggcccaagacagauaagccuacacacaaaaaugcacacccagaaacagaaagggauuaauguagaaacagaaaggaauucauacagugaucucauuauuaguaguaguauuaguacuaguaucucucaccuugagagaaaaauuuauucauuuauuagcaauggggucuuaccauguugcccaggcuggacuugaacuccugugcucaagcaguccuccuggcuuagcuucccaaguagcugggacuacaggcaugcaccaccaaacccagcucucucucucucuuuuuuuuuuuuaacaaaacacuagaauuuuucagcucugauuuggugcauagacagcauuucuccucacaaaggccaacacagaaaaagauacaaauacauucauccagcuaauauuuaguuuuaugacacagagguuuucaaacaaguuuaagugucaccugaagagcauguuaaaaaguuuaaguuaucacuuggagagcagauuucuuggccucgccccuugugauucuguuugaggggugugcagauguuacuuuuagaaacacuucugugucaggcacugaagauacacaagaacguaaucucuccaccaaagagaugacaaucuaguuggagaucaaucuaacuauguaauaauuacagccuaauaagguugcagggugcuaugagagcauggaaggggggaaccuacuccaacauggaaagggagcugggaaaggauaaagggagcuuuagcaagcacaggccagcuggaugaaaggucggggguauggaguggggacagacaggcuaagagaaguggggguaggucuuugcagcagaagcacugcggcaaaaaacugcaugugcuugaaauauaggcuggaggguauuguugaugcauaauguggcccuucacauaauucccauaaaucauuaacaaacccuguuucguucccuaugaagaauccuuuauuucccaguauuuauaauuuuucccccagcuugcaauuucuuggccaauuaacuacauauucuccuuuggaaaaaaaccuuguguaggacuacaugugagacggaaaacuggaaguaaccaaggauguuggaauuauauuagaaauuuacaaggugcaaagcaccacauuguaaagucuaaacugcuauauaaaugugaguuaccauuaucccaacaagaauauccugauggugaagcaggaggcaugcacccauuccugcauucguucgcucaauuuauauuaauuaugugcauaccauaugccagcauuacgccaggugcuaggugcuacgaugaguaaggcagucucuacuuuaaaagaauaacuucuugcuccuuuuuccuaacuuuuuuuuuucuauuuugcaaugagacuuaaugugcacucacacaaaucuacauugucccaaaucccaaaguccugcaaggguuggugcccaaccugcucccaacagaugcuucuggugggaccgacuaagcuguuccuuggagacagcacuauguucuugacaaccaaaaaggguuugccuuaaucuagaauuuuaggaacaauaaguggcacugcagagguccagggcugauguucaguguacuuaaccaccagcucaagcuggaucccagaagccuccagcuguuaacccuuuaguugccagaucaaggggguacagcggaaugaaccaggucagucagggauuaccuggggcuccaauuagcagcuauggacuacccaauacagaagucucuccacauuuaacaacagauacagccaugccagugacuaucagacauauaccaguccugggaaauccauauaauugacugguguccuuaaucaaggaaaaagauaacuuaaucuauauucuuaacauucauaugguacagaucaggacgauauggugaauuuguccacuggaaagugagaccaacuuuucuauacuuuccuuucaaauaaaaguuccauaagagaagaaaauccugaacuuuuguuucuugaugguuagaauuuuuuaaaaauaguaccagauagcucuauuuccacuuaaaggcuguauauuuguuucugaacacuuuugauaccuauauaaugagaaagacaauuuuuuuuuuuuuuuuuuuuuuuuuuuugagacggagucucgcucugucgcccaggcgggacugcggacugcaguggcgcaaucucggcucacugcaagcuccgcuucccggguucacgccauucuccugccucagccucccgaguagcugggacuacaggcgcccgccaccgugcccggcuaauuuuuuuuuuguauuuuuaguagagacgggguuucaccuuguuagccaggauggucucgaucuccugaccucaugauccacccgccucggccucccaaagugcugggauuacaggcgugagccaccgcgcccggccgagaaagacaauuuuuuacuguuuuuaaaaguugcuaacaggaguauuacagcuaauuuaugaaaagggaaguagaagagaaaacaauuugaggaggcaggaagagcagggaggugauacuggugucucuaacccccuuaucuccaaggguuuccucuuuggagguagagagaugaagaggggugaagagggaugcaggaauuuggccuggggaaauuagaagaaugaggagucuggaauuaggaugcuaagacaaaugaaaaguaacuagguaauaaugaagcgggaugauggaaguuaugaagaccucaggcuaagagauauuuggaaaaagggauuaggagaaaaaugagaugaugaagcacuaacauuagucaagaauaggaggcaggaggaaaaaaggugauuugggguagaggagaggcaacuuucacguuuuguacaguuacauuuuuucaacaaauuuuaaauuuuucaauauauauauuuuuaauagagauggagucucacuauguugcccucacuggucuccaacuucugggcucaagcaaucugccugcuuuggccucccaaagugcugagauuacaggugugagccacuguacccagccuucaguaaauuaaaaaaaauaagaauuccaggucaggaaauaacaauggcaguauaauuaucagcaucauuauuaguauauuaauuuuaucaagugcuuaugaugugccagguacuuuucucaauguuccacacuauuagcuuauugaguccucauaacaacccugaaauacuugauauaacaucuccauuuugcagaugaggaaaccaagucaaagagagguuaucuaaagugguggaacauggauuugaaucuaagcaguugcucuuccacacucuucaccaccaugcuaacccgaacaacaaaaaaaccuuuuugggaggcauccccaggucagaaguauuaagugguuauuacacaccaggcaccuauucuagaggcuuuacauaaauuaucaagcuuuauuucauucucacaauaauccuaugaauagguauugcaaucccuuccccacugaaacuuucuggaauccgaaauucugauacaccuauauagcuauaucuacaucuauguagauacagauagacacacacacacacacacacacacacacacacacacacacauucuucuauguaucuaacuguaguucacauauaaaguaaucauaaaucacuccuauugagauaauuagaaaaaaaggaaucaugggcugggaagagaaaagggagaaaaagcagaggacagaaaagacgaaaagguuugcagaaaaacuuuaguauaacagaaaucaagaaaauggagggaaaguaaacucaggucuuaguaguaacuccugagacuuuaagaaaaaggaggcugugaccauaauuuggaaugacaugaugacggcagaaaauaaaagugguuuuggaaggggaauaaauuaauacugcuuugcuacucauaaauauucaauaaagauuacccauguuauuugcaaugcaaacauacaagcuacucuucaucucugggacggagaauagguuauagaagaugugauuaaagucacaaaaucagaaagauuuuaagcuggaacaccagucuuaagcaugcauauuagcugcaguaagaaugaauucacaugcauauucuuacaaaugagacauccugaaguaacuagcaagcaaagaauauggaugaaaauuuauuguauaauuugaguggcaaugauuuuucauuaagauaugugaacagccucugauauaucuagugugcuguuuuaaauuuuuagugaacauuaaaacaugcuauaggggcuuucauaaaucaacucacgaccugaauucuuccaaccccauuccccgcgcgccccaaaaugucuuagguuagcauuuucaaagccuaauccucacagagagcaagguucuguauuauugugauucccauuguauuucuaucgaucaggaaaaccucagggagguuagauaacuuccccaaggucauuaucugauuucaaagcccuugcucuuucuauccaguagaacuacauugaacccggagcagcuaaugggaugggaagaccugagucauuugaugggagggaugaagaggccagggagcccccagccugaggacagagugggaaacugcgggcagggaaggucgacccccccgugaggggcuggcgguggguaggggcuucccggagaagggugaggugacgguaaggagggccuaggccgggccagguaagcuugcaaaagaaugccgcagaggggugguggguuaggagggcucagccaggguaggggcggugggugggugggugggggggguuccacggccgagcagagccugggaaccggcagggacgggcgagaaggcuacccugcaggccgcaccaggaagacagguacgcggagccgggccuggcccagcgcagccgcgcuccucgcuaucccgccagccuccgggagccgucuccggcaucgugggguuguccuccuccaggggcccgcggccucucaccugccggguggccgcagcgccgccccuccuccaucucgcaguccggaccccagcuccgccugccgcucuggaugaugcaggacuagaggcaucaucgccaucgccaccgccuccgcgcaucccgggagccgcggcaagacgcgggcgcagaggcgcagucacggagacgccgagggcaccgcccccuccgccg

SEQ ID NO: 16523 - RNA, 9247 nt, Homo sapiens
ugccuauaaagaacgccggagauggccacagaaaacuucccgccccacaaugcaaaggucaacguugacgccaucuggggugcgccuggaaucgagcaggccguuucugccgcguccaccacaaccucugcuguaucagagggggccuucgccgccgccgcccccaccaccgccccugccgccaucgccaccuccgccgcugccgccuuggggcccuccuccuucaccgcccccuucaccaccucuacacguucuaggccuucuguccuggagaagaagcuauagucguucucccuugugggcccggggcgcagccauggcggacggcggcggcggcgggggaacuggcgcggugggcggcggcggaacuagccaggccucugccggggcagcgacuggcgcuacuggggccagcgggggcgguggccccaucaacccggccucgcugccucccggcgacccgcagcucaucgcucucaucguggagcagcucaagagccggggccuuuuugacagcuuccgccgggacugccuggccgacguggacaccaagguagcugcggccgccugggcguuggggagcggggcugcacgugaggccgccggguggcagcuuugauuuucgaaagccgagagcaaaacaaaagauagcuuagaaaucucagcggugaggucuuacaccgcuuggggcaguacggagagcuuucugagcgaugcacacguggguuccugccugauacauuuacuacuaguugugauuuuacccagucccuucuccgaacuugggguuucaauguggguuuuagagccuagaccguaucauucccaagauggaacuccucugaggcccuuaauaacaaacuucgaaaccaaguagauaagcaagcgugcuuuagaauuuccaccuguuccguacucaccacugagaagcuggcauuaaacacaaugauuugaacacacagucaucaccauuuuauagcuguuuauuccuuuucucuagcucauuguuuugcagacuaguacggcguugaauuaagauaaauuguagaaacagcacccuuauuuugcacuucaucauugauaaaaggagauuuggugccuaguugagauccuaaugccauuggucagucccaccaguaaaacgcuauuucacuuuaccuacucgucagggugguuuggauucaaugaaauaauggguguuaaguaucagacauacaguaguugcuggaauguucauuuucuuccuuuucaaaacuugucuagccacgacugugguuguagguuaggagacccugucacuggacuccugcaggguagugauuucuccuaccagagccugucauggaaacauuuugcuuaccucacagcaagauugugagcuuagaauuagaccuuaagauagggaaaaacguagucuguuuauucguugaacguuuauuggccucuaguugccaagcugugcgauuacaggaauaagucacuaccccauccucaaaacuuauagucuagguuagaaaacugacauguaaauaaaccaggugguaaauacggauguagagagagaaagugguauacacuguuccuucuccaagaugaaaagcccaacuagaagucuguccuugaaacaaaguaauuuaauacauauacaucccagaucuguauugacagagcuuucaccuuuccuaggacaaguucuccauucauauuucuuauauuccguuagguuuugugugugauuuuaaaacaaaagcgacuacaguagcccgccccauccaagguuuugcuuucugcgguuucauuuacccaauuguugcgguauggaaguacuuguguucagguaaccccuauuuuacuucauaauggcccucaaagacauucaugcguaguguauauaggguucaguacuaccugagguuucaggcacccacuggggaucuuggaacguauccccugaggggggaggggacuacccucuugagcggcuggugagggagagugguuggaaccuucccauguacagcuccuuagcuguuccuucugagaauuccagguuguuuuaguucuugaagauaguguuuuuucaggcauaucuuaucugagaccuuuguugcuucagcccagugguucucaaagcguggugcuuggauuaacaucagcaucaccugagaacuuguuagaaaugcacauuuugggccccaccccagacugcugaaguauuuaggggaaauugaacagaugucuguaauuuacuuugcacuguaauuuacuuugaacugauaagugaacagguggagggguugguaguacaguaaaacguuaugagugggcucaugaguuccuuugacuucuugaacugagaugauucuguaucgccuggguuuguuacguguuuugguggugauguucacuguccuuuguccuuuuucgguaaacaguucguaucaucucaaaccaggugcguuauuuugaguagacgguauggcaucaggauuuaugcuuacaagggacaaaaauaauccuaacugcuuuaugcaaaggggagaaucuauugucuuacggaauccagggaaggauugaacgaacaaacucucccagagggugguaggcgugcguuuggaaccagauauuccccauucguucugucuuucaucucuguugauaucuguuuuacuguugguucagaguggagucauccauuugguuacuaguaucucuugauuacauuuuacagcuucuuccucuagagagaggcugucagcuccaaucugggaaaucccagggaaugucugcauugucuuagcguggcucaggcacccacuccuguggcacccucugcccuacccuugugaagagaggaagacaguuacuagaaagaaggcguuacuaggcagauagcacaugguaucugugaauuuuacuccucugcccccauuuccuugccuuucucuuuuccagguuuaguggagucuuugaguuugcucucucaaccuuuuggaagaggccagucauggaauugaggccugcugguuccuuugucaacuucauuucccugacuguuagcaaacuuugccgcaguaaugcugcauagcaaacugaaucucagcagcuuauaaccagcacuuguucacauguucauggggcggcaggucuaccaaaguucagcugagcuaggaaggcuucagcugguggcuuggcugcaggcugcccagguguggguccaggcuguggguugaugucaggccugcugcauguagaguuacuuaaaagcaaauggaauaauauaaguaaagcgccuggcauugugcccacccaccaucaggugggcacuuguguuaaccauuaauuccugacugccacauugcauggugaucuucaugcacaguggaaguguauuuagacuuaauaacguuucugugaaaagcaguguucugagagacuaaguucaaaacuuuggugcauauaacuucugaccuugccuccucuuuuuaacauuuuagccagcuuaccaaaaccugaggcagaaaguggauaauuuugugucaacacaucuggacaagcaggaauggaauccuacgaugaacaaaaaccaguugcgaaauggucugaggcagagugugguucaguaaguaagcagaauuuaaagcuuuugaaaaggcagucaucacaagugugaugcacaagaagguugaggucucuguuuagucaagguugaugggacuuuauaucaaguaucacuuaggaguugcagcagucugcucuuuuguuauaauuaagguuaaaggaagcaaaguacucaguugaaauuccaguuucugcagccugugaaggccuccugugugcaucucuacugggugcaucaaaaggcauuccaaaucgugagacauuuucccugcucuuugaaguuucaguguuguccaaacauauaugugaguuuuauaccaagauaucaggguuuggaucuugggcaagaggaguuggaucuuuauucucacaggugaaugugaacuaaauaaauucuuugaguccaccaggacugccaccucuaaaguguaauggugacagcuuucaggaaggcauagucuuaauaaaguaucguacuucacaguaacaaacugaaccuuaguuaauaaaggugcuauugauagcuuaucugagugacgcacaaaaguggagguggaggaggguacagaaaugggagaacacauuagugauugccugggguuacggaugggaggagggggugagugugacuugcaagugguagcacaagggggagcuugcaauggugcaguuaagugucacugaauugugcugugcucacgugcaacagcucguaugguaaagucgcacggagcuacacacacaaauaagugcaaguguaacugaagucuaaauaaggucuggauuggaccagugucauuuuccugguuuugauauugcacuaguuacgcaaggugcugacauuagagcuggcugggugaagggugcguguggaacucccuggacucuucuucacaacuuccugugaauaugcagcgauuuuaagauuucuaaaguuuuuaaaaguguuuuacuaacaagcuaguacuuccaauauggcugaaugcugggaagaagccugauagcagaagaugcccagugccuugucauucuggagucaguaccgagugccuuucccuuucuccagagaacagacugguggcaccgggcucuuucagaaagaaggggacaguagcugccccuuacugagcaacucuuuauuacaugucuggcacuggucuuuacauauaucacucauccucaugaaaagccuguuucacagcuaaagucacuuguguuuacccugucuugaguaaaucaaaacacugaacauucugaaauauuuggaaaguugccaugauuguaugaaggcuguuaacauugcuuugauuucuguaaugagcauggaugucauucuagagguaugcauguggcgcuuccucuugcauuucuuuaguaggaauuguaauacggaaaagugcacagaaguucagugaaacagauaauuagaacaucccuugaucacccagaucgagaaauggacucacacccccgaaacagccuagcuccggauguacuuuccuccuuucggaaguuuuccauauuccugacuuuuauacuaaucauuuccucucugcauaguuuuuaccaccucugugaaguuguuguuuuuuuuuuuuucccugcuuuuugauuugacuuagaauguguuuaaccugaaaacaugaacuuggcuuuaauacugggacauuucuccacaauucuugcuagcauuuugaauuugaggcaaaaucuacuggaguuucgaaacgcagacuuucugcuugcccccaggugcucuccccagguggacacugcaggccuucagagcauuggcucacuggccuggcuguucuggcccagaugcuguaacccagugccacagccuagaggguuuaacaggaaauuagccugugcuauugcacugaauuaugacgaauaacucuuguaacuguacaauauuuguuuuuuccaucuuguacauugggcuccugacaagauuuuauguuuuccucaaaaguuuaagaaucuccaggaaagugagcugcacucccuugguaguuuguuuccccugaucagggguuuuggucaguuggggaugcuuuaacaaggcgccguagacuagguggcuuguaaacaauggaaauuuacuucucaccauucuggaggcuagaaguccaagaccaagaugccagcauggucagguucaggggaaggccuucuugcaggcagcagacugccaacugcuuguucuucucaugugguggaaagagagcucgcuaacuuccuggggucccuuuuguaagggcauaaauugcauucgcggaggcucugcccccaugacccgaucgccucccaaaggcccuaccuccaaaggccaucacauuaaggauuagauuucaacauaggaagucugggggacacaggcauuuaguugauaauaucaagcuuuuacaucugguaaaggacccugugaauccgacucaggaagugguuugguaaaguuggaaagguauuggcuugugacugaggagagguggcuuuccuuuguuagcaucccauagccggaugcuaacuuugcuguauuuaacgaugcucaucacuaagggccgauacugucuaaugccuggucuaccugaaaaugugcccuucagugcucuaguggugguguauuuacaucuaggcuuccugucgauaagcuguuaguuaccauugaauccagggagcacuuuacacacuaaucaucuuucccaguucacagccuguuucuuaucuucuuugucaugauguacauuuacucaugucuuuccuuugcuguacccugacagaccauuugcccacuugcugcccagccuauuuuuacccgaaggcuuaaauggccucugaagucucaagucuacgggaaaauaaguaaaaccugcccacaugcuugugaugguauuggaauauuucaguccuuugagaagaacacuucacuuugaaccuuacgggcuauuuuccagacuguccaaauaugauuuguuuccucucaccaucauuuccaguacccugucccaaguguuugaauauagacauugauaugcccugauuuuugcucuacuucagaaaggaucggggauguaauuuagcccucuaggagcuuggaacuaauuuguuugucuauuucuuguuugcuuccaaguugcuuauuauguguuacagguagcaacuacagcugaaggccauggugaauugcuggugauguaaauacucccagcccugacugaucggccuuguuuaaauuuuaaggauuaguaaacagguugcugcuggagcuacuucugcuuaggcuauuaggagaauaaauguugaaggaaauggaguccaauucggggcuuacuggcuuugacaguacgaggaagcuuuucagugccacacgugucaaacucuuucucaccaugcugucauuuguuuguuguuuuggagcaacucacuuaguuuuguuuuugauucuuuuguacaagguugggugauugugggugagauugugcaguaggaauaacagcugcugguugagaauuaccccucaaaagugaaaauagcgugagcuguauaugguaaguggauugaccucuaaacucccuagaagggcuguagcuuugaagguggacauuuauugggcucgcacgugacacuuauuggggcuaaagaugaaucccgaaggaacuaaauaacagaaugaucuguuugucuccacaaggucagggauguuggaagcuggaguagacaggauuauuucucaggugguggauccaaaacuuaaccacaucuucaggccacaaauagaacgagcaauucaugaguuccuggcggcccagaaaaaagcagcugugccagcacccccuccagagcccgaaggccaggacccuccagcuccaucucaggacacuuccuaagguccaguauccuaucuucuguccaggaguaugcaucucuggcuuguagauauguaaaauggauaggaaugggguaggccguaauugaggaucauucaggaaguauuuacugcagauggacuucaccuacuguuauaagucacuuuuuacugagaacuaauuaguagcaguuuccugugucagugacugauuuucuguuccaccagcgcuaaacauguaagcuauggauagaugcuucauuagaaaucagcugggaugauuggugugcauaaaggggauucaaaugaaagucuuauuuugcugaaauguuuaaaugagucucuccuggacaugaguuaacuuaggcuugcaauuuuauuuaaaaucaagcagugccuucugaagugauauccuaaaugggauucagagucugcuuugagugcgacucgauuuccaugaauuuagaaggaguuuguuuaccacuaucaauuaccaugggauucuucuguuaggaacacucccccuuuuuaaauuaaauuuggaauuaaauguaauuuuaaacagcuguagauguacaaaagaaugcuuuuugcagguuuugggagacauuaguaggagcagcgaugaaguuagcaguggacuuuucgccguuguuggugacugcugggauauguuuuaucccuucauucugauuugguguucuuuuuaagauucucugagaugccuguuauaaucaguaagugaggugaauugacuagggcguuuugagugucagugaugagcaacgcaagagcaucaggacugucuuuuuguuccucuauugagagaagcccuugaguccaauauggaguguaaaacauucauuuuaagucuuucuuuuuaauuguaaauuccuuuaggaacauaaaagugaauauagucuguuaucaauaaauaacauuuugauaugauuaucuuuccuuuuuagaauacgccagacaccuuuugaaagcuaauuuuuggugaagaaauggauucgguuacauaagagugcaacuucagacugaagauaggccaaggucgucacugaucucaagauuucaaccuugaccaugggcagugaccagauugaaaggggagcaaguucggcagugggagaguugaccgugucacccccugcauugugcugccauuuggccagccuguccaagggcaugacaccaaguagacacuacagagagagaaacacuacagcaacccaggguuguccugaaacagacuuuuauacuugaacauggagacugcacauggacuuuaggguuugugcugugggauaaacggaagcuacagugagaacauagccagucccaaagacaauuucaaagaaaaaugacaguaaagauuagcugggaguagucuuugacagugcuuauuugauacugucucucagaguuugcaaaccagauuguacaagucauuagcgucagauagcuuuaaaguugugaccuucuuguacaugaaucuucuagccaguuuccuuuccuuuguaacgaaacaugaaauccuagaauguaugagaaguucagacauuaggcauaaggaaacucguuugcaggcucucuguccagggcugcuuccuguccuggaggggccagugagucuuagguauguuuauuuuauucucacauuuguguuuuuuuagaaaagugaauggucaauaaauggcuuaucuuucauaauaaaauuauuugauacuuuuacuccgaagcuucagc

SEQ ID NO: 16524 - RNA, 700 nt, Homo sapiens
cagagacgccucuuccgucugcgccucgccuagugaggcccggcgccuggaacccgcuucccccacccagagugagcgcagcaggucgccaucuuuugugugggcaagggacuccuuugauauuucucuucccuaacugggcuuugcaggaggagcaauagggacgugucaaggagaacggauuccucgcucacgaaggcauacggucaagguguuggagaucgaaguggcggcccgugaaaccgcggaugaaugagaagggugcccacaguaaagguggugcuccaagcaucacgugcucuggcccgagcuccgccccagagggaucuggaaggggaggcgggucuugccagcagcugugcggugccuagaacugcguuugcccuugcccagaauguagaccucacgagggacucucccuuaaccuuccauucgcucacccgcaccucccacucucccauucugcuaggcucgcaucuggugcagucucccaggugcagagaugcagcugaggcgucuguggcuaugcccccguaucaucccgaucuaguacaccuuacacgcaauaccagagggaaaauuccaaaacuaaaauuuuaucuugacccucacaugcuccgauuucuucuaugguugcccauuauuucgaagauaaaggccaaacuuguuagucugguauucaagccuuucuaccuaaugg

SEQ ID NO: 16525 - RNA, 3635 nt, Homo sapiens
cgcaguuccugcgcgugcgcgcuuggccucccuagugcgggcuggcagugcgggcagagcccggcugagaggggcggcccuggaggagacggaggccgcgggugggcccgaggcgcaagaggaagaugaggacgaagaagaggcgcugccgcacuccgaggccauggacguguuccaggagggucuggcuaugguggugcaggacccgcugcucugcgaucugccgauccaggugugugcgggcgggggcugggggcgcgggagucguuccccgggguccgggcauccgggcgccggcagccuccgaaggugcuggugggagacugcggcccaaggcugaggaaggcgccucugggcguaaacgaggguuuuaaccuugaccgggcgcacucgccuggggcgcgaagcuuaaagaggaaccaaaaaccucauuagugagugacaucaaaugacauuuuaauguaauuguauuuagggggcucgggggacagggucuugcugcguugcccgggcuggagugcagcggcguccucccaccucagccucccgaguaauugggaccacaggugcgcgcuaccacacccggcuaauuuuuaaauauuuuguacagagggagucucacuauguugcccaggcugaucugaaacuccugggcucaggcgauccuccugccucggccucccaaaaugcugggauuuaggugugagccacccgccuggccuguaauaccuuuaaaagucaaaguugaggcaaaaaaagagccuacgguaaaagaaaaauuuaguuuuaaauaagagcaagauuaguaguacugauuguuccauuugccucaagcgucaaucaugugucaaagcgucaguaucaugcuuugggacgauacugucuuuuuauuuauuuauuuauuuauuugagacugagucuugguccguugccaggcuggaguguaguggugccaucucgacucacugcaaccucccccucccggguucacuacaggcacgcgccaccacgcccggcuaauuuuuuguauuuuuaguagagacggggcuucaccauguugggccaggauggucuugaucuccugaccucaugauccgcccgccucggccucccaaagugcugggauuacaggcgugagccaccgcgcccggccaauuuuaaauguuuuauauuuugcucaucauggauauuuuaauugccuuguauuucuuaaauguuguauuaaaauauuuauuguuauuaccguguuuugcugccccgguaaauuuugcacaccugccuuacucagucccgaagccuggccuggguccugaugaucagggauauacucagcgugaacugacaggccucuacccaccccugggggcagguccucaugugaguuuauucucuugccuguuucuuagcaccucuuucccccagagacucuguccacuauggacauuaaaaugugaguggaacaugagauuggggcucugaugaauugggaaaccauaacguacaggcaaccacccuuccuugcccuucguaaaauggagcaccacuuuuuggccacuaucggcuuguucuuuguuguugcucaaggugguaaagagagccaggguucccacuucugcccuuggucuuuuguagguuacucuggaagaagucaacucccaaauagcccuagaauacggccaggcaaugacgguccgagugugcaagauggauggagaaguaaugcguaagugcuacccuccucccuucagguuaugugguccaggcuuucacagcaggaagaccuaacagugcuggucagccugcucagaaacucacaggccaugcccagggguacuggggcaaccacaaaccugcccugugcacagagguguugguuccuuuccugccaucggaggcuguggcuuuggguucucaccauggaucuucucccaucuguguccgugguugcagccgugguuguagugcagagugccacaguccuggaccugaagaaggccauccagagauacgugcagcucaagcaggagcgugaagggggcauucagcacaucagcugguaaguggaacaacauucccuucauuauagcccuucguggggcuagugcccuucuuggcacugucaccaggcaccaccuggaaacagcucucagcucugcaugaguacagcaccacugaagugaugagcucccugucacaagagugaugagcucccugucacagacagugcgggucguucugugccugggacuccugccucggccauccccaacauucugcucuuccaucggcaucaccccauccgagcugcuggguaucuucacuuggggacacugucgggaauuuccagugugucuggaaguggccucccuaguuuuggaugguacaccuguaggggcucccauccccuucucaccugggugcugucagcccucacucuccuauuggaucaacuauccuguucacugagucucaacacugucgccuguugcauuagcaagguuuguuuggccaagccgccccagacagcccucugagaacagagccuccuuguagcugccucagacccaaucugcacauuguacagaacagcccagguagggaggacagcugccccaggucccauaggacugcaugccucaagcccacgucaugcagagccacucagcucacccugcucagggcacgugguuuaccugcauuccccucuugcagguccuacguguggaggacguaccaucugaccucugcaggagagaaacucacggaagacagaaagaagcuccgagaguaagugccggccacguccugagccguagggcaccgcuguucuguugccccuuagucccccaugcucugccagagggcugcggcucccucuccggagauaacacccuccuccaaggagcuuccuuggggcccuccccacuaggagaauggcaggcagagggcagcuggaggggccuugcugcuucccaccaguggcagcuuagggcuacacagugccaggagggaggaaaucagagugggcauggaggcgaaaggcugugacucuaucugacacucaguucccugccccggggacuugugagucggagugcuucugggucugugagaggauggccacugcacuuccuggccuucccagaagccacacgccuccccucuguuguuucuucgugguccuccacagccucaggaggggagucacagauauguccuucuguagggcaggugcuuuaugccuuuccuucuuuuucagcuacggcauccggaaucgagacgagguuuccuucaucaaaaagcugaggcaaaagugagccuccagacaggacaacccucuucaucacugguggcugagcuuuuucccagcaggaauggguccucgaaucaucgugccucuuucacagaaaggacguugugguggccucaccccaggcaugcccaacaguaacugucagcauaaaccugggggcccucaggacuaggacagggugagccagugcucccuccuuucauguacuuggccugagacugaccucucccuagguccaaaugcccuagucacauggcagacccacggccuggcccacuguauaaaauaaaccuguuugcuucuuaguuugaaaaguagaaag

SEQ ID NO: 16526 - RNA, 14585 nt, Homo sapiens
cgcuccagggcauucccgggcgggccggaccggcgggcgggcggggacucggcgcgggcccucccggccagcggcggcagccuccuccccggcgcccucaggaccccccagagcccccggcggcggcagugagugagcgcggccgggagcgcagggcuccgggggcgggcggguuccggggcugcguccggagggcggggcgaguccucagcacccggggccggagcugcucagagcggccggggccgugucggggccggggccggggccggggaggggucgcggcgaggcccccccggggcggccgggcuuuucuuccuggaguuucccgagucgcccgcggaggcggcccagccccggauuccuagcccggcgcgccgcaaaaauagcccguggccggauuagcagccccagcggccuggccgggcgggacagcucggcuccagcccccgcccaacagcugagggucccaggagcgggagucuagaguccgggggugccccagguuccucugaacuccccccgcugcauuuuccuucccggccacgaccggcggguggugucuccgagcugaaacuccagcccagggcgggauggucccugucccggcugcccucaccgaugggaauagcaggagccguggagcugggggugggggacugacuccgccuucugccccacgacacugacucccccaucuguacacuucgaagcuccagggugggcugggagcgacucccgaagacagacucucacucugugcgcagaggccaacggggacaggccuucucccggcuggggugacagccagaccccagaugcucagggcauuggcagagggccugguugucugucaugcugggggcauguuuguggggcugggcggggaaugggcaggggaucuucccuggccccccagggccugcuuccgaccgaggugguccugaccagaguuucuucugugugugccgcuugagauggugaaugugugugucugucccgguggguggggccuaggucuggaggcccuucuccuauccugggaacucccacccgccaacgggacuuccuguuggagaccgggagaagauucaaggaugaaacuggcuuuucagguuugacccagcuagaugccugggcagucccaggcucgguucuccucaccccuguggagcuaaccccaaccuccuagccccgaccccaagggugggcagaagcuggggaccaagcagcuggcuggggcucaaggggucccugaggcggagcccccugccaccaggggucauucugggcaagccgggccccuuuuccugagaauggggcaggggcaaauggagugcaugggagucugguggugccagauugaaggggccucagacccuuucccagcccuuccaaguagcuuucacuggcuggguggccuccguugcacaagcaggccccucaaccagcaccccucaugagcuggccgguccccaccuuggggagcugacuuucuagggugcgcucuugguuuagggggagucguccaggucuccccugccuuucagggaccaucaggcccuccccuaggaucuucccagcuacagucccugcccagggcacccccaguugcucuuggcugugagggccuccgccacaccggcuccaguucccccaccucagugucugugccaggaucacauuuugcccagugauuggauuccuuggcuucugccuuuuuuucugaguuggacgauuuugggggugaguccuuccuucuucaacugagaugccccugauggagcagguggcaaggggucuuagaagggucugacagccguccacagccacaaggcugaagaacccagguggucugccuugucuucugggggucugcagacagggucccuuccacugcagcuccugggcagaccuggcccaaggcuuugagcucccuuauaggcccugggaccuuaggcagugaugggcuucucugagccucaguuuccuuaucuguaagauggauacagaggaccccucccagggguuagacagaccagugugaucagucaggaucugguuugaggaagcugagccaggcugcugaggaccgaagccauuucugcucugacuugguuucccuccuguggccucucuaguccuauccugcuucugguggguccugggaggggguugcaggguugcugagcccaagggugccugggcaccugggugcauguguguagggucagucagggacaccucuggagggcucugacuggugacugggcugcccaucuguccucuggccagacgugugcaggggaugugggccucucccaccugcagccuggggaggguguuuucgccuaacuccugagacccagcuagacuccagacuggggacuagcagugaccagcauaccaggcaguuuacccccagaaucuaguguagcuaaguccuugcugccauccccuuucugacuguguggccuggacaggugcccugagcugcacuugguguccccugauuccugggugugucugccaugucagccccugucagacccaacugagucagggguuuagcucuggugaccccugugccacauuugcuagcugagccuuggggcagugccccccccccuccugccaagugcuggccccuuugugcacuacccucacaggucagguccucagggauuccugugucuacaggcccuagggcggcuucccucacagauggccuguagcagggaaccucuuguucugucuccuugucuagggugaugaggggaggcagggugccagucuguccugcuggggaccuggagagaacccugcaaaggucucaggccugcccugcuccacccugaaccucauuucuuccacagaaaagaagaggcuucacugggaggguugaagagcacuuugggguuugcaaagggccuagcaaauaucauucucagcaugaugccauuaauagacaaggcagagaggccaggugacuuucccuucauuaauccagaagaccuggaggcugggcugccagacagcuggugacccccuucucaagggagaucuaggauugagcuucagauuaggagucaaacagaagacugagggucagagagcagcguguggguggggaugcuggaggagccacaucccccugggaugaggcucaugugagcugaggacacgucugggaaggugucccggggugaggccccuugcuccagcugaccucggcagcaggcaguuccuugggcggagcagagcccaggcuugaugguucuggccccgggguuggcagucaacuccgccgccaguugucccugccagcaugguccugugagugugcagggcaggccugaguacagaggugguugcugcucacaccugaggaugcagcucuccacuggcuguggccacugucuaugccuggacuggccagagcuucucucuagucucuucccaaacucgacaccuuuggaggguucuguccccagguguccccagggcugcccucuuguugcauaugcucuaggguccuuucaccccccagcuccugccccucagagagugccaaguacccacaggcuacaccacccugugauggagucagccgcugcuacugugccaggcacugcugugaccccugauuuccagaugggaaagcugaggcuugcuuaggguuguaggugguggagacacauggggcccaagcaucagccugggcuguccccaguggccucccugcaucggcuccugcuuucuggcucucccugcaccugugcacgcggccagcuugaugggugcccagacauccccagagcagaaaccugaguuaacaggacucuccaccaucccccacucagcccuuccacaccaggcucugcaggcagccagaggggacgucagcaugcauggcgccaguggcucccuugacccuccucgucccucagccucaucgagaguccugcccgcagcccccccagcugguccugggaugcacuguggcuuugggugucuccugauggggcugggccugggcuggcagcugugaggcugcugcagugacucagaugcugugugaccccaggcagugaggccuuccgugggccacgguuuccccauacacugaggggucagcggggugggggagacacuguuuggauccccccgaggggcuuucugggaacaagagcccacugugcgccuggggaaggccuggacacugagccacugucucugggagggcaaugugccgcucccuggccagacucuuuguccagccugggccugccccuccccacgccuacuccggcucuuccuuuggaaucccacccacuugaggcccagauggggaucuaggcacacagggguggggcagaccagaacacccagcacugcccacccgcaggaccuauaacugucgguucucagguccccuccugccugcacuccuagcaguggggguuuuuguggaggugggaaccccaggagaccuggauguagaggcauggcggcuggugccuccuucaugagcugagcacucugcugucuccuggggccgacugugguccccggcugagacaguccuggggagguuccuggggccgacugugguccccggcugagacaguccuggggagguuccuggggccggcugugguccccggccgaaacaguccuggggaggucagguuccccguacacgcucacagcucucggcucuucucacccccugacuguuccugcuugcauccgcucaugccaggcagcucgucuucccagacccagcugagaggucaucuugaggaauccuccguuaccccagauuagggaccccgauggccugcguuguucagugaucagugccuacccagcgguggcuucagagcaggccaguccugagcacuguggaggcagcagugacaggacaguggcccauacauaugugaaugaacuccugccuugugcugugcccagggauccaggccaaggaccgccuuuggguaguagggcagccugaggcugcagguccucccacacaggggagggugggcagagcgcauuugcagggcucugagaugggagggagucaggugugaggagcagcggagagcaggagccagggaagucauggaugugugugagcccaucagcuggcaacggucucuguuggcaaaggucacucacacuccugagugaagaaccagcuggaugucgccuagugcugcugggcacagguggagacuccuggagaggcuggcccccuggauucagccugcugauuccuggcaguggccccagucucuacgcugggcccugcuccucucuggcccccauaauggccucacuaagagcauucguccauuuucugggugagaacaugcugggaguguacucagaaugcugucccagcacuguggguuccggaagccccuugccgagcaccaccugccuucccaacgugucugaugcugucugaaauuccacccuuagugucugagacucagagguggccccuccuggcuauuccuuaccagcagggugaugguacugcaguccauauacccuguggagggagggcugggggacgaugaggaagucuagcugugaccccuucacgcuguggcugggccguauccaggacacgcaggucugggcuggguuugggucacgagucagaugcagaggggucuccuggugcaguucccagagggaccuugacccacccaguucucaguuaggaugccuuucuguccgacccuguugcacucuggggcucugcaugggugaggggcccuggagggauuucccagugauguggaguugcugcccuuggcucgugccccugauuccaggccaaguaugggccagggacaggaacucagccuuagggggccauguggauggaaugaucccugggcaccaugccuggggagugccccaaagcuuugccccccagcucucaccugggaccugaagugcacagucagcucagauaaggggcuggagcgugaggggugggguaagagccagcagaaggcaucccugaaguacccccucccaccugugucuguucuggucccuguaggaccaguaggggcugugagcagcauucccagccuuucccugguaguacagggucggaaggagccgugagcucugucccaggccugucccuggcuggcauaagaccauuaggagcugugagcagcacccugggcugucucuaauugugcugcccuccauauaugaccgugagcgaggcaagccuguguuuccuggccucaguuucccuauuuguacagcauagguggggcuuuccuccaagcaguugggagggagaccugugagugaaagccauuucuggggccuugguggguggguugccgacccagcggcuccgagccugucagaggcugcagcucuuuaaagaggcugaggaauuugggguuuucuguccaaaauugcuucagcucuggccagccccccacuaucugucucgugucaugcucaggggcccuucucaaucugggucuccacuggaaucgccguguggucccccuggguuggggacagcugcaggucugccaggaagguguaagggggaaauggagucguagucauauggccaggcagugguggccagaaucgaacccuggccuaucugcucuggggccuuccguggggcccuggccccgugccuggcaugucaugguagagccaagcuugcaaugccccgcagccccggcaccgagccgccucacugcuguuucugggcgcguggcgucaccugguggucacuacggugucugcgcccgggugguuucuggaaagucauuugugcccaggagccuggggccacuagcugcugcugugucacccucuuuccugaauguggugacucuaugcacuggaccgaucacacaccucuugcaggcugucaugugcauagugggcccuuugucccuggaguggaagucuggguggguaagagggugaggccugguaagacaggugugagauuugcccugggcacagacuagggugagccuccugucacugagaccucagaucggcuguccccuguguguggaaaccccugcaaccccagcugugcucacuccccuccuucaagccuuugcucagcuguuacuucauggggaggccucacugccuccugucaagcaacccuaguuugcuucccccgcucccaucauacuuagcaucuuuuaaccaguacauucacucauuuaaaaauauugucuagacuguaagcuccaggagggcagggauuuugucucguuucuccaccaaugugccucaagcaccuagagcaguauccugaccauagugugugcucagauaguugucccauggacuuauguugucugaggaccuaggcugugcccagcacugucugcugggaugaacaaggcaggcacagagaaagucggugcugagcacacaguagugcucugacagugggggacaugagcaccacgguugggcucaucacugcuucucccuccucccgggucugggugcaaugaaucuucagaugucagcuuugucauuauugaauaacacaccaugccccgcaggccugccuugcucugccaggaaccaugagugaggcccgcagggacagcacgagcagccugcagcgcaagaagccacccuggcuaaagcuggacauucccucugcggugccccugacggcagaagagcccagcuuccugcagguaggcccuggccugcagggacugugggugcccccuguccaguacccucaccaugacccuguugcccagccccugaggcgacaggcuuuccugaggagugugaguaugccagccgagacagcccacaucucuucaccccaccaugagcuccggcggccggugcugcaacgccagacguccaucacacagaccauccgcagguaccaacaccgcccagcugcuccauggggugggagcugggggcugguggggcagaggcagguacacagaggauggaaaugagaacaagggcccucuuguuucagcuuccuccuccaucucgguccccaccauccccuugcccuccuccuguucuggauacugaccgcucucaccccacuacccugcuccacucccuucucuucagcacucacucucuccuucucugucuccaccgcccggaugcucuugccucuuagcagccgacaaguacgcuucgggcguguccacacucugccccucuuggguccccgggcugcccgcagggccuucccacagcgccagucucucucuuggucccugcucagguaucucauacaggucaugaguguguugguguuuucuggcaugugcuuggcaugugaccucuugggagcugccagugugguuggcauucccuggggcuccuaacggcaggugcuggcaguguuuuuguuugcauguccaagugcuguggacagccugccugggcccguaagcaccugcugucugagcucugugguguccuggggccaagcucucucggguugagcucucagcuccuucucuggacucagugccuccccucaacugccccucagggaugguggggugagggccucuaugaagcacucaaccgggcaaggccagcugcggucuaguggaaacuuggaguuggcuaacaguucaggggguggcuggaacccacucauccucuuauuagaccuugcccacucagacccuggucccuggagugacuacaggccugggggcagcaugcugccccggaggagggccuuugaaguccccugccugggaggggcgaucuggccgccccuugcugagucccugccaugccagggggaccgccgacugguuuggagugagcaaggacagugacagcacccagaaauggcagcgcaagagcauccgucacugcagccagcgcuacgggaagcugaagccccagguccuccgggagcuggaccugcccagccaggacaacgugucgcugaccagcaccgagacgccacccccacucuacguggggccaugccagcugggcaugcagaagguaugccugccuguugcugccuccugcaggccccuccuuccgcucucaggggcuggggcugcggacacagccagccugagcagaagggacucucugggagcucacagucuggaagggcagucagacagccugcucgugaaggcaccugaaacagucucugggaagggguaccuugggauggggacauggucuugggauugcaccagggggccagugucuggaugggagagcauuccaggcaggaccucuaggugcuguggggugggagugguggccauagagcuguccaggggcccgugaggagucaggagcagcagucacgcugucuuugcaaggccucugugccucugggugagcuaggagcccccaugguccugacuccagcaucuccuccccuccuccagaucauagacccccuggcccguggccgugccuuccguguggcagaugacacugcggaaggccugagugccccacacacucccgucacgccgggugcugccucccucugcuccuucuccagcucccgcucagguuuccaccggcucccgcggcggcgcaagcgagagucgguggccaagaugagcuuccgggcggccgcagcgcugaugaaagugggugcaggggccaaaggcgggguugggggccgacccagcagccgggucucaugcucacuuccccguccccagggccgcuccguuagggauggcaccuuucgccgggcacagcgucgaagcuucacuccagcuagcuuucuggaggaggacacaacugauuuccccgaugagcuggacacauccuucuuugcccggguaagaagugcccgggguguccccccaccccacguucccuuccugccuguguccacccugaccucauguguuugcucaggaagguauccuccaugaagagcuguccacauacccggaugaaguuuucgaguccccaucggaggcagcgcuaaaggacugggagaaggcaccggagcaggcggaccucaccggcggggcccuggaccgcagcgagcuugagcgcagccaccugaugcugugagugcggcaggcagggaagaggggcagagagagaccccggggcccgucaggaacagcugggcgaguaucggcauucaccucugugggcgauggaagggguagccucagggacugggaacucacuacucacugggccaccaggggugggagacgcagagcugggcauggccccagucucauggcuugccuguggaaugggacagcaaucuuagaacccaggggcugggcagaauccaacggggaggcggaggugacagaggugauacuugcugaguugcagaagucaguguguccccguuccagcucccugccauccccggaggcccgcaguguugcuuuuuuacuggcaaggagaaggcagaugccgggcgacuugcgcaguauauucgccaggauagagacagggugcccuggugccccccggggagggacugcagcaguuugcggggcuggggcgggaggugaaugccggcucccuccaggcccuuggagcgaggcuggcggaagcagaaggagggcgccgcagccccgcagcccaaggugcggcuccgacaggagguggugagcaccgcggggccgcgacggggccagcguaucgcggugccggugcgcaagcucuucgcccgggagaagcggccguaugggcugggcauggugggacggcucaccaaccgcaccuaccgcaagcgcaucgacagcuucgucaagcgccagaucgaggacauggacgaccacagguaggcguggcaggcaaggccuggguugggauggaggcucccgggggagggugggggcuccgggucggggaugaggcccccgcugacgcuccaccccgcaggcccuucuucaccuacuggcuuaccuucgugcacucgcucgucaccauccuagccgugugcaucuauggcaucgcgcccgugggcuucucgcagcaugagacgguggacucggugagccccugugccuucccugggcccagacgaguggaguccgggcacuggacccccucccgacccgcucugggaggagagggccagagucggggcccgucugaucccgcuccccaaccucccaggugcugcggaaccgcggggucuacgagaacgucaaguacgugcagcaggagaacuucuggaucgggcccagcucggugaggacggggcugggggcggggccggcgggggcgggaccuggaggugcccggcgggggcaggaggccccggacugcggccgcucgucucccucgcccgcaggaggcccucauccaccugggcgccaaguuuucgcccugcaugcgccaggacccgcaggugcacagcuucauucgcucggcgcgcgagcgcgagaagcacuccgccugcugcgugcgcaacgacaggucgggcugcgugcagaccucggaggaggagugcucggugcguuuccccgcccgggacucccgccuucgucugcccgguguucgcucuucagaccucagauagacucggcagagugauccuucgcccucguuccuggcacaucccgccguccuuacgcgcaaggccuugucauauucauuccuccucauccccacccucccccaucuccagcuccucgccccguagaccaucaucugauuuggucuuuugauuuggguguacucuuccagcaugugucuuaaagcuuacauaagugguauuugccucuuuuccacuaagcaauuuuuaaaaaaauucaucccaacuuucaucacaucaucuuauguggaagugccguaguccauaccaguucccugauuuaggacacagagguuguuucugauuuucagcuaacaggaauuaugccgucaaacuccuuguaagagucuuuuccaacaugcacgugcaucucaagagugggggugacuuguagaagcggagggaagagcucagugguuuugccuucgacuccugacucccugcgugccccucauugcccugacccaacuggaccugacccugugucccccucccacaguccacgcuggcagugugggugaaguggcccauccaucccagcgccccagagcuugcgggccacaagagacaguuuggcucugucugccaccaggaucccagguuaguccugccggcagcucucucaccugccuuuguccacaccuuccccgggggcuguggugcagaggguguaggggcuccucuuguuggcgacuuggcuggaagggugccaaugcuaggggcucgaagccggucugaccacauacuuggcucaugcagggugugugaugagcccuccuccgaagacccucaugaguggccagaagacaucaccaaguggccggugagcugcaguggggggguuguuagggagcccuccgugucaugugggagagaaugccacaccccacccacuggugauaccagagauucccaucaugggaccaccucacguuuucagaggcugugcaccugcccuuuguacagccuguccaucaaccagcgccugccccucugagcaaguagaucaagagaacuagauggagacuugaaaggucaagugacauuauuccaguuugauagagacucagugugguggccugcuugaagucaaggaagccacaccguuuucugcuuuaugagcccacccaucuuugccucuacccccaaacgugguguggggccaaagguugggggaggcccugacucagcucguccucauuugugacccagaucugcaccaaaaacagcgcugggaaccacaccaaccauccccacauggacugugucaucacaggacggcccugcugcauuggcaccaagggcagguacgugugcgugccagcgagugcagcuggucucugggcucagagcaucgcccuagggugugccuucucccuaaccaaauccugaaauaagccaguauaccaaggaugugggguuagagggggucuggacuuccuuggggccaacaaagguggguaggugcggcugaaacucgcccuggaugccagcaaucccccucugcaaggcagcagucuccgaacccuggccugccuuucuaggugugagaucaccucccgggaguacugugacuucaugaggggcuacuuccaugaggaggccacgcucugcucucagguaggucugcagaguguccgucguuccccucccccagcuacugugaugcugauaugcugcucugcgcaggugcacugcauggaugaugugugugggcuccugccuuuucucaaccccgaggugccugaccaguucuaccgccuguggcuaucccucuuccugcacgccgggcaagugacacugugggccgggucgggggucucagggcccucaggauuggcuggcuggggguggcagaaaggucacuucccugcugaaugucucccgacccccgccugcuacugacuacaggaucuugcacugccugguguccaucugcuuccagaugacuguccugcgggaccuggagaagcuggcaggcuggcaccgcauagccaucaucuaccugcugaguggugucaccggcaaccuggccagugccaucuuccugccauaccgagcagagguaaggcuggcccucaggguggggauccucccgugugcaccugcagccugcugugaaccuguccauaucgagcacugagucugggagcaucuccaguuggauccucggucccaauaugcucugggccaugggaaguggggcagaaagaugaggccuuggguccagggggccugccagccccacugccuuacagcuaccccaaccaucccccagguggguccugcuggcucccaguucggcauccuggccugccucuucguggagcucuuccagagcuggcagauccuggcgcggcccuggcgugccuucuucaagcugcuggcuguggugcucuuccucuucaccuuugggcugcugccguggauugacaacuuugcccacaucucaggguucaucaguggccucuuccucuccuucgccuucuugcccuacaucagcuuuggcaaguucgaccuguaccggaaacgcugccagaucaucaucuuucagguggucuuccugggccuccuggcuggccuggugguccucuucuacgucuauccuguccgcugugaguggugugaguuccucaccugcauccccuucacugacaaguucugugagaaguacgaacuggacgcucagcuccacugagcuggcugcgggcuccagcggccgugugcuccagcaggccagagccagacacgaccucccugagccucacaggcuuacaggagucaccugcuccauguggggacuggccuguuuccugaacacagaccucuuucuugugccuuguucacuucuguugaaccccucguacugccgggcauuuauuauacuacuuccugucauaaccuucuaacuuguuucuugacgaccaccucauguggccaauaaauggacugggagcguuuuagcugccauuaacuugaccag

SEQ ID NO: 16527 - RNA, 3870 nt, Homo sapiens
cacauuuucccaccuccuuucugcucagucuuuucuuuuucccuucacuggguagucuuccaaguucacagaaaugaaaaucuuccuaaaacaggaaggcaaauaaaugagaaucccccuucugacccaaaucacuagcaaucacccauguauuuagauucacaugagcuccugacucuggaaccuggagcuaauuccccuaaaagucaguucauguaaacuucuuguuuaccaaggugacaaugguaauuaccaaggugacaaggggaaaagacuagaauguuuauacgacuguugacgagaucuguuuaaaucuagaagcaucagaaaauaucacaaugggauggugucaaccucuuuugggaguuucuggacccucuucaguaucuuuuucuacuuugggggcucuugaacauuucaaaguugcuuuaaaaaaagugaauucaucuaaugucauucuaccuuaauuucaagaaaacaagcaugguuuaaguuaauagcuagaaggcaaggucaugaauaagcaaagaaagugaggugcgcaaagaaaaaaaauaauaaucaccccagugugugaccuugagcaagucacuuaagccuuaguuuuccuucucuguaaaauagggguaaugauuucuaucccaugaggaugucugauggcuaauuucagugacacaauuugugcaaaacaaagagaacucuacuacaugguaaauguucuauucugcacaacaacaauaauaaucucuucaauugggggaaaaugaucacagccuuauacuuuuugucacuuauaauaucuuugcuucuuuggggccuggagaagaaaaagcagcucaggaugggguagaaggggguguaaaugacuucuugcaacuuauaaaccugcaguuagacccuuccaugccauacuaugcacugaaaugcauuccaggugcacuaaagaacugaauguuuuaaaaaaucaaaccacagaggggaaaagacaugaauauuuaucagaccucugggaaggucugguuaaaucuacaagcaucagaaaagaucacaaaggaagagauggacagaauuggcagcaggaauauucagcacaucuguacauagaaaagacaggaaaaugcaugcagcaaaaaugacaggcaaaggcaucauaucuuuauuagauaaagagcuuuuacuaucuguauguauauauguaugugaagccauaagaaaguuauucagacccuacuagauaaaugaauaaggaauucaaguagauaauucacaaaggaagaauauauuugggggagaaaaugagagaaggcaaucucauuagcaaccaaagaaauaaguuaccacuuuucuaccaucaaauagcacugacuuuuuaaauaauaauguuagcuguuaaagaaggcgaagugaaacaggcauaugcauacaugguaguagaaagguaaauugguuugacccuuuuggaaaaaaaagucauaacaucaaguguuaugaaaaaaaguugucuaguauaugguuuggggaaaacuagagaaaacuaaaacuagaucccuauguuaaaguauguacaaagguggacuccaaggggacuaaacaucuaaacaugaaagguaaaaguaaaaagucaauugcagaaaacgauaggagauauucucccucugacacauaugagcugugucaccuugggcaggacguuucaccuaucugagccucggcuuucucaucuuaaaaugggaauuuuaacaccuaccuuacaagauaaugucuauaaagcgccuggcaccugcuuugacagagagggcuuuccuccugggugcacagcugggucagccuuccuggccucuccuguguugguauggcgaugugagugaguacucuggccacuggagaguggggacaagugauggguguacuuccaggggucacccugcaaggccucccaugcguaauuccauauccucuucuccaucuauugguugauuagagaggauuuaggacuauggaagagggaggaacaacaagauggaaggagccugggucacugaaucccuacuuggaagucugcuuggccaagaaacccugauuagacuaugugauaagauacaaacuucuguugggugaagccacugauuuggagauugucuauuacaacagcuaacaauaccuacccuaaguaacagugcccaguaauuauucugcaauuugaccaacaaauucccguauugggaaucuaaucauugggguucauuaaauguaguuucugaugaagcccuugguggguggcagugggauuucuuaauccagucacuaaucaaaacugcacacugcaacauuuccagagaaguggcuaauagaaaaauagauucuguuaguugauuucagguuucuuucuaaauuguuaauguuggguuuugcacacucugagauugggauugacuagaaugcuuugacuagacuagacaagcacucaagaaauuuucaaaggauaaaccaaaccaaaacaaaaguaggaaaggggaaauauggaaguaaucagguugucuguaucagcugauaauagucugucccugggcacacagccagaaaauuugaacccuggccagcaacucacacacuccaggugaucugccaaaacagagggcugugaugacuggccuaggagcagggagccugcagcucacagggguacugagaugcaaauaacugcucuggccaugcaaaggaauauuuagggcaguauuuacauagugcaaaacuucugaagaaacgaaaugucuguggcagaugcugcugguucucuacccaacagccauuuccccuucuuccuuagaaaacguaucccaauuucauucuggccucaaagguugacucgugauuguucuaagcuagucuuugucuuuccauucccccuugucagucauuggucuaggacugaaugugugaucuacuucuggccaccaagauguuagggaagauuugcuagggccuuuugggagagauaaaagacagagggagauggaaaguggccuuuccucccacaacccccuuuccuuuucacuuuggacuuuguggaugaagaugugauuccuggagcugcugcaaccaucuugucaccaugaggguaaggccaaagagacucauagagacaccaauccaaacuuacuaagccucugagccaaccugggaguuuguuauaugaaauaauuaugccuguacuauuugcuuuuuuucagggguuuugcuguagguuuauccaguagugcugucaggguuaaguugauagaagaaucuuugaugaaacuugacugauuuuccuggaguuaccuagacaugguuccugacucucaccuggagaugucuaaaggcaaaagccugguuaguuugccugugaggacuaaugaaagagugggugcugcugugggaguaacuugcccauccagaguuucguggggcaaagaaacguugacuuuucccaugggcuaagugaacgccaugagacuagcuaggcuagagccuucuggaaaggaccucuccuaaaagaaaggccuuccagggcaaaaggaccccagcaggaggucucuguggggugcauaucacaaaagcguaggagcuggggacauuguauguugccagccagggacugucucuuaagagaaaaaaugggaguuucaagguccccaucaggaggucccugaagaagcuauaaaagagagaugcagcauuugcucaauggcugaccagaguauggagaaccaauccucuauugcccaacaccaaaguaggcuggaacaugugcuuagcggacuucagacauuacagggcauucggccuguggggcucuuuacugcuucucccguugcaacccagcgcuga

SEQ ID NO: 16528 - RNA, 1063 nt, Homo sapiens
gauagccuuuccgcgcuaccuacagagggguccauacagcgucguucuggauucccgucguaacuuaaagggaaacuuucacaaugucuggagcgcuugauguccugcaaaugaaggaggaggauguccuuaaguuccuuguagcaggaacccacuuagguggcaccaaucuugacuuccagauggaacaguacaucuauaaaaggaaaagugauggcaucuauaucauaaaucugaagaggaccugggagaagcuucugcuggcagcucgugcuauuauugcuauugaaaacccugcugaugucaguguuauauccuccaggaauacuggccagagggcugugcugaaguuugcugcugccacugaagccacuccaauugcuggucacuucacuccuggaaccuucacuaaccagauccaggcagacuucugggagccaaggcuucuugugguuacugaccccagggcugaccaccagccucucacggaggcaucuuauguuaaccuaccuaccauugcucuguguaacacagauucuccucugcgcuauguggacauugccauuccaugcaacaaccagggagcucgcucaguggguuugaugugguggacgcuggcucgggaaguucugcgcaugcguggcaccauuucucgugaacaccuaugggaggucaugccugaucucuacuucuacagagauccugaagagauugaaaaagaagagcaggcugcuacugaaaaggcagugaccaaggaggaauuucagggugaauggacugcuccagcuccugaguucacugcuacuaagccugagguugcagacuggucugaagguguacaggugcccucugugccuauucaguaguucccuacugaagacaggagugcucagccugccauggaagacuggucugcagcucccacugcucaggccacugaauggguaggagcaaccacugacuggucuuaagcuguucuugcauaggcucuuaagcaacacggaaaaaugauuggcggaaaauaaacaucaguuucuuaaaaaaaaaaaaaaaagaaaagaaa

SEQ ID NO: 16529 - RNA, 2901 nt, Homo sapiens
agugaaauagcuaacuuuuuuauuaaauaaaaagacuuaaauaaaaggaacggaaaagaagaagaguggacccagccuaaacgcagggugccccgggccccuggcacuucccccagcggccgggucggcugcccuuccuccagcggcccccgcgggggaagcagguggccgguuucuaaagaaaaaagccaaaacuuuuuuauuauuuacacguuugggcaaaaguacaaaguauaauacaggcgcccggcccggggggugcgggcggggggcggagaaacguaaggcgcuuucuugucaggcccgggccuggggcgggacggggcgcggggcgggggcucggauugugcggccgcgcggagcucgggcccuacccccuuccgcggcccgccagucuguggccgcgcccuggggccuacucgggcuaggcggccccuuccccucucggcgccgguucccccgcagcccgccugggggguccggggcgcccggcugggugggggcggcgauccguggcgacggugcgcgcuggugggcucacaccagggaggugacagcgggaaccuuggaacuauccuccucccagggcugcagauucugcagagcaaagagugacgaguugugcagacagagcgggucaggcuggauggagucguugaggcucuuuuggaaggcgucguguugcagcugcagcaugagccggcucgccugcugccgcuccgccucccgcuccuccgccgucugccgccugcaccgggggagggagagggacaguaccgucaugcacccggcaccgcggggccgccggcggggccccggcccucccgggagccgaggccauccgggagccucgaggcgcagaacccgucugccucccagcccgcgcuuuacgcccgaggcucuuauauccagggagccgguuaggaucauuuguuuuuguugugugccagagggucuccaggaggggacucugcccgccgcccaccugcacgcccggguauuguggcuucaccaacaauaaagauuguuccuuucgccagauagcaagggcagggccuauguguaacugacuuggcccugcgggaaccggggucgcugggguccgcgggugagcaggcuggcucugcaccacccgcacgacgcccgggggcugggucagucucauccaguucgcccagggccugucuugaaccccuuuccagacgcgaucgcuucgccguuuacggguugaaucaaaacagagaucggauaaaaacgcggcuggaauggagacgcggagauggggggagaggaaaccggcguccacgaggauuguugaaaauccgagagggcgggcuggaagaaggaggagaaggagagugcgagaggcccgugugugugcgcgugugugugugugugugugugccuguguguuuggggcgggggugggugagaggaaaucaagugaacgcaggagaccguacaaaacacggggagagaguuggaggggcucacgaaagauggggauggggauggaggagaaaccaaggcgugggagaccacgauggagagagaagcacaggccagcgagaagggugaaaggaagagguacaaucugcgaaggcgggguggggguguguuugggggaggcagaggggggcggggguaguggauagccuuaaaauagggcuagugcgaggcugcggcucggggcgggacaggugaagggcagguguaaggugggccgggucaggccucucucaccgccacuugguccuccgguuuuggaaccaggucuugaccugcgcguccgucauuuugagggacuuggcgagcgccgcccucucggcagaggccagguacuucuggcgauggaagcgcuuuuccagcucgcagaucugcacccgggaaaaggacgugcgcggcuucuuacgcuugggcggcguccgguucugguagggguggccgaugcgccgggucacggugaagggcgugagugcggccgccgcugcggagacacaggagggccccugaagcccagcccggcuccgccaccguucaggccccaugcggaccccguggcgccccgugggacacggagagcuccgcuauuucgcuggucgcgcgcguuuccagagacaccaagccggucgggagacccccucgcccccugucccuucccccgggcacgggcuuauuuuccugcaacucuccgauuacccuccccaccacggcugcccggggcccuggggccgaggccuccgccgcgcuugggccucugaaaugguuuccgggaguggagcgcacagggcgcggcgccucuggccccgagagggcggaggccuggagccuggucgccagcucugcucaccugugaagcggucuuucacgaagcggcggcugcucuccauccaggggaaauugagaccgccaaggcuggagaccgugggcacggagggcauggcggguagcgcgcuuggcagaggcgguggcacggccccgggcagcggccugugcgccggcacccggaucacgccugcgggcgcuaggcucagguucacacuguaagaucccgcguccucgaagggcgcgccgaggcccgcaaaggaggcgggcagagacggguauguggcgcccggacggcccccggggggcccucccagguagcuggcgccgucggggccccgcggggcgggugcgcuguccugguccgggcuguuaaggaucuggucgaugccgaagcugaugggcucgugcgggugcggggucugcgcgcuggcgggcgccuccauccugggcgggcggaagggcugggcugggcugggcggggaggcggcuggguccccguuacggcgcggccauggagcgcccggcgccucucgucgcacugaaacuuugccaagagugcgcgggcccgacagg

SEQ ID NO: 16530 - RNA, 442175 nt, Homo sapiens
uguuuuccuaaccacugugcucuccugccucaucucauguuauuguucagaaaauuauuugaauuacagacuuacugucauccugaucuuagaaauaacaaaucaaaacucagagauguuagaugaauuuccuaagguaugagaauuacaaaugucaauugaaucuccugaaaaguacaaagaucaaagauccaucugucuuuuuuagaaggcuaguuuccauaaaggaagauaauuuuauaauuccuauggguucuaaauguccuuccuuuaauugaguuuugugauagaaaugaauuauuugacguccuggagcaucuucugugcuaauuuuaauaguuguagggacauaauucuaucuuaaauuuuauuaacugacauaaaagagauggaguuguaugcauauuuuguugauagacacucacguaagaaaguguugauugaaaacagaaaucuuaagcagccacucaaauuuuaaaaggaaaaaaaggccgggcgcgguggcucacgccuguaaucccagcacuuugggaggccgaggcgggcggaucacgaggucaggagaucgagaccaucccggcuaaaacggugaaaccccgucucuacuaaaaauacaaaaaauuagccgggcguaguggcgggcgccuguagucccagcuacuugggaggcugaggcaggagaauggcgugaacccgggaggcggagcuugcagugggccgagaucccgccacugcacuccagccugggcgacagagcgagacuccgucucaaaaaaaaaaaaaaaaaaaaaaaaaggaaaaaaaguugucuucuuguuuccagaauugccuggugaauccacagaguacuuggcauccucuguuguuuucacagcccuacauuucuggugacaauauucuggagugggaaaaaaauuaaaugauucaaaacucaaauaauuguuucucccucaaggaccuaaaauuugaggugauaaaaaugccauuuuaaaacaauagcuuuaaaaggugguuggguuuuagaaguuaggcaaaagcagcaggcaguuaaaauaacgggguauugugcagcagacaucuuacagaggucagaaaucaggaugcguguuugggaugugggcaucagauauguuggguugugggaaucacaguugagauuggauaucaaaaguauugagacauggaaauggaaguuacgacuaugggaaucaggaacuuugggacacaggagugaaaaugggacacagggggaggguauuaacgauuuuaagguuuaaaggaguucaguuguggaaaugcagauuuauggacaguggaugagcuaugaaaaccaagggugaagcauggaagaugcaaacaggcuuauaauaauaaaguaucuuauguuggauuagaccucccacugaaaacuauuauaaagauaggacacguguguguaugacaauucuaucacauauauuaaauauauauaaaacuaugaguaaauaugaauuaucagcaaucaugcaugcacacacccacacacacacgacagauaaguaucuuuaacaacuaaaggcaauagaaaaggcagaacuuaaguggccacaaaucuugaaagaaggaaagcacaagggguaagauuccaauuuaccuuagauuccccaucugcuccucccugucaucaccccaaggcauuuuccaaguggcagcaaggaauaacagcuaaauagaaagcagcagucucaauaggcuaggagcaaaggcuggaguuucggaacaagagcaacugagauuugaaggacaaaauucuagaaagaaagaaacuauagagaugugaguccccaaauuuguguccguuccuaagauauacaugcacaugaagagacucuaagaaauccagcagaacaacagcaccuaaagagcucaacaaagauuucagcagcuacacagggcugaagagacagagacuagaguucaagccccacaagguggaaggaucuugguaaacauuccaggcuuuuguuuuuuugagacagauucuugcucuguugccuggccuggagugcaguggugcaaucacggcccacugcagccuauagcuucugggcccaaggggucuucccaccucagccucccgaguagcuggaacuacaggcacaugcuacuacaccaagcuaauuuuuuguauuucuuguagagaugggcuuucaccauguugcccaggcuggucucaaacuccuggauucaagcgauccacccucucuggcuuuccaacgugcugggauuauagucaugagccaucaugcccagccacauucuaggcuuuuaguuguaagaccuaguaaggaccauggccuaggaguaaggucauaacugaaguuaaccagaauuaaaaagacucaaugauccacuaguacucuugucugccuaccacaagaaaacuuagcccuccuuggagaaaccuguuaucauccagagccucuacaaauuuucuucuacaugguuugaauucaacaagaaaucaugagauauguaaaaaaaaaaaaaaaaaaaaaaaaaaaaaaaagaaagaaaaaaaagggccaagggccaagcaccaaaaacccaggaagacucagaugauucagaaauuggaguuaacagauaagggcuuuaaauaauacaguuaaaauguuuaagaaaauaaagacaaagaauuucaucaaagccuuggaaucuauuuuuaaaaugggagaggaggaggaaccaugaaaauuucaacuuucuaaaugaaaauucuagaacugaaaauauuauaacuaaaacuaagaauucaauagaggggauguauagcagcucagacacagcagaacagaguuucuauggaauggacagcaggcaaauaaaaaauacagaauagaaauaaggaauauagcaaaaacuuauaacauacauguaacuggaguuccagaauggagagguagagagagagaaggggacagaugcaauauuuaaagaacuagugaccaagauuuuucaaaacuugauaaaaaagauuacauucacacuuaaagagcuuuaugaaucccaagcaggauaaauacaacacacacacacacacacacuuagcgacaucaagcacaaagugcugaagacaaaaagaaaaaauaaaaaaagagaaaaauguucaaguaccugaggagggggccaaaagacaggagcaacaauuagacugauggcugauuucucaauagaaacaaugacaagcagaagacaaugagaagacauuuuuaaaaugcugaaagauuaaaaaaaaagccaaugugaaauucuauacccagcaaaacuauccuuuaaaaaaugaaggugaauuaagaugauuuuauguuaacaaaagcugagagacuuuguuguuagcagaccugaauacaagaagugcuuaagggaguuucccucuuaaauacuacagcacagugcucccaaauggaaaugcugaacuugaagaaaaaacggagaacaucagaaagcagcaacuuugacccaauucugcuccaauaaauucucauugcaguggaaucauuuguuguaaaauauaaguucauauuaaacaaaaugcagacaaagaaugagguaaagcuugaauuuuacaacuuaacagcauguagacaugggcgguuuaauuuuaaccaaaaucaaguuaaaaacauuguuaagcaacaauggaauuugggcccugggagucaggggucaagggcaacagcuggcaugugggagucaaagguuauggcugugugugucugugguuccuggcuguuaggagacaagaaaaucuguggagaugcaggugucgggagccaugggcgauaguuguauuuugagggucaggggucaagagagccuuuggaagacuuaugagucaggguccacggcugacgggugggucgugguaguugugucaaagggcagagguuggaggucaugacccaccaacacacgccgguugaaacuugagcgcaagggacgguugagauucccggaggacacgccccuaucggccccgccccgugcaccgccuccgucgccccgccccgucccucccagccccgccccgucccucccagccccgccccuccagcgcuucgaaugcggacgcgaagccuggcugaggcugcgaaggacgagcggcgcagggaccccgcgggcgucuggggcuuccgcggcgcccgccucugcucccuccccucgggcgcugggugccgaccggccggcuggccggcgccgccuccugggaagauggcgcugcacuuccaggucagugugcucugcgccgcgggcccgcgcuccgccacgcugggaacccggcgggacgcgucuggagaccgagggccgaggacagcggcggaggccgcagggccgugggccgguguccccggagucccagccccugccucugccccuagccggggaccgggacacuggucugggcugcacaccccaggcccgggccggagcccgagaaaggggcggccgagccuggguuggaggcggcggguggagggggcgggggacaggcccagggcucgucccggggaaggugcggacgccggcagcacgcucgcugaccgcggcuuuaguguugccagggcaggugggagucccagcugggccggcuuuggcgcgccucgcgcggcugccgagcgguggagcagccuucccgccuucccgccgcgucgccggcgcggcucuaucgucagccucccuccacacaguugagccccagccggagcgggggcuugggauccaccgaaggagcggcggcagcgguuggacuuuaauuggccagaggagacaggggcugcgucuggggggaguugcgagggagggcuacgcggccgccucuucggaggaggaaacccgggccgggcgcgggcgcgggcgcggacgcgaggaucgcagaggcuacgaagaugggacgcgugcuuguauauccucgggcugcucugacauccccguucaguuauucagcaaacauuuauuaucuccccacugugucucaagcauuguggaaaguucuggggauaaaggaugacaucuuacuauccucgcccucauacaguuaacagagaauuacaguacaagugaaaaauguaugguagaaauagucacaguaucauagcacagaaaaggggguagccagccaaauguguauguugagaaggagugaagcagagcugcuaugcucuuagcugagagaugcuuuaagauucuuugagccuccauucuuccauuuauuaauuauugagcgccuacuaugcuaggcgcugaagauacaacagcucugaacaaaacuaugguuucuacucucagggaacuugcagucuacugguccuugaaagagucguaguuguuugccaggugaagaggaagggaaggauauggagguagaaggacgugugagccaaggcaaagaauuguggaagaacaugguguacugcagaaaguugagucugguugggacaaagggaugggaucaggggaggcaguggguggcaggagaugaccccagggagggaagggaauuucauaauauggugacaguguaucuaagaaucucauuccccuuguagacucuuuugaacccccugugaucacacugauuuauaacuuggcugauuuauugauucuucuaaagggucuuuuuuuuaaaaccaguuacugucugauaaucgacaguucuagaauguuauguaguaagcccgacacauuaccuuuugacuucaugccauuucuaaggguccucaggucaaaauaauguauuaccacuuuaguaaauaugcccucugggaaauuuucacaggaagaaucuuacaaggaggauuuauggauuguaaauagguaaucagauguucacagagcccgaguaaaucuugagaguaaauuaaaagguaugguggaacuuuggaauuuuuucauacauggaaaggugauguacaguuaaaucaccaagcccuggaagacuucuucauauuuaggcacaguguuggaaaaguuagcugcugaugucaaaacuacccauauugguuuugcaggaauguacuucacaguacauuccaacauaaguacuucacaguacauuccuguagacagcuuaaaagcggaguuggacaaauaaaagaucagacaguuuuguugacuagaaaaaaacugaaauuucuccguuugaauucuuuuuagcauauaggaucauauuguuaaucaguuaacucaaggaacauuuguuaauagugauaaccaguaccuagcauuuugaguuuucauauccucauuauagaggugagcccugccacuaacuuaaaaagugugcauauauacguuucauucugaagacacugagucuuaaaacaguugugacuugcccaacguuacagaguuagaguaggccucauaacucauaaguuccguguuccccauuaccucugucuuacugucaccuacccaaaagggcagcuaggcaaaaauuauaccaucaagaugaugaguaaagaagcagauuuguguagggugagguuaggguaguggucaacaucuuuuucacaucaugacauacauaaaaaauguuaauugugugucucauuaacauaaaccgcucauugccaaaggccaucagugugcacuuuccccaaugucucaagcucugcuccuaaugcuuggagggcagagggaucaauaucucaggcauaccugugaaucauucaaagcaguugcauucugguuaggaagcugugaauuacgauacccugucccaaaggaauuaaugggucuggauucccugacaggcaauccagauaagggggcagagugaggaaaaagaauugagaagaaguaagagguaggcacuuuagguagaacagagguaccuugguaagaaucgagagaauguuaggaaaaauuuaagggacucaguugauccaacuuuuuugcucaggacuguuuaagaagcaggaaauauagccaugcuucuuaaucuccagucaagcuaccugauuugaucuagaugugauugagaacuauuauuuuuaaaugcaauuauaacaugagaaaagguaugugggaaugaccauucuggcaguguggacuugaaugggagaaacuauggaagauccguauggucuuuuauauucaccaguaacuggagagauuauuuaugauuuauuguggaucuucuguauggcaggcacuggauuaggcuuuccccaucuuuucuaucuucauucuacaauuaguuuggaagguagauauugcuguuugcagguuuguuguuguuguuguugucguuuguuuuuugagacagaaucuugcucgcccaggcuggagugcagugguggaaucucggcuaacugcagccucugccucccggguuccagugauucucuugccucagccuccuggguagcugggauuacaguugcaagccaccaugcccugcuaauuuuuguauuuuuaguagagacaggguuucuccauguuggccaggcugaccucgaauuccugaccucaggugauccgcccacuucggccucccaaagugcuaggauuacaggagugagccaccgcgcccggcccuguuugcaguuuuaacagcaaggcuuagaaagguuaaauuauuugcccgaggucacuuaauaagugaguggcagauuccaaagguuguguccacucuguuggaccagugguuuucaaaucgaaccaugacauuucuaagaccccacuacucucuacucgcauucccagagcagcuugagaaaucccuggcccuggcagccacaguuagaaaauauugcuugaucuacugucugugaauaucagggggagguguugaguugagucuuuauagaagaauaauugggaggacuuuaugacaaauuagguaugucccuggaauuagccauacugagauuagagggcagaguccacaagacugcccuuucuucucagaccaagugcaaguuuggggguuucccaaaaccacccucagguucaguaguugacucacagaauucaccgaaaguugucauacucaguugcaguuuguuacagggacaggauacagauuaaaauuggucaaaggaaggugacacagggcaacaucugugcagguuucaaaacuaagcuucuguuggccucaggacauguugugcucccugcaucaauauauggcaauaugcacuaauuauugcaaacugggugagcucaccuagacuucauuauacaggguuuuuacuggggcuucaguucuuagguaugauugauugauuguccacguguuugaaaucaguccuagguugacuauuaccuugugacccaaaguccugauccuaaacauguaauugguguuucugguguggccagcccccagccuaccacuauuggguauggccagccccuccccuaaauaaaaacauuccuaucagguaugauauacauuaccuuucagaagcaaaggccagaugucucuuauggcaagaccaaaucuguuacuauacaggagguacaaaggagacuaaggagagggggaagcaaaagauaacauugagcuuguaaaucuacacucuggucuagaaaucugaaacuacugagaagaagggacacuuaggccgggcaugguggcucacgccuguaaucccagcacuuuugggaggcugaggcaggugggucacgaggucacgaaaucgagaccauccuggcuaacacagugaaaccccaugucuacuaaaaauacacaaaauuagcugggcgugguggcgggugccuguauucccagcuaauugggaagcugaggcagaagaauggcguuaacccgggaggcggagcuugcagugagccgagaucgcaccacugcacucuugccugggcaacagagcgagacuccaucucaacaaaaaaaaaaaagaagggacacuuaaaguggaaagcauguucaauucuguuugucacauuuuugggugauuuuuuuauaucuuucuagauuuccaagagaaagaaauuuguacacaaauguaaagauggugaacagacagggcugaaaguauggacugccaggcaugguggugugugccuguagucccagcuacuuaggaggcugagguagggggaucacuugagcuuagggguucugggcuguauuguagugugcuccaccgaucaagugucuccacuaaguucaucaguaauauugaccucccaucaauaugggaaugggggaccaccagguugcuuaaggaacgaugaacuggcccaggucagagacagagcuggucaaaacucuagugcugaucuguagugggaccaugcccuugcauagcuauugcacaccagccugggcaacauggcaagacccugucucuugaaguauagacuaggacaucaucuccaggucgaugaugauggaaauaaagaguggcaauuugggcagguugggggagacaacauguauuuggggucuguagacuuguauuugacucagaauuugauuauuuaucauuaaucuugaggaauuuauguauauuugaucucagcuuuaguuuuuuaaaucuguagaauaaauauacugaaaauacauacuucacaagagccuauuuuucaggauugguuugaaaaaaagguggaaauacuuuuguaaacuauaaagcacuaaaauaaauauuaucuauuuuauuuuaagaaggaagaauuccaagagauccagauaaaagccuucagggauacucaggaaaagguaguaagaggaagaaaaaaagaguuugugggaaaugaguaacuucaaaaugaaggcaguuucuguuuauuguaaucaagaagcuuaauuccagaaggcaggaaagauacaggaaaguaauugaaaagaucuuuaaauucaauugaagaggauuuuuguggcuuauuaauguuuuacuauuagggaacauuuauuuccugaaacaaaaacauuuauucucuuuuuucagcuuuacugaaguacaauugauaauaaaauguguguaaacugugcaauuggauggguuuugccauauguauacaucugugaaauugucaccaaaaucaagaaaaugaacauauccauccccccaaaaguuuccuugugcucuugugccccuuuguaaucucuguuuuucccccacuccucugcugucuucccucccagccaggaaaucacugauuugcuuucuguuaagaaccauacaauauacacucuccagcauucaccuguugauaguugcaugcaugacuaucaacacguguggcuuuuacucagcauucaccuguugauaguuacaugugugacuuuuuacuugcuauauaaaaauaacucaucauuuaggggccaauucugugucagguacaaaggccagaaauaaguccagaauaauuuggaagauccuuauuuagacuauggucaaguuuacaucauugucuccuaggguaugaaaguuggaugcugucuguuuuugugugugugugugguuuuuuagacagggucuugcucugucacccaggcuggagugcaguggugggaucuuggcuagcugcaaccucugccuccugggcuuaagaaauccucccaccucagccucccaaguagcugggacuacaggcaugugcuaccacaccuggcugauuuuguuguuguuguuguuguuguuguuguauuuuuugaagagauggcauuuugccacauuggccaggcuggucucaaacuccugagcucaaacaguucacccaccuuggccccucaaagugcugagauuacaggugugagccgccaugccuggccugucuguuuguauuugauaguuacucugugggaggugaaugauguccacuucucuuuguuuuaccucuuaguuauuuauaugggcuucuaauguuaucauuaagacuuguagaagcuuuaagaacucaaaccugauuugucaacaaauugagaagggauccauuuuucugagaccauucucauauuaaucauauucucagauaucaaugcauaaaacuaagaugaaaauuuaucaguuuacuauaaaaaauaaaguuuccuuagaaaaugaagugcuaaacagaagauugcuugauugguuaguaaccaccauauugugggcuuaauugcuuuauacgucuagauaauaccuuucuaccaggggaagggucuuuguguguguaucccuuucucuaaaaagguuuuuaguauaccagguauaaguuuguuaccuuuacagugaaagaauaacuugauuuucccuuugagucuuuuguaaaagaaaauucaaaccuuucccuuuuuaucuuggauggccuuuuucauuuguuaauaauuugaaauaucuuuggaaaaaaagagugauugguaacauuguugauuuaaauacuauguaaauauaccccaggucuguucugucuugagguucuuuauaucaguaaaacaaaacagacaaauaauuuccagacuuuuccauaaucuuuccaaauagguuuauuuaggugccauuaaauugauuacuauucauauuacuuuucuagggcucacaacacuuuuuuuuuuuuuuuuuugaguugggagucucgcuauguuucccaggcuggccuugaacuccugggcucaagccuacugccucagccuacugaguagcugggauuacaggcaugugccaccgugccuuaauaccaauauauuuucauagaucugguggccagaaaucugaaacauacacugguuuggucccuucuggaggcccugaaggagaaaccauuucaugccuuucgcccagcugcuucugauggcugcuggcaaucuucguuguuucuuggcuugcagaaacaucacucuagucucugccuacaucuucauauggucuucccugcuaugucucugcaucucaaaucucccuccuuucucuuauaggaauaccagucaguggauuuagggcgcacuguaaauccagcaugaucucauaccaagauucuuaauuaaggauuugugaagacccuauuuccaaauaaggucacauuuauagguacuggaguugggagauggacauauauuuuaaggggauauaauuaaaaucauuacaauauuauuagguaauguuaaaaacaacuguguaccagaaguuacaugacacuaacucuuaauccuccaaaccuaugagauuggcacuguuacuagucucauuuuugcugccuuuuguuaaacaggucuauuacuauuucuuggccuaauucuuuuugcagucaaagucuacuucaaagaaucuuaggccuagaugaaugcaugccagcaggaucaguuuauuaauuauaccgaguauuaucaguucuaaaauucaguccuccaaauuuauuagaugaaggaaaagacuucuuagguugaucaugagagggaaaaagggaccccuuuuuauuuucauauauaaauacauauuuaauuuuacuuuaaguucugagauacacgugcagaacgugcagguuuguuacauagguauacaugugccguggugguuugccgcaccuguugacccgucaccuagguauuaagcucugcaggcauuagcuauuuguccucaugcucucucucccuccccucacccccacaacaggcccccuguauguguuguuccccucccuguguccaugugucuucauuguuuggcuuccacuuaugggugagaacauuugguguuugguuuucuguuccugcauuagcuugcugaggauaauggcuuccagcuucauccaugucccagcaaaggacaugaucucauuccuuuuuaauggcugcauaguauuccauggcuuauauguaccacauuuucuuuauccagucuaccaucaaugggcauuuggguuguuuucaugucuuugcuauugugaauagugcugcaguaaacauacaugugcauguaucuuuauaauagaaugauuuauauuccuuugaguauauacccaguaaugagauugcuuugucaaaugauauuucugguucuagguccuugaggaaucaccacacugucuuccacaaugguugaacuaauuuacauucccaccaacaguauaaaagcauuucuauuucuccacagcuuggccagcaucuguugauucuugacuuuuuaauaaucaccauucugacuggugugaaaugguaucugguugugguuuugauuugcauuuuucuaaugaucagugaugcugaacuuuuuuucauguguuucuuggccacauaaaugucuucuuuugagaagugucuguucauguccuuugcccacuuuuuuuucuuaugagauggagucuugcacuguugucuagacuggagugcaauggcacaaucuuggcucauugcaaccucugccucccugguucaagcgauucuccugccucagccuccugaguagcugggauuacaggcgccugccaccaugcccagcuaauuuuuguauuuuuaguagagacaggguuucacuauguuggccaggauggucucgaacuccugaccucaugauccgccugccucugccucccaaaguucugggauuacaggugugagccaccacaccuggccacuacauuugcccacuuuuugaugggguuguuuuuuucuuuaaauuuguuuaagguucuauguaaauucuggauauuagaccuuugucacauggguugauugcaaaaauguucucccauucuguagauugccuguucccucugaugauaguuuauuuugcuauguagaagcucuuuaauuagaucccauuugucaauuuuggcuuuuguugcaacugcuuuuggcaauuucgccauaaaaucuuugcccaugccuauguucugaaugauauugucuagauuuucuucuagagcuuuuauggcuuuggguuuugauuaagucuuuaauccaucuugaguuaauuuuuguauaaaauguaagaaaggggcccaguuacaguuuucugcauauagcuaaccaguuuucccagcaccaucuauuaaauagggaauucucuccccauugcuuguuuuugucagguuugucgaagaucagaugguuguagauguguggucuuauuucugaggucucuauucuguucuauuggucuauguguuuguuuugguaccaguaccauacuguuuuaguuacuguagccuugcaguauagucugaagucagguagugugaugccuccagcuuuguucuuuuugcuuaggauugucuuggcuaugugggcucuuuuuugguuccauaugaauuuuaagguaguuuuuucuaauucugugaagaaugucaaugguaguuugaugggaauagcauugaaucuauaaauuacuuugggcaguauauccauuuuaacaauauugauucuccuuauccaugaggauggaauguuuuuccauuuuuuuguguccucucauuuccucgagcagugguuuauacuucuucuugaagaagucccucacaucccuugcuguauuccucaguauuuuauuuucuuuguagcaauugugaaugggaguucauucaugauuuggcugucugcuugucuauuguugguguauaggaaugcuugugauuuugcccguugauuuuguauugugagacuuggcugaaauugcuuaucagcuuaaggaguuuuugggcugagaugauggaguuuucuagauuguaggaucauguugucugcagagaugauuugacuucgucucuuccuauuugaauacccuuuauuucuuucuuuugccagauugcccuggccagaacuucccauacuguguugaauaagaguggugagagaggguauccuugucuugugccaguuuucaaagggaaugcuucuagcuuuugccuauucaguaugacauuggcuguggguuugucauaaauagcucuuauuauuuuaagauauauuccaucaauaccuaguuuauuaagaauuuuuaacaugcaggguuguugaauuuucuugaaggcauuuucugcaucauucuauuuuucugcaucauucuauugagauaaucaugugauuuuugucauuggcucuguuuaugugauggauuauguuuacugauuugcauauguugaaccagcuuugcaucccagggaugaagucgacuugauuguaguagauaagcuuuuuuuuucuuuuuuucuuuuuuuaagacggagucuuacucugucacccagacuggagugcaguggugcaaucuuggcucgcugcaaccuccaccuccaggguucaugagauucuucugccuuagcuucccaaguagcugagacuacaggcacgugaaaccgugcccggcugauuuuuguauuuuaguagagaugggguuuugccacguuggccagacuggucuugaacuauugaccucaggugauccacccaccuuggccucucuaagggcugggauuacaggcgugagccauggcacugggcuuggauaagcuuuuugaugugcugcuggauuugguuugccaguauuuuauugaggauuuucacaucgauguucaucagggauacuggccugcaguuuucuuuucuuguugugucuuugccaacuuuugguaucagguugaugcuggccucauaaaaugaguuagggaggagucccuccuuuucaguuguuuggaauaguuucagaaagaaugguaucagcuccucuuuguaccucugguagaauucgacugugaaucugucugaucuuggacuuuuuugguugguaggcuauuuuuuuacugcuuuaauuuuagaacuauuggucuaaucaaggauucuacuucuuccugguuuaguguugugaggguguauauguccaggaauuuuuccauuucuucuagauuuucuaguuuauuugcauaaaaguguuuauaguauucucugaugguaguuuguauuucuguggggucaguagugauaauccuuuaucauuuuuauugugucuauuugauucuucucucuuuucuccuuuauuagucuagcuagcagucuaucuauuuuauuaaguucuuauaaaaaccagcuccuggauuuauugacuuuuuuugaaggauuuuucgugucucuaucuccuucaguucuguucugaucuuaguuauuucuugucuugugcuagcuuuuggauuucuuugcucuugcuucucuaguacauuuaguugugauguuaggguguugauuugagaucuuucuaacuuucugaagugggcauuuagugcuauaaauuucccucuuaaugcugcuauagguacaucucagagauucugguauguuggcucuuuguucucauugguuucauagaauuucuugauuucugcguuaauuucauuauuuacccaggagucauucgggagcaagguuaauuucuguguaguugugugguuuugagugaguuucuuaaucuugaguucuacuuugcacuguggucagugagacuguuaugauuucaguucuuuuguauuugcugaggagugcuuuacuuccaguuaugugucugauuuuagaguaaguaccauguggcacuagaagaauguauauucuguuuugggguggagaguucuguagauaucuaucagguccccuugauccagagcugaauucaaguccugaauaucuuuguuaauuuucugucuuguugaucuaccuaauuuugacagugggguguuaaauuuucccacuauuauugugugggagucuaagucccuuuguaggucucucggaacucauuuuaugaaucuggaugcuccugcaucgguugcauauauauuuaggauagcucauuauguugaauuguucccuuuaucauuauguaaugcccuucuuugucuuuuuugaucuuuguugguuuaaagucuguuuugucagaaacuaggauuuuaaccccugcuuuuuuuuuugcuuuccauuugcuugguaaauuuuccuacaucccuuuauuuugagccuauguaugucuuugcaugugagaugggucucuugaauacaguacacugaugggacuugacucuuuguccaguuugccagucugugucuuuuuauuggggcauuuagcccauuuacauuuaaaguuaauauuguuaugugugaauuugauccugucaucaugaugcuagcugguuauuuugcccguuaguugaugcagcuucuucaugguguccuuggucuuuguauuuugguguguuuuugcaguggcugguaccaguuuuuccuuuccauauuuagugcuuccuucaggagcucuuggaaggcaggccugguggugacaaauucccucagcauuugcuugucugaaauggauuuuauuucuccuucucuuacgaagcuuaguuuggccagauaugacauucuggguugaaaauucuugacuuuaagaauguugaauauuggcccccacucucuucuggcuuguaggguuucugcagagagaucuguuguuagucugaugggcuucccuuuguaggugaccuggccuuucccuccugcugcucuuuauguuuuuuccuucauuuugacauuggaggaucuaaugauuaugugucuugggguugaucgucuuacugagguucucuguauuuccugaauuugaauguuggccugucuugcuagguuggggaaguuuuccuggaugauauccugaaguguguuuuccaacuugguuccacucucuuugucucuuucagguacuucaaucagucauagguuuggucuuuuuacguagucccauaguucucagagguuuguucauuucuucucauucuuuuuucucuccugccuuauuucagcaagguagucuucaagcucugauacuuuuucuucugcuggauugauuuggcuauugauacuuguguaugcuucacaaaguucucgugcuguguuuuucagcuccaucggguuauuuauguuccucucucaacugguuauucuaguuagcgcuccuguagccuuuuauuaugguucugagcuucugaagccuacuucugucaguuuguccaucucauccucuguccaauucucugcccuuccuggagagguguugcuaucauuuggagaagaagcacucuggccuuuuggguuuucagcauucuuucauugauucuuucucaucuucaugaguuugucuaguuucgaucuuugaggcugcucacccuuggaugagguuuuuguggggacucuuuuuguugaugcugcuguuguugcuuucuguuuguuuuucuuucaauagucaggucccucuucuguggggcugcugugguuugcugagaguucacuucaggccuuguuagucugggucacuccugcaccuggagaugucaccugaggaggcuggagaacggcagagacaggugccuguuccuuucucugggaucucuguccucgaggggcaccaaccgcuucacuuggcugggaguaggggcuccccugcccuguguggcucucaggugggccaauguaccaccuugcucuucccuccucccuguggguuaccccaacugccuagucaguccuggugacagaaccuggauaccuugguuaucagugugggauuugcauguuguuuugguucuucucagugggagccuccgaucgccacugcuucuaguuggccaucuugacccccuauuuuuguauuucuuaccuggauaaaacaauauaauuuuuacguauucaugaacuauaaagauuguaugcauuuuccuguugugaacaguauguaguaguaaucuggguuuguuugggcuaaucuaggugggggagauguuuaaaauguaguucauuugagguucuuuaucuuaaucagccuauuugaaaucuuauuuuuggacuucuguguuuacucuagcaggaaauuuccaaaucugggaugcugggcucugauguaguuagggaaauggaaaaugcuauaaaagcgcuaagaaggagagaggaagagagaaguaaaaggaauaauggaagcuagaguaggucucauuuugguguuacuuguguauuccuuuaaugagaagguauaugcacaugagggaaugugugggcuaguguagcuauaagguuaccacauaaaauucaggcuagaaaggacaaaaaaauugcauuuuuuuaaaaggaauaucccauuguuuucauaugccuaccugacauugaaaucugugccaauauuuuuucuuucagagacugauucucuaauucaaauuuaaagugagguaauuuguuuucagaagaccucuuuaacaaaaaaauuuuuuggagaggagugcugaacucauuuuuuaauucuuuuuuuagaugguuuccaugugucccagaucgucaugagauuagauuuauaucaucaagauaggaugaugaacagaaugcuuuagucuuuaugcuuguaaaauaggagacuuuaacauaacugguuauuacauugcuagaaauaccaugggaucaagucaaaguuccugaaaauccugcagcacuuugaguuguugguucagaagcccgaaaucaacauauaauaaaaauaauauauauauauuuuugagacagggucuugcucugucacccgcugaaguacaaugauaguaucaaggcucacugcagucucaagcuccagggcucaagcgauucucccacuucagcccucuaauagcugggacuacagguguacccuacuauacccagcuacuuuuguuguauuuguagaggggauuuugccauguugccugugguggucuugaacuccugggcucaagcgauccuuccgccuuggccucugacagugcugggauuauagguauaagucaccaugcccggccuuaaauucuuaaaauuugagaaagaauauaaauuugguuaucugcaacuugugcaugaucauuucccccauccaucucccuaaccucaucugguaucuccuugcuguguuuaucagccgcacugaccuuuaaugcuuugagaugacuaaauuccacucuacugaaggacccugguaaauguucuuucuuugccuggacugccuucuagucuuuuuaaaaucugauucacuguuguaggucucagcauaaauauuauuucuugaggccuaccuuuccaaauccuuguuguagacaaguucucccuuucuuguacuuuuccauugcagaacuaucaauuuguaaguaaauaauuuggggaguaggagaugggccuguuuuguuugcaacuguauccccuaguaaguaguuguauaucgauaaacauguauugaauuaaugaauacacaugugauauuuguaucccuuguuuuuugugguuaaauauuuaccucauuuuuuucauugaaguaaaauguuaauuuuuuuuucuuugaagaguuuggcugaauuggaaguguuauguacucaucucuacauagggacugaucuuacacaaagaauagaggcugagaaagcacucuuggaacuuauugacaguccagaaugucucagcaagugucaacuuuuauuagaacaaggaacaguaaguauuugguaacaaugauuaaccaugaaagaucaguagauguaugucauuguuaaugaacucguguguuagcaaugguaacugauagauauugccacaugguuuuuuuguuuuugugaaacuauaguuucacugucaaagggguuaaucaggaaaagaauuggaaaaccuggaaagcaaacuuagggaagagccaggaaaugaaauaggaaugaauugagauaguuucuugauuacuauuggucucuuuuuaugucucauauuagugggcaaauuuacauuuuuaggaaguugacuaacaacuuaaaaaaaucuagauaggggaggcagauuguaauuaccucagaaacaugaaaggaugauucgaaagcaugcugauuaccucuugccugccucccaucuagauauucauagucuagacauucauauucauuuaguaaaauauuuaaaugucaaaucagaugcuguacugcuuacuugauuuauguacaugaauuaaaguagcaguuuguuuaguuggagagguagauaccuaaauagcuaugaaacgauugcaguaagagacuguguggucuagagcagaguugucaaacuuuuucugugaagggccagauagcaaauauuguagacuuucugggccaggagacaaaauggaagauauuuuguaagaacaucuauagaaagagaaaaaacaaauuucuacaaaguuuuauugaugagauucaaaauauaauaaucuaauacagacuuuuuaauaauacaggucuguuaaugaagagaauagaacuguuuuugggcggauaacauuuuucuauuaauaacuggaguucagaguuguuuucuaucaucaucauugauugcagauguucauauguuaaugcugaucuauaaugagauuuuacauauuuuauauuugaaaguaucuuuucacauagauagguacugcuaaauacuaauaucaguccaugagcauaugauuauaauuaagcacauucaucauuuacaaggcauuuaaaaaauucuguuaaauguugauauuugccuuuuagcaugucauuauaugcagauugaccacuuccaauugaagauuaagugggagcucuuaauugcacaguuaaauggauuuuauaauauggaaauuuccuuuacauuugcaucaagaucugaagcuggagcuguaguugaagcucagaaaauauaucucugaauagagagcucacuacuuguuuuaacuuuugacaaugugggaaguauauaaagcugccugacauuacuugcauuucaaaugauguuaucaaaauggcuuuacugcaguauaaguucugcauauagguucuaagcacuuuuuaggcaauuuuguauuuuugguugaauuuauugaggaacauuaucaauuuugcaacaaaaaguaaguuccaaagccauuucguguugaacaauggugacuugguuguucugaaugagacauucagaaaaauuuuagccuuaucccugagcuaaaaaaauagcaguaaaaacuuaucacugauaagcuauuaaacuauugugugaggagacaaguaaggauauuguuuccaacacagaauauucagauacugcuucucuaucuuacagaaauuaacagagcuaaaguucacaaaagugaaugaaguccacuguuaacacuacugauuuauuaacuuacaauagauucauauauuuaccacacaguaucugcugaugaauaauauggugaauaaccauagacuuuaaacaucuuacauuuuucacaagcuuuguaaauuuguucagcuaagcccuuuuccgcuccauauguuuuaccacuagugugacauaucguagcagauucuacuucaguuuauauugaauuaauguguccucaacuucuuuggaaauauucuguccuguaguucucccacagucuucauagaggccaauucuuuaguugcuucacacucagcauugacuucuagaauaaacagauaguaaguauugguaacauuaaugguaugagcauuauaagaaacaucuguccacucaucaagacuuaaggagaaccuuuccaaaucauuugucuuguuuucaaauugacuuuugauguuguuccagugucuucagcucuuugagaauuugcucccaccagaaacuaguaaucuuauuuucucugcacauauaacuuuggcugcuguaauaaaacaauguugauuuaauuaacucaucaucgguaaauggcugugugauuggcuaacaaaugagccacuuggaaacuuugguugcagucucauuuuuuauauuuguaaagacagucuacuaugaugagauauccaauuuucuauuuuuucugacuuuugauuuccugaguugggaauauugugaugggaauauuggggauauugcuuggucugauauugucagcauguauuguauucuuuuaggacaaccauaguaccauuacauaaaaagcacauuguuuugcuauguaaucaaugaaagaauaguccauacuccauugugccuuaaaaauuagauauuugaaguccauuuuuaucuuuucuuauuucgauaugauagacaugugcugguaauaauaaaagguaugugucaugucaugacaacacccauggcucucuaggcacuguagaguuguagcuaccucacugugguuuaugauacgcugagcagcaguaggaagcacugagcgccacauguggucucuguuuuagcuauucaauucugccaucguggcaugaaagcagccauaggcaguguguaaaugaaugagcauggcuguguuuuaauaaacuuuauggacaccaaaauacagauuucauauauuuuucugucacaaaauauuguuuugauuuuuuugaacagcugaaaagcuguuuaaaauugcaaaaaacauucuuaggucacaacccauguaaaaacaggcaggauuuggucaagggccauaguuugccagccucuggucuagagaaaaaaagagggaguaucuuugcaagaauuucuaggagguggagugaauacaugaaccaaauuuucaagggugagcaugcguuuagacaguuugaguauaguauuaagauaauugggggccagagagaauauagucagacauggguuucaaggaacacggaggucaggguggggaagauuuggaaaggaaccuaaaggcugucauggucagagcaaagucaagaauggaaucagaugaauuugaagagauaaucagaggccagaugauguagggcuguagaccaugguaaaaguacuguauuuuauuugaacuugcuuuauuucuccucuuugcuuauuguuauuugagauggcugucuacaucucccucaacuaaugauuucuuuuaagagauuguaugccuguguauguguauccuuuucuguauguauguaucucaaguugacauauuuuaucuauuguaaauuugccaguuuggaaaaccggaagaauuucuguuauugcuuagaagaacaucucuaucacaaugcuuuauuuuaauuucauuuaugauaauaauaaauaaaauuauucuuuacagacauccuaugcucagcuccuugcagcaacaugucuuucaaaacuugucagccgagucaguccuuuaccuguugagcagaggauggacaucaguaaguggcuuauuaugcuuuuuaaccaacugcgcuuuaaaaaucuuuuucuuuuaaauauacuaaacuguuacuaggauugcaaauuuuuuaugucugucauuuuuaaaaacaugaguaucaagucucauuuacucaucugugaugaacagugauguguuacauaaagcaacgucuaaucaaaaaagcauuuuuuuucuuuuuuugagacagagucuugcucugucaccaggcuggagugcaguggcgcgaucucagcucacugcaaccuacgccuccuggcguagcaauucuccugccucagccucccgaguagcugggacuacaggugcacgcuaccacacccagcuaauuuuuguauuuuuaguagagacaggguuucaccauguuggccaggauagucuugaucucuugaccucgugauccgcccuccuuggccucccaaagugccaggauuacagaugugaaccaucaugcccggccaaaaaagcauuuauuuaaugauaaacaauaacuagcauuuuguguacuauuuguuaagauuuguacuaucucauuuuauccaccaaauaagauuuuugaguuauccucauuucacaaaugaggaaguuagauuugcagacaggcucugucacgugcccgagaucacacaacuagaaaguaguaggguuaugauucaaagcuacucuaccuguuuagaguccaggcuuuuagucauuaucuuaacuugguaugcaacugaaugacaggacagaauucagcucucugguguuuuucaggaugcuauaucaaaaucauuugggguauauguaaaauaaaagcagguucuuauuaggaagauaauuuauauauggauaaacagucuuggaacuuuacuugaaaaaaugauuuuauaaaguagcaguauguuuuuuggaguuaauguauuuuaaguuuuuguguguauguaaguagcuugcauuucauauggacaaaauuguaauaauugaggugugggguuuuuugggucaucuuuguucauauuagaaauagauuguugacucauuucuguucuucagccucaagguuaacauaauuuauauuuaucagaaaaguuaaaauguauuguaugugauggaucuuuaaguuuaaauuugacuggucaaaaucucacaaugauaccuuguuuuccucuauauugacuguuauuuuuauaagcacucugagucuuagguacugcagaaagccuugagaaggauuuauccacuguuggacuugcauacuuaagaaagcaaaggaaaggaguuuacaguuuuaaaaauaaggguucaaauaguguaaagcuaagucauaaaacuugugauuuuguuuauuauacuuuucaauacacaucuuuuaaauagacuuaauuuuuuuagagcaguuuuggguucacagcaaaauugagcacaaaguacagaggacuuccguauagucccuucugccacacacgcacagcuucccaucuaucaacauccugcaccaaagucguacauuuguuacaauugaugaaccuacauugauacaucaucauuaaccaaagucuguaauuuacauuaggguucacucuugguguuguauuucuauggauuuugacaaauguguuaauacaaugacauguauccaccaauauaguauuauacagaauaguuuuacugcacuaaaaauucgcucuucucugccuauucaucccacccucccccaacccugaucuuuuuacugucuccauagcuuugccuuuuccagaauaugauauaguuggaaucauacagccugagguaucaaucauacauguaggcuuuucacauuggcuucuuucacuuaguaauaugcauuuaagguuccuccauguuuuuuucauggcuugauaccucauuucuuuuuagcgcugaauaauucuuuguugucuggguauaccgcaguuuauccauucacuuacugaagggcaucuugguugcuuccaaguuuugacaauuaugaauaaagcugcuaucaacauacauauguggguuuuugugugcccaaacauuuucagcucccuuggauaaauaccuuggagcacaauugcuggauuauauguuaagaguguguucaguuuuguaagaaaccaccacacugucuuucaagguggcugcaccacuuugcauucccaccagccaugagugagaguuccuguugcaccacauccuugccagcauuugccauuuucuggauuuuggcuaguuugauagauguguagugguaucuccuuguuuuaauuuguauuucccugagaacauaugauauacagcaccuuuuuaugugcuuauuugaccucuguacaauugacccuugaacaaugcggauauuaggggcauugacccccugcgcaaucaaaaagucacaacuuuugacucccccaaaacuuaacugcuuauagucuacuguugacuagaagccuuaccaauaacauaaaaacaggcugauuaauccauauuuuguauguuauauguguuauauacuauauucugugaauaagcuagagaaaagaauauuauuuggaaaauuaaaagaaagauaaaauguauuuacuauucauuaauggaaguggaucaucauaaagaucuucauccucaucauuuucacauugaguaggcugaggaagagaaagaggagagguuggucuugcggucucgggguggcagaggcagaggaggcaggaaaggcaggagcacuagguauaaccuuauggaaauacauuguaauuucugucugacuuuuuugcuuuuucauuucuuuaaaaauguuucuauaaaguaccaauccuucuguguucacuuuaaauucagugcccuguaucauagaaagguccauguccugaaagaagucuggaauaauggaaacauuucugccagauuguccaauguuaauuuuuuuuuuucuggcacugcuguuucuacuacaucuucucccucaucauguggcacugguucagaagcacucaucuccauaaaaucaucuguaaauucugauguuucuuuuguuagauucccuaguagguguagguuucucccuuguguaaaacuuagcaauuuguaggaaacuuugaucuuuuuuuucaagugaguaaugucugacaggcuuagaccuuuugucgccuuuacuuagaguugacguuaguaaauccuuaaaggcuuuuuaguagcagacuuccaaaagauucaggaauuuuagcauacuuuuaauuucagauuuucagcugacuuuagcuauaguauacaguagguuaagacucaugucuaugacuuuuacucgaagaacagcaguaaaguacagaaguuuucuauauuuagccaagauuuauuucaguagaagauaaucuucucugacuaaucuuugagauuggaauaagccuuuaaagauaaaccucagaauucucauuuugggguaauaucauccauuucaguucccuagguuuggcauaggagauagugacuacacuggugugugacucuuuuccuggagauuucuuccugaaaaaugcaagagcuguuggugagagcaggcuugcagugauaauaguugagucuggucuacaaagauuuuguaacuccuuggaaagccucuuauaaucauucuuaaccucuuuguagcuaaaaguuuagaguaguugaaaucuguaggaaugcacuucugagggccaaaaaugugacugacuugggaacaauucuuaaacugauuaacuagcuguaauauaguuuugugaauuuauugcacugauccuguaccuugugguguauuugucccuauuaaauaaguguuguuuuguccucuuuaauguugcuuguaaacaguagugcccauugaaacauauauuugauuuuuaaaaaauguuucauaugaaaacuaccuauuagguuuauuagaucuugaauuucuccaagauccauaucuugaaacccuucacucuccaccuuuuuuuuuuuuuuugccacauccacagucucuuucaugauuuccuugacuggcucugcuguuguauauccugugaagucaugcacaacaucuggacagagcuuccuccagcaggaauuuauuguuucaggcuugauggcucucauggcuuuuucuauaacaacaauggcauccucagugguaaaauccuuccagacuuucaugaauguucucucuguggggguucucuuccauaguguugacaauccuuuuuauacaguaccguguguaccguguaugaccccuaauucagaggcuaaauuagagauguguuuaggggcacauagaccacuuuaauguccucauugaacucaugggguucugaguggccagggacauuguccaauaugaaaagaacuuuaaaagguauucccuuaccggcaagguacuuaguaacuucagggacaaagcaucuaugaaaccaauccagaaaaagguucucuucuaggccuuguuauacagccagaagacuggcagcugguauuuauuuuuucccuucaaggcuaggagauuagcagcuuuguagauaagggcaguccugaucauaaaccugacuacauaaaccuugacugugguuggaacauguacaaucuaagcguguguguaaguuuugauaaauuuuaacuuuuuauaauagauuuguguauauuuuaugauaguaaaugauaaaauagaguaguaucuacauuuauaccuucuuauuuuuaaaaauauuucaacacuacaccauucauuugaggugccuuuuuuuuuuuuuuuuuuuuuuugagacauagagucucacuuugucacugaggcuggagugcagugugugaucuuggcucacuccucccuuugccucccgggcucaaguagugauccucccaccucagccucccaaguaguugggacuacagaugugacuaccaugccuggcuaaguuuuuguauuuuuuuucuagagaugggguuucaccauguugcucaggcuggucuugaacuccugagcucaagcgauccgccugccucagccucccaaagugcugggauuauaggugugagccaccaugcccggcuauguccgaguuuuuaaaaauugucauaagucuccaaaaauuuuuccaauauauuuauugaaaaaaauccaugcauaagugguucucuacaguucaaacucauguuguucaagggugaacuguuaccuucuuuggaaaggugucuguuaaggucaucggcccauauuuuaaucagauuguauucuuauuuuugaguuuuaagaguucuuugugcaguuuggaaagcgguuccuuugauaugucuugugcaaauauuuucucccgaucuguggcuuaucuuuuuauucucuugacauugucuuuugcagagcagaaauuuuucauuuucaugacaaaguuuaccuuauucauucuuucuuucguggauuaugccuuugguguugcaucuaaaaagucaucacugaaccaaggucacuuagauuuucucuuauuuuaucuucuaggaguuuuauagcuuuauguuuuacacuuaggucugugaaccauuuuaaguuaauuuuugugaagggcauguagucuaugucaagauuccuuuuuuccauguggauguccaguuguuccagcacuauuugcugagaagacuuuucucauauuuaaaagauucauaacauauuuuguuacucccuuugcuccuuugucagagaucaauugacuguauuuauaugggucuauuucuagguuuuuuuauucuguucuguugauuggcaucuuaguugguuuugugcugcugucacagaauagcugagacuggguaauuuaucaaaaaagaaauguauuucuuacaguucuggaggauggaaaguucaagaucaaggggcuggcaucuggugagggccgucuuggugcauuaucccauggugggagggcaaagagaaggcaaaagagagugacaaaagggggcugaaaucguccuuuuuaaaggaccuacuccugaaauaaugacauuaaaccauucauaugggcaaagcacucuugguguacucaucucuuaaagauccugccucuuaagauguuacaguggcaguuaaguuucagcaugaguaugggaggggacagacauucaaacuguagcuguugaugugucauuucuuuugcugauaccaaacugucuugauuacuguagcuuuaugguaugccuugaaguaggguagugucagucuuccaacuuuguucuucuucgguauuguguuggcuauuuugguauuguguucgguaugguguucgguauuguguuggcuuuugccucucaauauaacuuuuagaaucaguucauucauauacacaaaauaaauuacugggguuuucauugggauugcauugaaucuuuagauauaguuggaaaauacugauaucuugacaguguugaguuuccugucuaggaacauguaauauguauucauuuauuuagaucuucuuugguuuauuuuauuauaguuuuguaauuuuccucauaugggucuuguaccuacauauuuuguuagauuuaaaucuaaguauuaauauuucauuuuugaggguacuaauguaaguuauuuuguguuuuauuucaaguuccaguugcugguaaagcagagugauugacuuugguauauuaacccauauuguguaaccuugcuguaaucauuuauuaguucauaauuuuuugucaguucuuucauauuuucuacauaucaugccaucugugagcaaagacacuuuuaguucuucuuucuuaaucuauaugcauucuauuucuuuuucuuauugcauuuucuaggacuuacaguauuauguugcaaagcaguggugagaggggacaucuugcuuuuuucccaaucuuagugagaaagcuucaaguuucucaccauuaaauaugauuuuagcuguagguuuuuuguagauguacuuuaucaaauugagaaaguuguccucuauuccuaguuugcugagaguuuucaucucauucaucaccauucaacaucaauggauguugaauuuugucaaauacuuuuucugcaucuauuuauguuaucaugugauuuuucuuuagcuuauugaugugauggauuacauuaauuaauuuuugaauauugaacuagccucauauaucuuuuuucuuucuuuuuuuuuguaguuucuuuuuguuccauguucucuuucucuccuugcuuucuuuugcuugcccuuucuuucucucucucacacucucucuccagauaguucauaaguuaacucucuagacauagauuauaguguauacuucucacuauuagaauuuaggguuguuuccaucagaggauuuuuaguuaaauuuugagguguguaucgucucuuuccuuucccaaaugacauacuggcuuuuggggcagagguagaaauugaguguuuccccuuucuuuuaauuauuuuuauauuuugauagcacacucuaaaagacuaucuacaaguuuggauuuagaguuuugaauuaugaauuauuacuaaaauauaugauuuguccaauauuuggaaacaggaagcaaacaaaaaaucggaaugaaccacaauaaccugauucagagucccagucauuuuacauuuuugaccuucauauuuuuggccuauaagacagaauaauaguaauacauaauagcaguaucuucacauugcuaugagagccacaucaaguauuugaugggaagcacuucacaauuucugacaugcuucauaaacaugaaauauuauuguuacuguuauauaggcuuuugacacgcaaaggaccucuaguguguagcuuuccaacuuucuacugacuuuugucugggguuuuucccagcuguuuguugugguuguuguucucccauguaucuucccaaacauuuccauuucuucuuaguauggcuuuucucuauuaauuguaccagugaggaggagauugcugauguuuuaaaugauuguaauuauuggugcuuacuaaauuggaacauucuuauaguuuguguaaaaagcauaacaugagaauauuuuguguaaaacauucagcuaaaguaacagaaacauauucuagugauuuuuuuucccugccuuagauaaugaauuuauuagcccuagguaccuuuguuugggcaaucugggaacauguccuuguugguaucuagcuuuaaaugugaaacuuggguugucuccuauuuguuuguuuuauuauuauuuugagauuacccuccuccuaguggucacuacuacccacauaggguuugccuguauccacugcaagaugaacauuuucaggauauuaaaaauaaaaguguaauugaaguaaauacacuggauuuucuuuuauauucaggaagcagugucaucuucuuauguuuuguuauugaaauaaaagauuacaugcaacaaagcuuagaaccauauuacugugauucguaggagaaacuucucugauauuuguccuaaugcuaaggaaauuaugcuuuuuuucaaaauguauuuuaucuuuuuuauuguauaacuauuuuaauauuaauaaaaauuaagguugaaguauaauaguuacaagaacuuuuuuaaauaucaagaaucuuacuacaauuaucaagaaugcuuguugcauacauucuuggauuuuggaguuguuuccaucaaagcuguuuuuaauuaaauauugagguauuuaccuuuucuuuacuauuuucccaaauggcaugcuggccuuucaggccaaaguggaaauggaguuuuuucucuuuuaaaaauucuucuuguaguuuuccgagagacuucuugguguauuuguuaucugacuucaugagucaacuagaaagcucauaacugaauuugcuauccacuuuuaacaguuuugguguauuaacuuuauuacaagcuugacuuuacuauucuacuuaugcuuucuugaauuuauauauuuauuuuaucauauuauacuguuuauguuuguuuuuggugggacgggaucucacucugucacccaggcuggagugcaguggcauagucauucucagugucccaaguagguaggacuguaggcgcaugucacaauacccagcuaauguuuuaacaauuuuuuguagagaugggguuuauuuguauuuuuaaugcuaccucaagaagacaguguauagucacuuuugcuauaacaugacauguuccuaaaagugacugugcuaugcaaugcuacauaauaaaaagcacagggcuuaugagagaaaucagauuaugaaaauaaaauuuaaaaguuuugucagugacauauuuagaaaaagauacaaaucaaaucaaagguuaguagaguuuuacacauuaaaugguuaaggaaagcauaguacaauaaauaugacacuuuaccuugggaaagaccugaaguuuguucuuagaagugggacucagaaggguugcagcuugugaguuauuguaaaguggugaaagaaagaugaucugaaauaguauggaaagauauaauaccagauaaggaugggugggguugaugauacauaguagauguuugagguauaugcguuuuguucaguuggccuguauauuaguugguucucacacugcuauaaagaaauaucugagacugggugauuuauaaagaaaagagguuuaauuggcucaugguucugcaggcuguacgguuagcauggcuggggaggccucaggaaacuuccaauuauggcaguaggugaaggggaagcuggcauggcuuacauggcuggagcaggagaaagagagaagggggaggugcuucacacuuuaaacaaccagaucuagugaaaauuacuaucaugagaacaucaagauggaaaucugcaccuauaauccaaucaccucccaacaggucccuccuccaacauuggggacaugagacuuggucagggacacaaauccaaaccauaucagccugguuucgguuuucugcauucaccuagcauuuuuugguagauaaaaucaugcagaaacaaaagugacauauucaacaaaaguguucuauucacguuuuucccuaauauaucaaaugcauuggaacaaauuugcuuuuucaaaagaagccuaauaaaagaacuguauaaauaaacauaugucuugaggagagcuauuaacuuuuugucacagcaugucauugccaccucuuuuucuguuuuuuguaacaaauacugcaacuuuuuuguuuaaaguucacaaaauucuuuuuuuuuuuuuuuuuuuacauuaaguucugggauacaugugcugaacauggagguuuguuacauagguauacaugugccaugguguuuugcuguaccuaucaacccgucaucuagguuuuaagcccugcaugcauuagguauuuguccuaaugcucucccuccccuucccccacccccaccucucuuucuucauaugauucacacuauguuguuucugaaaaguccagaugacccauggaguguuuucuuuguaggaaacuacauucugaauuacguggcaucacagcccaagcuggcucccuuugucauccaagcucuuauucaagucauugcuaaaaucacuaaguuggggugguuugagguucagaaagaccaauuugucuucagagaaauuauugcugaugugaagaaguuucuccagguaagaagucauugcuacaugguuagaacaucacuacuugcuuuuuuugguuuagaauacugcucuucuuaaagcgauauaguuuguuuugugacuaccaguaccauguuaauuaugauuuauuauuuauccucuggauccuuuaucauuuauuguuaguaaaugaggaucgugcuguuacauaauuuccaaaucagaagaauguaaauaaucauguuuucuaauuucaaaauguguguacauuuaugacacauaugucuauguacuguauauauaaaacauguauauaaugcuuuucauagauuauguaauuaaauguucaucacaaccuaaaaugaaauagauuuuauuuuguaaacaagaaaacaggcuuagagggguuaaauaauuucuguaagauugcauagugacugauuaacgcauacagcuagcauuuaauaagccuccaacuuacgauaaauuuuuuaauuuuuuaauuuuuacacuauaccacauugacuauaucaguuucucaagaauguuuucaauuucaucauuacacauuguauauagguaucaaauagguacagcuauuauauaucaauaaagaauaguuauuuuaaaaacaauauuuuuaaccuaagugauuaaaauaaagucauaguauaugcacauuuaacuuacauaaauucagauauauggacagccaaaaaaaaaaaccaaaccaaaccaaaacaaaauaaacagaggcaagaaaacauuaaacuaaaucaugccagugauuccauguccugggcugauuuagggaaaccugaaucugcucuuguuuccuguuuacucuuacucaggaugacugucaugccuugcucaguaugauucagauauuugaagauauauguauauauuuuuucauacaaacguaauucccaaguagaagagaacuauuuuaucugauguccagcuaaagaaacaugaucuggacugggcgugguggcucaugccuguaaucccagcacuuugggaggccaaggcgugcggaucaugaggucaggagaucgagaccauccuggcuaacacggugaaacccugucucuacuaaaaacacaaaaaauuagcugggcgugguggcgggcgccuguagucccagcuacucgggaggcugaggcaggagaauggcgugaacccgguagacggagcuugcagugagcggagauugcgccacugcacuccagccugggcaacagagcaagacuccgucucaaaaaaaaaaaaaagaaaaauccaugcucuguuaguauucuugaggaaaaauuggcaguuuugauuaauagaugguucaguuuugguucaugguugaguaugggcaauuuugacuuucggagauuuuacuuuuaugcaguaacuuuaaaauucaaccccugucuaagauauaacuucaucauauagugcagugcuggaaaccucagaauaugaaaugcuagguuaugcugcuucugucuuaucuauguuguuaaaaccugguuaacaaauauuugaucauuuagaacuccacaggaauaaguguucuuagcucugaggagaucaguuuauacuagggcagaaggauaguuuauucaggacaaguaugagcuucacacuucagaguugcauuuguaaguuuggcaagcacaguagcaucccccuuuugucuuuuacuaagauuguucaucaagauuuauuugaguagacaagaggcgaccaugcaguucuuuaaaaauaaagucaggguugaaauugaaugaaauucuuguuggcuaacauuucucaagcucccucuuuaguggccaguaagcucaacuuaaguugggauucaauguaccuuuaccaguucuggaagaccaaaagaaacaacauguuuuagcuugaaaguuuauuauauaauaguaucaccauagaauaguuaguacguguuuuuuauauauauauauauauauauggcuugaccuaacccugcaucaugagaaagucaauuuuggcuuuaguguuuuaguuuucuagaauauuaucauaugguuccuuugaguauuagcagcuuuugugaauuuuguccuaaaaguuauuuuaaguuugucacaucuuuaacagccugaacuuuugugcauucucuuuuuucuauuauuauggcccucuugcugccacacuccaaacauacuuaugugucuccuuucuacugauauacucaggagauccuacugucauuuagggcagugcuauucaaauuaccggucuucagcaagauaaggagcuuauguaagacuguaaaugaacauagugccuucuucauugagaaagacuugcuaugacaaaaaagccagcugaccuaguguacuuugugacuuagcuguuuuauaaucuguuacaugcucuuuauuuugucauggacgaguaacaaacuauuuucaaauuagaauugaguuuguaggucaucaaucagcugguucuagcaauuggucaggguaccacacuuuggggaacauuaaccugguguacacauaggauggauguuucaguguguaggaaaucuggagcucaguucagacacucagacugucuugaaaggccauaaauaauuaaaaugcaaaaauugugagaccuuuuuuuguucugagauaauuugaauuuaauuacauccagugauaauggaauucugugauaguuaaaaggaaugaccaacuauaaaauuaagauuugaaaaguguaucuaucuucugugucaguuuuuaaaaaugauugcaauguaauuggaugcugcauuuaugauuuucauaauuccaguaugauuucacacaaggguaguuuguuaguaaugugcauauaaagucugaauuuuaaugauggaaaauuugagauuaaauuggaagcugauuaaauuaaaaacauuauauagauagucauguauuuaucucauugcauuguguacuuuacaugccaucauuauagguauguaacaauuucauauacaugcacaauuaauguuaaaagagccuaagugauccuaucugauauuagaacaagagauuugaauuagugccuaagcuacuuauuauuuauuuauuguugagugucucuaucucaauaggcuuuaagcaaauuauagagcuaaaagcauuuuuugcuuauucuuauucuuggucuuauaaaagguauuaagcuaaauucuuguauuuugaaacuuaguuuauuauuuguccuauaagugcuggaaacauuuuguugaguaucaugcauuuauaagggaggagcuuuuucccauuuagcucuguguauccaaauuuaucuuucaaaaaauagguuugaaauucuuuuguuuauagaacucauagcgauuuuucuuuauauuuuauaauuuuguuuccauuuuauuauugaguaaaugugguguuucagucuuuaauuguuuguaaauguuaccugguauauacauuaagaaccaaucacuugucuccacuuaggcuaaacuuuguuauuuucuccaaaggguacuguggaacacugcauaauaggaguaauaauccuuucugaauugacucaggaaaugaaccugguaagcgagccuuuccaucuaacaggagccugaguuugcuuaaguaaugcuguuucuuuucugcuuuuauuuguggcaaaauagacagccuucauuuuguggcauaaaacucugaauaaucaaguuuuuuguguguguaucuguuuuauugaugggcuaauuaagugguggaauauuuucauuguuauugaagauaucugcaauaguacagaguauuacaaagaacagagaauuagacaugguucuugcucccaugggcacuuggagaauuguucuuuuaccucauauaugucauaauaugcuaaccauaagaaauauaugcaaaagagaaacaaaccuuuauucacuuacaaauaaaauauaggugguuugaggaauugauucucaacaauggauacacagcaggacucauaaaaaaacaggcuuuuuuuugacugggccagguggcucacgccuguaaugccagcacuuugggagacugaggcagggggaucaccugaggucaggaauucgagaccagccuggccaacauggagaaaccccaucucuacuaaaaauacaacaauuagaugggcguggugaugggcgccuguaaucccagcuacuggggaagcugaggcaggagaauugcuugaacccgggaggcagagauugcagugagcugagaucgugccacugcacuccacccugggugacagagcaagacucugucucaaacaacaauaacaagaaacaauacaggccuuuuggguugcaggcccaaugcagaggccggcgcggcucacaagcgcccccagcugacuaugcaccagaaugacccaguugguggucauacugguuggccagugcgaaaaccagauuggcugcugcuucugggaccuggcacuaagggagcacgccgcggucagccagaaaggaaucuauuaugaggcaauaagcagcuuccuuagaaauguggauaccagcugucuugauugacaugguagaagggauagugaaugaaauucugcagggaccacugagagauguauuugauaccaaacagcucaucacugauacuuauggcuccggaaauaauugggcuguggaucacaaaguuuuuggcagucuguaucaagaccagguuuuagagaaacucagaaaguuggcagagcacugugauugcuugcaguguuucuuuauaauacauuccgugggaggagaaucaggaucugggcuuggcacauuucuucuucuucuucuucuuuuuuuuuuuuaaauauuccauugcgcguauguguacguacaaccauauuuucuucauuguuauacuuuaaguucuuggauacaugugcagaauguacagguuuguuacauagguauacaugugccauggugguuugcugcacccaucaaccagccaucuaucuacauuagguauuuccccuaaugcuaucccuccccuagccccccaacccccaacaggccccggugugugauguuucucuccccguguccaugugaucucauuguucagcucucacuuaugaguaagaacaugcaguguuugguuuucuguuccuguguuaguuugcugagaaugauguuuccagcuucauccaugucccugugaaggauaugaacucguccuuuuuuauggcugcaucguauuccaugguguauauguggcacauuuucuuuauccagucuaucauugaugggcauuuggguugguuccaaaucuuugcuauugugaauagugaugcaguaaacauaugugugcaugugucuuuauaguagaauuauuuauaauccuuuggguauauacccaguaaugggauuguugggucaaaugguauuucugguucuagauccuugaggaauugccacacugucuuccguaaugguuaaacuaauuuacacucccaucaacaauguaaaagcguuccuauuucuccacauccucucuagcaucuguuguuuccugacuuuuuaaugaucgcaauucuagcuggcgugaguugcagucuugcuuuaugaaucugggugccucuguauuaggugcauauauauuuaggauaguuagcucuucuuguugcauugaccuuuuaacauuauguaaugcccuucuuugucuccuuugaugguaucucauugaguuuugauuugcauuucucuaaugacuagugaugaugagcuuuuuuucauacgguuguuggccacauaagugucgucuuuucagaagugucuguucauauccuuugcccacuuugugaugggguuuuuuuuucuuguaaauguguuuaaguuccuuguagauucuggguauuagcccuuugucagauggauagauugcaaaaauuuucucccauucuguagguugccuguucacucugaugauaguuucuuuugcuaugcagaagcucuuuaguuuaauuagaucccauuugucaauuuuggcuuuuguugccauugcuuuugguguuuuagucaugaauucuuugcccaugccuauguccuuagugguacugccuagguuaggguuuuuaugauguuaggucuuauauuuaagucuuuaauccaucuugaguuaauuuuuguauaaggugucagguaggggcccaguuucaguuuucuguauauggcuagccaguuuucccaacacuauuuauuaaauagggaaucauuuccccauuucuuguuuuugucagguuugucaaaaaucagaugguuguagauguagagcauuauuucugaggccucuauucuguuccauuagucuauacaucuguuuugguaccaguaccaugcugguuugguuacuguagccuuguaguauacucugaagucagguagcaugaugccuccagcuuuguucuuuuugcuuaggauugucuuggcuauaugggcucuuuuuugguuccauaugaaauuuaaaguaguuuuuucuaauucugugaagaaagucagugguagcuugaugaggauagcuuugaaucuauaaauuacuuugggcaauauggccauuuucacaauauugauucuuccuauccaugagcauggaauguuuuuccauuuguuuguauccucucuuauuuacuugagcagugguuuguaguucuccuugaagagguccuuuacaucccuuguaaauuggauuccuagguauuuuauucucuuuguaucaauugugaaugggaguucacucaugauuuggcucuguucgucuguuauugguguauaggaaugcuugugauuuuugcacauugauuuuguaucugagacuuugcugaaguugcuuaucagcuuuaaggagauuuggggcugagauaaugguauuuucuaaauauacaaucaugucaucugcaaacagagacaguuugacuuccuaucuuccuauuugaauacucuuuauuucuuucucuugccugauuguccuggccagaacuuccaauacuacauugaauaggagugguaagagagagcauccuugucuugugccgguuuucaaagggaaugcuuccagcuuuugcccauccaguaugauauuggcugugggucugucauaaauagcucuuauuauuuugagauauguuccaucaauaccuaguauauugagaguguuuagccugaaggguugaauuuuauugaaggccuuuucugccucuauugagauaaucaugugguuuuugucauugguucuguuuaugugauggauuauguuuauugauuugcauauguugaaccagguuugcaucccagagauaaagccgacuugaucaugguagauaagcucuuugaugugcugcuggauuuggcuugccaguauuuuauugaggauuuuugaguugauguucaucagguuuaauggccugaaauuuucuuuuuuuguugugucucugccaggauuugguaucaggaugaugcuggccucauaaaaugaauuagggaggagucucucuuuuucuguugauugaaauaguuucagaaggaaugguaccagcuccucuuuguaacucugguagaauucagucgugaauccgucugguccagggcuuuuuuuuugguugguaggcuaccaauuacugccuuaauuucagaaccuguuauugcucuauucagggauucaacuuggguuuagucuugggagguauguguguccaggaauuuauccauuucuucuagauuuucuaguuuauuugcauagagguguuuauaguauucucugaugguaguuuguauuuccguggggucaguggugaucuccccuuuaucguuuuuuauugugucuauuugauucuucucucuuuuuuucuuuguuagucuggcuaguggucuaucuguuuuguuaaucuuuucaaaaaaccagcuccuggauucauugacuuuuugaaggguuguucgugucucuaucuccuucaguucugcucugaucauaguuauuucuugucuucagcuagcuuuugaauuuguuugcuuuugcuuuucuaguucuuuuaauugugaugcuagggugucgauuugaggucuuuccagcuuucugguugugggcauuuagugcuauaaauuucccucuaaacacugcuuuagcugugucccagagauucugauacauugggucuuuguucucaauggauuuagauaacuuauuuauuucugccuuaauuuuguuauuuacccaguagucauucaggagcagguuguucaguuuccauguaguugugcaguuuugagugaguuucuuaauccugaguuuuaauuugauugcacuguggucugagagacuguuaugauuuugguucuuuugcauuugcugaggagugcuuuacuuccaauuaugugucaauuuuagaauaagugcgaugugguugugagaagaauguauauucuguugauuugagguggagaguucuguagaugucuauuaggucugcauguuccagagcugaguucaaguccugaauauccuuguuaauuuucuuucucguugaucucucugauauugacagugggguguuaaagucucccacuauuauugugugggagucuaagucucuuuguaggucucuaagaacuugcuuuaugaaucugggugcuccuguauuggaugcauguauauuuaggauaguuagcucuucuuguuguguugaucccuuuaacauuauguaaugcccuucuuugucuccuucgaucuuuguugguuuaaagucuguuuuaucagagacuagaauugcaaccccugcauuuuuuugcuuuccauuugcuugguuaaucuuccuccaucccuuuauuuugagccuauguguguaggcuauuuacaaaggcacaugagaugggucuccugaauacagcauacugaugggucuugacucuuuauccaauuugccagucugugucuuuuaauuggggcauuuagcccauuuacauuuaagguuaguauuguuguaugugaauuugauccugucauuaugauuguagcugguuauuaugccugauaguugaugcaguuucuucauagugucgauggucuuuacaauuugguauguuuuugcaguggcugguaccaguuuuuccuuuccauauuucgugcuuccuucaggagcucuuguaaggcaggccugguggugacaaaaucucugagcauuugcuuguccguaaaggauuuuauuucuccuucacuuacaaagcuuaguuuggguggauaugaaauucuggguugaagauucuuuucuuuacgaauguugaauauuggcccccacucucuucuggcuuguaggguuucugcagagagaucugcuguuagucugaugggcuucucuuuguggguaacccaaccuuucucucugucugcccuuaacauuuuuuccuucauuucaaccuuggugaaucugacgauuaugugucuugggguugcucuucucuaggaguaucuuugugauguucuguguauuuccugaauuugaacguuagccugucuuggcggguuggggaaguucuccuggauaauauccugaaguguguuuuccaacuugguuccauucuccccaucacuuucagguacaccaaucaaacauagguuuggccuuuucacauagucccauauuucuuggaggcuuuguugauuccuuuucauuucuuuuucucuaaucuugucuucacacuuuauuucauuaaguuguuauuaaucucugauauccuuucuuccucuugauugauuuggccguugauguuuguguaugcuucacaaaguucucuugcuguguuuuucagcuccaucaggucauuuauguucuucucuaaacugguuauucuaguuagcaauuccucuaaccuuauuucaagguucuuagcuuccuugcauuggguuagaacaugcuccuuuagcucagaggaguuuauuacccaccuucugaagccuccuucugucaguucgucaaacucauucucuguccaguuuuguucccuuguuggcgaggaguugugauccuuuggaggagaacagguguuccaguuuuuggaauuuucagccuuuuugcacugguuuuuccucaucuucguggauuuauuuaccuuuggucuuugauguuggugaucuucagguggaguuuuuguguggauguccuuuuuguugguguugaugcuauugcuuucuguuuguuaguuuuccuucuaacagucaggccccucugcugcaggucugcuggaguuuucuggagguucacuccagacccuguuugccucgguaucaccagcggaggcugcagaacagcaaagauugcugccuguuuccucuucuggaagcuuuguucuagaggggcaccugccagaugccagccagugcucuccuguaugaggugucuguugacgccugcugggagaugucucccggucaggaggcacggagaucugugccuuagcagagcuugagcaccaugcugggagauccccugcucucuucagagcuggcaaggaggaacauuuacaucugcugaagcugugcccacagccgccccuucccccaggugcucuguuccagggagaugggaguuuuauauauaagccccugacugggucugcugccuuucuuucagaaaugccuugcgcagagaagaggaaucuacagaggcagucuggcuaccguggugggcuccgcccauuuugaacuuccaagugucuuuguuuacacugugagggcaaaaccgccuacucaagcuucaguaaugguggacgccccuccccccaccaagcuggagcauccaagguugacuucagacugcugugcuggcagcaagaguuuaaagccaguugaucuuagcuugcugggcuacgugggggugggauccucugcgcuagaccacuuggcucccuggcuuagcccccuuuccaggggagugaacgcuuacgucuugcuggcuggcguuccaggugccacucggcacauuucuuuuaaaggugcuugaagaugaauucccagaaguauguagauuuaugaccuccauuuauccuuccggugaggaggaugucauaacuugaccucauaauggcaucuuggcaaugaaggaacuuaaugagcaagcagacuguguguugcccauugacagucuuuauuugacaucauuagcaaagucgaccucauagugaauucuggaaaguuggguacaacuguagacgacuucaagugcuguggcuuuaaaaagcagaauaagcccuuuguugcagucaacaacauuguggcaaauuugcucaaccuaacaagcuccgcaagauuugaagggucccuuaauaaggaccauaaugaaaucagcaugaauuuaguuccuuuuccucagcuucauuaucuuguaucaagccuaacaccucuauacacacuggcggauguuaacauuccuacuaaaagauuggaucagauguuuucaaaugccuuuaguaaagaucaccagcugcuucaggcagacccuaaacauagucuuuaccucaccugugugcucaugguuagaggaaauguacagauuuuacaucuuugcagaaauauugaaagauuaaaaccaucucuacaauuugucuccugaaaucaagaaggcuagaccagccugucccuccuguggaccauuuuuauucauuauuagcuuuagcaaauaacacauaugugaagcccacauucauggaaaugaaagagagauucaugaggcucuacaagaaaaaagcucaccuucaucacugucuacaaguugaaggcauggaagaaagcuauuucacagaagcuguguuguuuuuaucagcacucauacaggaguggccaccacuguaugaguggaugccagaaaaaacauaccugugcaagauuuaccaagccuaagcauagccguguauaaaagaaacccuccaaaauauuuucuuaauuucacguuuuuucucaccuuucuguuucaguauuucuuugagauucagaaagucuaguuuguuuuucauauuaggaaauauuuuugucuaaaagagugauuucuguuuaaucacaauuugucgauaauaccagugugugaaauuagugaaauccuaguaccugaacuucagacauuugucuucagaaaaaucucccuuucuaaaauugagagaauggaguucuucaguauuauguuguauuuauaaccucauauuuaggcauuuauacacugauaaucaugucuucaauaaaaaucuuguacagauuuuuaucauuuauauuuugauauucuauuuaaauucuccugauucuguaaaaguagguacugggaauagaagaacauaauauaaauauuucuguguaauaccacuaacuauucagggauagguuuuauuccaaccguuaaggagguuuuguuucuucuuuagauaagaacuuguuuucucaaaagaauucuaauuuguacacuuaacauguauuuguauuaaauuuuuaaaauaauugcuuucuuaucaaaccaauugauuuuauaauaauaaauguuuauauuaaaaaacaaaacaggccuuuuuucacuuuauggcuccuaguuuggauuuuuacccuguacaaggggaguuuucagaagcuguacuucuccccaacagugcuuuuaugaucugaaccuauuaucaccuguuccguuugcacauaaaaugguucuaaacagaaugaaagcagaaguuggguucuauguggaguaauuuuauaauaaagaggaauguaguguuuaaaaacugucaucuugagugauauguguuugcgugugggcaugcauguccaugcacacauauagauguauauauguagaagagcuugcauacccaggaucacuugccaacucccuuuggaguaacauuauagccaugugcauaaaaaaauacaaaagaaccauuuucuacuuguguucaaucaggaauuagaaaauauuuuuagauuuauaggauggauuucuaaaauuuaaagugaucucuuaacuuaucacggccaucaccuuccugaguccuccaccccagaguauaugcuguguguuuguguguacauagguaucuguuaauaauacugugucagcagggauauuaugacagggauaaucuuauugaacucuaaauaugucuaaagaacuguagcuuccuucuaaaaaaguacauuuaaauauuuucauaaaagugaagagaauaguaugauaaccucauguacuuaucuucauuuuacaacuuuuugcuaauuuugaaacuagcaguuugauucauuucaugcuucucagcauaauaggaaaauagucugcccuggaaaugagaguuugugcuguguuuagauuaucacugaaauaagacuaguuaaugugaaguucugguaaaugugcaguuuagagagcaacaggauaacuucuuuuucuuaauuagcaaacuuacagaaaaguuguaaguacaguaaagagaaguuuuuucucaacugacgcuaaguugcuaacauaauucuccaccaccagggaauuuaguguauuuccuacacacaaggacguucuuguaccuaaccacaauacaaccuugcaaucagaaaaugaacacuggaauuauucccacuaucuaauccucauaccucauucaagauucacugguuauaaacacucuuucuagcagaagaaccaguuuaggauuauauaucacauuuaguucuuauguuuuauuaguuuccuucaaucuggagaaaaauuucucaaucuuuuucacuuucauggccuugacguuuaugaagauuauaggccaguuuuguaaaaugucccucaauuugggauugucugauauuuccucauuauuagauucagcuuaugugaauuugucagaaauaucacagaaaugauacugugcccaucuccuugccuccuaucaggaagcaugugaugauuugucacauuacugaugauguucacuuugaucucuuaauuaagauggacuccucugggcucacccauuguagacuuacucuuuucccuguuguaauuaauacauauuuugugaaaagguacuuaagucucugaaaauaucuuguuccuuaucagacuuucagcuuuuugauuuguuaauuuauauuacuauggauuccucguuucauucuauuuaauagguuauaauucauugcuaacauuauuuguuuuguugcucagauuuuccaagauuugaccaauaggaccuuuuucaagcugauuuuuguguccauuugauauuuccucaccauucuuuggguucuuucuuaccuucuggcacaagacagucuaagcuuuucuugcauugaaccaagcaccuuuuaagaaaagcuuuaaggucugaagugugauuuuggcuuuauauggugaaaaauauagauggcuucuguggagacaguucauucagccuaauuuuaugacauuuacaguuucaacuagcauuuauuaagcauuucugaaccaggaaguagggagaucuauaaugcaugaggguaauuaaauauucuaguuaucagaugugagccagauaaauucauguaguauccauaacaggaugugucucuuaagaaaaagaacuacacuugaguuuuccuaaaaguuaggaggauuauauaaguuauccugcuguuuuagaagcuagaguuucuguuccuggaguauauucacuauccagucauuaagaaguaaaauauccugugccuccaagguagaggcauauauaugcaauagaaaauggaugugcaauccuucgucucaaaauauuggauaucuaaaugaguaacccaaguaaaauaagcaugcaguccuuuaauauaacucuggaauaaaacauggaguuguauuuucgcucuauuuuuaccuuuuacaaacuucuuagcuucuuuaaaacuuacauauuguuaccuguaaagugagaaugacaacuacuuauauggaucuuaauaagauuauauuaacuugcacaggacuuaguguguagaaagugcucaguacaccuaaguuucuuuccauauuauggauaugaugagagugagaaguuagucuaagauagugugcauauaaacuugaauuucucaucuuuuaaaaucauccuuuauuucaaaacucauguguuuuaaaaagauaaaauguaucucacagauuaguuuuaaggaauaagcgaaauaauauaugaagaauacuuuauaaauugcaauuauaaugcuguuugcuuuuaauuuguauuaaggaaaaaauauuuuuauauauugaggaaaguguugagauuugauuuaaauuaaucaagagaggcauuaaaaauaagcaaaagacaugaacagacacuucucaaaagaaggcaaguggccaaaaaacaugaagaaauguuccacauuacucaucaucuuagaaaugcaaaucaaaaccacaaugaaauaccauuucacaccagucagaauggccauuauuaaauagugaaaaaaccacagaugcuagcaaggcuguggagaaaagggaacucuuauauacguuggugggaauguaaauuaguucagccacuguggaaaguaguuuggagauuucucaaagaacuuaaaacagaacuacuauucaacccagcaauccuauuacugaguauauauccccccaaacccaaaucugucaaaaaggaacaugcacuuacauguucacugcagugcuauucagaaaagcaaagacguggaaucagccuugguacccauugacgguggauuggauaaagaaaauacacguauaccacagaauauuaugcagcuauaaaaaauaaugaaaucauguccuuugcagcaacauggaugcagcuggaggcccuuaucugaagcaaauuaaugcaggagcagaaaaccaaauaccacauguucucacuuccaguaggaguuaaacacuagauacuuguggacauaaagauggcaacaguagaaacuggggacuacuagauaggggagagauagaaagggguaaagguugaaaaacugacuuuugggugacaggaucauucauaccccaaaccucagcaacaagcaauauaccccaggcaacaaacacacacauguacccccacaagcuaaaaugaaaguugggaaaaaaaaaaaaaggaacacugaaaaugcuaauuuaaaucuuacacauuggguauagguuccauaacuacuuuguguaaucauuuggccuucuguuauguuucauguuuuauaaguaaauauggcaaucgaguauaaucuaaauuauauguuggagcuuaggaaguaucacauaaucaauuuuaagcccauugcuucuuucagaucuauaaacacuagcaaggaaaaugguuuauuuucuucuuccaaauagcaauaagaauaaauaguaaugccauagcaacuguagaccauaguguuaauguuaguaugagugucagacuucagcuuugccuguuccuauugauaaauggaaauacuaaugguaugaauaguauaauuuugaauauacuacauuuuagguuagaggccuaagagcuagucuuaguuuauucuuaaaaauuauuugucauuagcuaauaaaauauucagagggaauauacuauugcuuauauaagaaaucagauuucugauuauuuauaauuucugccuugguuucuuuucguaguaucaaagauauaugaacuaaugacauauaugguacauauaggaauaucacuuucaacuagaagaauuuuucuguggcuaauucaguuuucuuauucauagacaaaguuagaauuuggagauuaucuuggagauuucucauuuuacagguggaaugugaggaacagggaaguuguuacugcaugauauaaaauaugguacaugguuuaggaguuaauagucuuaguaucuauuuuuauuuuauaaucuguguuguuuauacugccucugaaagugugaugaacuuugguuuuuaguauugggaucaguacggguuguaggaagaacauuaaauugaaacagucuagaaacuuggguucuacucaaguuuauuuccuuuuuuuuuuuuuuuuuuuuaguaaauuuugguuugcuuuuucauaggucugguuaaacuaauuucaucuuuaucuuuuuagguugauuauucuagaccuucagcaaaacacaggaaaauagcuaccucauuucgugauacuucucucaaagacguuuuagugcuagcaugcucucuuuuaaaagagguaaguuauuugauaauucaacuuccuaguuagaauauuugggaaauuuuaagaguuucaaaagaauuucaguugaauuuuccccccaguuuugccuuuuaaagaauuauuguggacagacuuaaguauaguaaauuugcauaagucuguaagcaguuccaaaaaauucacuuuuacucacugggcauaugauaaggugaaauccaaagggaaucuaauaacuuaucuucagguaguaguuucauugccuucccaguguagauucuuuaauuauagaagcuacuugaguauuaguuucuuuaucugcuugcuuauauuuugauaggaugcagaugaaaaaugaaaugacaauauuuuccugauucaucaacuaucaaaauuuauucauaguuuagccaagaucguugacuuuaacaacuucuuugggaaauaguauuuccccauuugcuacuuagugcccuauugaauauuagugauagcaugauucauaaugauacuguauucucuuguauaauauagggacuccaucaugcuauucaagccugauaauugguguaauauagcauugcugaaaguaugcuucaauaagcacuaguuuccauuuauuucaauucuuugguuuaguaacaugacaacugccacacuaugucagacccaaagaccuucuauuaucuuaaaauuuuucuuuuaacacagaaaauuuuaacauacacaaaaguagauagaauaguauaaccaguuaaccugucagccaguuaaacaguagcaacucauggccaaucuuguuuucucucuauuccugccuacccacuucuuuuuauauuauucuucaagcagaaucccaaauuucauauaauuuccucuauaaauauuucacaauauaucuaaaagguauaauuguuuuugguuugugugagaaugggcauuaucuuggaaauaggauuguucuccagaagcuuugugaguguccuccaacauucagaguucugauugccuuuauuagcugaaugugauucuuuuaugcaugaaguuaacccaguuuuucuugaagaagguaacauuacuuccuuauauauggaacaguauaacuuuguaaacuccuuuauuaguuuucauuugacauugaaaaauuauuuuaauucaugaaguguaaauuuauugauguauuucgcaguguuuucuuugauuuuguacuuuuuucagguguuugccaaaccuuuaaaucuucaggaucaaugucagcaaaaucugguaaugcaggucuugaaacugguccuuaacugccuuaacuuugacuucauuggcaguucagcagaugaaucugcagaugaucuuugcacggugcagauuccaacaacuuggagaacaaguaagaaaaaacuuugguaugaagggucaucaacauaaaggcacaguauuaagcaauauaguuucuguauguauaguuaucuuuuugccaggaauuaaaaaaauagcucaaauggauuuguaaccugaaguagcugcugauagcuaauauugaaauguuuucuguaauucauauuauaguaacuucuauauuuugauuuaggaaaaaagaaaaaacaaggacugcacuagagcuaaauggagagcagauuugggaggaaagucaagagcuaugauuugaaacuuucagacuuucagauaaacagagugggacaggaucccacucuguuuaugaucauuuucaggugcuggucaaaccuuuaaaucuucaggaucaguguuagcaaaaucugguaaugaaggucuugaaacugguccuuaacugccuuaacuuugacuucauuggcaguucaauaggugauucuacaaaugaucuuugcacagugcagauuucaacagcuuggagaucaaguaagaaaaaaguucaguaugaagggucaucaugagaaagaaaaaaguuuaauaugaagaguuggcaagagaugucaacauaucuuucaggguuauaaagagaaugaauuagauuaagugaccuagaagaggagaguugcaacuugcuuauagaaagggauaccaagaaaaaggaagcuaauuuguucucccauguuccagaaaaaugguggcaccuaagguaccucugaacucagaauugggaaauggggcugacgggguuugauaaaaagucuguacucugaacaguuaaacucuccaggaucuucucuaccaccugugcagcuaggugacugccuuuuccucccuuuucucuaccugugcuacuucuuuacuuuccaagaccagaguuuuuuuccucaagaaauaaaauuggagaggccucauauucauggauaccagauauaauagaggaacaguauuaauuuugugaaaaacuucuaauauggagaucagagacuacaacaacaaagggggacuuuguguucuguaucuugacuguggugauggaaacaugaaccaauacauguaauaaaaaauuucacagacugaaaacacacaucuacacacacaugaguacauguaaaacugggaaaucugaauaagauuguggauuuuaucaaugugaguuuccucguugagauauuauacuguaguuuugcaagaaauuaccauuguaggaaaauggguaggaguucacggggucuuucuguauuauuuuuugcaacugcaugugaaucuacaauuaucucagaaaguuuaauuuuaaaauggaggguaguuaauagcaacagagacaaggugaaaguagaaauaaacuucagaaagauauaaagaauaugcccagagagauguugagauaaugcaucccugaaacaaggacaggauauuguucagagaauguuccaaauuuacaggacaguugucaaaauaaaacauccaguggaaaaguuguaagacaaaguuaacccaaucuccuagaauguagaacaaaaaagcaaggagauguuugauaggaggaaaaaaaaaccaagaaaacuagaagaugaaauuaaggaggugugacgguuaggaguucuagaaagagaggauggagaaagaaggaaauuugcaaacagauaguaccccaaaauguucugaguucugaaggguaugcauuuuuggauugaaagaucccaccaaguucccagcauaaugaaugaaaaaagauauucacuaagcuuuauaaucaugacauuuuagaauaguaaggauaaagaaaaaaauucuaaaacuuaccagaaagaaaaaaguaagucuccuccuacagaggauuggggucaagaagguauuagacuucucaacagcagcacugaaagcuagaaaacaauagagaaguaucuucaggcuucugagggaaaauuguuuccaaacuagaccaaacuuaucaaaucuaagauagaauaaagacauuuucagauaugcgaguccuuccaaaauuuaucccuuauguacuugcucuaaggaagcuacuugauguacaagcaaagaaaguggaagauaauggaauuugggaaaugggcacuucaacacaagaugacagugaaagacauagaaaggcuacaguuguauaacaaaguuaaggagcaaccaguucaaguugaaggcucugggagguaggggugggugaaugcaaaugauggguuauuugaugcuauugaugguguggaacauguuaugaagaacauugugccagucucucagagcauuuggagagaauuagugacagauacacaacuaagcacagaaaagaugguaugauuaaguccagcgaguauuagaaaugugauguaauuacagcucagccguuaauauuauuuacauagucauaauaaauguaaacacauagaauugauuuaaucacaaauugugauaauaguggauggguuuuugagaggauugauuguggagagagugguaggggugguaggguuguggcauucgugauuagacagcuaaagcguuacacacuguaauaggaaugcaguugaugucuaaaguaaaacaaucaaaugaagaaauaguauacgcuauuauuuggaaacaugaauguaacuauagcuaaguugaaaagcaguuggaaugggauaggguacaguuuuuuuuuuauuguaagcuuuuuaguacuguuuacuuuuugauacuguuugaauucucaauguuuauauuacuugaauacaaaugaaaauaguaagaagauucucccaguucaaacuguagugcuacauagaggaagugcuacaugaggaagagccuggcuaguuaauuucucucuguauuauuucaucuuucaaaggaaaauagcuaggaauuaaaaauaggccuaacuggaaggaauggccacaugcagaggccuuggauuucucaguuugugugauauugucuuacuuuguuaagaucacugaauugaaaguaaugguguuagaaaauaauuuuuuuucccaguuuuccuggaaccagaaacauuggaucuuuucuucaauuuguaucauucacuuccaccacuacuaucucaguuaguaaguaaaagucauucguuauuucguuaaaaaauaccuguguaaauaaggggugguauauauuuacuucaaaaauucuguuuauauauucaauugaguuuacuuuucacaguaaguucuuauauuuucugggauguauacugcuuaaacuauuugucaaauuuuguuuguuuugucaacguuacauuuuauuucaugggugagccuagaaccaguaacuguugauuuagcucuugcccagagccaggacaaccuaccaaucccuaaauacauauuuuuuuccuacucaguucccauagggccuaaguccagcagcugaccaccacacaaggacuuucccuucuacuacccuucucuaacucuuccucaaccuugccuggcuccaugucuuagguuugacaggcuguccccuucagaucucugaauaagaaaugaaggggaucuacucacuugaauuguguucaucaagccaguuauuuauuuauuuuuugaaucaguguaaauucuauugcaugcuuaaaaaguucuugauacucuguaguuguauacaacuuugagacucuuagcuccaucuuugcggagccuaaaacaaaucugucaagguuauuaaaaauuguaaguuuaaguuuaaacuuguaaagcuggggaguucuaauauugccauuuucugaaaaacauauugcauauuuaaaguauauaucagugauguguuuguuuagguaucuuauugccuaaaagggaggaaagcauucacagaaauguccuuuuuaaaaaaacaugucuucucuugaaucuagaguuuaagguagugcuuuuuaaacuggguuucucaggguaccucauguuuccaguuggggccacagccuucugucuuuuagucgcaacagucuugcuuuuaguuguguaaaaaccaugguuucauguaauuauguuuugggauaaaacaaaaaagguacuagugcuuaaaaaauaaaguagaaaacaacugcuuugagagauaguaaugaacauuuauuggacauguccuauuuauuguaugauacuuaucucacuuaauccucaaaguggcccugaaagguaaaugauaaaaaucccuacuauguagacccagaaaaacagaaaacagacccagauugacuaagugacuucccccagggcaacaaagaaaauauuggcauugagauugaaacacaggucuuuuuugcccccaaccccagguguuuuuaguacgcuagugguuccuauacuuguacuucugaguuuccuaaggaguuuuuuguuuuuguuuuuguuuuuaauuuggguuuuagguucucaugguaggggcuguggcaaacuggagcacaucuaaaaagggcgucauuugauuuuugucucuuuucucaccguaaaguaccuaccuuuuccagcaccauuuucagaccauuuuuuaagaugcuaauagaugguguaaaauauuccuugaccaauuaaauuuggaauaugcuggauuacauuacagguucccccugccccccccaacaggauaccacgguacauaaugugcacuauuucccaaacauacuguaccacaaaaccauauuuucuuuuugguagaaaaccugauucauuagaaaauggaacuagauaucauaagcaauugagagccuauuaaauguauagcauguacaggccuugaacuggcugauuuuguuaaugaaaaaacauuagaggggaauacauacaaauaggaauuuuuaugaugggguagaaggauuguggguggugggagugguugaugauauuuagcuuuuauuaauuuuauguucuauaaugcuuuuuauauugcauuauaaugcauuauauucuauauugcauuaucaugcguuauauucuauauugcauuaucaugcguuauauucuauauugcauuauaaugcguuauauucuauauugcauuauaaugcguuauauucuauauugcauuauaaugcguuauauucuauauugcauuauaaugcguuauauucuauauugcauuauaaugcguuauauucuauauugcauuauaaugcguuauauucuauauugcauuauaaugcguuauauucuauauugcauuauaaugcguuauauucuauaaugcauuaaaauuaaauucauuuuaaauguaaagacuaguauuccuuacauguggccacagauacuuugaaaauugaaaugaaauuuuuuugguauuuuuuaggcacuuucauguuuaguucaguuugcuucgacaagaagguccuuauuuaacaguccugaacgugccaaguaccuugguaauuuaauuaagggaguaaaaaggauacuugaaaacccucagguauuuaugaaguaauuuaauacuuagcauauagagauacaguuuuucagcuaaaggcacauaauaaacucaucaugaauuuauuaugauucuggaagaaaacauuuaguaucauauauaucuuccuuagagcuuuuuuuuuuuuuuuugagaucaagucuugcucuguugcccaggcuggagugcaguggugcaaucuuggcucacugcaaccucuaccucccggguucgagugauucuucugccucagccucuugaguagcugggauuacaggcuugcacccaccaccucugcuaauuuuuguauuuuuaguggagaugggguuucaccauguugggcaggcuggucuccaacuccugaccucaaaugauccaccugccucggccucccaaagugcugggauuacaggcaugagccaccaugcucagcccuuagaucucauuugugguggagauggguaguuuuuaaaaauggauguuuccauggcugacuucuguguuucucuuauuuuuuucuuuuaggcaaauaugacuagagauuaucuaucuuacuaugcuucugucuuuuaccauuguauuacauuucuuugcuugcucuuaaacuacugaagugauuaauucaguauguccaccuuaugaacuagaagacauaauauaaaucugaauguuaauauuggagcaaguggccuuaaauuaugaaauuauguuuucuugcccucuuguggacaaguaagaguuuguagauuuuaaaauuuuuucugcauuaacuuuagagcuucauugccaauauucauuucagagaauugcaaagcugcuauugaguaauuugggugcuuacauaaaauauuuuguuuuacuuuuuauuuugauuuugguuuaaaauaucuguaaaauacagauuuuuaaagguuaaaugauuuaaggagguuuaccuaauucucuugguuauuaauaaauuuuggggggugacauauaucuucaguaagaauguucuacaaaaagcaauuguuuuugcauauucucagaaguguuuuauggguuaugcauuuauuuuaucuuuucaauguuaguauaguugugaaauuuucuguuuugcugauaaagaggauuuuaccaauauacuuuaaaauguuuaguuguuuaacucacuaucaucaaccaauagguggaagauaauaugccgauuccugauaauuucucuuaaaugauuuuccaacauccuuacguuaauguuucauggcuguaaaaguugguaugaauauuagauuguuuuagaaucacaaacauguuuuaaagauguaugauuacaaaauuuuuuugguuauuuuucuuuaauagguacuauuuucuauauauuucauggagcuccuaugaaugaaauugcuuagagacuuucaguuuuacaaagauacuuuuugaauucuguuucaucccagcuacagugcauacuaaaacuguuuucaaggagcuuacagacaacugggcagaccuuuuuuguuacuuccuuuuaaucuauacuccuccaaaauuuaccugggugaauuuuguuuuugcucaacuuuaguuauuugcucaacuuuauuccuuacauugcaguaauuuguuugaaugacugucuagagacauggagagacacggaguugcuugaggguacagugccuguagauacucaauaaauauuuguuuaauuaagaaaauuucuguuauuugugugcucauacauaccauuucagucuggugaguauuguucuuuccuagaguuuacuuuuaaucuuaaguauuuuccagguccuuuguugacuucuguuuaaaccacaguacacacacacacacacacacacacaacuuuuguguacuauaauagcuuccccaaaauuauaauuuagucauugugaugcagaucuucuuccaaggccucuacuuuggauuccuuguuauuaaucauugaugacaaaacuagaccuagcaagaaucccucuauuuuuuuacauuguuaacuacccaauugacacagaguauuuuaaguacucaugaaaauugggagacuuaagaugcuuugggguuuuacugauuuuauuguccauagguuggcuuguuuuuaagccuuucuuuuugucucauaauuuaggguuugucugauccagguaauuaucaugaauuuugucgauuuuuggcucguuuaaagacaaauuaucagcugggagaauuaguuauggugaaggaauauccugaaguuauuagauugauugcuaauuuuaccauuacuagccuacagguagguaaaaauauguaauuauguuaaacuguagccaguuuuaaaacagcuucuugguaaggguugguggggguauuugaaaaauaucuauuaauuugauuacuuugcuggaaauguucauuacaggguuuuagguaaaaaaauucauugaaauguauauaauaaaaauugagaagcuauuuaaauaucuaauaauugaauaauggcuugagaaacuauaauaaaaucuaugugaagaaauaaaauuuuuacagauuauauuauagaaaaguuuuuaaaauaauuuuaagggagagauuauaaaaccauguuuuucacaggaugucaacucugaaaaauauucauggaaugauuagagggaaguagaguaauauuuuaauguuacucugggugguaaaauaauagagauguugguuucuuuauacuuuuuugcauuuauaaauuugcuauauuauguguucauuaguuuuauaguaagaauaaaaguuaauuuaaaaauguauguuuaguaauuuuauucuguaauucuuauuguaggaagauguaauauuuuaaauaacuucugcuuuauuucuuuguagcacugggaauuugcuccuaacaguguucauuauuuauuaacucuguggcaaaggaugguagcaucuguuccuuuugugaaaucaacugaaccccaccuauuagacacuuaugcaccagaaaucacgaaggccuuuaucacuucucgguuggacucuguugccauaguugugagguauucaaaaacuaaauguuuuuguuguauuuccuuuugacacuuggaauuuuuuaagauaaaguuauaaauuuaaaauucaccccuuuuagcguacaguuguaugauuucugacaagugcacacaauuguauaacuaccaucacaauugagauauagauuaguuccaucaauccagauaguucuuuuggcuccuuuuucagucagccccucuccucacccucaucucuggcaguuacugaucuguuuuguguaccuguaauuuuuuuuuugucuuuuccagaauguuguauaaaugaaauuauacaguaugcagcuuuuuagucugauuuuuuuccacuuagcauaaugcauuugagagauuccucuguguuguguuaguacuuuacuuucauugcugaguaguauaccauuuuguggauauaucaguuuguuuaccaauucaccuguugcuggacuuuugaguuguuuauguuuuuggccauuguaaauaaaacugaugcaaauacuccugcacagauuuuguacaaacauaaguuuuuguuucuccuggguaaauagcuaggugugggauuccugggaugcauguuaaauauaguauauauuuuacuucguaaaagcugccgaacuauuuuccaaaguggcuguaccauuuugcauucccgcucacaauguaugaaagacucaauugcucuguguucucacuagcacuugauauuguuaguuugaaaaaauuuuacucauucuaauaacuauguagugguaccucauugugguuuucccuuaaugacuaauaauguugagcauauuuucaugcacuuauuuaccaucuguauguauucauugcuagugugcuagucaaauccauuucccauuuuuuaauuggguuguauauuuucuuuuuuuuuuuuuauauugagauuugagcagucuguguauuuucuucacaagucuuucuguuauguauuugcaaauauuuucuguguuguuugccuuuucauuuucuuucuuuuuauuauacuuuaaguucuaggguacaugugcacaaugucuugccacguugucuucuacaaugguugaacuaauuuacauucccaccaacaguguaaaagcauuccuguuucuccacauccucuccagcaucuguuguuuccugacuuuuuaaugaucaccauucuaacuggcaugagaugguaucucauuguggucuuaauuugcauuucucugaccagugaugaugagcauuuuuucauaugucuguuggcugcauaaaugucuucuuuugagaaguaucuguucauauccuuugcccacuuuuugaugggguuguuuuuuucuuguaaauuuguuuaaguucuuuguagauucuggguauuagccuuuugucagauggauagauugcaaagauuuucucccauucuguagguugccuguucacucugaugaugguuucuuuugcugugcagaagcucuuuaguuuaauuagaucccauuugucaauuuuggcuuugguuggccuugcuuuugguguuuuagucaugaaguccuugcccaugccuauguccugaaugguauugacuagguuuucugcuaggguuuuuaugguguuaggucuuacauuuaagucuuuaauguaucuugaguuaauuuuuguguaagguguaaggaaggaauccaguuucagcuuucuacauauggcuagucaguuuucccagcacuguuuauuaaauaggaaauaauuuccccauugcuuguuuuugucagguuugacaaagaucagaugguuguagauguguguuauuucugaggccucuguucuguuccauuggucuauauaucuguuuugguaccaguaccaugcuguuuugguuacuguagccuuguaguauaguuugaagucagguagcgugaugccuccagcuuuguucuuuuugcuuaggauugucuuggcuauacgggcucuuuuuugguuccauaugaacuuuaaaguagcuuuuuccaauucugcgaagaaagucagugguagcuugauggggauagcauugaaucuauaaauuaccuugggcaguauggccauuuucaugauauugauucuuccuauccaugagcauggaauguuuuaucaagguucauagcuuccuuucauuggguuagaauaugcuccuuuagcucggagaaguuuguuauuaccaaccuucugaagccuacuucugucaacucaucaaacucagucuccguccaguuuuguucccuugcuggugaggggcugcaguccuuuggaggagaagaaagaggugcucugguuuuuggaauuuucagcuuuucugcucugguuucuccccaucuuuaugguuuuaucuaccuuuggucuuugauguuggugaccuacagaugggguuucuguguagauguccuuuuuguugaugucgaugcuauuccuuucuguuuguuaguuuuccuucuaacagaccccucagcugcaggucuguuggaguuugccggagguccacuccagacccuguuugucuugguauuaacagcagaggcugcauaacagcaaauauugcugccugauccuuccucuggaagcuucaucccagagggucaccugccuguuugaggugucugucagccccuacugggagguguuucccagucaggcuacacaggggugagggacccgcuugaggagguggucuguucguucucggaguuugaacgcugugcugagagaaccacugcuuucuucagagcugucagacagggacguuuaagucugcagaagcugucugcugccuuuuguucugcuaugcccugccccaagagguggaaucuacagaggcugagcugcggugggcucugcccagucugugcuuuguuuacacugugagcuauucaagccucagcaauggcggaccccccuucccccgucaagcugcagcaucgcaguuugaucucagacugcugcacuagcagugaguuacggcuccgugggcgugggacccacugagccaggcacaggaggguaucuccuggucugcagguugcuaagacugugggaaaagcacagcauuuggucagaaguguacuguuucugcagauacagucugucacggcuucccuuggcuaggaaagggaaauccccugaccccuugcgcuuccugggugaggcgacgcccugcccugcuucagcuugcccuccgugggcugcacccacugucgaaccagucccaaugagaugaaccauguaccucaguuagaaaugcagaaaucacccaucuucugcauugaucucacugggggcugcagaccagagcuguuccuauuuggccaucuuggaagcccuccgccuuuucauuuucuuagcagaguccuuagaagagcagaaguuuuaaauuuugacuaaguccaaugcuuuauuuuuucuuuuauguauuauguuuuuguuguuauaccuauggaaacuaauccagggucacagagauuuuucuuuuauuuucccuucuaggaguuuuauugucuuagaauuuacauuuuagucugugaucucuuucaggcuaauuuuuguauauuaccuggcauaaggcuagaguucuucuuuuuggcauauagaugaccaguuauuucaacaucauuuguguaacagacuauccuuucuccauugaauuguuuuuacacuuuugucaaaaauuaauuuacugcauacauguaguucuauuucuggacucugucuucauuaaucuaugugucuguucuuucaccaguacccugucuugauuagguuuauaauaagcuuugaaaucagauaguaugaguucuuuaaguggcuuuucucuuucaaaauuguuuuggcaauucuacuuucuuugcuuuuccauguauauuuuugaaucaguuucuuaguuucuacaaagaaguucugcugggauuuugacugggauugcauugaaacuauagauuaacuuggggaaagaauugacaucucaacaauauugagucucuuagucucugagcaugucuaucuuuuaguuuauuuagcucuucucugauuuuucuuuaaucaaacauuuuaugguauuuagccuucagaucuugcauacauuuagguagauuuaauugauauuuuauguuuccuacugccuuuguaugauacuguuuuuuaaauuugaauuucuaguuguucacugccaauaucuacuaauacaggucauuuuguauauugaccucguaugcuaugaccuuaguuaaacuuaccuauuaguuugaguagcauuuuuguguuucuaaaaauauuuucuguuuacauaaucaugccaucuucagauauagacaguuuuauuuuuuaccuucuaauacauuucuauuuuauuuuuuauuucuuuucuuuuuucuuuuuuuuuuuagagacagagucucgcccugucaccccagcuggagugcaguggcgcaaucuuagcucacugcaaccuccgccucccaaguucaagcaauucucaugccucagccucuugcguaacugggauuacaggugugugccaccaugcccagcuaacuuuuguauuuuuagagucaggauuucgcuauguuggccugacuggucucaaacuccuggccccaagugaaccuccugccucugucuuuuauuccuuuauuauagaauuuuuauuuaacaugaaguuuauuuguggugaauaaaagugcuucacauucuaauguugucugcaaacuuauucuguguuugcagagaucacuuagaugauccacuggaugauacugccacuguguuucagcaguuggagcaguugugcacggucagcagaugugaauaugaaaagacaugugcucuucuugugcaguuauucgaccaaaaugcacagaauuaccaaaaacuucugcauccauauucugguguaacuguggacaucaccauucaggaaggucaguaaacuuuauaugacuacugaguauuauguugaauauuaaguaacaucauuaaucacuuuaauaguuuuacugcaaguuauuuuuauguauuuuccccaauuccugguccccuaauaaaccauuaauuuuauuaaccuccuggguauauugguaauuuguugguugauuuuuuuuuuuuucaguuuuccucuauaagauugauaggauauacuucucucuggaaucaauaugaagaaaaauugauaauggcccuugagcagauaguuuaugaacauaacuaucuuaacugguuguguuuucuucuuugcuauacuugauugcaaacucagaacccaauuucagccaauaaaaaguauauaauauaucauugugauuuugcuuuuagguauuagccuucguuauggcuuuacuauuauuuuuauuccucaauuucuuuauuuuguuuuuaacccuuuauugacggaggagguauuuauuucuguauauccuuuuagguccuuucaggaacauagggaguaaaaauaaauguauuuuuccaauuuucuuguuaagaugcacuacaggaauggaaauuucuaguagaaagcacuuuauaguucugaaguuguuuugcauauuuguuuaucuuguauuggaaagugaguuuaguaagagaucauaaucaaauuuacuuccagugauuucccauuuuaacuuaaaaaaauuuuuagaagauuauccuuuacauuugaauaauguuuuuuaaaaaugcguuuuauuaucuguccaucuugcguuaagucacacaguacugaugaggggcuagugugagauaaucuucucuacuucaguguuuuuuuucuuuuaugggaucuuauuuguaaauuaaauggggacaacuaacacuuuugcagcauuuagucucuucauuauugauuuauucuucuagaagaguuuugaaaguuauuaaauaucaaauucauauaaaaggauauuuauauauauugagacauacagaauagcaguaaccacaaacacuauuaccuugcuuaaagaauaggucguuugccaauaccuuugcagcaucuuuguuccucuuuccaaaucuguccucuuuccuaucaacagaaaauacuuaacaaucuugaauuuuguguuuaucaauucaugccuuuucuucauuauuaccacauguguaugcauuccgaaaauaauacaugauauugcauauuucucaacguuauacaaauggaaucauacugcauuuauucuuugacaacuuuauuaucauuucucaguauuuuauuuaugacagcucauacugaugcauauagcuauaguuccuucauuuucaguaccaugcacuguuacguuguuugaauguaccucaguuuauuugugcauucucuuguuaauagguauuuguuuucuguuuuuugcuaauaaaaucagugcuccuuaacaauuguugugauauccauuauauauucagcuuuaguagguacuguuaaacuauuuuacaaaguguuuguacuauuugacauccuaccaauaguguucagguguucccaucaaucucuaucaggaaguggcaaacuuuuucuuaaagugccaaauaguaaauguuucaggucuccaucgcaacuacucaagucugccuuuagccaggaagcagccguagaccauacucgugucuguguuucaguaaaguuuuauuuacaaaaacaggaggcugucuuauaggcuguaguuugcugaccuggaccuagauucuugccagcagcucguauuauuauaccugcauuuuugaugaucuaguugagaauaauauaccuccuagguauuuuacuuuucacucugcugauuaauaaguuuaguauuauuucauguuuauugauuguuguaucaucaucagugaaauguaugugcaucucuuuuguucauuuccaccucaccacuggauugcuuucuuucacugauuuguaggagucuuuuauguauuuugacauuaaucauuuagguuuuugaauuguaaauaucacuccaaguuugcgaccugucugcugcauaucauuuuaguguguuauucuuauuuucauaucaaacuugauuuugauuaauucacaaaaauuuuuuugaagagguaauguauuucauugugcaaaaauuaaaaaacuuaaaauguguucuguuccagugcuauacucuguccucccuuucuucacucuagcaaguaguuauucuuaguuuugcaugucuuuccaaaguuucuauaugcauauacaaagaguuaugaauauauaaauucuuaccucccuuauuugcauagaauacagcauaccauacucacugcucuacuucuugcuuguuuucauuuaguguuuuauagcuauuuucauaauauagagagaacucuuauuuuuuguagauacauacguaauauuuuacuuuuugaauauaucauaauuuaaccauuccauccacuguugacaaugauuuuagugauuuagucuuuuccuguuaaaaguauuccuguacagauaaaccuuguaugugucauuuuauguauauaugaauuuauaaauuucuccuagugaaauugccguugaguggaagguuaauguauuuguaauucugcaaauguugcccaguuguuuucuguaaggacuauaccauuuacuuguccacuagaaauguaugagauuguuuccauguauccuucauaggacaauauauauauauuuuuauuauacuuuaaauucugggauacaugugcagaaugugcagguuuguuacauagguauacacaugccauggugguuugcugcacccaucagccugucaucuacauuagguauuucuuggaauucuuggcaauccugugugugaaaaaugguuuuucaguauaauuuaacuuugcauuuuucuuaucagugagguugugcauuguuuaaauuuacauaagagccauuuggccuuuuuuuuuguaaaugaacaauucauuuccuuugccauuuuucuauuggguuguugguccuuuuuuucuccuugauuuuuaagagcuuuuuacaguuaggaaagugagcuccuugggugugaucagaguugcaaauaucuuuuuccuuuuuuucuuugcauauguuuuagagauucaaauauggugagcauauuuuguuucuuuuuguuguugcauaguauuccauaguauugccuuaccauaguuuauccauucaccagcugauggacauugaauuacacuuagaguuuuuggcuauugcaaauaaugauguuauuaacauuuuuagacaagucuuuguauguagaagaaauuuucauuucuuuuggauagguaccuaagaugagugcugggucauaugguaaauguauguuuaauguuguaagauacuacuaaacaguuuuaugaaguggauguaucauuuuucauucccauuaacauuguauaagaguuucacuuacucugcaucccugccaucauuugccaucuguuuaggcacucuacugggugucuaguguuaucucacugugguuauaauuugcauucccuaaugauuaaugauguuaagcaucuuuucuauucuuuuuugccacuuguauuucuuauuuugugaaaagucuguugcccauuuuuaaauuggauuguuggcucuuuuguauguguuagggaauugcaagagugcuuuauaugcucuguauucuguauacaaucucuuuuucacauauauguuuuacaaauauuuccucccagucugugguuugucuuaacuauuuuucaaaggugaaaaguuuuuaauuuugauggucuacuuuuucacuuuuuucuuuauggcuugagguuuuuguauuuaugaaaucuuuucuaaccuaaugcuaugaagaguucuaugauuucuguaaguuuaauaguuucagcuauuauauugaggccugugauccauuugguguucauuuuugugaauguugugaguuaagggucaaggcuuacaguuauccaguuguucuaacaccauuuguagaaaagaauaucuuucucccccauugaaucacuaugacaccuuggucaaaaaucaguugaccauaaaaugcuagagucuauuaguggacuuuuuguucuguaccacugaucuauauauguuuauccuuaugcuaauacuauauugucuugauuacuguagcauuaauaauucuugaaaucagguaauacaaauuauuuaaccuuuuuuuuuuuucaaaaccguuuggcuauucuaggucuuuuggcuuuacuaauuaauuuuagcaucagcaucucaguuucuucaaaguaggugcuagcauuuugauaggguuugccucaaucuauacaucaguuugggccagguuaacaacauugaggccugcaguucaugaacauuuaguuuucuuugcaauauuuuauuguuuucaguguacaguuagugaaauuguucacugaguuuauuccuauguauuuuugaugcuauuguaaauuuccugauuauucucugcuacucuauuaaaccagaauugaauuuugucuuugugucuuauaacuuugcuuaauuuauuaguucuaauaacuauuucauagauucuuaggauugucuaugugaucauguugucugcaaauaaagauaguuuuaugucaucuuuccagucuccaugccuuuuguuuauuuuucuugccuuauucuacugagggcuuccaguacaguguugaauaaaauguuaagaaggggacauucuugccuuguuucuguuuguaaauagaaagcauugagcauuuuacuguugaguaugauguuaucuguacgcuguuugaagacguucaugaguuugaggaaguucucuucaauucuucaggguguuuauaaugaauaacguauuauuuugggguuuuaaaauagaccuuuuaugcaucuauucaaaugacuuuuuuccuuuauuuuacgaauguagugaauuauauuaauugauuuuucgauguuaaaccagcuuugcauucucaggauaaauccuacuuggucauaauauaauguuucuuuagaaauuguuaaauucaauuugcaacacuuuuguuauuuuauaucaguguuuaugaaggauauugguuuguaguuuucuuguggugacuuugccugguuuggguaacaugguaauacuggcuucauaaaaugaguccgguaguguuuccucuuccuccucuaucuugugaaagaauuuguguaguauugcuauuauuucuucuuuaagagggauagaauucgucugugaagccagcgggccaagaggguuuauaauugugaauucauuuucuuuaaucagcauagaacuauucaaauuuucuguuucccuuggggucaaauuuagucauuugugucuuucaaggaauuuacucaauguuucaauguauuggaauaaaacuauucuuaauauuccauuguuauuaauaucuccagaagcugaaguugagauugauaauuuugucauuuuuuucuuuuguucugagugacccaacuagauuuucaucacuuuuguugaucuuuuuagagaacuauuuuuaguuucauugaucuuuauucuuucuucauuuucuauuucacugauuuuuuuucgccuuuauuauuuucugccuuauacuuacuuuggauguuauuugauauuccuuuucuaauucugggugcagacugcagaucuuugaguuuuagauuuuuggacuuuucuaauaaaaacauuuaaagcuaucaauuuuucuuuaaacauuacuuuaguuguuuaaacauuacuuuaguugcaucccacgaguuuuguaguuuuauuauuacuuuuuucuaaucuuuuuauuauuuuuuauuuuauuuauuuauuuauuuauuuuacuuuaaguucuaggguacaugugcacaauguucaguuuuguuacauauguauacaugugccauguuggugugcugcaccuguuaacucgucauuuacauuagguauaucuccuaaugcuaucccuccccgcuccccccacuccccggcaggcccugaugugugauguuccccgcccuguguccauguguucuuauuguucaguucccaccuaugagugagaacaugccguguuugguuuucuguccuugggauaguuugcucagaaugaugguuuccagcuucauccaugucccuauaaaggacaugaacuuguccuuuuuuauggcugcauaguauuccaugguguaugugugucacauuuucuuaauccagucuaccaucauuggacauguggguugguuccaagucuuugcuauugugaauagugccacaauaaacauacaugugcauguguccuuauagcggugugauuuauaaucauuuggguauaugcccaguaaugggaugacugggucaaauguuauuucuaguucuagauccuugaggaauugccacacugucuuccacaaugguugaacuaguuuacagucccaccaacaguguaaaagcguuccuauuucuccacauccucuccagcaccuguuguuuccugacuucuuaaugauugccauucuaacuggugugauaugguaucucauugugguuuugauuugcauuucucugauggccagugaugaugagcauuuuuucauaugucuguuggcugcauaaaugucuucuuuugagaaguaucuguucauauccuuugcccacuuuuugaugggguuguuugauuuuuucuuguaaauuuguuuaaguucuuuguagauucuggauauuagccuuuugucagauggguagauuguaaaaauuuuucucccauucuguagguugccuguucacucugaugguaguuucuuuugcugugcagaagcucuuuaauuagauccaauuugucaauuuugucuuuuguugccauugcuuuugguguuuuagaaaugaaguccuugcccaugccuauguccugaaugguauugcuuagguuuucuucuaggguuuuuaugguuuuaggucuaacauguaagucuuuaauccaucuugaauugauuuuuguauaagguguaaggaagggauccaguuucagcuuucuauauauggcuagccaguuuucccagcaccguuuauuaaguagggaaucuuuccccauuucuuguuuuugucagguuauucaaagaucagaugguuguagaugugugguguuauuucugagggcucuauucuguuccauuggucuauaucucuguuuugguaccaguaccaugcuguuuugguuacuguagccuuguaguauaguuugaagucagguagcaugaugccuccagcuuuguucuuuuugcuuaggauugucuuggcaaugcgggcucuuuuuugguuccauaugaacuuuaaaguaguuuuuuccuauucugugaagaaagucagugguagcuugauggggauagcauugaaucuauaaauuaccuugggcaguauggccauuuucaugauauugauucuuccuauccaugagcauggaauguucuuccauuuguuuguauccucuuuuauuucacugagcagugguuuguaguucuccuugaagagguccuucacuucccuuguaaguuggauuccuagguauuuuauucucuuugaagcaauugugaaugagaauucacucaugauuuggcuaucuguuugucuguuauugguguauaggaaugcuugugauuuuugcacacugauuuuguauccugagacuuugcugaaguugcuuaucagcuuaaggagauuuugggcugagacagugggguuuucuaaauauacaaucaugucaucugcaaacagggacaauuugacuuccucuuuuccuaauugaauacccuuuauuucuuucugcugccugauugcccuggucagaacauccaacacuauguugaauaggaguggugagagagggcaucccugucuugugccaguuuucaaagggaaugcuaccaguuuuuguccauucaguaugauacuggcuguggguuugucauaaauagcucuuauuuuuuuugagauaugucccaucaauaccuaguuuauugagaguuuuuagcaugaagggcuguugaauuuugucaaaggccuuuucugcaucuauugagauaaucaugugguuuuugucuuuggcucuguuuauaugcuggauuacauuuauugauuugcauauguugaaccagccuugcaucccagggaugaagccaacuugaucgugguggauaagcuuuuugaugugcugcuggauuugguuugccaguauuuuauugaggauuuuugcaucgauauucaucagggauguuggucuaaaauucucuuuuuuuuuguugugucucuaccaggcuuugguaucaggaugauguuggccucauaaaauaaauuagggaggauucccucuuuuucuguugauuggaauaguuugagaaggaauggaaccagcuccucuuuguaccucugguagaauucggcugugaauccaucugguccuggacuuuuuuugguugguaggcuauuaauuauugccucaauuucagaaccuguuauuggucuauucagggauucagcuucuuccugguuuagucuugggaggguguauguguccaggaauuuauccauuucuucuagauuuucuaauuuauuuguguagagguguuuauaguauucucugaugguagucugcauuucugugggaucaguugugauauccccuuuaucauuuuuuauugugucuauuugauuccucucucuuuucuucuuuauuagucuuacuagcggucuaucaauuuuguugaucuuuucaaaaaaaccagcuccuggauucauugauuuuuuugaaggguuuuuugugucucuauuuccuucaguucugcucugaucuuaguuauuucuagccuucugcuagccuuugaauguguuugcucuuccuucucuaguucuuuuaauugugauguuagggugucaauuuuagaucuuucuagcuuucuccugugggcaguuagugcuauaaauuucccucuacacaaugcuuuaaaugugucccagagauucugauauguugugucuuuguucucauugguuucaaagaacaucuuuauuucugccuugauuucguuauguacccaguagucauucaggagcagguuguucaguuuccauguaguugagcgguuuugagugaguuucuuaauccugaguucuaguuugauugcacuguggucugagagacaguuuguuauaauuucuguucuuuuacauuugcugaggagugcuuuacuuccaacuauguggucaauuuuggaauaagugcgauguggugcugagaagaauguauauucuguugauuugggguggagcguucuguagaugucuauuaggucugcuuggugcagagcugaguucaauuccuggauauccuuguuaacuuucugucucguugaucuguguaauguugacagugggguuuuaaaaucucccauuauuauuguacgggagucuaagucucuuuuuaggucucucaggacgugcuuuaugaaucugggugcuccuguauugggugcauauauauuuaggauaguuagcucuucuugcugaauugaucccuuuaccauuacguaaugcccuucuuugucucuuuugaucuuuguugguuuaaagucuguuuuaucagagacuaggauugcaaccccugcuuuuuuuguuuuccauuugcuugguagaucuuccuccaucccuuuauuuugagccuaugugugucucugcacaugagaugggucuccugaauacagcacacugaugggucuugaauuugauccuguuuuuaugauguuagcugguuauuuugcucauucguuguugcaguuucuuccuaguauuggucuuauuuggcauguuuuugcaguggcugguaccaguuguuccuuuccacguuuaguguaaggcaggccugguggugacaaaaucucucagcuuuuguuugucuguaaaggauuuuauuucuccaucacuuaugaagccuaguuuggcuggauaugaaauucuggguugaaaauucuuuucuugaagaauguugaauauuggcccccacucucuucuggcuuguagaguuucugccgagagaucugcuguuagucucaugggcuucccuuuguggguaacccgaccuuucucucuagcugcccuuaacauuuuuuccuucauuucaacuuuggugaaucugacaauuaugugucuuggaguugcucuucucaaggaguaucuuuguggcauucucuguauuuccugaaucugaauguuggccugccuugcuagguuggggaaguucuccuggaugauauccugaagagugguuuccaacuugguuccauucucccugucacuuucagguauaccagucagacguagauuuggucuuuucauguagucccauauuucuuguagacuuuuguucauuucuuuuuacucuuuuuucucuaaacuucucuucuaacuucauuucauucauuugauauucaaucacugauauccuuucuuccauuugaucaaaucuacugaagcuugugcaugcaucacguaguucucgugccaugguuuucagcuccaucaggucauuuaaggacuucucuacacuguuuauucuaguuagccauucgucuacucuuuuugcaaggguuuagcuucuuugcaauggguucgaacauccuccuuuagcuuggugaaguucguuauuacugaucgucugaagccuucuucucucgaaucgucaaagucauucucuguccagcuuuguuccguugcuggcgaggagcugcguuccuuuggaggagaagagacccucugauuuuuagaauucucagcuuuucugcucugguuucuccccaucuuugugguuuuaucuaccuuuggucuuugaugauggugacguauggaugggguuuugguguggauguccuuucuguuuguuaguuuuccuucuaacagucaggacccucagcugcaggucuguuggaguuugcuggagguccacuccagacccuguuugccuggguaucaccagcugaggcugcagaacagcagauguugcugccuaauccuuccucuggaagcuuagucucagaggggcaccgggccuuaugaggugucaaucgccccccuacugggaggugccucccaguuaggcuacucgggacucagggacccacuugaggaggcagucgguccguucucagaucucacacuccaugcugggagaacuacugcucucuucaaagcugucagacagggacguuuaagucugcagaaguuucugcugccuuuuguucagcuaugcccugccccuagagguggagucuacagaggcaggcaggccuccuugagcugccgugggcuccacccaguucgagcuuucuggcugcuuugcuuaccuacucaagccgcagcaauggcucaagccccuuccccagccucgcugccgccuugcaguuccaucucaggcucuugugcuagcagugagcgaggcuccgugggcaugggacccuccgagcuaggugcaggucauaaucuccuggugugccgucugcuaaggccauuggaaaagcgcaguauuagggugagagugucccgauuuuccaggugccgucugucacagcuucccuuugcuaggaaagggaauuccuggaccucuugcgcuuccagggugaggcaaugccccgccgugcuaggugggcugcaccgacuuguuuggcaagcccuagugagaugaauccgguaccucaguuggaaaugcagaaaucaccugucuucugcgucagucucucugggagcugcagacuggagcuguuccuauucggccaucuuggcgccaccaagccgcuguuuuauuuuuauuuucauuuaaagauaauuucuaauuuaauuauuauuucuuuguucuuugugauuuauggauuauuuagaagugugcuuuuaaguuacaaauauuuagaguuuuccuaguuauuguuacugauuuuuaaauuuuaccuaccuuggucaaguaucauuuugugugauuucagucuuucuaaauuuauuaagacuugucauaugacccagaauauugucuguccuggcaaacguagcauauacacuugaaaagaauauguauuuugcuauuuuuggguguaauauaaauauaaauuaagauaauguucauauauucuuugucuuuauugauuucuuuugucuguguaauuauauuguuugcagagagagggguguuaaaucuccaguuaugauuguggaauuguuuauaaucuaauuccuuaaauuuuuguaucauguaaacauuugugauuguuaugucuuccuuauugaccuuuacucuugaaaucuaucuuaucugauauuacuguaaccacuccacugucuucuuaugcuuacuauuuauguaguauaucuuucuccauccauuuacuuccugccugccugugucuuuauauuuaaagugugucuuuuguaggugguaaauaguuguucccuuuuaaaaaauccauucugaccaucucuuuuuacuggaauguuuaguucauuugcuagguggaggacaccaacuuaauuccauuuaaauuauuuccuuagaaugggaguuucauaucucauuuucauaucacacugguagucuguauguaguccacaaaccaugugaggucugacuuaaagguuuuuuccuccucuucaguuagcacugaggucaagucagacagguuucugucuugucuuucuguuuagggcagauuuuuuuuacccaguuuguauuuucauuugggguguaacucuuugcaucagcuuuuuuggacuucucacauugggccuguccuaggcuuuuuccuuuggccauuagaggagaagcucaaacucuaguuguuucugugccuguaacucuaaauuucagccuucauauuauuuuuggacauugaggaucauuuuacucuucuaccagcucaguaguacauuugguaccuuugugcaaauuagaaaaauguuccauuucauccaggccauugcaacaacaugcuagaguaaauagauuggugggcagaauauaggcuggauuucaguccuaacuuguccuuucaguugaguaucuuuacaggugacccuguaagcuuguguuguagugcuguuuuuguuuugacugaugacacaugacaaucuuuugucauuucagauuuguguucugugugcagacauuaauuuggauuauguuauuuuauaauuuggauuguguuuagccagcuaucuauaaaauuacauuuaaaaaauauauagcacagacaauuaguguuugguucuucaaaaguaaagaguuaguaauaacuuaaguguggucaacuacauccucugaaaggccuuuuagcugcaaaauaaucagauccugggcuuacaguaaguacgugaaauuucuuagguuuuuauuuuucuucccacuccucugcucucugauucugugucucuccuuucucugaccuccucccucccagccucucccaucauccagaucaaaaagugaacuuuaaucggggugggacgggucaaacagcaaacaagggcaaaaagcaggguugcucucaaagacagauaauaaauaucaaugaugaaauucgugacaaagccuuaggccgguagcaagauagguguaccaaccugagacucuuguauuaaguugaacccucaaaaggguauaaaaugguuuuaaauugguagauacccuggcuuccagcagaagggaaugaaaaccucuuccaaaggaucaaccauaauuuagggccuuggaaauccugcagauuaaguuaaacaaguguucauaguaaacaaaaacaauaaaagccagcacauaaacaaugaaguaagcugccaugaaugagcacuaacaaaaauaaguuaucuauuugauuuagaaccccuaucuccuaaagacucuuaagauguuggaauuggauaggaauauaaagcaauuaugugcgaaauaguuaaagaaauaaaaaauagaaucacaaaugagcacauaacaggagugugaaaaacaaccaggaggauaugaaaaggaccugaaaaaacuuuuuuuauugaaaacuuugugaucuaaaauuucauggauguguuaaacaguaaauuggacccaacugaggaaagaguuggcuaacuggcaguuagaacugaagaaauuuucaagacugcaggaaaaaaggaaaaugaaaauauuaaaagagacguuaaaggauggaaugaggucagguaugucaaaaugagucccagaaagauagaauagaggaaggaggagaggugauaacugaagaaauucugagaauuuuuuugacuuaauagaagacaugaguucaucaauacagcaagcccaacauauacccaucagaaacagaaaaacaaaacuuuagucaaacuauauaaccccaaagacaaaauguuaaaagcagcuggagaagaaagaucacuuagaaaguaguguaaacuggacugauaacucaacuucucaacaguaaaaauggaagccagaagguguuagaauauuauucucaaauaacugagcaaaaauaacugccaggcuguuauuguauaucagcaaaaauaucuuucgagaaaaacgauauacaauagagauuucagacaagugaaagcagaacguuuucuacuagccgaucuuucauuaaagguuuuuauuaaacauuuuaaagguuauuuucgaggaagaaggggcauggucccagaaggaagaaaaggaguacauggaaauugguaaacucaaaaauuuuauuuuauuuauuuauuuauuuauuuauuuauuuauuuauuuauuuaagaugcagucuugcccugucaaccaggcuggagugcaguggcgugaucucaguucauugcaaccucugccucccaaauucaagccauucuccugccucagccuccagaguagcugggacuacagucaugcaccaugccgggcuaaauuuuuuguauuguuuuaguagagacggaguuucgccauguuguccagguuggucucgaacuucugaucucaagugaucugcccaccucggccucccaaaaugcuaggauuacaggcaugagccaccgcaccuggcuguaaacacauucauuuuaacauucauagucuguacaaaauaaggauuauguguaauuuguggaauuaagaacagaauaaaaacaugaaaagacagaagcaugucagagagagagucgggggagugaugagaauuaaaauuauuuuaaguccuugucuuauuuaggaagggaauuaaaauggcagcacuucaaggguaacaacuaaaagaguagaaacuguaugauugucucccauaacccagcaaagagaaaauaaugaaauagaaaaauaagcaaauucaauuuuuuuaaaagccaagaaaggaaaauaaccagagacaauaggacaauagacaauaaaaaaaugguaggaguguuccagauauguuauuaauccaauaaacauaaaugaguuaaauuuacaguuaaaccagauuauaaauuugaauauuuuaaaaauagccaauuaauuauaaguuacauacucaaaacauuaaaacauggaaaguugaaaguaaaaggauuuuuuaaaaugugcuaugcaaauaugaacguauaggaggcuaggaucauuguuaauaucaaacaaaaaugacuugaagagaaaaagcauuauuaaaacuagagcuaauaguuuguguaccaggaagguacagguugagcacaccaaauucaaaaaucuggaaucugaaaugcuccaaaauuuaaaacuuuuugagcacugacaugaugcucagaggaaaugcucauucaagcauuaagaauuucggauuuuuggaauugucauugucacccaggcaugcaaauauuccaaaaucugaaaaaauucagaacugagagcacuucuggucccaaguauuucagaucagggguacucaaccuguauaacaauuuuagauaucuaguacuuagugaaguaguaucaaaacauaucaagcaaaaauugauagucgugcagggagaaauggacagacuugccaucauaauggaaggcugcaguacacuucuuaauuguuggcauaucaaauaaguagcaaguuaguaaauuuaggagggauuugaacaaugugauuaacagacuuuaaugaauugauguauauaaaacacuggaaccaacaguuugaaaauaccaguuuucuccagggcacauggcguguuuuaaaaaaaauuguccaagcauuagcauaugaagugagucucagcaaaugucaaugacucagugucauagagaccacuuuuuuuuuuuugcaguguaguuuuaauugcugauugguuaaaaaaaaacuaaauugcaaaacaaaacaaaaaccccacaaaaccccauacacuugggaauuuaaaacauauacuuguaaauaugagguaaaagaaaucuugaggaaaauuuuaaaauagaguuaacacauaauacagaaauacaacauuuuuggaauauagugaaagacuuaauucaaaggagauuuauugaccaaaaagcuuauuuagaaaagaaaaaaggccagaauguugggaccuaagaaucuaacuugagaaguuagaaugagaggaacagauuaaacccugagaauggagaaagaaggaaacgaagcagaaauuaaugaacuaaaaaauaaagauacaguagaauuaaaaaaucagaaguuagaucuuuaaaaagacaagaguaacaaaccucuugugauuaggaagaaagaauucacaaauauauacuauuaggaacaaauagaggaaauuuaauaauggauacagcaaagauuuaaaagguaaaaucauucuugcuauuuccagaggucaauaaaugaggaaaugaauaaauuucuagaaaaaauacuaaaauugacuuaaaaaagagacaagaauuuagaagauguuugcaacacacacuaagcaagaaucaccaucuacaagaauaugggaagaauucuuacaaaucaguaaaauaaacaguucuuuaggaaaaugaucaauagcaaauaggcaucuggcagaaaaacauaaauggugcauauacaaaaaacccaacuucauuaccaauaaaagaaguagaccacaugaaauauauuuuccugucuacugggaauaaaucauaagaaaucuuacagaaaaaugugagucaaaaggaauucuuauauacuucuggugggaguauaaaguggaaucaguuggaaauggaauagaaaugaauuugguguagucuuguaaagcagaacauuugaauacccauugaccugacccuugaaccgucacauguguccucuagaacagggguccccaaaccccaggccaugaagcgguacugguucauggcuugccaggaacuggguugcacagcaggaggcgagcggcaggugaacaagcauuacugccugagcuccaccuccugucagaucagcagcggcauuagauucucucauaggagcgugaacccuauugugaagugcacaugcgagggaucuaaguugcacacuccuuuugagaaucuaauguguauaaugccugaugacccgagguggaacaguuucaucccaaaaccaucaccuccccuuccuccccaguccguggaaaaauuguauuccaugcaaccugugccuggcaccaaaaagguaggggacugcugcucuagaaaaucuguacacaaaauguacaauaauauucauagcauuauuguuuauaaugucaaaaaguggaaacagcucagaugcucaucaauaugaagaugaauaaauagaucauaauguaauuauacaauauuauauaaaaaaaugaaugaacuauaccuagugagugucagagauaagauguuuaaugaaaagcaacucucaggaagcuacauacagcaugaaacguaauaaagucuccaaacaaaugagacuugaagugucuuguuuaggaauauauguauaugugaggaagcuuuaaaaaaucaaaagaauaauaagcauuaaauauugacucaugcuuacuucuaggguggaagguaaggggacaagcucgggaaugguauggagguagaugugacaguauugcuaaugcauugauuguucuacuggguagguguuuguuuuguuacacuucauaugcguuacauauauguuuucauauauaucaauuauuacauuaaaauguaaacagauucaguuggaaaagaccuauuuuccuucaaaaggauauugaaugaagauaugaauguuuuaaaauacaugaaucaguuaguugaaauguaauaauuuagugguauuacauaggacuaucucuugaauaaaaugccagaccucauucuuuguuaauauaaaccgaaggaguuuuuauaguuggauacacuaugcaguuuuaguaaaauaacauuucagagucuguaauauaaugccuaguacuuagaaaauuuuuaauaguauuagucaaaaggucagugggaaagaaucugucugcccuuuuagagauaucuguggucugcucaaaaugaucauuuuauauuaugaaaaaugccuaacauggcccuaguuuguauacacuguguguaguaguauuaguuuuuuugcgugugugaacacuucaguuaguguugaacaaagaaaauuauaugcucuuguuaugugugcuuuaauuuagaugcuuaauggcuuuuaauguuacaaaauaaguuuauuauuauauuaugaucucauuuguauuauauugucucgcucuucuguauuuguggugauauggucaugguuuacgaaaacaauaauccguaagaaauaggucauuaacaguaguuaacguuuacuugugaucuaugguaaugacugauuucuuugggauuacugcaguuauaaaccauaauuacagauuauuacagcaauaauuauuuuguuaaggaaaaaauguucuauguuugaacagcugcuaaaacaagcacccugaacauuucaggauaaauagaaaaauggaaaauuauaauggaaauuuaguauuauuauaaaaugagauuuaaaaaaaauuauagauaugaaacuuauguagcagauuuuuuucucuaaaugcaauuuagauacguguauuuacaugguucuuuaaauuuugugaauguaauuauguuaccaaaauaacauuuuuuguauauauuuaagguguacggcaugauguuuugauaaauacguagcgaaaugacuacuacagucagccaaauuauccuaucaccuuccauaguuaccauuuuuaaaauuuuugugguaagagcacuuaaaaucuaaucuuuuagcaaauaaaguauuacuaacuauaguccucaugcuguacauuaguagacuuacuccuccuguacaacugcaaguuuguaccauuugaccuaauuucuaauuuccucccuuuccuuaccucuaguaaccaccauuuuacacucuguuccuauguauucuaccuuuuuuuaagguucugcauaugagugagaccguauaguauuuuucuuucuguuaguagcuaauuuccgaaaguagcuucuuaacauuuacuguuuugaacacugugagucuaaaauuguucaggguuaggaaauaguuuaacguuuaugagaaauacuguuucucuuucaucuaaauaucaaaauuguauuugacagcuuaauaagaacgucuuuuuuugagacagggucucacugucaccuaggcuagagugcaguggugcgaucucggcucacugcaaccuuugccucccagguucaagcuauucucccaccucagccuccugaguugcugagauuacaggcgcaugccaccaugcccagcuaauuuugauauuuuuugguagagacaggguuuugccauguuggccaggcuggucucgagcccaugaccugaagugaugugccugccucagccucccaaagugcugguauuacaggcgugagccacugcaaccagcuccaauaauaaugucuuuauauuucacuguucaucucuaacauuaauucuaacucauucaguacuugcucgauuuuuaagguuuaagaaauaucuucuuuucauuucucauacaauagaaaccauugcuuucuaaaacagaguaaauauguacucuauuuuucucuaaguaaacuuccuuucaaaauuuacuguaauuuuagaagaaaaugcucauaauuaaucacaugcuaucuuugcacagcauucuuugaucuaauaaguuuaauuccaaggucacagaaauuaguacaaauuuaaauuuugagaaauucacauuuuauauuuagauacuuuacucauucuguuuuuaaacaauggugcucaucauacugcauugcaaaaauuauugauuuuuuccucuaucuuaucugucucucacuaggcucaguucccugagcauggagucucucucuccccugccccagccuuucccauacauuuguguauuuaguuauaucccuagcacagaacaugauacaaaguagauacuuacagcagauguuuuucuggaaugucuuuuacuuggaauuuuuuuuuuuccugguuggaggguguuuguuuuacuaacagcauuagaaaguguauauggcuagucguaacuagcuuuaauuguaauaagccucuuugguagagaggaaagaacuuaaaaauucuuauugugugacuucauuuucuugagcagcaucugacguaaggcacagaaagaacauggauguuacauauugguaugucuuauguuuuuuuguagguaugauacagaaccacguuaaaaaggggaugacaauuuaauaauaguuacacuagccaacauuuacugagcacuuauagcacuuacucauauauuuuacaugcaaaauaccaguuggugcuugucacaacucuaugggccagguauuauuauccuuguaagauuaaguagccuaguguaaauaaguacuagaggcaggauuugaaccuaggcuguguucuuauuagcuaaauuguacugcuucccuuuuuuuaaaacaaauauuuaucuuccaguagagaaauauaaaaaauuacaugcacggugaggucuuugucuguuuucagguaggcauguuuuaucaagggcuaauaggcagguauuucuauguuuacauuauugguaagcccaaaaaauuaagcuugcuuauuuuaaauucagcuauaucaacaaguauucauuuuaugugucuuguuuugggaaucaaaaaaagugugaaaugucuccuugguaaugauccccaaagcauaugcagucucaucugugauaaagacucaggagacagcuaaagaacaguucaggguuaggacucauaauguguuaaacgcuuaagagauuguuggauuauaagauacuguuggaucuugaaggucugucuagcuaauugacaacuguauugcuggagcauucccuuuuaccaaucuugagaggaaguauaauaguuugagaaugaacuuuuggaaauucauugccuagauuucagucacagcucugcacuuuuaaauagggacuuguaauauuaaaugaauauagauacaguacuuagaacagugccuagugcagaguaacuacuauauaaauguuugcuauuauuuuuaauaguaauaaaggcuuguuuuaagaaaccaguaucuaaaaaucuaaauugauaaaacauaacaggaagguaauuauuuacauuuaaguguuuuucauuuugagaaauaauuuacaauaggagauuuuaaaaagaaugacuccuacagagagucauuacauaugcauucaccaaaagucaugcuugcaauguuuuagauucacauccauuacaugaaguguauaacauauccuacacacaauuggagcauagucuguuaauagcgaccucuguaaaauucuaagaaauacuacuaauugucauuguuugguaguuauguuauauaaagucgcugugaacaauaaauuagcaaauaccgaaccauugcuccugugggccucugaccacaacauuuucaucagcuaaccaacacaugaccuuuuuuuaaguauguuucuguagaaagacaccuuauucaguauauauugucgauuuauugacacugaacucauagccagcagcacuauuuuucaugcuggaacaaagcuuaucuaacauguguuuucuauauaagacacauaacaagcuuuuuuucuuuaggaacacugcauagcauuucagcauuaugcuuagaucaucuuaaacagugaaaucacuaacaaaaaacacaaaaauguggcaguagauagaccauuaaaaacauacuuguuuacauuaugaagcugaaacaagaagguagaguuucacuuuguuugcucugagcuugaaacauguguacuggacaacuacagauuuucacugcuuugcacauuagcaggugacugagaguauugauuuugggauuauaaauaaauuuuaucaaguaggcaaauucacaaauaauggaaucugugaauaaugaggaucaacuauaucauaucuuauauugaguauuauuggagaaguugcuuuaauuuaagcaauagaaauauaauuacuauuaccauucauuauuaauaaugggucuacauuuuaauacauuuauuaaauugguaauguuaaccuuuccuuuccuuuuucaugccauguuuucuauauaaugauuucuuaauucaguaacccauaucuguugauaauguauaauauacccagcguuguuuuaggcucuggagauacaauagagaacaaaacagacaaaaauaccuguuuucaugcaguuuacauucuguuggaauacacagguaacauaaaagauaaguauguaaaauauguuagaaaauguuaagugcuaagauuuaaaauaaugaagcaaggaaagaagauaggaaaugcugggggggauuguauuaucuauuaccagaacuuaauggcuuaucagguaacaauugcauuauuaucucucaguguucuggggguugauaagucucagaugguucucuucaggggucuuucagucauuguaaucagaugacagcuggggcuggaguugccugaaugcuucuuuacucaccugucuggugugugugcuggaaugcuuagaguguauacucuaucuaguugggcauuucucucucuguucaaucucuccagauggcuaguucgggccuccuaauaguauaauggucucaggguauauggucuucuuaaaugguggcaggcuuccccagagugaacauucucugagagacuggaggaauuugccaguucuuguaaagguuaggcacaguacuaggauggcgucacuuucaccaaauucuauuggucaaagcaguuacaaauuuccaaagauuggaagaauaaacuccaccucuugauggcauauacauacauggaaggaauuggugaugaguauuugaagacagacuaccaugcuaaguauugaaaauugauaggauaucuugguaaggucugagaaggugacaucaaguaagacuggucagcauaguuguaucuuuccccaguuauauuaaacugugugaguacuggcaaagaguagugguguaucggacauaaacagucaugguuuuguaagaugaguauaucauagcaaaagaggagcuaaauguaagugcaaggcagagaugauaaugauugaccauauaauuaaagcuaaguaccuaggauagauaauaugugaaggguauaagagagagugaaaaaauggcagauucccaaaaacuaauaaaagagaucagcaaacuugcaggauacgggaucaauaaauaaaaucaaugguaugucuauuuuuuaacaaucagcaauugaauaugaaaggaagaaaggaaguccauuuauaguauuaucaaaaaggauaaaauacuuaggcauaaauuuuaaaaagaaguguaagaauuauauaccgacacuguaacaguguugaaagaaauuaaagauauaaauaaacagaaagacuucucaucgucguggaucagaagacuuaauauuguuaagauggcaguacucuucagauugaucuccaaauccggugcaauccacuuuaaaaucccauggguuuuuugcagggauugacaaacuguuccuaaaguucauauggaaauccaugggacccaaaauagccaagauaaucuuguaaaauaaugaaauuggaagacucauauuuuuuuuuauuucagaauuuacuagaaaacaacaguaaucaagacuguuugguaccagcauacagguagacagacauauaggaccugggugcgguggcucaugccuguaaucccagcaguuugggaggccaagguaggaggaucacuugagcccaggauguucaggaacagccuggucaaccuagugagacaccucaucucuacaaaauauuuuaaaauuagguagcuauguugaugugggccugugaucccagcuguucgggaggaucacuuuugccugggauuuagaggcugcagugagcuaugauuuugucacugcccuccagccugggugaccgaguaaaucuuaagugacuuuggguugggcagcuauuucuuagauaugacaccugaagcagacaacagaaaacaaauuagauagaccagaguuuaucuaauuaauuagacaaauuagauaaaacagaguugcaaauuuugugcaucaaagcaugccaucaagaaaguacagcccacagaaugggagaaaauauuugcauaucauaugacugauaagagauuagcaucuagaauacauaaauaauuauuacaacccaguaaugaaaaagacaacccuuaaaaaugggcaauggauuugaauagacauuucuccaaagaagacacacaaaugaccacuaaacauaugaaaggaugcucaacauccuuaguuauuaaggaaaggcguaucaaaauuauaaugaaauaccuccucacaccaacuaggauggauauaauaaaaaagaaaacuacaaguguuggcaaagauuuggauaaauuugaucuucauacauugcuggugggaauguagaauggugcagccgcuuuugcaaacauuauggcaguuccucaaaaugugaaaaguagaggugccauguaacucagcaauuccacuucuaaguauacucaagagaaaugaaaacauacauccacauaaaaucuuguacacaaauguucauagcagcauuauuuauaauagucaaaagauggaaacaauccaagcuuccaucaacugaauggguaaaugaaaugugauauauccauaguaaccaaaacagcaugguauugguauaaaaacagacacauagaccaauggaacagaauagaaaacccauaagucguauguuuacagccaauugguuuuugacaaaggugucaagaacauacauuggggaaaggauacccucuuuaauaaaauggugcugggaaaauuguauauccagauguggaagaauaaaacuggacuucuaccucuuaccguauacaaaaaugaaaucuagauggauuagacuuaagaccugaaacuauaaaacuacuagaagaaaacauggggagacacuucaggacauuaaucuaugcaaauauuuuauggcuaagaccucaaaagcacaggcaacaaacauaaaaauagacaaaugggauuauauuaagcuaaaaagccccuucacagcaaaggaaacagucaacagagugaagagagccuguugaaugggagaaaauauuugcaaacugaccagggaggaauagaauaugcaaggaucacaaauaacaguaaaaaaaacaaaaacaaaaaaaaaauaacucaaauaaguggcagucaaaugacaugaauagacauuucucaaaaggagaacauacaaauggccaauagguauaugaagaaauacuuaacaucacuaaucaucagggaaaugcaaaucaaaaccgcagugagaugccaucuuaccccagucagaaugauuauuauuaaacagaaaaaauaacagaagcuggcaaagauguggauaaaagggaacucuuacacacugguggugggaauguaaauuaaaacagccauuauggaaaauagggagauuucucaaaaaugaaaaauagaacuaccguauuguccagcaaucccaauacugggcauuuauccaaagggaaagaguucaguauguuaaaagaauaccuguacuuccauguuuauugcagcacuguucacaauagcaaagauauggaaucaaccuacauucccguugauggauggauaaaauaaugugguauauauacauaguagaauaccguuaggccauaagaaagaaugaaaucgugucauuugcagcaacauagguggaacuggagguuaagugaaauaagccuggcacggaaagacaaauaccauguguucuuauacauaugugggaccuaaaaaauucauuucauugagguaaagaacagaaugauaggagaagcugagaaugguguguggguggacuggggaguggggcaggaugaagagagguuggcuaaugaguacaaacauacaguuagauaaaagguauaaguucuaauguuugauagaguaggguaacuauaacuauaguuaacaguguauuccauauuucaaaauagaaggcaggauuugaauuauucucaacacagaaauggugaauacucgaggcaauagauaugccaaauacccugacaugaucauuaaacauucuuugcauguaacaaaguaucacauguaccccacaaguaugaacaaauaugguguaucaauaaaaauaaauaagaucuauacaaacaauggaauguuauucagcuauaaagaaaaauaaguauugauaugugcuaaaacaugggugguccuugaaaacauuaugcugacuugaaaggagauagucacaacacucacuuauuguaugauuccauuuauaugaauugcccagaaugggaaaaucuaaugagacauaaaguagcuuagugguuguuuagaagcuaggggcauggggguaggaugcagaaugacagcuaguaugaaaauguucuaaaauuagauuguggugaugcuugcauaacccuguuaauuuacuaaaaaacauugaauuauauccuuuaaguggguuacuuguaugguaugugaauuauauuucagugaagcuguucaaaaagugauaggcucauggauugaagauucccaguaaaacaaaggauuauggaguugugagauucaucuuuguagauauugaaaucacuagugauuaugauauaaauauuguuggaaagacugacagccaagaaccaauacuuucaaaaaacagggggaaauaaucugcaggagaguagauaauugcaauaagaagggauauuuguuaguguuguugaugauguaagauguaaaggugaaugcuuucaugaugaagaaagagaaaauauuaaguagaaaugaggaacgugaagaucaccuacuccauauucaaggcccaagauacacgagaaguggaagaaaaagcagcuaccacuugauagagccuacagagaaagcagggucaucagaguagagcuucuaugauagacuuuuauauugacccuaaaacacugaaauucauaagguaacuuucuggauacuuucagcuuccuacaugaaguuuuugaucuguuacguuuuucaugaauuguaugucaugaaacuugagucuguuuuucaguggauuacuugaucaaauuaguguucuuacucuccuacuuaaucuauuucacauuccuaauguauaaggcuguauaauuggucaguucugguuuauuuuuguuuugugagagaauaaaggaugugaauacuugccagguuagauuucuaauuuacaggaaucuugucacccuaauagguugauaugucucaccaaaaauuauaaaagaguuguugauuaauuguaguauaauaaugacugcuaguauccaugggagaacagaaagaauuuguucuuuuucuaacuuuuauuuguccuuucugagucuucuaacaagcagauagccucuuuucuucauuauucaguuccauaccuuuuaaaaaaacauuuuuacuugaaagcguuucuuaaucagaaacaauugauuucaguauuaugaaauagcccucucaucuuugaaaaaucagucuccaagaauagcauaaaauuuguuuuuagcaagauaauuuuauguuguuaauuauuuguaaaggucucaaaaguacugaaggaucaccuagaucaaugaauccagagauauaaaauaauauaccuuaagcaaaaaucauugaauaaauaccuccauuucuaaauuagucaauuucagcugcccccaaaguaagauuuaugaaaacuguagauguugccauuugugccacugccuuaaaucuauuuaauccucuacuacuaucagcugugaaguuaacucuaccaucaaacaaugugaaaucuuggauuuuuuaauacaucaugcauaaaaauacagaaggaacaaauuuauuacuaucuauuauguuccaagcaggggaaauauuuaaaaugaucacacugguacuaucaugacauugaccauucagaaaagaugcugguccuuggaucaugagaguacauccugacugaauaacagaucugguccuagacaguuuaguguuuuguacucaaauuuauuuucagucaugucuucaugguagacauuguuuuuuccauuuuacaaaugaaaacccuaagacuuaaagagauaaguaacuuaugcaagaucacauagcaaauuaguagagcugggauucaaauuaguuuuauuuggcucuaaauucuaugccauuuucaguguucuacugccuugauaaacuuaaaaccgaucugcuuucuauccagaacugaguucacaauaauuuaucacucauuuggaagaacagaucauugugcugauuuuggaauuucccccaagauaagcuacguuucuaugaauacuuacuaaacuuuuuucuuccuuauucuauauuaggacgucuugcauggcugguauacuuaguugggacaguuguaggaggaagauuaacauauaccaguacagaugagcaugaugcuauggauggagaauuauccugucgguaaguaagagcuauguaauuuacugaaauucacuaaauaguuaaaaaaaauuaguuauugaacuaguauuaugagugaagacauuuuguauguggccuuuugaggaagguauuauuucccuuuuuauuggugagaaaaccaaggcucaaagguuaaaugauuuguagaagucaaaucucuaauaagugauagacucaaaauauuuuguacauguuugugcaaauaaugugauaaagauuuagguugcuuuuuauuacuuaggaugugagcaagcacauacaguugguguguauuggaaagguggcaaaauugggugacauacauccaaucagaaaguauuagguagucaguuacccaucgcagguuuugucaccuauuggccacagucuuaggaaaaagcaguugaauuauucucuucaaguuucuauucuaaccugaggaaaauuucuauauaugaauaauacaagugaauugauuuuccauauauuuuaauuuauuuuuaauaacaaaucuccuuauaacagcgucauacauguuuuuauugaagacuuaaacauucaaaugaaaauaaaaauuauauacuaauuuggagauaaccacuacuguuauuuuguaaaguccguuugagucuuuuuaauuaacguguauggguguauguuuacugcauguguguuuuucaacuuuucuuaaacauuacaaaacaauguaagauggagcuaauaauaauaccuaacuuauuuugggcuauuauaaggaauuuauuuuuuuaaaugcuuagaacagugccuggcaauuagugguauauuuuacacacacacacacacacacacacacacacacaccccaaccccacccacccaccucaacaccacuuuuuaaaaucaaaugcaauaucaacauuuuaccuggacauuaaauuuucuaaauuuagaaaauuccuuguuuuuggaauuuuagguuguuccucaauuuuuuuuauuauaaauuacuuuuagauauacuaaauuguuuuuaguuauaucuuuauguagacugaaauaauuucauuagaguucguuccuaaaugcagaauagcuggucaaaaguuauguagcauuuuaaagacuuucaauacucaauaccacacgguguucugaaaaaggaccaauguauccucugaaccaaggguccccaaccccuguacugguccacagccuguuaggaacugggcugcauagcaggaggugagcugcaggugagcaaggauuacugccugagcuccgccuccugucagaucagcagggacauagauucucauaggagggugaacccuaaacuacacaugugagggaucuagguugcaugcuccuuacgggaaucuaaugccuggugaucugagguggaacaguuucauccugagaccgucaccccacaccaccccaaaccccauccauggaaacauugucuuccaggaaacuggucccuggugccaaaaagguuggggaccacugugcugaacccaaauuguaugauaguuaacauuuguuagugguugaacugccagauaguaggguucauauuguugccaguuuauagguaacaaauguauuauuucaauugguauuuauuugguuacuaguagaaucaaacauucuuuuccacuccuagcuuugccauuuuuucuuugugauuuuuauaucuauauugauuauauuauuuaccugcuuuucuuuugugaugaucucuucuaacuuauuugaaagagcucaguauauauauauaucuauauauauauauauauaugcucaguguguauauauauauauguauauauaugcucagucuguguauauauauauaugcucagucuguguauauauauauaugcucagucuguguguauauauauauauauauauauauauaugcucaguguauauauauauauauauauauaugcucaguguauauauauauauauauauauauauauauauauacacugaaugaacucuguagaggaacgaacucuaaugaaauuauuucaaucuacauaaagauauaauuaaaaauaauuuaguuauaucuaaaaguaauuuauaauaacaaaaauugaggaacaaccuaaaauuccuguauauauauauauauauaucucagagaucuuaauauuuugcuccucauuuugaaaauguuuucucuguauuuuuacuucagaaauuucuucuuuacuggcuuuaaauauuauguauucagaucuauggacuuuuuccuucauauuucucugcugcuuauauuuagaaagauuuuuuuuccacuucugauuaaugaaaauauccaccuguauuuucucccagcugucuuugguauuaauagcuuuuuauauuuauuuuuaauauaucuugauauuugguuucauauguuuuuuccaaauuuuccaauuaaugccaauccuacccucuacugauuugaaguggcacuuauaucuuacacaaaauuauuucaucuuuuuucaggccuuucauacuuuuccauugaucuuagaaguauauuguuauauauuuuuacccuauuaaagaccuuaaaauuguuauaccuacuugugauauucuccuucauuuuuauuauuaaauauauuucuaagugcuuaaugaauuuauuguacuuuuggauaaaaaauuucauuuuguuccauuuccuuuucaaccuuuaaacuauuucuucaauaaaaugugaaucuucauggaccaugaauauuuuuaguuuuucuaagacuuauuauuuucuauaucaaauugaauuacuugaaaauaugaauaacagguguuuggggccuccuuaaagugcuuuaguuacuuuucaaccaaacaaaaaauuugcuacucaaucucucgaguagcugggauuauaggcauaugccaccacgccuggcuaauuuuguauuuuuagcagagaugggguuucuccauguuggucaggcuggucucgaacucuugaccucgggugaucugccugccuuggccucccaaagugcugggauuacaggcgugagcaacugugcccagcugauuuuuuuuuaaguuuaaucaucaagcagggaaauaaacgacugggcgcaguggcucaugccuguaaucccagcacuuugggaggccaaggugggcggaucacgaggucaggagaucgagaccauccuggcuaacacggugaaaccccgucucuacuaaaaauacaaaaauuagccaggugugguggcgggcaucuguagucccagcuacucuggaggcugaggcgggagaauggcgugaaccccggaggcagagcuugcagugagccgagaucgugccacugcaccccagccugggcaacagagcgagacucugucucaaaacacacacacacacacacacacacacacacacacacgcgcacacugccacuaucucgugagaaaacguauauuaggaaauaaaguagguauauauuugccaaugagaaacaaauauuaguuuuuuauuuaagcagcaaacguauugaacauguugaacuaagauuuguguuuuggccugcauucccuggaaaacagagccuugggugaaguucaugggccaauauuuuucuggagguuagggagaagaguacauuuuuagagaagaaagaauaagaggaaagggaaaguaagugagacaauaagagaaaacaaauacagucaaucuuuauuauuccuggauuccauuuuuugugaauuugccuacuucauaaaauguguuucuaaucccaaaaucaguacucauggugcuuuuguggucauuugcagacaugugcuuagggaugaaaaaauuugaguuuuguguugcacuuucccaacugagguugaacaaggugauacucugccuuguuucagcucuuguacugcaaauaauugcccuuuuuauauucuguuuagagccacauuuuucauacuguugugcuuuuuguuggugcuuucaguguuuaaaaucgcccagcuguauuguuaaagugcuauuuaguguucuuaaauacaagaaggcugucaugugccauacauggguuagauuagcuuuguuuggguaccagugggaguacugugaauacugcaguagucugugaguucaguguuaacaagucaacaacauauuugaaaaagccucucuaaacagaaauacacaugaaacaagauugcaauccauugaccaaaauguugucaccagaggcuugcaggaaccuaauccuguauuuuaccuaggagcaaugguucauuauucacuaauucaguguucacagugacuacagaauauaacuaccaugaauaaugagaaccaacuauguaaggugguguauuacugagaaaauacaacugguugcuugcuuuuauaggaauuuucccuggaggccacacgaaaccacuugugccucagaacaacucaugacugggggaguaaggacaagcaguauauccauuggcuucuuucugugucucguuucuuacugguuaaugucuacuccugggguauuucacuuuuccacacuucuuaguuauguuuccuggccucuuugaggagcugcugggaagacagagcuuuaauugguccuguuagaguuaugaacaggaauggugguuugucucucuuuucugggaagauacauaacuccagaaacugugagagucuuuucuggggcuacaagacaaguggcugaagccaggggugaggugagaggugauagugugguuggugggugugcaagcagggccaagcaaauucaagguggggcauauucuaggacuuacacaacagucuggaaauaaauauguauuuuagaauauugagauucuaaacuaagaaugaugucuuacguaaaauuacaaaaaaaaucacuuucauaugaagauguuccaaauaauuggaacuacaguacugugacuuucuauaaguuauauauaauagcauuccaacuccucagagaacacuaccaaauuagaagaucaugaagcuccugccaaaacuucaugugcuauuuuggcaugaaaaguugaagagucauaaaagcuccuaacauugugaugauuuauaauuaugacugaaacaugcuacuuuaaacauagcaaauaaauauauuuacacucaggccacauaauucuaauuaaauaaagacauuuauagucauuuuaguuucauucaucaugacuaaaaugaaaaccucuugagagauucuccagggauuuugucuuauucaucaugcauccuguuaacucauuuauguaugcaguugcaauuuuuaaaauuuuugcuaucagaccuuggcgaugaccuugagcaguaggauauaaauaacucccacaugcuuagcguuccaauaauggaacacuaggcauaaauguaauccacuagugcuaguagauugagugcuagcuucuuucagaccuauucuacuuagcugugccacccugugucucucauugcucucaccuacccaucucccagucaucccucauuaucaagacuuuaauaacuagcucagaguuuuccucucucucccaaacccugcuauuauauaaauaacuucagcugcuuucugaucagauaauauuucucccauuuucuuacccauaagccuccaguggcuuccuaucacacuugagacaaauuucaaggcccuugugauggcccagaguauccugugcuacuucugaccucauuuccuacccuuucccauuuaacacuggccuccuugcuguccuuugaguauuaccaguguguuuucacuuuagggccuuugcacuucucuuucuucugcuaagaauacuuucuuccagauguuuguauaguacauuuggcccuugaacaaugugggaguuaggggcaccaaccuuccacacaguugaaaaucugccuguaacuuuagacuccccccaaauuuaacuacuaauagcccacugcugacuguaaaccuuauugauaacauaaacagucaauuaaaacauauuuuguauguuauauguauucuaugcuguauucuaacaaaggaagcuagagaaaagaaaauguuacuaagaaaaccauaaggaagaaaaaguaaauuuucuguucauuaaguggaucuucauaaaggucuuuauccucuucaucuuaaacauuggguaggcuuaaaagcugagaaggcgaaguuggucuuacucucucagggauggcagaggcgcaagaaaauuugcauauaaguggaccugcacaguucaaaccugucuuguucaagggcaaacuauucuuccucacuucagucaggucuguacucagaugucuuuuucaaagagggcuccucugaccucccuauccaaaauagcauccuuaccccacuuuauuuuucuugauaguacuuauuaccucuugauguuguuuguucuacuagaguaagggaaggaguaagcuuuguuuugcuuacugcuguauuuuaucuccucuguguagcaaaaccuuaacccugagggaauuuaggguuuucucuaauuuguugagugauaguaacagaaauugcacacuucuguggauaggacccauugucacuuguuguuuuuaaccucaacuaggcccucagcauugcucagugauucuauuuuguuucaguaauucuugucuucugacuucuaaacaccuauugggcuguuucacugggauguuguaucccacaugcaccucuaauucagugacuaaaauuaaacucaucuuuuccaucaccuaacccuggcucucuucacaugucucuucaucauacacucaguuucccaagccugaaucgugagaguuauccuuaacuuuuucccuuuuucucucuagcauucauauagucaucaaguccugucaguucuaucuuuuaguuaccucaguuaguccaccuauccuaucuccucugccaguuuagcuacuaucaucuuucaccuggauuaguaguaaguuuuuaaacggacuucuugcuuccuuuugcagccagaguaaucuuucuaaaguacagaucugauuaugucaaugcuuggcuugaacuaugcaaugacgucauuguuuuuaagaugaacaacauggcuuaucaggcuguucauuaucuggcuccugccugucccauuagccucauuuucugccauucacuacauuauagccauguugaacauuauacagcugaguagcugggauacaggcuccugccaccacaccuggcuaauuuuuuuauuuuuaguagagacaggguuucaccguguuggccaggaugaucucaaacuccugaccucaagggaucugccugccuugggcucccaaagugcugggauuacaggcgugagccacugcacccggcccccugccccuuuagauggcuacacaugcuuuccuuuuugucgcaacacuauggcuuugccuuguucguccuagaauauuaggaaauagcauuuguuauaggacuugucauucuuuauuccagcugcuucuuuuaucuuccucuugauagauuauagauuucuagaggacuggggauauauaggucuuguacuuuguuguauuuugaaugccugacacauaucugacguauagugggcccucaaauuuguugacugaauaaaugcuuauuuaguuggauaccuaggaaaauucagcacaguuauccaaaauucauuucauuguguuugaaauggcaugcuuauacuuggaucaaaaauuauuuaucuuuuuauucugugcuuuuuaccagaaauaauuuaagauaaacgaauaauacauguaggacaauaaauugaaacugggaauggauauuauauacacauugaacaucccuaauccaaaaaucugaaauuugaaaugcuucaaaaucugaaacaguuugagcaucaacaugaaucucaaaggucaugcuuaaaggaaaugcucauugaagcauuucagauuauggauuuuuggauucgagaugcucagaugguaaguauaaugcagauauuccaaauuucaaaaaaauuaaaaaucugaaacacuucugaucugaagcauuucacaaaaggaauacuuaaccuguauauauugguauguauaggcauuagucuuauacacuuguuagagguggcagcacaucuucagagggcacugugguagagacugucaauugucuuucaucucuucuuccuuucccuucccauaauaaagugcuugauuguuuucuugagcaaauggccacucugaauaaagaccagauuuucuagguuguuuugcagcuagguauggcaaagugauuauguucuuaguguaaaugaacguguuauguguaauauauguagauguaauggguggagcugaaaaagcuaccucagaccacagagugcuuguggaggcaaguguaacaacaagauggaaggaaccugagccccugauacaucuuggagcaccaacuagcuuuagggaacuacccuggauuuuugcuugagagagaaauaaacaucuauauuauguaagccauuguuauuuuggauuucauacacuugcagcugaaccaguacaacugcuaaaacuucuuugacaaauggauuguguacccugcugggaacucauuccuacucucuugcugguggggaugucauugccucuuaggcaaaugcagaucaccagcuuaaaaugaguuguaaaggcaccccaacaaauuuuuguuccacaucuucuuugaauuugggaaugugugcuauaaaaaggaaauaaaaguaaacaagagaaagugcauaaaaucaacacagaacuugaguaggagaagggagauccuaugcaaugaagaauuuaaaaacaagauacaccuuauuuaagucacuugacaaaucacuuggcuccagagaugaaauuugauguauauaucuauuuauuuaacuaaaacuuacuccaguaaucugcuaauucaccaguacacagauuuuaaaauuuagcuuuacuccucaucucaaaauuagaagauaaacguaucacacauccuauuaggaaaaaaaccucaaaaccuguuuauaauaaucuaauucuuaaaucuaauuccucagcaaguucuccauaaaucuuagcaguacugagaauauuugguaugcaaaggguacuuuuaaauaaguagcuuuauuuauaaauauaggaaauaaucacuauaaaaacgcuugucaaaauauuuuuucuuaacauguuggcaauacguagcaaguuuuuaaaaauuuucguaugcugugaccuagacguuuuguuucgagaagucauugaggguaaaggaggggaaaguaguuauguuuuacuuagaaauaugaauuuuuauccaaaauaagaugauuaaauuuugauguagccuuaauuuuaugcaaccauuaaaaacagugcuuuggaaaauuauuuaauaacaugguaaaaauaauuggucaagauauauuuagugugauggauuguagaaaagaauaaaagguucaguaaguguucugaaugcauaagugaauccuaguauauaugauaaauacuucauaauggugaacaaaagauagucuguacaggaaauaaaugguuuugaagcaacuggguaggcaucuuuaaaaaauaauguuagcuccuugucucacacuguauaaucaagaugaaucucaguguaucauagagguaaauguagaaaacaagaaucacaaaaauaccugauucagguaagaccuugcuauuaugcaaaauccaugaaagaaaaaauugaacaaauuuucugcaugagaaaaacaauaacaaaaacuucugcauggcauuaaacauuauaaagcaguaggccccagggacugguuuaguagaagaugguuuuuccauggaccggggcaggggaugguuucaggaugaaacuguuccaccucagaucaccaggcauuagauugucauaaagagcacacaaccuagaucccucgcaugcacaguucacaguaggguuugcacuccugugagaaucuagugcugcagcugaucugacaggaggcggagcucaggcgauaaugcuugcuugcucauugcccaccuccugcugugcagccugguuccuaacaggccacagacuaguaccggucugcagcccaggguuuggggacccuugucauaaagucaagagacaaaugaaacacaaaauuguuuacaguucaauuauagacaaaggggucaacccucugauauauaaauaauuuguaaaacucaguaauuaaaagacagccaaauagaaaaaaaaucaggaaaggauaugagcaaacgggucacagaaaaugacauggaaaauuuuuaaccucgccuaaauaagagguguacaaauuaaaauacaccgagaugccguuuuucaacuuuccagaaauucuaauuuucugucauccugaauuaucuugucuguguguauauagacacucuuauggagugaugguaagaguauaaauuauuucaauuuuuauggagugcacuuugguaauagcuaucaaaauuauaauaauuuaugcuguucgagugaguagcuugacuuuuugaaauguguguuauagauggacaugugugaaaugacauaugcaagauuguuaauugcagcauuuuguaacagcaaaaaauuauaaacaaccuuaguguccaucaauaggggaauguuugaaaauauuaugguguauucauauaauggaauguuuuuuuguuguuguuguuaauuuuauuauuauuauacuuuaaguuuuaggguacaugugcacaaugugcagguuaguuacauauguauacauguaccaugcuggugugcugcacccaucaacucgucauuuagcauuagguguaucuccuaaugcuaucccuuccaccuccccccaccccacaacaguccacagagugugauguuccccuuccuguguccauguguucccauuguucaauucccaccuaugagugagaacaugcaguguuugguuuuuuguccuugcgauaguuuacugagaaugaugauuuccaauuucauccaugucccuacaaaggacaugaacucaucauuuuuuaaggcugccuaguauaccaugguguauaugugccacauuuucuuaauccagucuaucauuguuggacauuuggguugguuccaagucuuugcuauugugaauagugccacaauaaacauacgugugcaugugucuuuauaacagcaugauuuauaguccuuuggguauauacccaguaaugggauggcugggucaaaugguauuucuaguucuagaucccugaggaaucgccacacugacuuccacaaugguugaacuaguuuacagucccaccaacugugugaaaguguuccuauuucuccacauccucuccagcaccuguuguuuccugacuuuuuaaugacugccauucuaacuggugugagaugguaucucauugugguuuugauuugcauuucucugauggccagugauggugagcauuuuuucaugugucuuuuggcugcauaaaugucuucuuuugagaaguaucuguucaugucuuuugcccacuuuuugaugggguuguuuuuuuuuuucuuguaaauuuguuugaguucauuguagauucuggauauuagcccuuugucagaugaguagguugcgaaaauuuucucccauuuuguagguugccuguucacucugauggugguuucuuuugcugugcagaagcucuuuaguuuaauuagaucccauuugucaauuuuggcuuuuguugccauugcuuuugguguuuuagaaaugaaguccuugcccaugccuauguucugaaugguaaugccuagguuuucuucuaggguuuuuaugguuuuaggucuaacauguaagucuuuaauccaucuugaauuaauuuuuguauaagguguaaggaagggauccaguuucagcuuucuauauauggcuagccaguuuucccagcaccauuuauuaaauagggaauccuuuccccauuucuuguuuuucucagguuugucaaagaucagauaguuguagauaugcagcguuauuucugagggcucuguucuguuccguuggucuguaucucuguuuugguaccaguaccaugcuguuuugguuacuguagccuuguaguauaguuugaagucagguagcaugaugccuccagcuuuguucuuuuggcuuaggauugacuuggugacacaggcucuuuuuugguuccauaugaacuuuaaaguaguuuuuuccaauucugugaagaaagucauugguagcuugauggggauggcauugaaucuauaaauuaccuugggcaguauggccauuuuaucucugaauagaccaauaacaggcucugaaauuguggcaauaaucaauagcuuaccaaccaaaaagaguccaggaccagauggauucacagccgaauucuaccagagguacaaggaggaacugguaccauuccuucugaaacuauuccaaucaguagaaaaagagggaauccucccuaacucauuuuaugaggccagcaucauccugauaccaaagccgggcagagacacaaccaaaaaagagaauuuuagaccaauauccuugaugaacauugaugcaaaaauccucaauaaaauacuggcaaacgaaauccaguaccacaucaaaaagcuuauccaccaugaucaagugggcuucaucccuggaaugcaaggcugguucaauauacgcaaaucaauaaauguaauccagcauauaaacagaaccaaagacaaaaaccacaugauuaucucaauagaugcagaaaagaccuuugacaaaauucaacaacccuucaagcuaaaaacucucaauaaauuagguauugaugggacguaucucaaaaugauaagagcuaucuaugacaaacccacagccaauaucauacugaaugggcaaaaacuggaagcauucccuuugaaaacuggcacaagacagggaugcccucucucaccacuccuauucaacauaguguuggaaguucuggccagggcaauuaggcaggagaaggaaguaauggguauucaauuaggaaaagaggaagucaaauugucccuguuugcagaugacaugauuguauaucuagaaaaccccauugucucagcccaaaaucuccuuaagcugauaagcaacuucagcaaagucucaggauacaaaaucaauguacaaaaaucacaagcauucuuacacaccaauaacagacaaacagagauccaaaucaugagugaacucccauucacaauugcuucaaagauaauaaaauaccuagggauccaacuuacaagggacgugaaggaccucuucaaggagaacuacaaaccacugcucaaugaaauaaaagaggauacaaagaaauggaagaacauuccaugcucauauaauggaauguuaagcagcuucagaagagaaugaggaaccuccuuaugucugauguguaaagagcucuaagauucauuguucaauggaaaaagcuaagcuuagaaccauguggauaauauguucuauguguucagaaggguugggaggagaaucuguagucauauuugccuguacauacauaaaacauucucuggaagacauauaaacuauuaauaauguguguauauauguucaugugugcauauauggaagaaacugggugggucaggccuagacagagcuuccuuugugcaaauuagaaaaggauacugcuuccucaacaaccucuacuucugucucaaaaaauuauuauauuauauucauuuuguuagcacaagguacuuggcggucauccaccagaaaauuuuaaugaaaauagauaauauugaaggauuuuuuuugagguucugcacuaaguuuuucauuauauugaauuaagcuuuuucuguaggaaauuuaacauaaucuucaguucauuuauaauuuucuaauaauaauaguuuugaauaauaauagaaaaguugugauuuucucuuaauaauaguuuaacugcuguuaggaauauuugauuuuguaaagaucaccuuguaguuuauuuaagguaaaauuuuauuauucauuaagggcaggauauaacuuuuguuagauguaccucuugauauuuuuuugaacuuugagucaugaccucaaaauauuuaauuauuuagaaauacaagauuaaguaaaaaggugaaauacaagacuacauacuuaauauccuucuucuuuuacuaaaaauuuauaguaaauuuuuacuguaguauaggguuuuuuauguguaugccaugcauuuauuuuaucaguuuuuaguaaaauaauaucuguauauacauacagaguuuugcaucuauaugcauguauguguaugucuuaggaaaaaaaggcuagaaugaauuagaccaaguaguaauaucucucaguaguaggauuucagaugauucaaaaaauauuuucuuuauauuuuuuuauuuucccacuuuuuacagugauuauauguuauauuacauuuaugguaaauguuuuaauguuguuucucuaagguuuuguacugaagguuuuuuuuuuauuuucccuucaugaagaguuuuucagcuuauaucuuuaauggauaccggauugccucgauguuguaaugagaaaauagagcuugcaauucugugguucuuggaucaguuucguaaaacauauguuggugaucaacuucaaagaaccucaaagguagguuucuacuagagaguuuaaaacauguuauuggggaugaagaaagauguacauauauaacugaaugauauauuugggaaauuucuacauaagacguguaauugauuaaugaauugaugaauuggugaugaagugcaauguaaaauuaaguugcuuguuuuauaccuaguuuaccauuuucuuuaaagauugaguggcagagagguaaugaauauguuuuacauggauggucauuaaacaguugagauuauuuuaaacacuaaucaauuuugccuuauuguauuucaagacugaaagcauaagauuugcuuuuuuaguaguuccaggguuuuuuggacacuuauuuauuuauguggcuucuaguauauuucacuaauuucuuggcauuuguacaugauuaaauaaugaggacuaggaaaauuagauguguccuuaggagacugcauauaaccuuaauguuaggaauacucauaguaugauaauugaauguuuagcaucaguaaguuaagaugacuugaucuuaaaguauaaugaaagauuauuaagggcauuuaugugaaaccuaagcagauauuuaguagcauuagauacugacacugaguaaaaucuucgccauaagaaguucuaaggauauucucauuucauuugaacuuaguuuguuuuagugauguuguaggauuuuuuauuugaaaauucuaaaauaaacuuuuuauacucauuuuagcuguuuuaucuuaggaaauguaaccuucaguuuacuuaggauuuucugauaauaauaauuguguaguagugugaaaaaauuuuuuguuugauuuuaagauuauccuuuaguuuauuucagguaaaauauucuuuuuuaaggaaaugaugccauuuuauaauuucuuucucaaauauauuaugauauuaucauuuaggauuaauaucaauaaaauucucuuagaauuuagcugccaccaaaugagaccauuuggaagaaaaagaguagcuagaaauaaauguuuuagguugucaguaagacaacuuagaaucagacaauaauuacauacuauaaaauuuauauaacagagugccuuuuuaauaaucccagaugugauacuugaagauugaauauaaaucaaaugaugauaaauuuucuuguuuaauauguccagagaguaucuuugcuuuugcaaaaggguuacucucaaaauauugcuaauacaguauccauuugguguaggucuuaaaucaaaacaguauaauauggaguagaaaauccuucuaaguguuguuuugaaggcaccuggaaggaacuauguaaaaugagacuaguuguuuuagggcuaugggauuucggauuuuguuucaaaacuuuuaauauaagguaauugugaaaaaaagcgaauuacagauuaguuuuucguuuuugaaaaagcuugcacuuuaggaaaaaguaaacacaucaccagaaugguauugacuccuuuauuguaacuuuaacauuguugguguguguaucuuacccuauuaaaggaaguuaguccuaaggugacaaaauuucuaaggcauuucuauugcauaaccccagagugaaacuaaaucuuccuacuuuuugguuucucugacuuaccugccaaucugucuuaauagaaaucauuuucagaaguccuuaauuaugugucccgucacucuccuagguacucuucaugcuagcuuuauuccuuacaguaggcuugcaagguugguauuaauguccucauuuuacuaaugaaagaacagacucucuaagacauuucguaaguacuauauauacaauuuuuuuagcaaccaacuacguaaggaagagugaguggaacauauuucuugguggguguauugucugauuccaaauuguggcaaaaagugggagaauacuagauaauagcaaaugaauguuuaacaauuaaugcgugcuuauuuuguaccaggaacugugcuaagcacuuuugagcagucucauuuaauuguaucauguagaguaugacuucaagguucuucccaaucucuuuucggcauaugucaccagcuucauacuucaguacaccauacuugcacugcauacuuuauaugugguaaacuuauuucagguucuucagcagucugugcucucuguuaauuccagguauuagaagaaaauguuuccccugcuuaauuaugccuaguguuccauuauuggaacgcuaagcaugugggaguuauuuauauccuacugcucaaggucaucaucaaggucugauugcaaaaauuuaaaaaauuccaaccucaggcaugaauggguuaagacacuauuuuuuuuaaauccaucuuuuacuucucugccuuauucugccaacuacuuauuguuaucagagaccccauccuuuaguauccccuuuuuaacucucaaauucugagaguguucguuuugucuguguucuguagcacccauuuguucccuguuuuaauauuuauuacacugcuuuguaauuacuuguuagugaauagacuguaauuuugguuaguacuauuucugccuuguuuauuguuaucugaaagagccuggcauguauguauuguuuguaugcuuucaacuuacuguugaauguguguauuuaauagaauucuauaggaauucggccuagaucucauguauaauacuuucagguaauaaaggauauauucuugaguuggaaaaugaugcugacuugagugaaauuauucagcaguuauaaauaagguguaauauuaagcaucuugaacauuuuauaaaagccuguauagacaacagaauauaauuuauagaaguaaguucuucaggaaccaagguggaauuacuaaaguguccuaagugauguaugugauagaaguccuauaugugagaaagaauguuguaaauaguagccauaggcauuuauugagcaacaagucugugucaaauacuuugcucagaacuugaaaggcauuauauaauuucauugucacaaaaaugcuaugaaaauagcgauuuuguuaaaauccuuccuuucuguagacauggaaauugagguuuagagggguuaaccaauguguuuaagugguucaaccuggauuugaacccuaggcaccugacugcagagccugagcugcugaccacuuugguauauugccuccuuuuuauuggaucuuuccacugggauguugaaugggcccuugaaacuuauuuccaaaaaggaacucacuaucuuuuagaacucugucuuccuacuucccauauuuuaaagaagaaugacauugaauuucccuuuuguaccucuuguauccaaucugucaccuaauccugugaauuuuacuuuuggaguaucucucagguguacuccuuucuucugccccuuucuuuuuagccucacuuucacugcuuguuauuuccuauggaauuucaaaaguauucuacuugcccucuuuguuuccauuuugcuucuccccacuccacucuauuuuccauacugccacuggaguauuuuuuuauuagaaaaccaaagaauaauguaauaaacacucauaugcccaucauucaguuuugucaagucuuaaugcuuugcuauauuugcuucagaucuguauauuuuugaguuaaacaugaauaauccuguugcugcucugauuucacuucucuagcuucuugccccacuguccuaaauuuaguauuauucucauccaugauuuuguacuuuuucuacauuucuguguauauauaaacaaaacacagcacuguuaacuuuauauaaaaguauuaugcaguuuggaucuuuaggauuuuuuuuuuuuuuuuuuuuuuugagguggaguuucgcucuugcuguccaggcuggagugcaauggcgccaucuugacucacugcaaccuccgcuucccagguucaagugauuuuccugccucagccucccaaguagcugggauuacaggcaugcaccaccgcgccuggcuaauuuuuuuguauuuuuaguagagacgagguuucaccauguuggccaggcugguuucgaacuccugaccucaggugauccacccaccuuagccucccugaguguugcaauuacaggcgugagccaccacaucugaccagaauucaucuuuuuuuauuaccauuuuugagauuuauucauaaugacacauauaguucuaauuauuuuaauuauugagugguauuagaguguaucacuaugccauuauacauugauuuuauuauugauauguuagauuguuuccagauuuucaauuuuuacaaacaauacugcaguaaauauucucaugucugcauccucaugcauauguaagaguuuugugaagauaaauaguagaauugcugggcuguaaaauguacauaucuuaagcuuuacuagauauuauuagguugccuuccuaaguguuauaacagcuuauuuccucucccccagccaggguaggugucuguuucuauugucauuauaugugcuuuugucagacuuuaaguuuugccagucuuucagaaaaauuuuuccugugcaauuuuucugcuuaaauuuuuuuauugguuucucguuacuuauaaaaugaauucuugcuuaugaugaaacuuugccuaccuuugaaaucauuucuuuucauuccacuuuaugacaugauucauaugugcugcugucuuuuuuccuuugguuuauuccuguucauuacucagugacuauugauaaguaaccacuauguauuaaugccagggaugcaaaagugaauaggaucauccaucuccccuguaaguuuuuaguuaaagggaacauggacaaguaaggaaaaaaaauuauaaaauugauucauauaugcauuuaaacagcauaugaugaaaugaagaccagacaaacuauuaaauacauacugcugggauuuuugguuaucuguaugugaaaauuuggauuaagacuucauaucaugcaaaaaucaauuucuaguagaagacagacucuaaauaugaaaagcagaauacuaugauuuagggauagggaagaauuuuuuaagacauaaaaaagcuaagcucuaaacucagaaguugguaacuucuaccuauauuaaaaguaaaaacuccugugaaucagaaaacacaauagacaaaguaauaaagaaaagcuguaggaauacauucauaauacauguaacuuauagagaaucaacauucgguuauauaauuucugugaauaaauaagagaaaagcuaccuacuaguaaaauggccaaaauacaugaauaaacacuucacagaagaagaaaucacaauggccaguaaacauggucuuaguccucugggcugcuguuaacaaauaccauaaacaacaaacauuuguuucucacaguuugagagccugagaaguucaagaucaaggcuagcagauuuugugugugguaggagcccuuuucuguuuucauaguuggugccgucucucuguguguucacauaguggaaagggcacacaaacucucucagaccacuuaugaggacacuagucucauccaugagagcucugcccucaugaccuaauugucuccaaaggcccuaccucuuaauaucaucaugcugggaauuagauuucaacauacgauuuugucagggacacaaacauucagaccauagcauuucacauuugccccacaaagugcauguccuucucauaugcaaaacacgccauuccauucuaguuuaguccccaaagucuuaguuuauccuacaaucagcuccaaagucugaagccuagagucucauguaaauaucaucuaaaugagaugugguugagacuccacagugauucauucugagccaaauuaccccucuagcugucagccuguuaaaucagauaacaucauaugcuuccaaaauacaauggugggacagacacaggguaguccuugccauuccacaagggagaaacaggaaugaaggaagaaaugacaggucuugaacacguccaaaacuuaauaaggcagcauuaaaucuucaggcuccagaauaaucuucuuugacuuaauguccuacuuucugaacacacugggguagggauuaggcucccaaggcucuaggugguagaguucucauauacuggaguugggugcuugcugcucucccaggauggaaucacaugccaguggcucuuuuagucuagaguuccagagaugaaugacucugcccccaugacuccacuaggcauugccauaguggggacuuucucugguggcccuguccuuccagcaacccucugaguuguacagcugaagcuccaggcagcucuauuuuuggaacuggagguggccacacccccauggcuugagcauuuugcaagcuggaggaagugguacugcauguaugccaccaguguuuacucucuaugcccucugaagggguaaucacuuuagccuaggcugcacuugggccuauggaacuguaccuggggcagccaaggagcacugcaugagaauguggggaguggaguauuaaggcagggccaggcagcaagugcuaggguccugugaguacccauggcccuuccuuugaaaucauuuuuucuuccaggcccuugcgcucugggccugggagacagaaugagagacagccccaaggaucugugauacacuuucagggucauuuuuuccuugucccugccaguccaggcacaccuuuuguguucucuccugaacauacuuucucauuuuucacaauauggaaaggcugauaauuuuucaaaccuuuaaguucucuuuccuuuugauugaccauuuugucuuuaaaucauuuuucuucucacauuuuauuauuauaaacauucaagggaaaccaagccauuauuuugcuuagaaauuuauucagccagcugggcgugguggcucacaccuguaaucccagcacuuugggaggccgagguggguagaucaccugaggucaggaguucgagaccagccugaccaauauggugaaacacugucucuacuaaaaauacaaaauuuagccaggcgugguggcacgugccuguaaucucaacuacucuggaggcugagacagaauugcaugaaccugggaggcagagguugcagugagccgagauugcgccacugcacuccagccugggugacagagugagacuccugucucaaaaaauaaaagaaagaaauguauucagccaaauauucuauaucauuccuuacaaauucuuuuuuacaaaacaguaggacacaaacaauucuucuagguucuuugccacuuuuauaagggcaccuuuuauaagggcacuaaucccccuuauaauucucucccaaaggcccucucucuuaaaaccaucacauuggaaauuagauuuuaacauacgaauuucccgcauuuuuucugcagcucuguuuguuuuuuauucuuuuucucucuguccuuugaauaguacuagggucuuaauauagauguaaaagcuaaaaaacaaaaaaacaaacaaacagaaacaccaaaauggauuccagcaucuuauaagugcuuucucuuaugaucgagaguaagacaagcauggcuacucccuucucuucuauuaaauauuguacuagggguucuauugagauaaauaggcaaaaaacaaaacaaaacaaaacaaaaaggcauccagauuuaaaaaaaaaaggaaucuaggaauaaagggauuacaucucuacuugcagaugacaugaucuuauguauaggaaauccuaaggauccacugaaaaacuguuagaacuaauaacaucaguaaguuugcaggauuauaagauuaauacaaaaacucgacugaauuucugugcacuugcaauaaacaacccaaaaacaaaaggaacaaaacauuccauuauaauagaaucagaaagaauuaaauaggaauaaauuuaacaaaaguguaaaacuuauaaucugaaaaucauaaaacauuguugaaacaaauuaaaggggauguaauaacuggaaagauaucuuauggucauggauuacaagacuuaauauuguuaagauagcagugcucuucaaauugaucuacagguuuaacacaaucucuaccaaaaucuuagcuguugucuuugcaggaauugacaagcuuauccuuaaauuugugugaaauuaaaagaacgcagaauagccaaaacaaucuuggccaagaacaaaguuggaauacucacacuuucuaauuucaaaacuugcuacaaagcagcaauaaguuguuacuuacaauaauauuaaguuauaguaauuauaguaagacagugugguaagcauauacauauaaacgaaugaaauagaauggagaguccagguaaaaaccuucacauuuguagucaggugauuuuuugacaagggcaucaacauaacucaguaguggaagaauaguuuucaacaaaugaugcugguacaacuggauauucacauucaaaagaaugaaguuaguccucucucucacaccauaugcaaaaguuaacucaaaaugaaucagaucuaaaugugagaaaaauauaaaaugcuuaaaacauagaaguaagucuuuaugacuuuggacaaugguuucuuagcuaugacaucaaaagcucaagcagcuaaagaaaaagauacauuggacuucaucauuuaaaaacuuuuguacuucagaggacaucaucaagaaauugaaagcgcaaccuacaaaaaugggagaagauauuugcauaucauauauuucauaaaggucucgcaucuagaaucuauaaagaauucuuauaacucaauaauaaaaagauaaauaacccaguuuuuuaaaugggcaaaagaucuaaacagacauuucuccaaagaaaaucuaugaauggccaacaaggacauggaaagaucuucagcaucauuauuuaugguagaaauucaugucagugccagaaauagauaccacuuuacacucacuaggaugaauaugauuaaaaaaaaaagauaauaacaauugugagugagaauguggagaaauaggaaucuucauacacuguugcaaggaacguaaaauauugcaaccaauuugaaaaacagucuggcaguucuucaaaagguuaaacauagaguuaccaugauucaguauuucuacucuuauguauauauccaagaaaauggaaacuacacucuacauaaacauuugcacacauguucacagaagcauuauuuccaauagccacaaaguggaaaaaaauuugcaugucuauuagcugaugaauggauagauaaaauuugguauuuccccaaguggaauguuauucagccauaaaaaggaaugaaguacugauagaugccguaacaaguaugauaauugaaaacauuacgcuaagucaaauaagccagccacaaaaaaacaaauaccacaugauuccagugguuugaaaugucuggaauaggcaaaucuauagaaauagaaaguagauuauugggugccuagggcugggguuauuggagauuggguagucauggacaaaagguaugaaauaccuuugugguguugaaauauucugaaauugauuguggugauggcugcacauauccauagaaaaaaacacugaauugugcacguuaagugugugaauuauauaguaggugaauaugucaacuuguuaccaaaaaacagaccaaaaaacucacuuuuaaaaugggcagaagauuucaacaagcacugaaaaaagguaucuaaauggccaauaugcauauaaaaagguguucaguauuauuagucaucaucagagaaauacuaauuaauaccuaagugaaauaucacugcucaucugacaaaauggcuaaaaauuuuaaaaacugaucaaaccuugaugauggaguggaacacaugauaacauuuguugcugguggcaguguaaauuaauaaaaucauuuuggaaaacuauuuggcgauguacuaaaacuggauauagucuaccuuaugacucaucagcucuacucuuauuuacccagaagaaaugaauuuauauguuugccaaaugcaguguacaagaauauuuauagcaacuuuauuuauaauauccaagaacugggaacaacccaagugucugucagcagucaaauggauaaauaaauuaauguauacucauacacuguaauacuauacaacgauuuaaaaaaagaaaaacuacaugcaaaaauuuggaugaauuuaugaugauuuuacaauaaucacuucagcuaugaugaagaaugaaaaagaucaaaaguguacauauuuuauuauuccacuuaccaauuucuauaacagucaaaacuaauuuauggugauggaagucagaauggugguuaccuuuggguagggagaauauuuugacugggaaagugaacuaagggagccuucuggggaccuugaaauguuuuauuuugauggggcuuaaaugaguguauacauauauaaagacacugagcucauauuaugauuugugcacuucauauuuugccucaauuaauuuuuuuuacaaaagauucauggaagccugguguguaauuguguaaaaaaguggaaacuugccuaucaguagaagaauggaugaauuacgguauuguuacacagugggauuauguauaacagugaaaaugaaugaucuaaaacuacguuuauuuuuggguaacucuauaaaaccauccacaauaugguaugaaaaaaagucauacaaggacacaaaugacauuccuaugucaaauauguuaagaaaauuguaugcucaugaauucuaccuaugguaaaaauaauaugugcaugggauuaguaaacacuaaauucaggauaaugguuaucucugguugagaagaggaauggauuagagcaaaaggcauaguucaaccauaucuguaauauuuucuuagucugcauggugggugugcauggguguuuauuaaauuuuaugccuuucucuauauuugaaauauuuaauuugcaaaagaaauaauuauaagaacucuaguuaaauauagcaaauuaaaauuucacauuuacccuccuguccccuugcaacuguaucauaaugagaguagaggaauaaaaaauacauuugcaaggaagaaauuagagaaugauauggucuggcuguguccccacccaaaucucaccuugauuucccauguguugugggagggacccagugagagguaauugaaucaugggacaggucuuuccuaugcuguucucaugguagugacuaaaucucacaaaaucugaugguuacuauaaaggggaguuguccugcauaagcuaucuuaauuugccugcugccauccauguaagaugugacuugcugcuccuugccuucugccaugauugugaggccuccccaaccauauggaacuguaaguccaguaaacaucuuucuuuuguaaauugcccaguuucagguaugucuuuaucagcagcaugaaaauggacuaauaaaguaaauugguacugggagugggacauugcugaaaagauagcagaaaauguggaagcaacuuuggaacuggguaacaggcagagguuggaacaguuuggagagcucagaagaagacaggaaaaugugggaaaguuuggaucuuccaagagacuuauugauuggcuuugaccaaaaugcugauaauuauauggacagugaaauccaggcugaugugaucucagauggagaugaggaacuggagcaaaggugacucuuacuauguuuuaacaacaaaacuggcggaauuuugacccuacccuagagaucuguggaacuuugaacuugagggagauaauuuaggguaucugguggaagacauuucuaagcagcaaaacauucaagaggugacuugggugcuguuaaaggcauucaguuuuaaaagggaaacagcauaaaaguuuggaaaauuuguagccugacaaugugauagaaaagaaaaucucauuuucugaggagaaaugcaagcuggcugcagaaauuuguauaaguaaugagaagcugaauauuaauccccaagacaauggagaaaauguccccagggcaugucagagaccuuugugggagccccucccaucacaggcucagaggccuaggaagaaaaaaugguuucaugagcugggcccaggguccccaugcugugugcagccuaggaacuuggugcccugugucgcagcugcuccagcuguggcugaaaggggccaauguagagcucaggccacggcuucagagggugcaagccccaagccuuggcaccuuccaugugguguugagccugcaaaugcacagaagucaagaauuauaguugggaaccuccacccagauuucagaggauguauagaaaugcuuggauguccaggcagaaguuugcuacaggagcggggcccucauggagaaccucugcuaaggcagugcggaagggaaaugugggguuggagcccccacacagagucccuacuggggcaucgucuaguggagcugugagaagagggccacuguucuccagaccccagaaugguagauccacugacagcuugcacuguucaccuggaaaagccaucgccagccugugaaagcaguagaggggagucuacccugcagagccacaggagcggagcuacccaagaccaugggaacccaccucuuguaucaucaugaccuggaugugagacauggaggcaaaggagaucauuuuggagcuuuaagauuugacugcccugcuggauuucaaacuugcauggggcauguaucccccuuuguuuuggccaaugucucccauuuggaauggcuguauuuauccaaugccuauacccccauuuuguguaggaaauaacuaacuugcuuuugauuuuacaggcucauaggcagaaggaacuugccuuaucucagaugagacuauggacuguggacuuugaguuaaugcugaaaugaguuaagacuuugagggacuguugggaaggcaugauugguuuugaaauauaaggacaugagauuuggaaggggccaggaguggaaugauaggguuuggcuguguccccacccaaaucucaucuugaauucucguguguugugggagggaucuggugggagguaauugaauucucacguguugugggagggaagcaggucuuuccccugcuguucuugugauaggaagucucaugagaucugaugguuauuaaaagggggaguuuuccugcacaggcucucauuuuuuuuuuugccugccacuauccauguaagacgugacuugcugcuccuugccuugugccaggauugugaagccuccccagacaugugaaacuguaaguccguaaaccucuuucauaaauuacccagucucagguaugucuuuaucagcaacaugaaaacggacuaauacaguauguuaggagacuugaaacuagcaaccagauguauaagcgguaucugucuuaauguaccugagagauucuaaccuuaaauuccugcagugaagaaagcuaguaguuaggugauuugcacuaagaacccuggaaaagcccagaacuuggagacucuagauaccuuugaaugcugcaguucgggguguggcuaaaaauaggauaacugauuuaauuaggauuaauuauauucccagaacgcuuaccugucccagcacaacuggagauugucucuccgaaauucuugcaagagauaggaaguuuuuuauggaaguuugaacaggagguucuaggggauaagaauaagacacuggacugaaaaauauuccuagacacuuuacaacucuuaguugucaugaacuguuagccaggguuaaaaccccaaagcaggaaauuagugaaaugcuuuugugaugaagaagcuuauucaagagagagaccuacagauauagauauagauauauaggauccucaauuuuaaaaucagccugcuuaugacccuacagugagguuuacuggaugagaagcccuguugugaacauaaagcuccuauucuuuuuugaguaacucauucugauaauacaauugacaauagcuagccucuugaagaaaaccucauaugaaaaccaaagagaaaaacagaaaauaggaaauuggaggaaaacagaauuaauauuaaaaccauuaaaaggauuuuguuaaaagaugauucagagaagagcucuuuggaauuaagacaugauagaagaaauuaaaacuuaguagguuuggaagauaaaguagccaauaucaccuagaaugcagaacagaaaguuaaaauaaaacuggauaauaggagagaaaauagagaauccaggagguccaacauuggauuaaugggaguuccaguaagagaaaaagaaagaauacuagaaauucuccuguagugaaagauaacagguuccauacugaaaaggacuaugcagaguuccagcaaagugagugaaagaagauccauauuaagguauaguauuggaaauucacagcaucaggauuggaaaaagaggagauccuuaaagcuuccagagagaagagggguuacauucaaaggacuaagaaugaaaauuacauuggucuucucaauugcaauacuaaaauagaagacagugaaacauugucuugccaauuuugagaaagaaaaugaauuucaacuuaaaauuguauauccaguaaaacuuaaguaugaaaauagaauaaagaccuuuucacucagacaaagccucaacuuuacuucucuuauaucuuuuaccaggaaguugcuggagacuguauacuacucaauuaaaaaaguaaaccaagaaaagaggaagaagggagagaugggaucugagaaucagaggaucaaacacaggagagaggcuaagggaagcucucggauaacagcugugccucaggccuugagagcaaccaguucaaacuggagcagauggaaggucauagguguuuuguuuuguuauuuuucuuuaaagaacugauagauuacuugcugucuuggaccagguugagaggaauugaguuuuacagaucuggaauaguguuugagggucaacuaguaauaaauagaaucacauaaaacuuagguaaaugaaaaggaagucaaacuaaacauuugugcacaaaagggaauugaaucauaguaccauggaacuuaguuaugaaugaugaauacaguaucauaaauauguuagggagucaaaagauaaugugaaaaauucuuauaucaggaaauagcucugucugccuguuuauuuagaagaaugaaugaaaauaguaaaagaaauagccgaaagaguugaaaauggguugacuugaguauuggaaucagauauggagaggaguaugucagaggauggcaguuuuuuauuacuguuuuacuuuuuaaaucauguauguguauaauuuuaguagaaauacaaauuuggacaauuacaacauaguuuuaugcaugaaaaaauaaugguaagcguuuggugcccugaaaacacaggggacaguguauuuaacccagauuuugggaaucagaaaggcuucugggagagaagauuccugaaugaaauccagaagaauuaguugaagcugcugaagaggaaggaaaaugggaugcuuguucuaggagguagaagcagaaugugcaaagccuuaaagcucuacauuggaagaaauccagauagguuaguauagcuaaggcuugugguauucccagugagcauuacagagccuaacauuagauuuucagcaaauacugaauaaauaaauaaauaacugauguaagggaaggaguuuuuuaagaguaggaagucugggaaagcagacacauagcagucacaugcagccuaccuugugucuagagcaccagaauucuagucaagaagguacagcaaauucaggucucuacagacugaccaguuugucauccggguguaugguuucuuucugagguacauagauaacccacccaggaguuuaguaacauauaauuaaaguacuccagaauguucauggaauaaaauauucuaaccaaaaguguguuuaggccaggcacaguggcucaccccuguaauccuagugcuuugggagauaaggcgggaggaucacuuaaggccagaaguuugagaccagccugugcaauauagcgagacccugucucuacaaaaaauucuaaaaauuagcugggcauggugacacacggcuguagucccagauacucaugagggugaaauggaagaucacuugaguccaggaguuucaggcugcagugagcugugaucacaccagugcauuccagcuuggaugaggcagcaagacccugucucaaaaaacaaaaacaaaaaaaaaguguagcuaauaguuaaauacauauguaaaugaucaccuauuuauuaggguauaauuuaaaacguuaaaacucuuagaauauuucuuagacuguaucagaauuuuacaguauuuccuguuuauuuuuguauccauuaguuguuaccuggugugucaccauuuacucuaauuauaaauuaucuuaguuuauugauaacaauuuuaaguauuauuuuuuauauuaaaugucuauuagaaaagguccauuuuaauuuuuaauccaauuaaaaugugauuuuuaaguuuuaaaaauggauaaggaagaguccuuuuaaaauacagacacacacacaaagacacacacauauacacagacacacagacacauacacauauacacacacagacacacaggcacacacagacacacacagacacauauacacacacaggcacacacacacgcagaaccacacauauacacacaaacacauacauacacaaacacagacacacacaaaugcacacacagacacacacacacacaucuuagcuucugaauaucuaccaaaaguuagaaguuuugaacuuuguucuuaaaucccuuuauucaagcuuacccuaccauaaacaucaguuuugucuugguugguuaugaaaccuuaucagugagugaaauuccaaaaauuaauaaauacguguuguuaagguccuggaauguauuuuccuuuaaaaauagacccauaaacagugauacugaucaagcauaguauaauagaauuugccugaauucuguccucccaaaacaggauaccagaaauugagcaagaaguaauucccuuucucucuuccauuuaaauuuugaaauagacaaguuaaucuucaaaauuuuugcucucauucuucauuccuuguuuugauauccuauucaaucuuucaccaccaaagggugaaaucccuuguaucucuuuuguucaucaccaucuagguauacaggaaaacacacacgugugugcacuugugcaaaucugcuuucuuuccaguaccuuucaucugccagaugucaacuggaaaacauuccaauugaaggaugucaugcuauuguauaaaugaauucuccuggaaaggauugccuuuccuaaagaaaauauuuauuagugccaaauaauucaaaugguauaacaaagugaagugaaaaaaucaguauguguugugguagcugcuuggauagggguaccaucuugucugggaguguauaccuaugcuaguuuccuccuuuuuauuuuuugccuucauucuucugaauuuacauauuuccuaaaaauuuccaaauugcuuuucaggaagauuuucaaggcauugggaagguuaugaagccagagggagugaaaacagaauaguaauuuauaaauaaaguuaccauacauccagauuugccugagauuuccccagcucacgcuuguugucuuggcagauuguuaguuaauagcuucaucuuucauucucaaaaaugucucuguuuggaugauaaauuauaugaucuccuugcauauaaaccacaaguuucuaaagaggauaauauaguaauucauaaauaaguuuguaaaggccaggaagugaaccuuuccuuuugacucuguggcucucaguaccugaguaaaagccuuguuuauaagugucaugaacuagugauauauaagcauguuuagaucuuuuuuguggaauaacuugaaauuugcauuaagccgauaagugcuccaguaguguaacuauagugaacaauaauuuauuguauauuuuaaaaucacuaaacaaguagaauuggaaugcuccuaacacaaauggcaaaugcuugagguaauggauaccccaauuacccugauguuuauuacacacuguaugccuuuaucaaaacaucaaaugaaccccauaaacauauauauauauauaccugugauguacccauaauaauugcaaaucuagaaauuuuuuaaaagauaaguucucauugauguauuuucaaauuguccaaaauaaaaacggggaauuaucuaaacuuucaagcuuuaucuguguauauggauuucuaaauuguuuuguguaauuacuuauuauucaaccuuuuuccuacuguugaguacacauaugaagcagcagauggcauucuuucccugcaauuguuaugucuuccuguaugguauguuacuguaauaacaguuacuguuaaauugaguaggaaaacacuugaauaaggaaauagaaaaacauuucaugauaguaucuucaauggacuacuacaacuuuaagugcaauccaauguuaaaauaauguacuagcugcuguuucaugguacuuggauauauucugauuacuggcaacuuguauguuuguauuugauacacaauuugggggaaaaguguuuagaaaguucauccuaaacaaauuguuucauacauagaauuuucacuuuggugaaaaauagguagcagcuuuaauaccuuuuaaacacuaaacauugaaacauuuuaaauauuucagcaugccaaauauaucauguagauuauaggggaaaggcaccugugaccuuuaagauuauauguugaagcuugauuguuacagaauaaugcuuagugacuuuagggauuuuuuucuguuaaguguuuuaaagcuuuucagacuauuucugggcugcuuuuugacuaccauauacugaauaaauauaucauaaucaguuuuuguaauagauaacaauuugaccuaguuagguuuuccuucuuggugagugguuagugcuuauauuucaaguuaauguacauacugcuagauaguuuuauuguucagggauuuguuauuuuaauagucaugucauaugcucaauacauauauaauacauuaguauucagauaggccuuuuuaaaaaaaaaauaauuucucuauaccgcuucccacuuuuuuauccuacaugguaauauauauuaacuguuuuuaaaaacacacauuuuauaccugcuuaacagaaaguugagcaaauaauuagacuaaaggccuaauuauuuuauuuaaaaacgucuuugcuguauaaauagauuugccaaauucuacuuuugagaaugaauuccauaagugcauuuaaguguuggugcaagagcauuaagcacuagacgaggauguuuggggcagaaaaaucuaguuaaaaucuuugcagccacugguaauuaaaauuaugguguaaguuagagaaauacaggaaguaaauuggaaaaauaugggcuuaguuuuuuuuuaauaagcugacuuuuacuauuuauuuaucauaccaaauauaccauuauuugacaucaaaucuugugagaauuauauuuuguuauguaauuauauauacauuaaacacuuacucucucccuugugcuaugcuagauccuggaagaauucaaagaugaugauuuuuugugauuacuuaauaaaauauaugcuuacccacagaauauuuuuacucuauuuuuuccucucuuuuuuucuacuuacuuuuaaugauuauaaauucucaaucauuauaaaauucgguaucuguggauaaaugcacaaaguaaaacuccacgugcauucugaugugaauggcacuuuuuggauuguucucgaguaauuauaguuugaugauugauuuuuuuuuuuuaaguaagggagagggugauaauuucaucugguagagaaaaguuuucuguauuccaccuaucuuuuaguguuugauuuuuuuuuuuggugauucuaggaauaagaauaauaaaugaaauaccauguaguaugugacuaaauacccaaauaccaaguagauguacuuugaagaguugucagcacuaaagaagacuuucaauuugaaagagguuuuaguuacuaaauuuuacgacuugaaaacccagucccuccaucagucuguaauuuuuuuuaauagucauuggaucuuguggaaaucaucaacaaggcaaucuucguccacaaaucagaaggcuagggccacaaauaugcauauuuucccugauaaaagauuuucauaauuaaaauuuuaugucuacaguucauuauauauguauuauacauacaugaucuuugcacuuaugugauaguucuugcuucuggaauaaggauggauguuguugaacauucagagacucugccagauaccucuuacuguuuauuauuuuuguaccaaauuaaauaugccauuauuugacuggaaaaaaauuagccaggcaugguggcaaugcaccuauaguccuagcuacuggcaaccaguuuguaagaugaagaugggaagccuuccuuaccggagucuuggguagaauuugcuaucuuaaaaauauucaaguugcuuaaaguaagaucaugugugaauacacgucaguaacuuugguauuucaguaauaaagucauaggcaaacccucuacuaaguuuuuacuagaaauauguucaccuguaaugguggugcuaaaauuauuauuugucaaaaauaguugucagugagaaucucauacuacauacuuggaaguauuuucuaaugcuuauaauugacuuaaguaucuugcuugaagggaaucaggaugagauauaaucuauccuacuugugcugcagaaacgcugaagcuauucagucuguguaaauaauccaucccacaucuuugcuuccucuucagugaaugcuuaacauccauauauuaugauggcuugaguaucauuuggaaacauaagucauaauagcuacaaguuuguaaucgaaauauugcgaaaagaauuuuagguuucaagauagugauccuuuaaugucaaauguuuccugcaaaacugaaugaggaauauuguggauuauuuaauuuuuaaucauuuauuucaugauuauuuaaaaguucccuauauuaauuaaucacuucuauacuaauauguuauacuguuuugguaggauaaguguaagaagauaaucauuggauauuauucccaaggcaaauuaguauuuggagaauagauacguuuagccugagagcuugguauuaaguaguuuaaacaucuuaauaauguauuggaguauguguguuuuuauauuuuuuccucagauguauacuggucuuugcuaacucauguucuuaucuaauauccaggaaggaaaguuaagaaguuaggcuuacugaaaaauauauaugacuguuaagccagaauuucagacuaucaacuuucauguauacaguaugauuacaaagauguaaaacaaacaaugaaagcuaaaguauuagcaaaaggacagaggaaauaugacaaaauauuuauugucuuuaguacuaaaacaaugagcauguauuuucuuguuuuuuauauuuucacauuuucccuacuuguuauauacauuugggaaaaucagcaaaguccaaguuaaagugcuuaacuauaauugucuaaguuugaaugguauugccauuguucagaugauacuuuuaagcaacaauuuaauucauagcauaguuugcaauuuauugaauaaaaauuuaaaaauaugguaucaauaauuauucuccaauuauacuauauugucuuauaacuuuagauucuacuacacauaaaugaaugcaauguguauuuauuagauucccacugauuucagcgaaaguuguggcuuacuauauuucugcuuauuuuaucaaaguagcuaccucuugguuauguaauguuaagcgucuugccagcaugugacaguaaaccagauaaauauaaacuuuaguaguguggaauauaauaguuuauuuuuauauuccaucugguacauuuauuuuuuuccuuccucugaaaaggccaacaaauuuuuucaguuuaaacaaaggauaaaugagcauucugaauaaggcuucuuuaguguccuaaugauuaaugaucacugaacacuuuugaaagauuagcauuuuucagggcugguaaaaaaauauacuguuuuauuuaauuauaagaaaguaaaggcgcuucacacugacaggugguggaaauuagcaggcaguuuugaaauugugcugugcacgagaaauuagaucucauuuuaauucugcuuuucucaacuagcaaaugagguuaaugccauacauauucagcugauauggaugaagaaauugauauaaaguagaucaacauagcuacagggcuagauuaauuuauagguaaagaggcagugauaaaugaaaguaauguaguaguggucacuaaacuccucugccaugagggauacaauagcguuaguugcucauuaaaggcauugucggggugcaucaaauaggaauuugaaaaggaauagccaacuaaccccuaauuaucaaaauacagaaaauacuaauuaugccuuaauuagcuuuucuuuuaauguacugaaauuuguuacuuuuuguguggcacaaauggauaguuauaucaacaauaaauagguuguuuuaauaacuuucuuuuaccucugggaaaacuacacuccaauuuuuaauaugcaauaaugcuucucucuagccuguaggagaugaaaauuauuaaguagcuuuauuuuuuugaagauuuuacagcagcuuugggaagaauuauuucaccaugcaucaauuauuuuuaauugaacugaauauuuuucagauuguaccaaaugccucucauuuaaguuuaucaguuaggauuuaagaaaacaucauaaugagaacugcauauagucucuguuauuuguuauaauaagacaaugaugauuauuuauuuugaauuuuuaaaaagcaacccaauuguugcuuguaaagguagucaccguauucggguagucaggauggagaauuagaggcuauauauucuagaaacuuggcuugugauuccuuuucuuuccucaaauaagguaguuaucaacaauccaguuaagaaaggguucaucuguucagaauaaagaugcgggaagcagcuuggccuuuucaucagauagaucuccagccagcucugggcuucaacuagcucucacuaccccugggaaaucucauuacuuuuucugcguaucaguuuccuaaccugucaacagaagugauaccuuuuacagaaauuugggaugauuaaguaaaauauggcaaauaccaagcacagaauuuaguacaguacagauguucaaaaaaacauagcugcuguuauugguaagaauaagaagaacuauuuuuaaaauuuuaccacuauuuaaauuuaaugggaaaauucucuuugaaagaauuauguguaaucuuuagaacaucuaauguaauucuaaauuuguguuggaaaccaaccaauuuaucacagauugauuuuuggagaagaauuuggaaacaguuggucuuuggggcauguauuuauggugauuauacauguuguuuccuaauaccaggcagaacuuggaauuaaaaccagacaguuugauucuaaagucaagacucuagaaaaagacaaaagugugacuucuggccugaugaaaucuguaaugaguucaaaagcucugcuucuccccucaguugcuuuugaugcuuguguugcauuuguguuuccauccauuccuccucuuuugcucuccucugcuauccuuuucggggguaguagucaugaaauaaacuggcuauuaacucuaucugugacacuaauucucucuuuuguuuuccuugccaguaaaauaaaauaauaauauucauugcucuuuuugguaauugaaucaguguaaucaguguguuaugccaacaucccuucauuaguuauguugccucuuuugucagaaaauaauuugaauaggaaagaggagagagcaggaaagacauuucauaauuaaucaagauaugaauacuguacuaccuuaaaaaauaagcauugcccagucuacuuaacagaauuaugaaugcuaaauaaauauacuguaugugaaaguaaguuguaaacuauaaagcauugugcauaucuccaugguacaugucaaaucagcauacuaccuuucaccugcuuacaaacugaccaaaaagaaaauuaaaguggugauucugaagagaaggaaaaugaauggguuuguuucuguggaggguauaggagagugggagagaaugucagagaggaagaaaggagguaagauuuuuauguauaucaaaggggaugggguuuuaaaagguuagaaauguugaauuagaguaguggccucaaacugaggucccagauuagcagugucaguccaccuggaaacguuaaaaaugcaaauucucgagcccugcuccacaucuucugaauuagaagcucugagguaggcccagcaagcccuucacguaauucugaugcucacaaaaauuugagaacuacugaauuguuauuugaaggcagaugcucugccuuguuucuuuuuuaucaucacaaggaacuagguuuguuuguuugguaauauccccugccccuuuuuaaccugacugccagauccuuucuuuuaucuuacuuaaccugugaucuagagaagggaagggggaaaaagccacuuguccauuauauguuaaacauugugcuaaaauacucuaggggaaguuauaagucaauaggaucuguguucuccuguuccaauaacuaaaauuuguaugguuauacacaguuuuuauuuaaauuguuuuaaauuuucuccuaaugacuuuucagaaaacugcaaucagaccaaugccuuaguucucaaauguaacuauucccuguuccuggcauuuuacauguauuauauugcugguuaucuguagacuguaacuuucuaaaauacauauuuuuaaagaaaaguacuugagacacuguaccaagauuaggucagcagucacacuuuguuucuaggauuuuggcuucagaaucagauuguuuggauuuaacugccaguucugucuuagacaaauauguaauaucucuaagccauucuuucuucaucuagacaaugagaauaaugguaccuauguuuuaggaaaguuuugacauuaaaugagaguguauaugaaauaguuggcacagugccugacauguaagugcuuaauaaauauuaacuguuguaaugaugaugauaaugaugaccauugcauggcugucacuuuucugguucaauuuaaccaauauacacuguuuuuagaguuacaaaauguuagagcccugaagaggcuacagauguaguuuaaaugagcacucucccagcuguuuucuacauaucacaagacucuugcaaacagaauuuaacaaguuaacagcaauuauuuuaaaaaaggauuuuuuuuccaaaauaaacuuggaaaagccagucuauuguaucucucuuggaaauuuauaaugcauauuggcauguuaaacgcuuuaaggagcuccuaccuuaaacgauccuuagcagcuaucaaaauuacuuaaccauagaaaccuuuucugugggaaauaccuacuuauguuuugcaaaauacagucugggaaaugcuaucuagaccaggcacuuucuuuuauuaagaagcaucucccccaccccacuccauagaaauugaugacuugccuuaggucauacagcuguagacucaguuuggaacucaaagcuuuuccuagucuuguuucaccuguuuaucuaaucaaguucggauauagaaaggaaaauuauuugaauugguagaaaauuagaggugguucuauuauguagaaggaaagaggaaugaaagauaauucuaauauagugcugcuuauuuuugccugauuguaggagaauccaagauacuuguuuaaaacacagauucuuagacuucuguaaauuuuaauuuguagggaugagguaagauuaucauugcuggaucauacgugaaaagguccaagauuuucagaguuugaucuuuauaaauugugucuuaugauucugaguaacuagauaauugguguuaacuuucuguauugggagaaagaugauuaaauauggaccagauucuaucccaagaaaugcugauaaaccucauuucauguacauuuagaucuuaaagaauuugguuuacuugcuuauuuguugucuuucuuuucaauacccucuaguagauagugccuaaugcaauuauagaaaucugucuauuaagguagcuguaaggucauuuagagcuauacauuuuaaucagccuaacaaauuaucaacgaguuuaagcucucuuuucauaaaugacucauuauauucacuuuuuacuuuuugaccaugacguuguuggauuuauucuaaagggauaguauaccuauaauuuaaacuuaaaucuagaucuuaugucagaaaacaucuaagaauuuguaacugguaaauguugauaauauuuagaauaauaacauugccuuuauaacugauaccuauucaaggccuauaaagacaguaagaauucccuaugaaaugagaauuaguucugguguauauucagaugucugcuuucaaauauuccuaguuaaaucagccaguugaagaaagucaaacuguauauugcauuaauuaaauuauuaagauuuuuaugaucuuacguggugauuuuauguguuacaguugaaacauuuccgagacauguuguaugcauaucuuuucuuuaagaucuugacauuuauggccaagcuacguacccauuuuugcauuuaccauguugucuuuuacaaggugucaauuagcauguauuuucuauguauuagguuaaagauggguuugugugguuuuuacuuucaaaguaaauuguucuccaauuuauuuuguaaccuacuuuuauuuuguaaccuacuuuucuuuccuguuuugacuucagagaaaccaaaccaaauaaaauuauaguaugaagguccuuaaaaauauuccuaucuguugacacaguguuucaugucuggaagugcagucugaauaaauaauuugaaauacagacaaagcuuuguauaccaagguauuaaucccagugauauuugauagagucgaugguugauuaaauagguuguacagccauaugaugaaauaugaggcagauaaugaaacuuguuuacugaauguaaaaaguuuuguucuuuaccccauuguacucccucuuucuaggcauaaccacuguaucacucuagacauuuuccuuuaugaaaaauguuuuacaugauugauguuuugcauauaaucuuacauuuaaaagggagggggugaacaaauuauaaacauauaaauguuuuuaaacaucacuaaaacgauuggaagaaaauacauuuaaauguuaaugcuguucacaguagcaugugccuuguaguuccagauacuuggggaacugaugcaggaggaucccauggggccaggauuuucaggcugcagugugcuaugaucacaccugagaauagccacugcacuucagccuggcaacauaggagaaauugucucuuaaaaaaaaaaaguuauugcucaucucagggccuguuauauaccuucaguuacccuccauagccccucaaauaauuuuauuuuuaagaaaagcucauggaaaaaugauaaucuuucuacaucaaaagggcuagaaaucuaaaagucugagaaagagaaugcuugagggacccucuccuuccucacgguuauuaaguguuaguuaaagcuguuuuuuucccuaaaaagcaaggcaaugaaugaaaagauaaggauaauaguagacaauaaugucaaugaaauaaaaugaggaauggaaaauuuuuuaauggaaauuugacuuggagugauugucauaauaccuguaauggaguucagaggaagcaaaaauagucuucaugagauugguugucuugaucauuugaaauugggauuuguuuuauccguacuguguaaaauagcuuuucagccacuauacuaggugaauaugaagaaaguuuucuguucuggagcauucugauuucauaguuaugccaaaaaguuuuugcagauaaaaagucaugaagacagcauucagaccuaggaugguuguacucaaaagcacuugccguagguguacauaauguuuagcauuuuacuuucuggguaagauguacugcuucaguuuggaaauaaaaaauguaucuuagguuacauugucaucauuacuacuuuuccuuuuagaaaagaauaauuuaucuuucucaacuauaugaaagggaugaacauuucucuguguuccuacucauuuugcauuaguuucuauaaaauugaaguggauugcuagcaaaagggggggaacccaauuacaguuaaguccccaaaacugcauuuugacuccaaaucuucagugugaugugucuagaaaggugauuaaacacauaagaauccugaaugauacgguuaagcuuuguguccccacccaaaucucauuuugaaucauaaucgucaugugucaaaagagagaccagauggagguaauuggaucaugggggcaguuuccccccaugcuguucucgugauagugagugaguucucacgagaucugaugguuuuauguguuugguaguuccugcugcauucauucucccuccugccgccuugugaagaacuugcauuguuuccccuucgccuucugccgugauuguaaguuucuugaggcuuccccagccaugcagaacugggagucaauuaaaccucucuccuuucuaaauuacccagucuugggcuguucuuuauagcaguguaagaauggacuaauacacggaguggagggcggagaguuuguucaauccagcguccuguaucccucagagauucauaugcaguaaaucugagguaggacccagaaaucuguauuuuaacaagcacuucugguaauuuugagauagaugaucccucaacuacucuugaagaaacugguccaaaaguucuuccucccaguccacauaguaaauguacuaccaagguuugagagauuucuuuauaaguccucucagaaagucuuucuagcaugcuugacauagguugcuguuugccuauuuggcuuaguuaaauacuacauacccauucuuguguaauuccaaacuguuagaaaagcguauacuaauccaguauuucuguuuaaauucaguaugaacagacucacaucuaucauuagggaaauucugaaaucacuugagaaaaaaguuuccuuuauguugugaauggaaaacaauacacaguauuaaauaauauaauaagaucucaacuguaugacaauaggaggaacaaaagcaccauaaggaaaugaaccaaaauguucauuuucuuuaguucucaugacacagagaauuuauuuuccucugcuuuucuguauuuuccaguauuauuucuuauaaaaagaaacauauuaauuuuaaaaaugcccuucuuuggccuggugcaguggcucacaccuguaaucccagcacuuugggaggcugaggcgggcggaucacaugaggccagggauuugagaccagccuggcuaacauggagaaaccccaucucuacuggagaaaaaaaaaaaaaacccuuuuucugucuucacaguuaacuugauuauauagaugaaagucuaacaauuucauauuacuuuucuuuuauacuuaguugcacaguaugcuaugaggucugugaaaugcauguacauuucucauuggaauauuuuauuguuauguguguagauuuuugaauauagcauuuugaacauaauggucacguuggagcaauugccauuucaaaucauuaggaacacucaggucacuuuggcauggagcuauuuuguaaaagacguagaagccauuuauaaacuuugguuugcuuuuuaaaaauuuauuucauucugaggcuuauccguguaaaauuaccaaaaugauugugguuagacucuacauugucacaguauuuaaaugugcacaauauuccacuuagaaauaaugucaguacuaaaaguaguagagggcuuugauagcaauauuaauacaucguuaagcccuucucauuaaacaguguaauagucuuguugaaguuuguuaggcauuuuaaccacuacuaauuaaaaauagaccuacugacuagucuguuuuacugugcuuuauugugucuuggauguucauucagauacuuuugcuguugagaaaucaaaucgucucuuaugguuuuaauuacaaaauacauauuagagggauacaguucuuagggcugugauuuuuaauuuguguaaccuuuuuuuauuuuggaaaggaaauuucagauuuuuucuaguaauuuuucauuugugaguguuguuuucuagauacagaaaauguaccuagauagaugaucacauuuuaggauauuuugcuuacguguuauuuuauauuuauauacuauaauaccauuguauaguucagaacaagaaaauaucuugauaaaucaucugcuacugugaggcaguuaaaaaaauuugaggcucacugaaaaugugugacuugcccacugucucauauugcuaguauuggagagaaaacuagaaucuaggccuuuauuuuccugauguaaugauuuuagcuaauuauuauuuauuuucuuaaaucauugcauuaauugauuuuucacaaguagagccuauaucaguguuugcaauaauuaaauuuuaaguauauuucuauaauuguaaauaaaauccugacauuuguuacaggaugggguuuucuuucaucauauuuuuauaauaaaaauuaagcaguuauaaaaauaaauagccuaguuuuucaauugguauaagcuggcuuuauuuuauacugcuaauaaaggcacauuauguucaagcauugcaauuaucgcugaaaugcauguccauuaacugaaacauuaggcugaguauauaauuacugucuagagccaauaucuuugugaagcuguaccuauaaugcuauuaaacuauaaacaauauuuguaaacuaauauuuaaauaauucagaauugauauaaucuuuuuguaaacuuaaaaaugaaugcuauauacauuuaguuugauuguuuuuacgugcuuagaaaaauaugggaauucucaaagauaauugaaauaugugucuugagauagaugaauuuuuaauauaguugcuauaaccuaauaccuauuauucuuucugaagucuuuuguuccauauuuuuuauugugguaagaaauauacaacauaaaauuuacuaucuuaaccauuuuaaaguaugcaguucagugauauuaaauacauucauauuguugugcaaccaucaccaccauucaucuccagaagucuuuucaucugcacaacugaaacacuauacccauuaaacaauaauuugcauccucccaccaguccuuggcaacuaccauucuaguuauugucucagugauugugacaacccuagguacuucauguaaguggaaucacaugguauuagugugcuugugacuggcuuauuuuacuucacauaauguccuuaaggguagcuuauauuguagcagacaucagaauuuuuuucuauuuuaagacuauuauucccuuguauauguauaucacauuuugcuuauccauucauucaucaguagacacuuggguugcuuccauguuuuagcuaucaugaauaaugcugcuaugaauauggauauacaaauaucucuucgagacccugcuuucaauucuuuuggaguagaauugcugcaucauggguaauuuuguguuuauuuuuuugaggaaccuccaugcucuuuucuacagcaguuguaccacuuaauauuuccaccagcauugcacaaggauucgaguuucuccacauccucaccaacacuuauuuucuacuuuguuuuacugaagucuuuuauucauacaaaauauguauaaauucuguuuacaaaaaaaaugauguagcuauagucaagcuuuuuaacuugaaaggucuuuuggggccuaucaaugcaaaauugcuuuuaaaucugaauauauugacuauugaaaucuacugugucacacgcauccgugucaugcgcguccgugugaagagaccaccaaacagccuuugugugagcaacaagucuguuuauuucaucugggugcaggcgggcugagucugaaaagagagucagcaaagcuuggugggauuaucauuaguucuuauagguuuugggauaggcagugaguuaggagcaauguuuuacgggcaggggguggaucucacaaaguacauucucaaggguggggagaauuacaaagaaccuucuuaaggauggggagaauuacaaagaaccuuuuuaaggguggggaagauuacaaaguacauucaucaguuaggguggggcagaaacaaaucagugguggaaugucaucaguuaaggcuguuuucacuucuuuuguggaucuucaguugcuucaggccguccggauguauaugugcaggucacgggauaugauggcuuagcuugggcucagaggccugacauuccugucuucuuauauuaauaagaaaagcaaagcaaaauaguggugaaguguuggagcagugaaauauuuugggggugguauggagagagaaugggcaauguuucucagggcugcuucgaggggauuaggggcagcaugagaaccugcaaugggagagauucaacugaagaaagauuuugggguaaggggugauauugugggguuguuagaaggagcguuugucauaucgaauuauugguguuggccugaaugcgguuuuguaugaauugagaaacuaaaugaaagacacaagguccgaauaaaagaaggagaaaaauagguguuaaaggacuaagaauugggaguacccaggacguccaauuagagagcguccaaggggguucaauguuauuguuugcuugguuggcgacuuucaaggcucuauccaaguuuuugggguacacuucaaguugggcuggugucuggaaugagacuggagccuaauaaaaaggaguguccaugcaggagcuuaaaugggcuguacucuguagcaucucgaggacaggaucuaauucugagaagggcaagagguaaaaguacuguccaguccuuuuuaaguuggaggcugagcuuggugaggugugucuuuaaaagaccauuagcccauuuuaccuuuccugaagauugaggaugguaagggguacaaaguuuccacugaauaccaagagccugagaaacugcuugggugauuugacuaaucauggccaguccguuauuggacuguauagaggugggaaggcaaaaccgaggaauuacgucugacaaaagggaagaaaugaccgcagugaccuucucagacccuaugggaaaggccucuacccauccagugaaagcaucuaccgagaccaagagguauuuuaguuuccugacucgagccaugugaguaaagucaauuugcugguccugggcaggggcaaauccccgaguuugacguguagggaagggagggggccugaacaaucccugaggaguaguagaauagcagauggaacacugagaagugauuuccuuagggauagaccuccacaauggaaaggaaaugagagguucuaagaggcgggcuaguggcuuguaaccuacauggaagagguuaugaaaugacgauagaauagaaugggccugugaggcuggaaggagauauuuuccuugguccaagaaccauuugccuugugugggaagagauugauagguggagguuucggugggagaguaggugggagugacugaugagaaggaggaaaacuggccgugagggacagaaguuggaaugcuagcugcuucuuuagcuaccuuaucagcauaagcguugcccugagugaugggaucugaugccuuuugauggcccuugcaguguaugacuccagcuuccuuuggaaguaaagcggccuugagaagaguuuuuauuaaagaggcauuaauguuggaggacccuuguguagugaggaaaccuuuuucagccuauauaacagcaugguggugcaggauauggaaggcauauuuagagucaguauaaauauugacacauagucccuuugcaagagugaaggccugaguuaaggcaaugaguuuggcuugcugagagguaguggaagggggcagaaugguagccucagugauagauguggaagauacuauagcauagccugccuuugcuggugaguggcgauuaggccugguagaacuaucaucaguaaaccaagugugaucagauugaggaacaggaaagaaggaaauauggggaaauggagugaaugucagguguaucagagauacagucaugggggucaggugugguuucgggaauaaugugggaggccggauugaagucugggucaggaacaaugguaacugugggagacucaacaaagagugaguacaacugaaggagccagggagcagaaaguauaugugucaugugugaggcagaaaauagauuuuggaaguuaugagaacuguagagagugaguugagcauaguuugugauuuugagggccucugaaaguauuagggcaauggcggccgcugcacggagacaugauggccagccuaaaacaguaaggucaauuguuugguuaaaaaggcuacagagugcgguccugguccuuguguaagaauuccaaaugcacagcccugcaauucagcuguauguaaugaaaacaguuaggaugagucagggaaagcuauugugggagcagucucuacagcugucuucaaggaacagaaagaggaguggggaaaggauuuaggaucuauagggucagcuagguuuccuuuugugaguuuauguauugguuuuguuaggauggcaaaaccagguauccaaaggcaaaaguauccaaccaugcccaggaaggaaaggaguuguuguuuuguagaagggguugggguuugagagaucagucagacacuaucggcagggagagcacguguguuuuuaugaagaauuaugccgagguagguaacggauggagaagaaauuugagcuuuggagggggauaccccauaucccuuggagaauuaguguugaaggagcaggaggguguccuguugagaagauugaaaggaggggcuacaaaguagaaggucaucaguauauugaauaaggugagaaguggagggguggaaagaaaguaaaucaugagaaagagcuuggcugaaguaaugagggcugucccugaagccuugcggcaguacagcccagguaagcuacugggacugaugggugucagcgucaggccagguaaaagcaaagagaggcugggacgagggguguaggggaauagugcaaaaagcaucuuuaagaucaagaauggaauagugaguuguggaggaagauauugaggacaaaagaguguauggguugggcaccacaggguggauaggcaaaacaauuugguugauaaggcacagauauugaacuaaccuguaagaguuguccgguuuuugaauagguaaaauggcagaauuguaaggagaguuuauagguuuuagaagcccaugcuguagcaggcaagugauaacaggcuuuaauccccuuaaagccuguugugggaugggauacuggcauugugugggguaagggugauuagguuucaaugggauaguaaugggcgugugaucgguugccagggagggaguggagaugucccauacuugcggguuaagguaggaggauaugagaggaagacacgaaggaggcuuuggguugggaagaaggguggcaaugagauguggcugcaguccaggaauaaucagggaagcagauaauucgguuaaaaugucucagucuaauaagggaacugggcagguggggauaaaaaagagugcauaaaagaauguuguccaagauggcaccagacugggggaguuuuaagggguuuugaagcuuggccaucaauacccacaacaguuaugggggcaagggaaacaggcccuugaaaagaagguaauguggaguggguagcccccguaucgauuaaacaggggacggacuuacucuucucuguaagaguuaccugaagcucagcauccaugauaguccagggggcuuccaaggcgaugggcagcaucagucuucagcugcuaagccaaggagaucugggaaggagucagucaaggaauguuggguuugggcuucagggguuuuaggagcagcagugaugugagucggacagucugaccuccagcgggggcccacacagacagggcacggcuuaggaggaaucccaggcugaggacauucugaggcccaguggccaggcuuuuggcauuugaagcaagguccaugaggauguuuugaaggagccccugcgagcuguggcuuggauguucuaaaguucuugcaugcuagagaugugguuguggguuuuccuacagcggaggcaaguagcuguaacucagaaauacguugcugucuggcuacccccucucuauuauuguguaccuugaaggugagguugauuaauuccuauugugggguuugagggccggauuccaauuuuugaagcuuuuuucuaaugucaggagcugacugggugauaaaaugcauauuaagaauaaggcggccuuuaucgugaaaauggccauacugcccaagguaauuuauagauucaaugccauccccaugaagcugccagugacuuucuucacagaauuggaaaaaacuacuuuaaaguucauauggaaccaaaaaagagccugcauugccaagucaauccuaagccaaaagaacaaagcuggaggcaucaugguaccugacuucaaacuguacuacaaggcuacaguaaccaaaacagcaugguacugguaucaaaacagagauauagaccaauggaacagaacagagcccucagaaauaaugccgcauaucuacaacuaucugaucuuugacaaaccugacaaaaacaagaaaugggaaaaggauucucuauuuaauaaauggugcugggaaaacuggcuagccauauguagaaagcugaaacuggaucccuuccuuacaccuuauacaaaaauuaauucaagauggauuaaagacuuacauguuagaccuaaaaccauaaaaacccuagaagaaaaccuaggaaauaccauucaggauauaggcaugggcaaggacuucaugucuaaaacaccaaaagcaauggcaacaaaagccagaauugacaaaugggaucuaauuaaacuaaagagcuucugcacagcaaaagaaacuaccaucagagugaacaggcaaccuacagaaugggggaaaauuuuugcaaucuacucaucugacaaagggcuaauauccagaaucuacaaugaacucaaacaaauuuacaagaaaaaaaacaaacaaccccaucaaaaaguaggcaaaggauaugaacagacacuugucagaagaagacauuuaugcagccaaaagacacaugaaaaaaugcucaucaucacuggccaucagagaaaugcaaaucaaaaccacaaugagauaccaucucacaccaguuagaauggcaaucauuaaaaagucaggaaacaacaggugcuggagaggauguggagaaauaggaacaguuuuacacuguuggugggacuguaaauuaguucaaccauuguggaagucaguauggcgauuccuucgggaucuagaacuagaaauaccauuugacccagccaucccauuacuggguauauacccaaagaauuauaaaacaugcugcuauaaaaacacaugcacacguauguucauuguggcacuauucacaauagcaaagacuuggaaccaagccaaauguccagcaaugauagacuggauuaagaaaauguggcacauauacaccauggaauacuaugcagccauaaaaaauuaugaguugauguccuuuguagggauauggaugaagcuggaaaccaucauucucagcaaacuaucgcaaggacaaaaaaccaaacacuccacguucucacucauaggugggaauugaacaaugagaacacauggacacaggaaggggaacaucacacaccggggccuauuguggggugggggaagcgggagggauaguauuaggagauauaccuaauguuacaugacgaguuaaugggugcagcacaccaacauggcacauguauacauauguaacaaaucugcacauugugcacauguacucuaaaacuuaaaguauuaaaaaaaaaaaaaaagaauaggucggccuucuggccccucugggucuagggugguaaagcaucuaaggguugcugcuaagcgggccaugaacugggcuggguuuucgucuuuacguuggguauuuucuuuaaguuugucauaauuaacagcuuuguaagcugccguuuuaagcccuucaacuaggcaggaaaccacguaaucucgcuuagcuauaccuggggaaucugccugauaguuccauuggggaucuucucggggaacugcucucaugccuuccgggaggucuggcucaugaagccggugguuaucagugugagauugggcuagagaaaaaagucuuucccguucaucuggggaaaggguagaaguuaggaugacauuuaagucacuccagguugaauuguaggacagaguuagauaucagaauuccuguguauauuuaguggggucugaugagaaagagccuaaacgcuggcugauuugggaaaggucugauagagaaaaaggcacacguacccugacuguuccuucagcuccagccaacucucuaagaggaaauugucgggcagugggggagagcuaguugcagaaagaaacuguaaaccagaccagguguggagagggagguaauagaaggguuauaggguaggggagcagaggcugaagaagaguuggagccugauucagccuggcagggagcgacuugaggaggagcagucugggaaggaagugagaggucagaugggucaguagaaaaggaagauucacaagacucagcgaugcuugggguugggacugaagggacaggugggagggaaagaaggaggauuugggacaaguugcauugggaacagagacuagggagggaacgaagugugaaaaaugccuggacguagggcaucucagacuauuugcccauuuuucgacaaaaauuaucuaggucucguaggauggagaaaucaaaagugccguuuucuggccauuuagaaccauugucgaguuuguacuggggccaagcagugaugcagaagaaaauaagaugcuuagauuuuaggucaggcaagaguugaagagguuuuaaguucuugagaacacaggcuaaggagaagaaggaggaauggaggguggaaguuugcccauagugaaggaggcaaguuuaaagagaaggguagauauggcgaagccgguggggagcaacccugggcugcaaugugggugagcagccaaagcaggcaucccugcaauugacuugccaccaagggaauauggguaaaugaccaaggcaggagucccuguggugaucagacaccaguggaauaugggugaauaaucaggcaggcaucccugcaaugauuaaacaccaagggaagacugucuuccugaaucugugaccggugccggaguuuuggguacacagauaaaaugugucuccuuugucuguacuagagagggaaaagaucuggaauuggaaggacagggagauugaaggguagcgagagaggcuggagaagagagugaaaagaccgcuuacucgaaauuggugagauguuccuugggcugguuggucugaggacccgaggucauagguggaucucuucacggagugagggugaggacaggggacuggucucccaaaggagucccucugacccgggucuuuggcaccaaaugucacggacguccgugugaagagaucaccaaacaggcuuugugugagcaacaagacuguuuauuucaccugggugcaggcaggcugagucugaaaagagagucagcaaagcauggugggauuaucauuaguucuuacagguuuugggauaggcaguggaguuaggagcaauguuuugcggguagggggugaaucucacaaaguacauucucaaggguggggagaauuacaaagaaccuucuuaaggguggggaagauuacaaaguacauucaucaguuacgguggggcaaaaacaaaucacaaggguggaaugucaucaguuaaggcuauuuucauuucuuuuguggaucuucaguugcuucaggccaucuggauguauacaggcaggucacaggggauaugauggcuuagauugggcucagaggccugacauacugaccuuauguuuucaauuaaauguaccaccuuucuuuacuguuaccacauuuguaagcguguuuugaugacuauuaaauauagaugcuucccaauuuucuauagugcuccuuuucaauuuguauaauuuacagguuauuaaauggcauuacuuauuuauuuggcacugcuaaauguucauuucaaugccauggcuugggcauguuaucuccaagcuauuuaaugaggaagacagagucaagagacuuccugccucauuuugucccugccacuaaggcugcaccuuguaguggaaaucauuuuggcuuugaaaucugaacuugauuucagugccaaucuuuaucacuuaguagguuugugacaguuaagcaauuuaccuaacuuuucugcaugucaguuucccuaaauaaaacacugcuggacuguuugaggguuagagauaauaaauauaaagagugucaaacaagauugguguucucuaaaucauagcuauuaacauugcuuuacuuguaacuuuggguaaguugcuuauaaucuaaaucuuagauuuacuucauguaaaaugaaaggauugaauuggauugguauaaaugggucuuaggacccuugagguaauauacagauauuuuuauuuuguacacuuuugugagguuuguaguguucaucagauucauaaagugauuuguaaauccccugaauaaaaggguaaauucuaaacuaggugaucuccaaguucuuuucuuaugauaaaauuuucuaccuauaggcuacauagucaacuucagugugacugagguuagggaaauuauuuuugaaaaauuuuuugaaucaggaccucagaauguaaauguuuguugcuguuaaaaguaauuauuauagucuucuagcuuuugguaacugauggaaacacuuguaucaaguaaccaucuugcugauaacaauuauaaccucuggacaaaacauuaaagaaaaagaaacacuguuugaaggcacuggagagugaucaaaaguagguaggaauuggagguaagaugcaccuuuauggaaaggaaccaaacugguugaggucuacauuuaucugacuuauucuuuaaauaaaugcacaaguuuaugcaguauaugggaauacagcucaagcagaaaucagcccucuuuuugaugaguuagaggaugauauuuagggcaaugaaagcaggugaaaaauugagagugaucccagaaaggaaggagccacaaagugagggaacccccaaauuuguaugcagguuucccccacaaccaugcgggacaagauuccaggaaacccagaggcaaugaaggaacaauaggcagaaagcuuaaagaauuaaagagagaucuuagcaguugcuggagauggacuuuagaguucccacccugcuaaaauagaggaacuugguaaaugccucaggcuugcuacggaaaaccugaaauggccacacacaguauggaucuuauccuaugauuaagaucuucacgauaaaaccaaagccaaacugaaauagcuaucaauauguucuaaccuuuaagcaagcccuuacagguuaaggugauccuccauuaauucaguugucuguaagaauaaaauucauuauuuucuggaggaagcuaauacaauacagaguuccaagauuauaugaagugcccagccagaaauuaauagacaagugaggaaauaaggaaaggcaacucauuggaaaaaaaucugcagaaagagaccagcaguucacucagaugcuggauuacuagacagguaccuuaacuauaauaaauaugcuaaaaaaucuaagggggaaaaaugaggaaauuccccuaucccccacaaaaaaccaguaucaggaaugaaagaggguacaucaguauagauccuauagauguuaaaaggauuauuagggagucuuaugaauaaguuuauaccaguaaauuugacaacuuagagaaaaaugacaaaaucuuuuaaaaacagaacuuaucaaaacuaguaagagaagaaauggaaacuuguaaguggguuuacauuuuaauaaaaggaauuguaauacguaauuuaaaaucuucauacaaaggaaauugcaggcccacaggauuucacugacgaauucuaucaaacauuggaggaaaaaauaauaccacucuuacauaaacauucagaaaaaagaggaagagaagaacuucccaguuucuuuuaugagucuaaucuaacuaauacaaaaaccugacaagggcauuuccaaaaaagauugcagacuaacaucucucaugagcacaaauacaaaaauucccaauaauuuuaaacuuuacccaaauuacuagguuucaaaaagaauucauuaguuuuuaagauuaauucaacuaacaguagauauuguacugcuuguauuugcuuaguuugccaucacauaagaaugugaauaaauauugauguuauuauccaauuuauuaucagaaaugaccagguaucauaugaggauaaccaacuaguauguuuuuuggccuauauagucucccuuaguacuuguauaauggguaguuauucguucuguucuuuuuuuuaauauguguuuaaaaggaauugaauuuuaacccauuuuucaugauaauuauggaaaauuauuuuuuccaaugacauauuuuggaaacuuucaaacccacagaaaacuuaauaauuuaacaaaugccuucauacugugcauuuugccacauuuguuuuaccucucucuuucuacaucuauauauacauuuaugcauacauaugauauauaaccuuuuuuugguaaaccauuugaaaauaaguuacauaacaucaugagaguuaaccccuaguauuuuuuauauaccuccugagaacaagaauauucucauacacaaacgcaauacuaugauuacacucaaauguuguaaugauauaggaauauuauuuaauacauaguuccuaguuguuucucguuugucccaguaauguccuauauaacuuuaaaaaaaauaucugaaccggacaugcauuggauuuaaugucucuuuaaucuaacaucguuuugcuaccuuuuauguuuuuucaugauuuuaacauuuuugaaaaguccaagccacuguuuuguagaaagucguacuauuugagcuauucugguuauugccucaguaauauauuuguuuaaacaaauaauauauuuguuuaaacaaauuauauuauuuguuuaaacgaauauauuguuuguuuauuuguuuaaacaaauaauacauuuguuuaaacaaauaauauaauuuguuuaaacaaauauauuugccaagaauacuguguggcugaggaaagauaauucuuaauaaauuguuuugcaaaaagagcacuucagagcaaugaacuauggagcaaaaggcaaaaugacggaaacagcaaccuuaaguucauaugguuauccuggagauacugauucugcauugcauugucguugcuugcuuuucauuuagcuggucuuacaugaaggaaaugaacugauauuuaguauuuauccaagguaaaauucuauagcuguuuuugaauugccagucuuuuugguuuacauaagcccuugcugaaaacgaaaaaucugcugccuggaaucuauauauuauaguuauuguacauuuccuaggauucuuuugagaaaacuaauuuugaucaagauucucacucuuuacugagaagaaucauugggcaaaguaucucuucaucuuuuaagaaguuugcuucucauaaguuaaaguagaaauuguuaaauagucaauugaaacauuuucaguggucauacccaaagagaaaguaauaacaguauuauuucuuguuuaagucauuauuugcuguuccuuuuucaguuaccucauaauuuucaugacaguuuuaauagguagaaauaauuacuuucuaacuuggacuuuuucuacaaguugaauauuuucuuuuaguugagaaguuuaaaguauacuuuuaaaaacaaauguauaugguugcuugcagauacgaucaaaucacagaauaguuacauuuuaauuccuucuaucauacauuuuaauuucuccugucguguuaagauagucuguauagcuucauuguucaucugucagcuuuucaguuaacccaaaugaggaaacagucacuuuuugaaagauauuuagaagcuuugaaugucuaguuugacuuuagaguuaaaucucagaagacauauugcauugaguguauguguacguucagcuuagaacugccuuacacugcugcaauaauacugaugcacauuuaguugauacugcuuacaguuccuuaugaacuuguucagagcaguucccagaacucaaggauaaucucaacauucaucacccaccauauggcccaaacugcugcuuucagcccaacuuccagccuucguggagcaucagacugaagcagagcucucaacuauuggacuucuaacugugauccagccgacuuuccuauugagaaaccacauagccccuuuauugguuacuaccucaucuuuuuuucuuguucauaaccagucuucuuagaaauguugucuguaccacuugucuccaugcccucaucaacugcucauuucucagccuguucuagauauuuuuuuaacauacuaguaucagguuguugcagcacuauuaguugaaaaggcuauccuuucuuccauuuaauuaucuuggccuuuuuugaggaaaucaauuaacuauauauguguagaucuuuuucugaacucucuauuuugucccauugaucuuuaagccuauccuaucccaauauuuggauuacuguagcuucuaauaagucuugaagucagauaguguuuaaaccuccaaauucgauauucuuuuuuaaaaauggcuuuggcuauuuuaguuuugugccucuccaugcaaauuuuagaauuaacacaugcauuucuacaaaaaauagaagaguaugguguuuauuggaauugcacugaaguuacagaucaauuugucuuaaaauuugacauuuuaagaauauugaggguuuuuguauucuuccugauucucuuuguacuugguucucucaguuguugagggagaagucuuaaagugucucuuacuauggauuuaucuucucacacuucuauacaguuucacuuuauauauuuugaaacucuguuguuaaguccacaaauuuuuauauccuugaugaauugaccucuuuauuauuuugaaaagacccucuuuauucaugcuaauauucuuugcuccaaaaucuacuuuguuugauauuaauauagcaacuucuauuuucuuuugauuaauguuggcaugguauaucuuuuuuucauuuuuuuaucuuuaaccuaucuaugucuuuauauaaauagggugguaggcagcauaugauucagccuucuuucuuucuuuauccuagaugaaaaucucuaccuuuuaauugagcuguauagaccauuuacauguacugcaauuauuaguaugcuuggauuuaaucuacuguuuucccuuuuuaucuguuuuauucaauggauuuuugccuuucuuuggaucgaacauuuaguauuuaucucccuuuuugaacuuacuagcuauaacuauuuuauuauuuuguuaguuaugcuuuaggguuuauaguauacauccuuaauuaucacuguccccuuuaaaaugauauuauaccauuuuacuuaucaaaaaagaacuuuccagcagaguacuuccauuuccucccuggcugaccuuguucuauuguugucauauauuuuacuuauauauacauuauaagccucauaauacugugguauuacuuuugcuuuaagaaguuaauuaucuucugaagagauuuaaauaauaagaaaaucaguauuuuacucagauaguuaccauuuccaguuuucauuccuuuugugcagauccagaguuucaugugguaucauuuucuuucuuucugaaggguuucuuguaaaauuucauguauuagagaaaucuuaaugacagauucuuucagcuuucauaugucuggaaaaacauuuauuuuugccuacuguuuuggaagauguuaacaaugguauauaauucuagguugauaguuuuuuuccccuuucaauacauuaaagaaguugugucauugucuucucacuuguauuuuuuaugaugagaaaucugcuguaauccuuuucuccauuucacuguauguaauuugccuuuuuacucugucugcuuucaaaauuuuuuccuucuuacuggauuuaagcaauuugauuauugugugccuugguuguuuucuuauauuucuugugcuuggaguugagcuucuugaaucuguaaauuuugaguuucauuuguaaaauuuggaaaacuuuuagcuuuuauuucuucaaauauuuuuucuguuccucccccuucacuuucuugaagacugcaguuacgcauuuauuagaccacuugauguugcccaacagcuugcugaugucuuuguuucuguauguacuuuacuuuggauaauuucuguugcuguugauaaguuuacuaauaccuuccuccacaaugucugaucucuuauuaaucauauccagucuauuuuuuaaaaucucagacauuguguuuucuucucaggcagucugguuugggcuguuuuuauauuuucuaugucucuaaauauauuuucuaacuuuuugaacauaugaaauacauauuauauugguuuuaaugucuuugucuaauaauuuaauaaucuguaaauuuuucuucucuuugcaugccuaguaauuuuuauauuggauugcagacauauuuuuuuguauuccuauaaauauuuuugagauuuguucugggaaacaaauuacuuggaaacaguguguuucuuucagaucuugcuuuuaaacuuuauuaugcgaaacuagaaaagcacguagucuaggacuaauuuuucuccuaugcugaaacaaaaucuuucuuaguacuugaugcaccaugaauuagaagguuuucuguaucuguugauauagagauuauuucuggccuuguaugaacccuagauacuauucugucuaauccuucugaugguuuucuuucccucuguaacauuggaugcaugauaucucacaugcauguguugauugauccccuucacaucucuagacuucucauuggaguucucuccucuccaggacuuuugcaaacucuagcuacuuugaccucuggauuucgcuuuccaucuccucaacuuaaaaagagucugcuggauuccacuaagguucugcuuuucuggggcaaucccagggcucacccuuguguccuguuucuuagggaucacugcuuuuuuuuuuuuuuuuugcuugacuccaaugucuugaagguuguuguuucauauauuuaaagugucuagguuuuuuuaguuguuuuaggcaagagggucaauacucccuguuacucuauauuggcacaaguuuuaaauuuuuuuggaaaauuuuucaaaauuucuauaagugacaaagcuauucuuagcuuacauaccauaaagacauaagugagaggcugaguuuugccuguaaucuguaguuugcugacuucucuuuagaccauuuuucuuuaauaugauuaucaauauggcuaccaccuugccauuuguuuucuauuuaucccaucugguuuuuguucuuuuuuccuuuauauauauuuuuguuguuguuauacuuuaaguucuaggguacaugugcacaaugugcagguuuuuuacauauguauacgugugccauguuggugugcugcacccauuaacucgucauuuacauuagguauuguuuuuuguucuuuuugaguauuuuuuacuauuccauuuuaucuucacuauugacuuauuaguuguaccucuguuuuauuuguuauuuguuucccugugauuuauaauaugcauuuuuuuaugucuucuuuaaaaaaaaaagcgggauacacgugcagaacgugcaguuuuguuacauagguauacaugugccauggugguuugcugcaccuauugacccguccucuuaaguucccuccccuugcccccccaccccccaacaggcccuggcauguguuguuccccucuauguguccauguuuucucauuguucaacucccacuuacgugugagagcauucgguguuugguuuucuguuccuguguuaguuugcuggaggaugauggcuuccagcuucaucccaugucccagaaaaggacauuaucucauuccuuauuaugucugcauaguauuccaugguauauauguaccacauuuucuuuauccagucuaucauugaugggcauuuaaguugguucuaugucuuugcuauuguaaauagugcugcaauaaacaugugugcaugugucuuuauaguagaaugauuuauauuccuuuggauauauacccaguaaugggauugcuggguuaaaugguauuucugguucuagauccuugagaaauugccauacugucuuccacaacgguuaaacucauuuacauucccaccaacagcguaaaagcauuccuguuucuccacacccucgccagcaucuauuguuucuugacuuuuuaauaaucaccauucuggcugguguguuaugguaucucauuguagauuugaugugcauuucucugaugaucagugauguuaaguuuuuuuccauauguuugcuggcuggauaaaugucuucuuuugagaagugucuguucauauccuaugccuacuuuuugaugggguuguauguuguuuucuuguaaauuuguuuaaguuccuuauaaauucugaauauuagaccuuuguuagauggauagaacacaaaaauuuucucccaucuauagguugccuguugacucugaugaucguuucuuuugcugugcagaagcucuuuaguuuaauuagaucccauuugucaauuuugguuuuuguugcaauugcuuuuggcguuuucaucaugaagucuuugcccaugccuauauccugaaugguguugguuagguuuucuucuagggguuuuaugguucugguuuuuacauuuaagucuuuaauccaucuugaguuaauuuuuguauaagguguaaggaagggguccgauuucaguuuucugcauauggcuagccaguuuucccagcaccauuuauugaauaggagauccuuuccccauugcuuguuuuuuuucagguuuguugaagaucagaugguuguagauuuauggugguauuucugaggucucuuuucuguuccauuggucuguaugucuguuuugguaccaguaccauguuguuuugguuacuguagccguguaguguaguuugaagucaggucgugugaugccuccagcuuuguucuuuuugcuuaagauugucuuggcuauaugggcucuuuuuugguucuauaugaaauuuaaaguaguuuuuuuucuaauucugugaaaaaugucaaugguaguuugaugggaauagcauugaaucuaugaauuacuuugagcaguauggccauuuucacaauauugauucuuccuauccgugaggauggaauguuuuuccauuuguuuguguccuuucuuauuuccuugagcaguuguuuguaguucuccuuggagagguccuuacaucccuuguuagcuguauucguagguauuuuauuuucuuuguagcaguugugaaugggaguucauucaugauuuggcucucugcuagucuauuguagguguaaaggaaugccugugauuuuugcacauugauuuuguauugugagacuuugcugaaguuccuuaucaguuuaaggaguuucggggcugagaugaugggguuuucuaaauauaaaaucaugucaucugcaaacagagacaauuugacuuccuuucuuccuauuugaauacccuuuauuucuuucccuugccugguugcccuggccagaacuuccaauacuacauugaauaggaguggugagagaggauauccuugucuugugccagucuucaaagggaaugcuuccagcuuuugcccauucaguaugacaucgacuguggguuugucauaaauagcucuuauuauuuugagauauguuccaucagugccuaguuuauugagaguuuuuaacaugaagggauguugaauuuuaucaaaguucuuuucugcaucuauugagauaauccugugguuuuugucuuuguuucuguuuaugugguagauuacauuuauugauuuguauauguggaaccagccuuguauccgagggaugaagcugacuugaucgugguggauaaguuuuuugaugugcugcuggauucaguuugccaguaauuaauugagaauuuucacaucaauguucaucagagauauuggccugaaauuuucuuuuuaugucaugugucuucccggcuuugguaucaggauggugcuggcuguauaaaauaaguuaggaaggagucccuccuuuucaauuguuuggaauaguuucagaaggaauggugccaacuccuuuuuguaccucugguagaauucaacugugaauccgucugguucugggcuuuuuuuuuguugguaggcuaugaauuacugccuaaauuuuggagcuuguuauuggucuauucagggauuggaguuauuccugguuuagucuugggaggguguauguguccaggaauuuauccauuucuucuagauuuucuaguuuauuugcauagcgguguuuauaguauucucugaugguaguuugaauuucugugaggucaguggugauauccccuuuaucauuuuuuauugugucuauuugauucuucucucuuuucuucuuuauuagucuagcuagaggcauaucuauuuuguuaauuuuuuuuuuuaaaccagguccuggauucauugauuuuuuuggagggguuuccaugucuugaucuccuuaaguucuucaauucaguucuucucuggucuuaguuauuucuugucuucugcuagcuuucagauuaguuugcucuuuccucucuagcuguuuuaauuaugauguuaggauacugauuugagauauuucuagcuuucugauaugggcauuuagugcuauaaauuucccucucaacauugcuuuagcugcgucccagagauucuaguacguugucucuuuguucucauugguuucaaagaacuugauuccugccuucauuucacuguuuacugaggaguuauucaggagcagguuguucaguuuccauguaauugugugguuuugagggaauuucauaauccugaauucuaauuugauugcacuguggccugagagacuguuaugauuuccguucuuuugcauuugcugaggaguguuucacuuccaauuaugugauugauuucagaguaagugccuugugucacugagaagaauguauauccuguugauuugggguggagaguucuguggaugucuauuagguccacuugauccugagcugaguucaaguccugaauaucccuguuaauuuucugucuuguugaucugucuaaaauugacagugggguguuaaagucucccauuauuauugugugggagucuaagucucuuuguaggucucuaagaacucauuuugugaaucucagugcuccuguuuggaugcauauauguuuagaauaguuagcucuucuuguugaauuguucccuuugccauuacguaaugcccuuccuugucucuuuuuggucuuuguuguuuuaaaaccuguuuugucugagacuaggauuguaaccccugcuuuuuuuuuuuucuugcuuuccauuugcuugguaaauuuuccuccaucccuuuaucuugagccuaugugugucuuugcaugugagacgggucuccugaauacagcacaccagugggucuugacucuauccaguuugccggucugugucuuuuaauuggggcauuuagcccauuuacauuuaagguuaauauuguuaugugugaauuugauccugucauaauaauccuagcugguuauuuugcacauuaguugaugcaguuucuucauagugucauuggucuuuauauguugguguguuuuugcaguggcugguaccaguuuuuccuuuccauauuuagugcuuccuucaagagcucuuguaaggcaggccugguggugacaaaaucccucaguauuugcuugucugaaauggauuuuauuucuccuucacuuaugaagcuuaguuuggcuggauaugaaauucuggguugaaaauucuuuucuugaagaauguugaauauuggcccccacucuucuggcuuauaggguuucugcagagagauucgcuguugguuuggugggcuucccuuuguaaguaacgugaccuuucucucuggcugcccuuaacauuuuuuucugcauuucaaccuuggaggaugugacaauuaugugucuuggggcugcucuucucaaggaguguguuagugguguucucuguauuuccugaauuugaauauuggccuuucuugcuagauugggggaguucuccuggauaauauccugaaguguguuuuccaacuugguuccauucucucugucacuuucagguacaccaaucaaacguagguuuggucuuuucucauagucccauauuucuuggaggcuuuguucauuccuuuucauucuuuuuucucuacucuugucuuugugacuuauuucaguaaguugaucuucaaucucugauaucuuuucuuccaccugauccauucagcuauugauuguauaugcuucacgaaguucuccugcuguguuauucagcuccaucaggucauuuauguuccugucuaaacugguuauucuaguuagcagcuccucuaaccuuuuaucauguuucuuaacuucuuugcauugaguuggaacaugcucuuuuagcucagcauaguuuucuguuacccaucuuuugaaggcuacuucugucaauucauccaugucauccuucauccaguucugcacccuugcuggugagauguugcgauaauuuggagaagagucacucuggccuuuuagauuuucaguguuuuuucauugauucugucucaucuucgugaguuugucuacuuuugaucuuugaggcugcuaacccuugaaugggguuuuucuguggacuuuuuuguuguuguuguugaugcuccuguuguugcauuguuuguuuguuuguuucaauauucaggucccuccucuguaggguuugcuggggcuucuguaagguuugcuggguuugcuggggguucacuucaggcccucuucauccgguucacucccauaccuggagaugucacucaacaaggcuggagaacaggaaagaugggucccugcuccuucucagaucuuugacuuugaggggcgccaaccugaugcccguaggauuguuccuguauuggguaucugccaaccccuguuggagggacucacccaguuggguggcacagggauguggacccauuuaaugaagcacuuugucccuuggugguggggugugcuucacugggggaaacccgcucaucugggcugccuggauuccucagaacuacgaggaggaaaggcuaagucugcugguccgcaaagacuguggccauccuucccgcuaggggcucaggcccagggagaucuagguucugucccugacccucuggcuggaguuacagaguuccugcaggggaaccccacccagugaggaaggaugggucagagucaagccugaaaaggcacucugaccacagucugccacagccgguguguugggcugugggagacaugucuucguaccaagccuuccagccucccuggucccaggaggggaaaagugcagccuggagcuauacagagggaugcugccuucuccugcccagggaacuuagcguguuaggcaguugugagucccaguguuguuucauacgccucccacaaggagcucaaauggcuuagacagcaggcaaccgcagcuauggugcugguugccccucccccugggagcuugguaggcuuaagcagauuccagcugagaggcgguugacaaucuguagggcucugggguugggaugcuagccccaguggugugguuuugugagugagaucauccaauccauggguugcacaguucuguggaaaaagcacaguuucccuugcuggguagcaugcucauucacugccucccuucacuggugggagggggcuccccugccccauguggcucagaugggccacuacaccacauuguucuuccuuccucucuggaucacacuagucuccuagucaguucugaugagagaaccuggauaccuugguugccagugaaggauucacaugccuauuauaguucuuuuuaaugggacccucugaacgccgcuguucuguuucuagucggccaucuuggcccugcccccaauaugcaucuuuaucuacuuccucaaugguauuacaguacuucacuucuaauguaagacuuuuauaacuuuuauauuucuguccuuuguacuauuguucuuauagauuuuacaucuacaucaaaccugucaaaacauuauuauuuuuuaauugccuauuaagaaauugaacagugagaggaaaauuuuugucacaugugugcuauuuacacuucuuuucuuuguauagaucuaaauuuugaugugauauccuuuuuauuuucuauuugaaaaacucuuuaacauauaguacagauuugaugaaaauggauucucucaucuacuuuuuuucuaggugaaaaauuuauuuucuccuuaauuuugaaagacauuuucacuggguauaaaauuccaguuuggcauuuuguuuuucuuucagcuauuuaaaaguguauuccacugucaucuggcuuucauaguuucugacaagaagucugugacaauuccagaacucuacccugaaagaacaaguuaccuuagacucugaacucuuaucucugucuucucaacucagugaaauuucuguacuuuacuuaggauccugccuuuuucucuguaguuuggaaugcucaccuuauuuucugucucauacauucuaguccuucacuggcuguuugcucuuggaucaaaaguguuacuucauauauuuaauccaguuuuuuguuguugcaaaaaucaagagaguaaaucuggacccuguuacuguaucauagcuagaauaacauguucuuuauuucagaaaguuaaaaaauaaauauucauugaauccacuaggaacgacauuccuucuuuagaugcuagaauuauaaaaacauuaacuguauaggcuuggucucuagugucaugaaauuugcauuccauuggaaucagaaacauuuaauaacugcaaaucaaaaagguaauuuaagauaauagagaaucugugaagacaguacugcagggugguaugauagaguaaugggggaaagaguauacuuuaaauaggaaaaacaugaaauugcugaggugguaauauuugacuuuagccuuguaauaaaaaacaggaauugacagacuguggucugagggccagugucuguuuuguaaauaagguuuuaugggaauacagccacagucauucuuuuacauauugucuauagcugcuuuguaacaauaaugggaaaguugaguaguuggaccauaagccuaaaauauuuacuaucuggucuuuucagaaaaaaauugccaauccuuaacauaaaagaagcacaccacuugcugauugagcugagaucaccacugacuacauuacuuauaaaccugguauauacuuucuauccuuauucaacauaaucaaccacuuacuccuucuagaaaucguuucuucuuuuucuuagcuugucugauaccauguucuuuuguuuuauuuucuaaucucuguagcaacuucuuccucagcuucuuuagucuaauaauuuuccugaaucugaucuuuaguguuacaguauauuagggcuagguuucaugucugucuucucccuuuuuuuuuucuuaaauagcaucaugcacuccugugucuucaauuacugucuauuuccucaugacuuccaaauacauaucucuagcuaggccugucuucugaauuuuaaaccuaugucuccaacuaucuacaugacauucaucaaucuaaauucaauagguuauaaacagaauucaugauauccucugaaaaagcugcuuuaccuuuauauuucucucuuucaguaaauggcaucuauugcuuaugucaguacucuggaauucaucaguguaaccaaucagucauuaagaccuuucaaaauucccccuucuauguauuugauuguuuauaguucuuucugugcuucuauauuccuaguccaagcugccuuuccaugaccucugugguaacuuccuguuugucuccacauauccauucucaaagugguucauuggacaccauagccagaguuacuguaaaugaaaaucaguggcuucccaguguuuuuaggauaaagaucaaagucuuuuccaugguuuauagaguccacugaagaaacuguccucccuagcuuuaugcuauaccauuuuccuuuuucuagguaaucuggcauucuuuuacuuccucaauucuccaaauguuuuauuagggucuuugcauguauuguuucuuucuugcauggaauggcuguuuucuuucuucuuugcuuacuuaauuccuguuuucucuaggcagccuucccucacccucacucccuccucuuagguucucauauuauuuuguccuuaguccuuuuuuuuuucuuuuuuucuuuuuuuuuugagacagaauaucacuguuacccaggcuggagugcagugaugugaucguagcucacugcagcccugaauuccugaguuuaagcaauucucugugccaaagccucccaaguagcugggacuacagguacaugcccaaguaauuguuguuguuguuguuuucaguacauuuuuuuguaaagacaagaucuugcuauguuguccagccaugucuugaacuccuagccucaagugauccuccugccucggucucccaauguucugggauugcagacaugagccacugugcccagccuauccuuagucuuaagugcacuuauuacaucugugauuaaucacaacuauaauuaauguaauuauuugucuuccucacaaaacuguaaacuccauaacagaaggcuuugugucuguguuguucgccauugcaucgacagcaccaagcacauuuucugauacuaaauauuugugaaaugaaauaauaaaggaguauauuaugucuuuuaauuaucacaaaaccccuguaauuuauuauuucucuuugggaggcuuuuaaauugcuugggagaaauuugguaaagaauaauuguaauagcugccauuuauugagaaacucccaugugcuugcuguucacuaggcuacauacacaaucuuauuuuaacccuuacaacacccuuacaauguaguuaauuuuauucccauuuuuauguggggaaacaggcucagagaagguauuucacuugcucaguguacacaguuagugacagagccgugauucaaaccuaauugaucuuucucuauaugcucuuauacucuaccacuguauguugcgccuucuaaccagauaguuacugcgaaaacuccugcaauuucuaauuuuaucacaaggcucccacuauauuuucccccuuuucauuccuuuaacagaagaguuuaaaguuaguaucuagacauaccagcuuauauauucauuaauuaauaauuuauauucacacaaugauuguagaaaugugaguguuucuuagauuaccaaacaucugugaaaucgugaaggaguauugaaauuuaguaauuugguuuggaucuuugaagauauucuguagaauuguuuuccaaaaguuacaacugguuuacaauuuuuuucuuaauugccauuaacaaguuuugacccugagaugagaaauuauucacaaauuucaauuaaauacuggaaugcuucauauuuucuguacuuuaggacagggauccccaacccccaggccacagguugguacugguuugugaccuguuaggaccuggacuacauggcaggaggugagcggugcgugagaaacauuacugccugagcuccaccuccugucagcgacagcauuagauucucauaggaggacggaccuuauugggaacacacacaagagaucuagguugcggacuccucaugagacucuaaugccuaugaucugaggugggacaguuuuauccugaagcucccccacuauccguccagggaaaaauuuggucccuugugccaaaaacacuggggaccucugcuuuagaacaugcaguaaaacuugaauggauuguuuaacagauuguuucuuuaaugaauuuaucacauaaaaucaggcauugcuuugaaaaagugcaguuuauuucacucuguuauuacugcgugguuccagauuguuaaagauucagcuacuuuaaagcagugucuuaaagaauuaauuuuuguccuuucagcauuggcagauucauuuuugucauggaacaucuuaucuccuuaugaugcuuuugaaguauuaauauagguggaauuaccuaugauaguuugguggaacuaaacucuuugucacuuuuucuauuugugagauuugcauauaguauuguagcuuuuuucugaaauuuuuuguuuugcaacgugccuucauaagaaacucaucgauuuguauauuuaaaaagaggcuguaaagcauuugaacuagccccaguaggaucauauuauaauuaauaauaauaauaauauuaaugucaccagggcuugcauaacaauucauaauaauugucuuuacacuuaaguuuaacuacuaaacuuuguagccuaauauagugauuuuuaucacaaugauaaacuuuuuuauuuaccucuugaacuguauguaagaacagagaccaguagaccuaguuuuuccugguuauuuuguagaacgggaauugggaacuggaauugaggaagugauuucaauuucauguaaauuuuucugcuauuaauuaguuggccuauuaaauuuuuagaguagcuauugaacuuuugcaaccaguuuuauuuugaguacuuuauuaaaguaucaucuguuagcuuuucauaucaucucaccauauuaucuuacugagguaaaauggaauuuuuugcuuacugauuuuuuacauaagaauuaagugauacccauacauaccaauaacauugaaauuccaggcuuucccaugaaggaaaacaguuaaauuaaugcuagauuuauaaggcacuacaaaaaaaagcacuaaauaaauuuuuaauuuaaaaauaaaaaauuaauaguguugaugggggguggaauagacauuguagaauccuaauacuauuuaauguuguucauauguguaagaaagacacauuauauuuuaaaauauagauucuaauauugaaagaaaaaaaucaucaguuuuggagaugaaacgcauuuuuaggaaucuuauauggaaacuucaauaaggacauuuuuauaccaguggaaaaccugauuggaacaccuuagagacauauuaggcacuguuguuuggaaugccagauaaguuaaccucuguaagauauauauucuuauaaaucacugcuagcauagcuguaauaugugaagauaauuuauuaauuuggacugaugcugaauguagacaucuuccauaucuaaccuuaagcauuuaaaaaaauauuuuaggacuaauuauuuuguccaaaaaagcaaucuuuugauuauugaucuucacagaauugauuuguaagaugucaugaucaauugugguuagcaucuuuauuauuauauccauuccaagauaauuuuaggcuuuugauaccuugauaccuuugucucuuccaacuuuugcagagacuuuccuugcuugcauacagagaagagcuaguagcuaaugaagaaugugcaaaccugccuuuuuucccucuccuaagaaaggagaauucauccacugccacuguaccuuuuuuuucuuuucuuuuuugucuugcacagaagacagacaucuuccugugaagggcuuguggcaaaccuauccaacucggguuucuucuuccuugagaacgaucugauucaucaucaucugaaccagggaucacagucuaagguccaggugagggcaagucagucuauauguuaagccaguucuuuucuggucagguaagucauacucaggcaugaacucacucagcaucagucagccuuaguuuuuuaaaaguuuccuaguccccagagagauaauacaauuuaucuauucauuuauucuaggaugcaccuaaacuauugaugauuaaucaccuuauuaaaugauuccauucuguguauaaugugaucauuuucaacacacuuguucaucuuaaauuccagaacucuuaaaaggaguauauguguggggugagagggagaaaaauacugaaacagauagguauuucuagcugcaauuuuaauacuuauccuuaucuucauuuuuauuuuaugcguaagaguuuagaacaacuuaaaaucagccuagaauauaugaucuuauaccuucguaauuuuaauaacguuugauuauguuuguagauggcuuggaaccagaagcugauugagaauauuagagcuaacauuugcacucauggucaucacggaggucuuuguuggcuugccaugaauucuuuccuuuaaugucaaaaugacuaagacagagacaagaauuuuccuguucuguaucccacuucuauaugcuaguaauaagaaacuucugauugugccucaggcaaguggucauagcuaauugaaauccaguuuuguaccuugaugcuaucuuacaacuugggaaguaaauuaggucuguggcuaugaggcuauuuucuggacaaaauagccucuuauuuuucaaaaaaauuuuuuuauuugaggaaaaaaaucuacauguauucugacauuuauaauccuucaaaaugcacuugggcauuaugugaaauuuguuuuauagguggacauuuuaaguaaauuaguuuaagucuuacaaaacauuaauuuguuucaucaugauaaugacauugugugcauuugguugugaaaaaaacagaaguaguacuuuaauauaccuugucucugacuuucacccacacauagcagauaugaauaaauugggcauuuauuucuccuauuggcuaauuuuccaagugacucuuaaguuaugaacugaaguuaauauacuucagugaguuugcuacaguaaugacuccuggucacuaggaagaagagagauugucuuccucugaaauuuuuccaaccauuaagguaaauggguuguaagaauacuguuggcuucuugagauacauuguuuuguguuuauuauucaaaaacaucuauacuaguuuugagcaagagaacauuucuuuggcuggaaaggcaacuuuuuaaagcauucauuauuuggaaccauguuacuguuggaaccuaaauaaaguaguuauuuacuugagucuauauuaggacaacuaaguuaguauggacuuagaaauuguuggguacaaacccuguguuucuaucucguuauguuuguguaauaugugcagaagaaucaaaauauuuauuggguguuuuaaaaugucuccagugguaucucucuugaacagaaaagccauuuauuuaauucugcuucagauucuaguagaaaauuauuucccacuagaucauaaguguuuuaagaugauuagguuccuguaugugcauuguaugaguaugugaacauauccuaacccaauuuuauaaauauauaaaguaauuuaaauauuuagaaaucucaacauuaaaccaagaaugucauccacauuaaaguguguauuaaauauuugaaucuguauuguaaugaacucaguaggcauguuucaaagacuuaggaaguagcacagauuuccauuaugcucuugggcugggcaagucaauuacauccucaaaggguuguaauuuuguagaaauuagcagacuacaaaggaugcuugaugguuguaucugacuggcuuuggaaaugcuuacauuucuaagacugugaauuuuuaaauaaucuuuccuacuuuuuuuccuacuuuuauccuucuuguauguuuuuguaaccaguaguuuuuuagguagacacauaugugaacuuuaaacauuuccauauuuauaguuaguguaauuauuacaacaucuguuucaauauaugaaugaacuaaaauuuggaaacuuaaaagaucaguuuuuagucuuuaaaacauuagagcaggaugagcucuuaaucaucuacacaaagauuuacaggcuuuaaauauguagauuuagauuaucugugauagcauuuucauucuauaccaguuaaugcauuucagagacaugugguguguguauuaagggacaugcuagcugauuguaccuuacuguaagcaaaacaaaauuauaaaagcagauuuguuaugaaaaauaagaaaucgaugauuuccaaaaucaaaaaugugacuuucggacuauucuauguguuguuggauugaucugccuuuucuuacacaagagcauacugcugaccccaccacaagcuuuaccuguuaaguaaaauauguuguguuuggaauauagcauagccuagagccaggcauuauggagaugauaugcugaaauugggguuucuuuucuucauucucccuuuccaguuaggauuugauugcauuacuguaauaaacauuaacauugaaaucauguuuuaaauuucuucauguucauuuucuggccucuguaggacacacacagaaaagaccagugaaugccauuucaucuaagaagcucuuuaaaugcauccaagaugccagaaauaacccuuucauaccuccugaguaguagcaacauguaaugguauaggaagaaauauuccaccuagcuuuucuuuugguggugucuugccauuaacucauaaaaacguauauccuacuauuaucucuaccauaccuucaugucauugguuagauugccugauggcuacuaaugucucaaguuaauagccacagaauauuucagaaagguggcguccacuuuauaaaaugugucuaugauugccaaagucuuauuuggcuagaaacaacuaaauuuaguugaccgaguaaaauuguauauucuuagaauaugucacuuaaaacaaacaaauagugauuuacuuucaguucugaaaauauuuagaaggauuuguuaucucuugcagaccuuccugcagacuacuaaugggaugaacacaauauaucacuuuuauaauagugagcuauuaaaggcaagcauaaagcagucugaagcccauaagugcugccaacagcuccugcuuuaaugaauucccuuuuagauguccauuaaaugcucauggcaaauguacucauaauggaaauggcaaaucuaaauggguagauaugaauaauccauggaguuuaaauucuguuuaugaucaucuucacauuuaguuuucaagacaacgcaguuuaguuuucauuacaguuuggaauaaagaggacagggaguaauugauugcuucaagcagauuaaaaucaaugguuuucuuuucaaagaaccaguucaaugcaguaauuccaacuuuaaacauugauuuagaggacucaacacaaaauguuuugugcugugugaacuuuuauauaggaagacuaauauuaauuuuauuccccuguauaucuguauagugaaauauagagguuguuaguaacaugugcaugacuuaauagugaucuauauuaagucauuuugauauuauugcagucauauaaugaaucagugagauucccgucaucacuguaauacuguuuguaacccauuagcacagagaaauuacagcccaucauacaucauuacugugauugaggcuuuauuaccauauucucaaauugcuugcuugcuauaaaacuaaauagacacaagacaacuauagguagaguagagacugcgcauuauugugcuacaguaaugagggauuauuguaccauaauggguugaaacuuaugaggaaaauaaacuuggcaguaauagaaaacuggagacucuuuuuacauuuguuuuuauuacuuuaaaggucaaauauauuuguuaugcucagguuauuguuuauguauuacaugaaucauagccuuuuaauauuuucuaaagauuuuuuucacccccacccccacccccaauuguauccuuucaaagucuguggccugaugcacuuugaaugcuuaggacuggacuuggaaucuguguuuuuccuguugugagaugagacguuuuacugcuacuaagccuaccauuucugaggguagguagaaagcuuuaaacuuuaggcuauuuucagcauacuauacauuuuguuuacaguguggauaggccaguggucuucacgcucuucaguugaaauaaauguauuaaugcagcaauauucuaagcaaugaauacagauuuaaaauauggaacugucuagggccugauuguaaaagacuuuugauguuucaaagaugaaaauagaaaaaauauacugcguccauauuaaagaagaaaauccuacgacaguagaacuuacuguaguuauaaccugggaccaugcuguccucuuuggaagaauauguugccuauguugccuuuucuaacuuuagagguuauuguugcuuuggcuaaaaauuuauauguaaaguguuuuauaaucaugaacauaugcuaauuucuggguuuuguuuuauauuauuauuuuuauuuauuuauuuaguguuauuuuuuagagacagaucucacuguugcccaggcuggaggguaguggcacuauaauuagaacuuauuaaauugugcauauguucauucacucucuguugagucuuguuuaugaguuauaacauugagagcauaauaugaacaguguaaagcccaggguacugacuuuggagauaagauugcauggauuuaaaguucucagugcagagugguuuucugaucucaaucucauugugauuugauaccacgacaauuuaaauaucaaacaaugacccaucugggcaacauagugaggcucugucucugcuaaaaauaaaaauaaaauaagagcugggcaugguggcgcauuccuguagucucagcuucucaggagacugaaacaggaggaucauuugagcccaggaguuugaggcucuagugaacccugauggggccacugcagcccagccugggcaagagugagaccugucucuaaaaaauaauaauaaaugaaugaauaaauaucaaauaauauaaaaugaaagccagaaauuagcauauguucaugauuaugaaacacuuuauguauaaauacuuugccaaagcaauaguaaccucuuguuaacuuagaaaaggcaacauauucuuccaaagaggacagcuuggucccagguuguaauuacaagccacuuacacauuacucuuaggguuaucauauguaauuaccacccccuuuguaaagcauauauuuuauuuauaacacauacuguaguuguagugguauaaaaccugaaugcuugcuuaccaaagaacugcaaugagacaugcugcauaaaaggaaagcuuagaauuggcugaggggacuaugccuaaaugaugccccagccaacucuaccugguauauucuucaaugaagaaaacuguaaaacauccuaaucaaccaacuucuuuccaugcuugccagaguauauagccacuuugaauuacaugaauguuuuugugacucgguucauuucaucacuucaugggagcaccuuccauguuaaaaacagaugcagugcaaaagcagaaagccagaaauaauagugagaggcaaaguuagagaaaugugcauauuaaaucuuuaaaauacucuaugacuuuuuccugcccagcaucuuuugggggaaaaagagagaagaugaauaaauuaaagguuuuuuucuuucuuuguuuuuuugagacaaggucucacucuguuucccaggcuggagugcaguguugccaucauggcucacggcuccuggcagcuucaaccuccaggcucaagugacccuccugccucagccuccugagaacugggaccauaggcaugagccaccacagguuugguuuuuuuuucuuaauagguuggacauauggcuauaaauaaaaaauaagaaaauuaaaaaagaguaagugcuaagaagaaaaauaaaaugaaauuauaaguauaagaaaugcuagaugggguuguuauauauaugauuuuuuguagaaggccuuucugauaagauggcauuuaaggaaaaaucuaaauaaagugcaggacaagccaagauauuuaucuaugguaaaaaaauaucccaggaacagugaauguaaguguucugagagagaagcauauuugauauguaugcagaacagcaagacugcuauggcucagcagauaaagggggaaacauaagaaauuaaacaugauaccuuaguaauuuuuuaaaugaauuuaauaacauuaaagucuuucuguguaguuagguuuuugcuauuagagaggugguucuaagucaaaugaugcuucuaauaucuuucuuaauauauuggauaugaccuuguuuuuuaaguauuuaaauaugcuugaacauguuaacccgaucauguaucuuuuguggaggucuagaguuuuuuuuuguuuuguuuuuuaggguuuuuuuuuuuaaugauacaggcuuuauuaucuuccccauuuugcagaugagaacacugaggcauuuacccaguggcuuauaagcugauaggugcuaaagccaggaaucaaauucagaaaguguagcccagauucugaacuuuuagccauuguuugcacuguuuguuucuuuuuuuguuuuuuuuuuuuuuuuuuuaaguaauuucaacuuuuauuuuagauucaggauaugugugcagguuuguuccauggguauacuguauaaugcugagguuugggauacacuacaacccguuaccaagguagagagcauaguacccaguagguuuucuuuucuuucuuucuuucuuugagacagagucuugcccucuugccaaggcugaagugcaguguugugaucucagcuuacuaaaucuccaccucccagucuuaagcaguucuugugccucagccucccaaguagcugggacuguagguguguucuuccaugcccagcuaauuuuuguauuuuuacaaaauacaacaaaauauucaagcuauuuuauuggccaagcuggugucgaacuccuggccucaagugguccagccaccuuggccucccaaagugcuaggauuacaggugugagccaccucugugccucuccccagugucucuuguugcugucuuuauguccaugaguacucaauuuuuagcucccacuuauaagugauaacaugcgauauuugguuuucuuuuccuguguuaauucacuuaagauaauggccuccaucugcauccauguugcugcagaggucacaauuuccuucuuuuuuaugguugcauaguagucuaugguguauauaugcuacuuuuuccuuuuguucuuacaauuuucuaucuuuuucuuuauaauuucagcauuuauuuuuagaugucagggguacauaugcagguuuauuacauggguauauugcaugaugcugagguuuggaguaugacugaacccaucacccuggaagugagcauacuacccauaguuaguuuuucaacccuuucucccucuagcaguccgcugugucucuuguugccaucuguauguccguggguacccacuauuuagcuaccacuugcaaguaauaacaugugguauuuguuuuucuguuccuguguugauuuguuuaggauaauggccuccagcugcauccauguuacugcagaggacaugauuucauucuuuuuuauggcugugugguauuccaugguguauauguacuauauuuucuuuacccaguccaucauugaugaacaucuagauugauuccacaucauugcuauuguggauagugcugcagugaacauaugaguacauguguuuuuuugauagaacaauucauuuucuuuuggauauaugcccaguaauaggauugcugggccaaaugguaguucuauuucaaguucuuugagaaaucccaagguacuuuccacaguagcugaauuaauacauguucccccccaacaguguauaagcguucccuuaucucugcagcuuugccagcaucuauuguuuuuuuuucuuuuuugacuuuuuaauaauagccauccugacugguaugcaaugguaucuuacuguaauuuugauuuucauuucucugaugguuagugauguggaguauuguuucauguguuuguuggcugcuuauaugucuucuuuugagaaguguugauucauguccuuugcccgcauuuuaauggagcuguuuuuugcuugcugaauuguuuacauuugucauaaaguuuggauauuagacuucuguuguauguauagguuuuucucucauucuguagauugucuauuuauucuguugauaguuucuuuugcugugcagaagcucuauaguuucauuagguuccauuugucaguuguuguuucuguuacaauugcuuaugaggacauaaacauaaauucuuucccaugacugauguccagaaugauguuuccuagguuuucuucuaggauucuuauaguuugaggucuuauauuaaaaucuguuaaucggucgaguuaauuuuuguauaugguauauacagcuacauauagcuagccaacuaucccagaaccacuuauucaauaggaaguccuuucccgauugcuuaguuuuguugaccuuguugaagaucagaugucuguagguguguagcuuuacuucuggcuccucuauucuguuccauuggucuaugcaucuguuuuuguaccauuaacaugcuguuuugguuacuguagccuuauaguguaguuugaaguuggguaaugugaugaaugccuccagauuuguucuuuuuguucaggauugcuuuggcuauucaggcucuuucuguucuguaugaauuuuagaauaguuuuuuuuuacuucugugaaaaaauggcaugguaguuugauaggaauaguguugaaucuauagauugcuuuggacaguguggccauuuuaacaauauugauuccuccaauccaugagcaugcaauguuucuccauuuguuugugucaucugauuucuuucaacaguguuuuggaauucuccuuguagaaaucuuuaccuuuuuguuuagauguauucuuagguauugugugugugugugugugugugugugugugugugcacgugcacagcaauuauaaaugugauuuuauucuugauuugucucucagcuucaauauuauugguauauagaaaugcuaguaacuuuuuguacauuaauuuuuguauccugaaacuuuacugaaguuguuuaucaguucuaggagccuuuugacagacuuaaggguuuuuuucagguauacaaucauauuguuggccaagagagauaguuugacuucuuuuccuauuugcaugccuuuuauuucauucucuugccugaaugcuguggcgagggcuuccaguacuauguugaauaggguggugaaagugggcauccuugucuuguuccaguucucaaggggaaugcuuccagcuuuugcccauucuguaucaugucggguauggguuugucauagauggcuuuuauuauuuugagguaugauccuuugaugccuaguuuauugaggguuuuuaucauaaugguaaguuggauuuuauugaaaguuuuuuccacaucuauugagaugguuuuauugaaaguuuuuuccacaucuauugagaugauuuguuuacauggugaaucauauuuauugauuugcauauguugaaccaacuuugcuucccaggaaugaagcuuacuuguuccuggugaauuaauuguugaugugcugcuggauucaguuugcuuguauauugucgaggauuuuugugucuauguucaucauggguauugacuuguaguuuucuuuuuucauugugucuuugccaggauguaccacauuuucuuuauccauuccaccauuuaugggcaccuagauuaauucuaugucuuugcuuuugugaauagugcugugaugaacaugcaaguguaugugucuuuuuaguaaaaugauuucuuuucuuuugguuauauacccaguaaugggauugcuagguccaaugguaguucugauuuaaguuccuugagaaaucuccagacuguggagacagugccugaacuaauuuaucuuccuaccaacaguguguaagaguuccuuuuucucuauagccuugcuagcuucuguuguugguuuuuuuuuuuuuuuuuugcuuuuuaauaauaacuauucugacuggugugacaugguuuugauuugcuucucucugaugauuagugauguugaacauuuuuuucauauccuuguugccaccuguaugucuucuucugaaaagugucuguucaugucuuuugucuauuuuuuuuaaugagauguauuuguuuuuguuuuuuugcuuauugaauuaaguuccuaauagauucuggauauuagaccuuuguuggaugcauaguuuacaaauauuuccucccgguuuauagauugucuguuuguugaugguuacuuuugcuguguagaaacucuuuaauuaguucccauuugucaauauuuguuuuguugauuugauagacugcuagcuagacuaagaaagaaaaaagagagaagauccaaauaaguacaaucagaaaugacaaaggugacauuacaucugaucccggaaaaauacaaaggauucucagagacuauuaugaacaccccuguucacacaaacuuagaaaaucuagaggaaauggacuaauuccuggaaacaaaaccuuccaaguuugaaucaggaagaaauugaagccccgaacagaccaauauugacauuugaaauugaaucaguaauaaaaaccuaccaaccaauaaaagccgcagaucagauggauucacagccaaauucuaccacauguacauagaagagcugguacaaacucuaccgaaacuauuccaaaaaaucgaggaggaagugcuccucccuaacucauuccgugaagccagcaucagccugguaccaaaaucuggcaaggacacgacaaaaaaaacuacaggccaguaucucugaugaacguggacaaaaaaaauccccccaaaaauacuagcaauccacaucuagcaucauaucaaaacguuaguucaccauaaucaaguagacuucauuccugggaugcaagguuguuucaacauaaugcaaaucaauaaaugugauucaccacuuaaacagaaugaaaaaccauauaaucauuucaauagauggggaaaaagcuuuugauuuuuguucuugauaagauaugacagaaagucucagagucagagccagggacuuucuuaaauaauuuuagagcuuuuaguugcaaaaugucuuuguuuuuacugcuggcauaaauagguuuuccauuuauuucuagcacucaguaaaaacauauuauuuaauuuacuggcucuuccaauguaguauaugagucugcuaaaguuugugaagucuuguucguuuauuuauuuagguugcugacaaguggaaauaggugagauaugaaguuuuggggauuuuaauccuguagaagggguccuugaauugaaaaaaaguuuugagaaccaguugccuucuucccagggagaagauggagcagaggucccaaacaugguaaaacugagguagaaaagaagaccuuaggagaagcuugagguucaaagagagggaauaaguuaaaaauguaaaaaguuaacuuuugaaacagagaagaggaaacuagugaagaaggaauucuuccucgcugcauucugcauuaguuaucuauugccgcagaacaaauuaccccuaaacuuagaaguuuuaggaaaaaucauauucuauuucacagacuuccugaggcacaggaauuucggaauggcuuagcugaguaauucucacuuaaggucuuuuaugagguuucagucgaaauguugauccagggcugaaaauucugaaaacuugacugggguuggaaggucagcuugcagaauggcuugcucacguaacuguuaacagaaggccucaucaguucuagccuguuguugacaggaggccucaccuccuugccacaugaagcccuccauagggcugcuugauuguccccaugauauggcagcuaauuuccccaaagugagugaugcaagagagagggugggaaagcuacuguaaaaauugggggucauguuauuaauuauuuguuauuuauuuauuauuacuauuaagcaguaauugauagcacucauuuucuucauuuauauugugauuccucauuguuuuugaucaucucagggcacaaaauaacaaucucccaaaacaaagaaaccaagcuaccaccaccaacuugugauaaauacaaaauauacauaauuuauguauuuugaaggaaguccuguaauauccuaguugaaauuauuucuugaaguacagucacacaucacuuaacaacaagaguauguucuaagaaauguccuuuuaggcaauuuuguuguuguggaaacgucaggaacuguucuuacacaaaccuggaugguauagccuacuacacaccuaggcugcgugguauagccuauugcuccuaggcuacaaaccuguacagcauguuacuauacugaauacuguaaacaauuguaacacaaugguaaguacuuauguaucuaaucauagaaaaggcacaguaaaaaauacacuuuuuuuuaaauuuaauauuauuuuaaguucugggauacaugugcaagauguacagguuuguuacagagguaaaugugugcgauggugguuugcugcaccuaucaacccaucaccuagguauuaagucccacaugcauuagcuauuuauccugaugcucucccucccacugcacccccgacaggcccugguaugcaucguucuccucccuguguccauguguucucauuauucugcucccacuuauaagugagaauaugugguguuuagucuucuguaccuguguuaguuugcugaggauaauggcuuccagcucuauccaugucccugcaaaggacaugaucucauucuuuuucauggcuacauaguauucuaugauauauauguaccacauuuucuuuauccagucuaucauugaugggcauuaggguugauuccaugucuuugcuauugaaaaauacacuuauauuuuucauagauccuaggccuauacagggucaggaucagcaagacacaacuaacuauaaaaauuccuaucauguaguuaggauaggaccuaacuauauaguuauauauaguuaacuauauaggaacuaacaauauaauuagguccuauccuaaccauaugauaggaauuuuucaacuccauguaauccuaagggaucaccaucuuagaugcagccaauuguugaccaacaugucauuauauagugcauggcuuuuguacgucauggcuacauuuaaauaugcuuguuuucaguguuagggaaauauauguggugaaagagaugauuaauuaaugcugguguguuguuugcaucaaagaggaaauuuuccuuuuacuuauauuuugaggaugauugggaacaucaagaauagauuuauauuacaguagcacucacauuugaaucaucuuuggauuaaaagguucuaacuaguguccuuuuugcauugcuuuucuuaauuauaacuauaaaucaaaaacauguaaaacuauagugugccaaauguuuucuaagacccauuuaaugauuguaauaacccacucuagggggggucaucaucuuuuugucaggacaaucagguuuacggauaggcuccuacucuuaaauuugugcuuuguacagagggaguauauauuacagacacuuggauaaaucauuucauaaaguauuuucugcaguaucuucuaaaauauaaaguaauuugauuaaaaauaaauaagauuguacuuagugggcacaaaaguggaugaauaugggauaacuucagaaaaaagagauauagcugaugguguguauugauugaugacuacuuuccuguacuuaaacaguuuauacugugcaaauauugaccuguaucaagugacugacuacaguauuuucaugcagauauuccuugaauuacuuuuguaaucaguaauucuuuuugagacaaauauguaaaaugaaguauucuucuuuaagaaaaccuaggaucuuuuuauuuuuauuuaaaauauuuuauuccgaagauuccaggaacauacauaggauaaaauagugguuucaaacugguuuacaaucaguggaacuguuucuucaaaugaaauuuuacauagaagcaaauggcucagacugaaaugaggaugugggguugcaagaagccagauguuccaaugguucaguucuuacucucucuguggugcccuuggggugucucucuggcauccuaagccucuaaggagugcauuuugagaacuguggacauauguaggaauuuguaauucauaggccauaugccauucauuuggguguuagaugacacugccucagugucauuguuagaucacauaggcuagccaacaguaaacaggaauauauuuauugcauauaaaaguuauuauuagugaacauguuugucuaauugacacugauaauuagaugugugauguggggucagacacuuccaauucucaauuucuuuauauguauguaacuagagggaguuggacuaggguaagcagaagcuccuggcaccugccauucuaugguucugauaauauuuauugaccuucaaugaagagucuagaacuuuucugcuaugagauaaagaaaaagucuuaagccaugguuuggaacucuaagagauuuaaacucagauuggugagauaaaacuagccaacaugaaacuauuagagacaaucuaucaaaguauuaauaaauuguuuugcacuauaagaucuaaacuuauacagaggcaaauagaaaggaucuauuuuaaaauccuuacauuuaaaauaaaagugccuguuugacauuucaucuaauuuggugaacuggcaaauuacacacacauguauuuccuacuaagaacuagaaaucaauccuguugcacuauuaugaucuuaaauaugaucuccuaaacguguagaaagguauuaguugcuuucuuuccccuggugccuaugaguauuaauauauauuacauuuuaauuuuaaugcccccggugaaaucuguauucuuaaagaacuagaaaucugaauuuuucagcuuuaacagauuguauuguuuaugaguacaaauuaauuuuuuuucacaaggcuuuucuuaaaaugaauuuuaauauaacauuaaagucauauauauuucagcauauuaaagaauaaggaagaauuuuuuauguuggaaacuuauuuuaccuuauuagcaauuuuaauucauuaagccuuauuuuugcuuuuguaauaauaacauuuuuucaaaccaucuuaaauuuuguagagaauuuuaauuuauuugaucuuugacuauaauauucaaauugguuuugcuuugcucacaaagguaaagagaauuccaaauuuacucauaauaaaaauauuagagaaacugucaauaaauuuacuguuauaauugaaucacaugauaucuaaauuguugauaauaugaucugcucguuaaacaauagugucuggagaaaaugauggauuaauugacugauggcuaaaguuucccucaaauauaaugguuuacccaguuugauuugauuuguguaaaauaacuuucucuaauaaacaauuugcucagaggcaauagaagaaaugaaugguuaucaaaccaaacuuaauuagucuauccuagauugauauuacuuggggagucuuuguuuuaauuguggagugcuggauacaaagaguuugguucauuauuuuuuccuguauaaacacuauuguguaacuaccuauggaauaauaacaugugaauucauuuuaauaaaugcuuguaaagugaauuagcuaauuauaccaggcuaaaaaugauuccuuuaauuauuuuggauauuuaacugguacuucaguuuuauuauuguuugucuguaaaugugauuuguauuagcucugccaaacuaauuauaauguauaacuuaacaaacaauuugagcaguuuuguaaugcuuauauuguucucuucucuuaugcaaaagaaaacauuauuucuaguuugcaugaaaauaaagguuugauacaaauucacauggaaauauauguguaaauagagaagaaaaaccucucaauaugcaagguaguacuugauauaacuauaugaaugagaagaaugaacagauuuccuucaggagaagauaagccagugacucauuaguuuaacuuaaaauaugauauagcauaagagauuugauuguuauuuuaaagcuggaaagaugaguuuucuucaugcccuaucuagagagugaaaaacucgauccucauucucaaaaagaaagauuuauaguaauaauguauuguggaugucaaaaacaauaugcuucuuaaucacuuuuacuuaacagacuaauugucuuuaaaucagaaauaaaugagaacaaaggcuuuaguaauaaaaaauacagauuccaaguuuaggcuuucuaggggaaaagcaaaauagccucuaaaacaguaugcaauguaaaucauucuucuuuuaaaaauuaauauacaguaaaauucacauuuccaucuuuucugguguacaguucuguuuuaacccaaguauauauucauguaaccacuaucacagucaggauacagaguaguucuguccccugagauaaauaaauaaacaaacaaauaaauaaauaaagccucccucauggugucacaucuucccucugucccuaacacuugggauccacugaucuguucccauucacuacuguuuugccuuauuccagaauguuauguaaauggaauccuauaaaacuugaccuuuuaaaacugguuucuuucacucagcacaauuccuuugagaauccuccauguuuuuacaauacaguuuguuuucugucuccuucuucccaaauuauagcaacacuaauaucaguuuuugaaguaaauauaaauuaucugccccauauggaaacuuauuuucuccaucauaggaucccuaaaagaacuggaacuugauuuuuuacccuauucaugccuauaguucugccuuuuuuuuuuuuuuuuuugagcuggagucucacucugucaccaggcuggaaugagugcaguggcaugaucucggcugacugcaaccucugccuccuggguucaagcgauucuccugccucagccucccgaguagcugggacuacaggcacgcuccaccacguccagcuaauuuuuuguguuuuuaguagagacacgguuucaccauguugggcaggauggucuugaugucuugaccucgugaucugccugccucagccucccaaagugcugggauuacaggaugagccaccgugcccggccaguucugccuuuuuaauggcugcauuguaauuuuaugaauguaccauacuugguuuaagcugucuccaacauagauacuuagauauauuuuuuuaaauuaucuucagugcuacaguaaacaugcuuauacagcauaugauauguaagaauagcugccuucaauuucuagaaaagcaguugcuggaugaaaaaaaaauacacaaaauuauaugguuggauggauugcaauuugccuuccaagaagauugaagcaguuugaaccucacuccauuaucuugccaucaaugucauuuguaaucuuugcaagucuaguagauagaaacugucuuacucuaauuuauauuucauuaaauauuaggacauuuaaacucaguauucugaauauauuauuucuguccaauuugagcaguuucagcacaaucuuaauuuuuauaaaucucaaguuugucauuuuauuuuugccauuuuaaugggauuguagggcaucucauuguaguuuuauuuugccuuuuuuuuuuuuuuuuuuuugagauggaguuuugcucuuguugcccaggcuggagugcaauggcacagucucaacucacugcauccucugccuccaggguucaggugauucuccugcuucacuucccgaguagcuggaauuacaggugcccaccaccacacccagcuaauuauuuguauuuuuaguaaagaugggguuucaccauguuggccagacuggucuugaacuccugaccucaugugauccacccaccucggcaccccaaaguguugggauuacaggugugagccacugcacuuggccuuauuuugcauuuucuuaauggguaaugauguugaacgguuuuuuuuuccacaaacuuaauugccuccauauauccucuuuggaaaaguaucuuuucaagucuuaacccuuuuuuuuuuguuuuguuuuuuuuuuuugagauggagucucacucugucgcccaggcuggagugcaguggugcgaucucagcucacugcaaccucccuccaccucccggguucaagagauuguucugccucagccuccugaguagcugggauuacaggcgcaugccaccacaucagcuaauuuuuguauuuuuaguagagacaggguuucaccauguugggcaggcuggucuucaacuccugaccucaugauccgccugccucagccucccaagucuuacccauuuuuuaaguuagcucauuuguuuucuugcuauugaguuuugagaauacuuuauauauagauuuugacuacaaguucuuuguuggauaugugauuugcacauuuuuuuccucuaaguauguagcuuguuuuuuucauucugaaguauccauuaaauagcaaaaguuuuuauuuuggcagagucuaauuauuacauuuuuauggaucacgcuuuugauaucauaucugagaaaucuuugacuaauucugguucacaaauauuuucuccuaaaagugauagaauuuuauacaagucuuuugggcuaucuuuuuuccuuuugcuuuaacugacuugcaucuuuacauuuaaugugaguuucugauagauuuuuuuguuuuuuaauugagauagagucucauccuggagugcgaugacacaaucaugguucacugcagccuugaucucuuggguucaagugaucuucucaccucagcuucccacguagcugggaccacaggugcacuacacacccaacuaacuuuuuuauuuuuuguagagacaucuucuuucucuguugcccuggcuggucucaaacuccuggacucaagugauccuccuaucucagucuuucaaagugcuggaauuauaggugugacccaggaugccuagcccaaaagcauaucuuuaggucuuguuuuuaaucuguucacacaaucugucuuucaacugcuguguuuauaucauuugcaguuaauuauuacugaugcuuggauguagaucuacccuuuucuuuuuuuuuuaacuuuuagguucagggguacaugugcagguuuguuacauagguaaauugugugucacauggguuugguguacagauuauuuugucacccagguaauaaccauaguacucgauagguagucuuucaguccucuccuuucucccauccccuacccuccaguagacugugcugucuguuguucucuucucucugucccuguguacucaauguuuagcuuccacuuauaagugagaacauguggcauuugauuuucuguuccuguguuaguuugcuuaggauaauggccucaagauccauucauguugcugcagagggcauaaucucauuuuuuuaauggcugcauaguagugcacaguguguaugugccacauuuuuuuauccagucuaccauuggugggcauuuagguugauaugcuugucuuuguuacugugaauauugcugcagugaacauacuugugcaugugucuuuaugguagaacacuuuauauuccuuuggguguguauccaauaaugggauugcuggguggaaugguaauucuauuuuaaguucuucgagaaaucgccacacugcuuuccacaauggcugaacuaauuuacauucccaagagcaguuuauaagcauucccuuuucucugcaacuucaccagcauguauuauuuuuugacuuuuuaauaauaguuacucugacuggugugaggagguaucccauuguaauuuugauuugcauuucucuaaugauuagugaugcugaauauuuuuuauaugcuuguuggcugcauguaugucuucuuuugaaaagugucaguucaugucauuugcccacuuuucagugagguucuuguaaauuuguuuaaguuccuuauagaugcuggauauuagaccuuuguuggaugcauaguuugcauauguguucucccauucuguagguugucuguuuacucuguugaugguuuauuuuugcugugcagaagcucuuuaguuuaauuaggucucauuugacaauuuuugauuuuguugcauuugcuuuugauaucuuugucaugaaaucuuugccaaggccuauguacagaauggcauuuucuagguuaguuuccaggguuuuuauaauuuuagguuuuacauuuaagcuuuaaucaaucuugaauugauuuuuguauauggugaaggcuagggguccaguuucaauccucugcaugugacuagcuagugaucccaacaccauuuauugaauaugaaguuuuuuccucauugcuuguuuuuguucacuuugucaaagagcacauggcuguaggcaugcagaauuauuucugcacacucuuuuuuguuccauugguguaugugucuguuuuuguaccaguaccaugcuguuucaguuacuguagccuuguauuauaguuugaagucugguaaugugaugccuccagcuuuguuucuuuugcuuaggauugcuuuggguauuugggcucauuuuuguuccaugugaguuuuagaauaguuuuuucuaauucugugaagaaucacauugguaguugauaggaauagcauugaaucuguaaguugcuuugggcaguauggccauuuuaacaauauuaauucuuccuauccgugaacauggaauguuuuuccuuugugucacucugauuucucugagcaguucccucucugauuuuuccuucuugcuaccuuuagauuacuuaacauuuuaguuuuccauuuuaucuauugaguuuauuacuauaaacuauaaacuacuauuaguaucuucaaauggauuuuucaugauuguucuagaaauuauacauauucaacuuuucacaaucuacuuagaauuaauauuuuaccauuuaaaguagaauguaaguccccuuauucuucacucuuuguauauaacauauuacauacauugaaaaccuaccagauaauguuguaacuuuugcuuuuaacuguaauacauauguuauguggcucacaucuuuaaucccagcacuuuggagaccagugcgggcagauggcuugagcucaggaguucaagaccagcaaagccccgucucuacaaaaaauucaaaaauuagcuaggcauugugacgugugccuguggucccagcucuucaggaggcugaggcagaaggauggcuugauugcaggagugagaucgugccacugcacuucagccugagugacagagugagacccuaucuuaaaaaaaaaauguaagaagaaaguaauauuguuacauuuauuuaaauaucuacccuuucuguuuucuuucacuccagauaguccaaguuuuccccucacauacuuucccuuuugucugaagaaauucccuuacuucuuauagagcagauccacagacaaugaauuuucuuaguuuucuuuuaucugagaaugucauuauuucaucuuuauucaugaaggauguauucucuaauagaauuagaauuagagaauguaauucuguaauagaauuuugauuugaugguucuuucccuuucagcauuuuaaaaauguucuacuuauaucugacugggugguuucugauaaaaauuccauguucauuuggauuguuauuccccucuauguuaugugcuguuuuucuugggcugcuuucaggauuucuuuuuucuuggccuuaguuuucagcaauaugucaaaauugucuggguuuggauuucuuuguguuuaucuuucaugagacuguaaguuuauguauuuugcugaacuugagaauuuauuauuccuuuuuucuuuauuuauuguugugaaauucacaugcuauauugaguguuuuugaauauacacauucagugaccuuuagugcauucgccaccucucucuaguuuuaaaacuuuucaccacuccagagaaauacuuuguaccuauuaaguaaucacucucuauucuuuauuuccccugccccuugaagauaauacuaaucuacuuucugucuguauagauuugccaauucuguauauuuuauauuaaauaaaucauacaauauuugagcuuuucugucuugcuguuuuuaccuagcauuauguuuucaagguucauccaaauuguaacauucacuuaacuucuuuuuauggcugaauacuauuuaauauuucacuuuauggcuauuacacauuuugaucaucuuuucaucagcugguuuggauuugagaugauuucaccuuuuggcucuuacaaguaauguugcuguaaacauuuuuuuacaaguuaccauguggacauauauuuucauuucucuuggguauauacauaaaaguagaguugcuaaaucauaugguaauucuuuaacugaauugcugucaaacuauuuuccaugauggccacaccauuuuacauucccaccagcaauguaaaagaguuuaucuuucuccacauccuuguuaacauuuguuauuuuuagggucgcuuucuuguuguuguuuuauguuauuguagccaucuugguaggugugagauuauagcuuauugugguuuugauuugcauuuuccuaacgucagcugagguuuagcaucauuuguuuguuggcuauuuguauauauucuuugaaggaggaucuggauuuuuaaauccuuugcuuauuuuuaaauugggucguuugacuuuuucuuguugaauuguuaguguuguuuauacauucuggauaugaaaucccuuaucaaauacaugauuugcaaauauguucucccuuuuuguagguuaucuuuucacuuuuuugacgauauucuuugaagcucaagauucuuuaauuuugaggaugucuaauuuaucuauucuuugguugcuugugguuuuugagucaaaucuaagaauuuaauaacaguuacaaggucaugaagauucaucccuauguuuuuuucuaauauuuuauacuuuuagcucuuguauuuuguauagggugugagauuauaggauccaacuucauuccuuugcauguggucauccaguugucccagcaccauuuguugaagauacuauucuuuccccauaaaaguaucuuagcaccauagucaaaaaaucauuuauccauagauuauaggguuuacuucuggauucucaauuuuguuccuuuguucuguaugucuguucuuacgcuauuaucacacgguuuugguuacuguagcuuugcaguaaguuguaaaaucaggaaguaugagaucuccaacuuuguuuuucaguauuguuuuggcuauucaggacucuuuccaauugcaaaugaauuugaacaucagauuuucuguuucuacaaaaaugccauugaauuuugauagguauuguguuuaaucuguagauuauuuucauaaguauugccaucuuaauaauauuaagucuucuaacccaugaacaugaaaugucuuucuuuuuuugagauggaguuucacuguuguugcccaggcugggguacaauggcacgaucucagcucacagcaaccucugccuccuggguucaagcgauuauccugccucagccucccaaguagcuacuuucauauuuuuauuagagaugggguuucauccuguuggccaggcuggucucaaaaucuuaaccucaggugauccaccugccucagcaucccaaaguccugggauuacaggcgugagccaccgugcccggccaugucuuucuauuuaguuaagccuucuuuaauuucuuucaacaaugccuuagaauuuuuuuuuuuuaauuaggcaaguucucuuuuuucucaacuuuuauuuuagguucagguaguacaugugcagauucguuacauggguaaauuguguguugcugagguucaguguacgaaugaucccaucacucagguacugaacauaaaaucuaagagauagcuuuucaacucuugcucccuuacuucccuucuaauaguccccagugugucuuguuuucauuuuucugcccauguagaauuuucauuguacaaaucuuucaccucccuuguuaaauucauuccuagauauuguauccuuuugaaugcuauuauaaauggaauuuuuaaaauuuuccuuuuggauuguugauugcuaguauauaggaacuuaacagaauuuuuguuuguugaucauguucccugcaacuuugcugaauucauuuauuagcuguaguagauuuuuuguagacuuuuguagauuuucuauauauagaauuaugucaucuguaaagagguaguuuuguuuuuuuuccccacucugcaauuuguaagccauuuauuuauuuggccuaauugcucuagccaggacuuccaguacaauguugaauagcaguggugaaaguggucauccucuuguuacucaucuugggggaaagcuuucagucuuucaccauugaaugugauguuagcuuuuuuuccuucaaauccugucaguguuuaguucauauauauauauauauauauauauauauauauauauauauauauauaauugcuguauuugaugcauauaugcuuaucauuguuauauauucuuacugaaaugacuauuuuaucaauaugucuuucuuugucucaugauaauucucuacuuaaaaucuauguauucugauauuugaauagccauucuagcuaucuuuuaguuacuguuugcauagaauauccuuuuuuauccuuucacuuucaauuuguuugugucuuuggaucuaaagugagucuccuguaagcagcauauaguugacuggugugguuugguuuuguuuucggggguuuuuuguucacuuguucauuuuuaaagugaaagcaaguuuauuaagaaaguaaaggaauaaagaaugacuacuccauuggcagagccagugucuugggcugcucacugcgauuacacuuauaguuauuucuuuauuauaugcuaaacaagggauugauuauucauuaguuuucuggaaaaggggugggcaguucuuggaacugaggguuccucccccauuuuagaccauauaggguaucuugcuaacauugccauggcauuuguaaauugucauggcacuagugggaguguuuuuuagcaugcuagugcauuauaauuagcauauaaagagcagugaggauaagcaggggucacuuuuaucaccaucuugguuuuggugcauuuuggccagcuucuuuaccacauccuuuugucagcaaggacuuugugaccuguaccuuuugccgaccuucugucucauccugugacuuagaaugccuagccuccugggaaugcagcccaguaggccucaaccuuauuuuacccagccccuauucaagauggaauugcucugguucagacaccugugacguguuuccccccucccuuuuacaagggaauccuuaaucuuaaggguuguagagggacaaugaugcaucuucuauaacuucuucaggcugaaaacaggugaugauauacaugucuaacuauuagggucucuuguauucaggguggagaggcgcacauuuagaaagcauccauaugcugagggccauucauaacucuugagauccgacagaaggugguaucuggaagacuaauaaguguucaacuuaagaaaacauugagugaguuuauccugcauaucuacacaaagaguacaauaucaguguauuccacaacaguaaagaaaaauaagcaaaauuaucccaaguaaagagagcuuuccaugaacugggccacugucggaaccaaacugauaugggguugcuagcugauuccuguuuguccagaauuagaauacugauccagauuuuuacauuacucaucccucuuguuucuugugagcagcagcuagaaaucacugguugguuuacaggaauagacaggguuagucugaauugcaggaaaaaaacaucagaaacaacugaugaaacuagcauguacuaacagguguaccauauuucuugaaacauaauuuuucucucuccagucucccauuuuuauuaaagacaaaucaugguacgaaugauuuguucucaaaauaagauguauucuuauacuuggccugauuauuuguauaaaguucagcaagaauaauuaauuuucacauaugcuuuuuaaauuggcuuugauggaacuuuguuccaaaaaggaaucucaaacaagacuuuuuuucauaaagcugagccuaaccauggguuuguaccaucaaauaccuaugaguugagcaaauuccucuuaucuugagguuccaagauaacuuggggcuucuggaccuguuagaaagugacauucuguacuuagcacagaucaggaacccucuauagggacaguauagacaagguaugaggccaguuuucccaaggggcuuuuauuggcucuguaagucaaguuugauaccuuuaagaaaagcaugcuauucgagucaaagccuuggcaaaacaaccaguuucuccaguuguguccuguugccaaaaaaaaaaaaaaaacaaaaaaaaaaacauucuuauuacacuugugcaaguaaaacuauguugccguaaauuaagauuacucacaaauaguuucgaaauucuggagaaaucagcuagagagaaacaaauauguuccaaauuuuguuuacaggaaaauacuuuauucaauuguuuaaaguuguaaauagcucaaaagaaaaucuucuuaacucugaaaaccaaaacaaagaauugguaacauuuuaagcaaaaagccaaaaaagauuacuucaguuuucuauuaguucaguccaugcaguuaacuccuguccugacuuaucaucaccaacauuucagcucuccaugaguccugaaaguuuuuuccuguauucuaaugccacagucuccaaaguuaccagaaaccugcauucaggagcaccugucaaaguucuauagcugacuuauaaaccaccuuuuaaagaggaucaaaacaagauaacaaucguuugugaaugacaacaugucuuagggcagccacagucaaaaacaugauugacaaagaaauuuuguuaucuugguggcauauaaugauuuuauguaacaauuauaauuauuacugauaacaugcacuaaaucauaucagaauuacaggaguuucccguaauuuuggaacagauaccaauaacaccaauaacauauucaaacaaauacauccccaggaaagccaaacaccauuuuauauuugacaguguuucuugugauuuuuauaccagauaagcccuauaugucacuuuuggacuuuaggggaccuaauaucuaaaagaugaauuagguuagaaaagacaucauuuauaauuuuacuuuggaaaguuugucauauauuaaagguuuaaaacacuugauauuguaaaaucaaaucccaggucaccagaagucauugauuuagccaaauuauaccucaaaaauuuuuuaaagccaaaaaccuuuacucauuaaggggaagacagcuuuccaaccaaucggucucuuuucuuuuccuccuuuuuccuacaguuuauucagaaggcaaacaaaaauauuucauuuuuuaauauaacaugaaaaucuuguucaagaaaggaagcuaacuuucaccuuugcguuagugcacuauugaugucaaaccuuaacaaaacccuauagacaaauccaucuagucucaaucaguaugaccuuaagguaagauucauauaaaccuuuuauagccuuuuacagcuuuugugaaagagcagauccaugcucuaagaaaauucuggugugcuuuuauucuaauguucaauuuauggaaaaacugaguaccacuuuaacuuuagccaauauguucacacacagaauuucuuuuacaagauuauuuuuucacaaauccuccacaacuugauuguuuucugguuugugguuccuguguuccuuuuuauagugacaaaccauuuuauauauuuuaaauguuuucauuuuguacaauaaaguuagcauauuuuauacauauuuauauaauuauguuuauauauguguuuauugcauuuugcuuuuuucacuuaauuauaucuccuggaaaucauuccauuucaauacauagaguuccucuucauucugucuuauagcuucauaguacuccauuuuguguggauaucauaggguauuuuaccccccagucuccauugcuuuacaaucacaaaugauacuguacgaauaacuuugugauuauguauuuauuagucuguucucaacugugaagaaauacccaagacuugauaauuuauaaagcuucauugauuuacaguuuucuguugcuggggaggccucaggaaacuuacagucauagcagaaaggaaaagagaaggcaccuucuucauaggguagcaugauggagggagugcaagcagggguaaugccagaugcuuacaaaaccaucagaucuucugagaacucacuaucacaagaacagcaugggggaaacugcccccaugauccaauuaccuacaccuggucucggccuugacacauggagauuauggggauuacaauuggaggugagauuuggguggggacacagagccaaaccauaucauauauuuucauauuguuggagauacauauuuuagauaaauucauacagggauuucuagcuugagauuugguuauauguagcugguuagauauugacaaauucuccuucauagggauuaugacauuuucuguauccaucaaaaauauauggcauuaccuauuucucucuuaccucacuaauaaaauguauuuuuuuauuuuauuauuauuauacuuuaaguuuuaggguacaugugcacaauuugcagguuaguuacauauguauacauaugccaugcuggugugcugcacccauuaacucaucauuuagcauuagguauaucuccuaaugcuaucccuccccccuccccccaccccacaacaguccccagagugugauguuccucuuccuguguccauguguucucauuguucaauucccgcccaugagugagaacaugcgguguuugguuuuuuguccuugugauaguuugcugagaaugaugauuuccaauuucauccaugucccuacaaaggacaugaacucaucauuuuuuauggcugcauaguauuccacaguguauaugugccacauuuucuuaauccagucuaucauuguuggacauuuggguugguuccaagucuuugcuauuuugaauagugccacaauaaacauaugugugcaugugucuuuauagcagcaugauuuauaguccuuuggguauauacccaguaaugggauggcugggucaaaugauauuucuaguucuagaucccugaggaaucgccacacugacuugcacaaugguugaacuaguucacagucccaccaacaguguaaaaguguuccuauuucuccacauccucuccagcaccuguuguuuccugacuuuuuaaugauugccauucuaacuggugugagaugguaucucauugugguuuugauuugcauuucucugauggccagugaugaugagcauuuuuucaugugucuuuuggcugcauaaaugucuucuuuugagaagugucuguucauguccuucacccacuuuuugauggaguuguuuuuuuuuuuucuuguaaauuuguuugaguucauuguagauucuggauauuagcccuuugucagaugaguagguugcgaaaauuuucucccauuuuguagguugccuguucacucugaugguaguuucuuucacugugcagaagcucuuuaguuuaauuagaucccauuugucaauuuuugcuuuuguugccauugcuuuugguguuuuagacaugaaguccuugcccaugccuauguccugaaugguaaugccuagguuuucuucuaggguuuuuaugguuuuaggucuaacauuuaagucuugaauccaucuugaauuaauuuuuguuuaagguauaaggaagggauccaguuucagcuuucuacauauggcuagccaguuuucccagcaccauuuauuaaacaggaaauccuuuccccauugcuuguuuuucucagguuugucaaagaucagauaguuguagauaugcagcguuauuucugagggcucuguucuguuccauugaucuauaucucuguuuugguaccaguaccaugcuguuuugguuacuguagccuuguaguguaguuugaagucagguagcgugaugccuccagcuuuguucuuuuggcuuaggauugacuuggcaaugcgggcucuuuuuugguuccauaugaacuuuaaaguaguuuuuuccaauucugugaagaaagucauugguagcuugauggggauggcauugaaucuguaaauuaccuugggcaguauggccauuuucacgauauugauucuuccuacccaugagcauggaauguucuuccauuuguuuguauccucuuuuauuucauugagcagugguuuguaguucuccuugaagagguccuucacgucccuuguaaguuggauuccuagguauuuuauucucuuugaagcaauugugaaugggaguucacucaugauuuggcucucuguuugucuguuauugguguauaagaaugcuugugauuuuuguacauugauuuuguauccugagacuuugcugaaguugcuuaucagcuuaaggagauuuugggcugagacaaugggguuuucuagauauacaaucaugucaucugcaaacagggacaauuugacuuccucuuuuccuaauugaauacccuuuauuuccuucuccugccuaauugcccuggccagaacuuccaacacuauguugaauaggaguggugagagagggcaucccugucuugugccaguuuucaaagggaaugcucccaguuuuugcccauucaguaugauauuggcuguggguuugucauagauagcucuuauuauuuugagauacgucccaucaauaccuaauuuauugagaguuuuuagcaugaagguguugaauuuugucaaaggccuuuuuugcaucuauugagauaaucaugugguuuuugucuuugguucuguuuauaugcuggauuacauuuauugauuugcauauauugaaccagccuugcaucccagggaugaagcccacuugaucaugguggauaagcuuuuugauguggugcuggauucgguuugucaguauuuuauugaggauuuuuguaucaauguucaucaaggauauuggucuaaaauucucuuuuuugguugugucucugccaggcuuugguaucaggaugaugcuggccucauaaaaugaguuagggaggauucccucuuuuucuauugauuggaauaguuucaggaggaaugguaccaguuccuccuuguaccucugguagaauucggcugugaauccaucugguccuggacucuuuuugguugguaagcuauugauuauugccacaauuucagagccuguuauuagucuauucagagauucagcuucuuccugguuuagucuugggaggguguaugugucgaggaauuuauccauuucuucuagauuuucuaguuuauuugcguagagguguuuaguauucucugaugguaguuuguauuucugugggaucgguggugauauccccuuuaucauuuuuuauugugucuauuugauucuucucucuuuuuuucuucauuagucuugcuagcggucuaucaauuuuguugauccuuucaaaaaaccagcuccuggauucauugauuuuuggaaggguuuuuugugucucuguuuccuucaguucugcucugauuuuaguuauuucuugccuucugcuagcuuuugaauguguuugcucuugcuuuucuaguucuuuuaauugugauguuagggugucaauuuuggaucuuuccugcuuucucuugugggcauuuaguacuauaaauuucccucuacacacugcuuugaaugugucccagagauucugguauguugugucuuuguucucauugguuucaaagaacaucuuuauuucugccuucauuucguuauguacccaguagucauucaggagcagguuguucaguuuccauguaguugagcgguuuugagugaguuucuuaauccugaguucuaguuugauugcacuguggucugagagacaguuuguuauaauuucugaucuuuuacauuugcugaggagagcuuuacuuccaacuauguggugaauuuuggaauaggugugguguggugcugaaaaaaaauguauauucuguugauuugggguggagaguucuguaggugucuauuagguccgcuuggugcagagcucaguucaaauccuggguuuccuuguuaacuuucucucucauugaucugucuaauguugacagugggguguuaaaaucucccauuauuaaugugugggagucuaagucucuuuguaggucacucaggacuugcuuuaugaaucugggugcuccuguauugggugcauauauauuuaggauagcucuucuuuuugaauugaucccuuuaccauuauguaauggccuucuuugucucuuuugaucuuuguugguuuaacgucuguuuuaucagagacuaggauugcaaccccugccuuuuuuuguuuuccauuugcuugguagaucuuccuccauccuuuuauuuugagccuaugugugucucugcaugugagauggguuuccugaauacagcacacugaugggucuugacucuuuauccaauuugccagucugugucuuuuaauuggagcauuuaguccauuuacauuuaaaguuaauauuguuaugugugaauuugauccugucauuaugauguuagcuggugauuuugcucguuaguugauggaguuucuuccuagccuugauggucuuuacaauuuggcauaauuuugcggcggcugguaccgguuguuccuuuccauguuuagugcuuccuucaggagcucuuguagggcaggccuaguggugacaaaaucucucagcauuugcuugucuguaaaguauuuuauuucuccuucacuuaugaagcuuaguuuggcuggauaugaaauucuggguugaaaauuuguuucuuuaauaugguugaauauuggcccccacucucuucuggcuuguagaguuucugccgagagauccgcuguuagucugaugggcuucccuuugaggguaacccaaccuuucucucuggcugcccuuaaaauuuuuuccuucauuucaacuuuggugaaucugacaauuaugugucuuggaguugcucuucucgagggguaucuuuguagcguucucuguauuuccugaaucugaauguuggccugccuuucuagauuggggaaguucuccuggauaauauccugcagaguguuuuccaacuuguuuccauucuccccgucacuuucagguacaccaaucagacguagauuuggucuuuucacauagucccauauuucuuggaggcuuuguucguuucuuuuuauucuuuuuucucuaaacuucccuucucacuucauuucauucauuucaucuuccaucacugauacccuuucuuccaguugaucgcaucggcuccugaggcuucugcauucuucacguaguucucgagccuuggcuuucagcuccaucagcuccuuuaagcacuucucuguauugguuauucuaguuauacauucaucuaaauuuuuuucaaaguuuuuaacuucuuugccuuugguuugaauuuccucuuauagcucggaguaguuugaucgucugaagccuucuucucucaacucgucaaacucauucucuguccagcuuuguucuguugcuggugaggaacugcuuuccuuuggaggaggagaggcgcucugcuuuuuagaguuuccaguuuuucugcucuguuuuuuccccaucuuugugguuuuaucuacuuuuggucuuugaugaugguaauguacagauggguuuuugguguggauguccuuucuguuuguuagcuuuccuucuaacagacaggacccucagcugcaggucuguuggaguuugcaagagguccacucuggacccugcuugccuggguaucagcagcaguggcugcagaacagcagauuuucgugaaccgcgaaugcugcugucugaucguuccucuggaauuuuugucucagaggaguacccagccgugugaggugucagucugccccuacuagggggugccucccaguuaggcugcucgggggucaggggucagggaccgacuugaggaggcagucugcccguucucagaucucaaacugcaugcugggagaaccacugcucucuucaaagcucucagacagggacauuuaagucugcagagguuacugcugucuuuuuguuugucugugcccugcccccagagguggagccuacagaggcaggcaggcuuccuugagcuguggugggcuccacccaguucgagcuucccggcugcuuuguuuaccuagcgagccugggcaauggcgggcgccccucccccagccucgcugcugccuugcaguuugaucucagacugcugugcuagcagucagcgagacuccgugggcguaggacccuccaagccaggugcgggauauaaucuccuggugcacuguuuguuaagcccaucggaaaagcgcaguauuagugugggagugacccgauuuuccaggugcuguuugucaccccuuucuuugacuaggaaagggaacucccugaccccuugcacuucuggagugaggcaaugccucgcccugcuucggcucacacacggugcgcugcacccacuguccugcgcccacugucuggcacuccuuagugagaugaacccaguaccucagauggaaaugcagaaaucacccgucuucugcgucacucacgcugggagcuguagaugggagcuguuccuauucggccaucuuggcugccaguccuagaauguauuuuuaagcuuuugaauuuguugcuaauuugaugggugaaaaaauugacuuuuauuguaauuuuaauuugcauuucucuuuuauaugaaugaaauuacauauguuuuuacauaauuaacaagcauuuuuauaucuccuuugaguuguuuauucaaaucuuugcccauuuguuuguuuuuuuguuuguuuucagacaggguuucacucuguugcccaggcuguaguacaguggcaugaucuuggcucacugcaaccuucuccuuccaggcucaagugauccucccacuuuagccuuccaaggagcugggacuacagacacaugccacugugcccaggcacaugccaccaugcccagcuaauuuuuguauuuuuuuuucauagacaugggguuucuccauguugcguaggcuggugucgaacucuugagcucacaugaucugccugcuucugccucccaaaguacugggauuacagacaugagugaccaugcccagccucccugcccauuuuucuauaggauuucuauagguugauuuuccucaauuuaaaaaaaaaaaauccuugauuuauuaagaauguaacuauuuaucugcgauauaugcugugaauguuuuucccaauuuugucaguuaccuuugauuuuguuaaugaguuuucuuuggcuaugcacauuuuccaacguaucaucuuauuuuguuuuuaauugcaucuaggauuuuagucauaguuaggaacccuuuccuuacagauggguuuuagaggaauucacugauuauuucuuuuggugcauauauagauuuacuuuuuauauuuauaucucugauccauuuggaguuuauucuuggguguaguggaaggaaugaaucuacuuuuaccuuuuuucaaauggcuauccgguauucccuacaccaaccauccucaaccuuuuuggcacuagggaccagguucauggaagacagauuuuccacagaauggggggguggggugaaggggacgguuuuggcaugaaacuguuccaccucagaccaucaggcaucacuuagauucucauaaggagcacacaaccuagaucccucccaugcacaguuuacaguagguuuccugcuccugugauaaucuaaugcugcugcugaccugagaggagacggagcugucaggugauaaugcuggcuugcccuccgcucaucuccugcuuugugacucccaguuccuaacaggcuauggacugguaccaguccauggcccagggcuuugggaucccuccccgcccuacacuguguauuaaccagagcaucuuugacccaaugauuugagauaccaguuuuaucauauacuagauguuuauauguaauuggaucuaauucuagaaauuauauuuuauuccauugauuugauagcuuauucuugugccaguaccauacuguuuaaugaaagagguuuguagcauguuuuuauaccuuggaguaguucuacccugccuccuuucccaccuuucacagaucuuuauauucauuaauuuccuagcuauucuuguguuuauuuuuauuauuuuuugagacggagucucacucugucgcccagauugaagugcagugguauggucucggugcacugcagccucugccucccggguucaagugauuuuccugccccagccuccuaaguagcugagauuacagacgcccaccaccaugcccagcuaauuuuuuguauuuuuaguagagacaggauuucaccauguugaucagucuggucucagacuccugaccucaagugaucugcccaccucggccucccaaggugcugggauuacagucaugagcaacugcacccggcuguguuuauuuuuuauuuucaguuugaaauaaaacuaaauuuguuccaagcaugcaauacaugguuauuaaucauaguuaccauauuguacaauagucuucuugaacuuauuucuccuaucccacuggaauuuuguauccuuugaccaaucuguccccaacuucaccuuccuccagucccugguaaccacuauucugcucucuacuuuuaugaggaguucagguuuuuuugauuccacauauaaguuagauuaugcaauauuuaccuuucuguggauagcuuauuucacuuaacauaaugucuuccaaguucacucauguuguugcaaaugacgggauauccuucuuuuuuaaggcugaauagcauuccacuguauguauauaccacauuuucuuuauccauucaucuguuguuggacacuuagguugauuccauaucuugucuguuccaaauaaugcugcagugaacgugggaguggagauauuucuucaacauaccuauuucauuuccuuuggauuuauacccaguagugaaauugcuugaucauaugguaauucuguuuuuaacuuuuugaggagccuccauauuguuuuccauaauggcuguacuaaguuacauucccaccaacagugugcaaacguucccagaucuuuuuuaaaaaaaguucaaaagagagaaguuaaggguguccaucacuaguagaccugucugacaacaaaugcuaauggaaguccuucagacugaaaugaaagaacccuacacuguaauucaaagccauaugaagaaaguuuuuuguuuuccccauugccuuuuaauuggugaguuuaaucuauuuacauuaaaaauauagguuauuuuaaguuauuaucaauaaugaaccacuuaguugugcuauuuugcuguuuuucuauaugcuuuuguuccucaguuccuccuauacugccuucuucuuugauugauauuuuuucuagugccaguuuuaauuccuucuccaauucauuuuguauaauuuuaaaauuauuuucuuagugguguccaugggguuuacacuaaacauccugaauuuacuuugacuugauauuaagauuacuugaauagcauacauuaacucuccucauaucuagcucuguccccuccccuuugcauuauuauuauugccacaaauuacaucuguauacauuguguucuuguuaacauauauuuacaguuaaugccuuuuaaaucauauuggaagcagaaagaaggguuacaaaccaaaaauacaauaauauuggcauuuauuuaucuguguacuuacuuuuaucagagaucucuauuucucuguacgccuucgaguuacaguauaauguuuucuuucauuucaaccugaagaucuuccuucagcauuucuuaauggggcuagucuguuaguaaugggcuucuuuagcuucuuaaaaauuuuuuuaaaucuaggaacgucuuaauuuuuccuuuauuuuugaaggagaguguuacuagauaucaaaugcuuagucaacaguuuuuuucuucuuucagcaguuagaugaucccacugccuucugaccuccauguuuucugaugagaaaccugcuguuagucuuauugagaaucuuuguaugugauaacucaauucuuacucacuacuuugaagauuuucuuuuuauuucagcaguuucuuuauaaugugucuuuguguggaucucuuuuaauuuauucugcuucaauucacugagcuucugggauuuauagagucauaucuuucagcaaauuugguguguuuuucauuucguuauuucuucucuuccuuacugcuccuuucucccucucuuuuccuucuuuaauucucauaauguguaaguugguaugcuugaucauuucucccaaguuccuucuggacuguuuauuuuucuucauccuuuuucuuucugauacucagacugaguaaauuucccuguuuccaaguucacugauucuuucuucuggaugcugagaugugcucuugaacuccuauauugauuuuuuuaauuucagcucuuauaauuuuauuuucuuucagcuauugugcuuuucaacuccagaauuccugcuugguuaauuuuauaacuucuauuuuuuguuaauauuaccuacuuguucacacauuguucuccugguuuccuuucauuccuguuccaugcuuuucuuuagcucuuugaacauauuuaaagucuuugucuaguaaauccaauguaugggcuucccucagaaauuguuuuugucaauuuucuuccugugcauagcuuauacuuuccugguuucucuguaugcuuugucauuucuaguugagaaguagacauuuugaguauuguaaugugguaacucugaaaauuauauuuuuccuccccagggaacacugcuguuacuuuccuuuuguuguuguuguuguuguuguuguuguuguuguugagacagagucucacucuguugcccagguuggagugcagggaugugaucucagcucauugcaacuucugccucccauauucaagugauuguccugccucagccacccaaguagcugggauuacaggcauacaccaccacgcccggcuaauuuuuguuuguauuuuuaguagagacaggauuucaccaugucggccaaggucaaacucuugaccucaagugaucuacucgccucggccucccaaacuccugggauuauaggcagugagccaccacacccagcuggugcugauacuucucaaaggcugcaguuacucguuuauuuaguaacuuuccaaacuauuuuugcgaaaacuauccuugucauguuuuugcgauauuuugcgaaaacuauccuugucauguguggucacugaggucucuauuucauauucucuacagccagcuggugaccugacagcaguuuaccugaaugccuggaaccaauaaguaaaggagaaaaaaaauagguguucuguuucuuuaaauuauuucaacagaggccuccaggaaaucuacuucuacuugaggggauugaaacauugcuggccagucauugaaccacuaggcagauucaaauauacaacucugauuuuuguuagacaggguccuuauuuucugcccuagcagcaggaagcugcaccaggaacuugggccuuucuccccucacugccuucugcaggucuggaagugauaguugcugugcaaaaugcugaaauuuaccagcuucuuuauucaucaagcagucaccuggaugccacaagucuucagcuagagucuagaguucugaaaucauugauucugagaguucuugcuagcucaaugguuucaguggaggaauugauuacuagaguuucuuacccugccauuguugugucaucauuuagccauuauuucugaaaauacuauuucugcaucauaaauuaaaaccauacuuaguauccacauucuguuuuucauuuucaguacaguguucaauaaauuaaugagguauucaacacuguguuauaaaauagaguuuguguuaggugcuuuugcccaacuuuagacuaauuuaaguguucugaucacauuuaagguaggcuaggcuaagcuaugacguuuaguaguagauauuuucaacucaugauggguuugucaggauguaaccccaucauaagucaaagagcaucuguaaagacaaaguacuuuagaaaaaaauacagugauaggaugacaagaucagaaaagagauuaagcauagguagguuugcuguagugcuguugaaaucuaaccuucuaaaaacggucugccaaaccugcaucugcuccuccuuguaaaagaagugaaagguaauauaauauuaucaagaauauaaaauuaaacagacgggaacucuuguaacucaguacacaaaauuucuaaaacauggccuuaaaggcuaagcaugucuguauuuuuccuuucugucuugacagaaaaaaaucuaaccuuucuauaggucagacuaagcaaguucuauuaauuagcccaaacuucaauaggacagauuaucugagaauguucuuacuuguagggcacuuuaauugaaauaagacuaauucugacuccugauuuuacgggugagaaaguugagauccaacaaaauuaauuaccauaaagaacaaaaaucugauugccauuuuuguuccuuuuucaauauacuuaguagcccuuccucaaagaaaguuuuagcacaaaauguauucucuuacuuggaauuacuucugcuguuuguuucuguauauaaucugaauaaauauaauguuaacacuggaaaaguuccuagaaauuagcuguucuucaucuuuuuuggaucaaagaucauuuugagaauuggauaaaauguguuugcuaugcccuguccauagacuacugacuuagauauguaauaauuucugacauagauggaaaaacccaagaccaggagaugguaauuguuugaagauucaaaagcaggucaauguuagaagaaauuagaauggucuacucaugcauuacccauaauaguuaaguucuucauauuauaauaaugagauaguuuucuuuccuguuugccuuccccuccucuacacuuuacaauacuaguaucaguuuucugaguuaaucugcauguucucugcuauauggagacuucuucaguguauccucaucauaguuagaacuugauuuuuacucuuauuuacacauuuaguuuugccuuaaugacugcauuguuuuccauuuuaugaaagucccauuuguuuaaccugucuccaauauagaagcuuaaauuuaaaauauauauguauguuacauucaguacuaugguaaacauucugguacauaacuguucugcaaguauaugugccagaaauuccuagaaauaaaauugcugggugaaagaggaagcacaaaaaaaaauuuguaugaauuacuguuugccuuccaaaaagauugaaccaauuuguaccuaaccagcaaaacauacaguucauguuucuguguaaccucgccauuuuuaacccuucuuuugugaucuuugcaagucugguaacuggagguaucuuacuuuuauuuaauguguaugucauuaaguauuagugcaauugagcucaauauuguuaagaugucaguuugccccagugugacauauauauucaguguaaucaugaucaaaaucccagcauauuuuuuguagauauugacaagcuaauucuaaaacuuauguggaaaggcaagugaacuagaagagcccccaaaauuugaaauggaaaaagaggaacaaaguugagaauucacacuacccaauuuuaauauaaggcuacauaagucaagccagugggguccuggccaaaggauaaacauauaauucagugagacagaauagagagcucagaaauagacccacacaaauauuaucaacugacuguuggcagaagcuaaaaagaaauuccacaggaaaaggguaguuuuuucaauaaaugguacuggaacaaugaacagcuuuaugcaaaaaaaaaaaaaaaaaaaaagacccucaauacgucaacauguaccacacaacuuguacaaaaauuaacucagaaugcaucauagaacuaaaauguauaacauaaaacuauaaaacuucuagaagaaaacauuuaagaaaaucuccauaauuuugacuuaggugaugaguacuuaaaauugacaccaaaaacacaacucauuaaaacuuuuuugagaaauuggacuuuauuaucaaaaguuuaaacuuuuaaacuuucacucuaagaaaggcacuguuaacaagaaugaaaagucaagugcugaaugggagaaaacauuuggaaauuccaaguccagcaagugacuuggauuauccaaaauauacaaaggacucugaagaacuugccaguaagugugauaggaagaauaaugcccccacacccccaucacccaaagaugccuacauccuaauccaaaagggagugaugauguagaagaggaagucagagauacgaugugaaaaagacucaauccaaugauguuggcuuggaaaaugaagaaagagaaauaugagccaaggggcaggcgugauuucuagaagcuagaaaaagcauggaaauggacuuuccccuagaaccucaagaaaggaacacaguccuacugacaccuuaauuuuaggccagggagaugucugacaaauuucuaacaugcagaacuguaagauaguaaauuuguauuguuuuaagacaccauauuugugacaauuuguuacagcaguaauaagaaacuaauauaggaagaaaacaaaaaagcuaauugaaaaaaaaaaagacaaaagaucugaauagguacuucuccaaagaagauauauggauggcaaacaaggauaugaaaagauacuuaacaucauuuaucauuacagaauggaaauuaaaaucacaauuagaugcuaugucauaguuguuagaauuguuacaaacagacaauaaauaaauaauggcaaggaucuggagcagcaggcauucucauuuauugccagugggaaugcagaauggcauagccacuuuggaagucaguuugauaguuucuuaaauaucacuucuggguauuuaccuaaauguauugaaaacuuuuguucacacagaaaccuauaugcaaauguuuauagcagcuuuauuuauaaauugacaaaaacuaggaacaaccaagaugucuuucaguaagugguacaguggaauacuacucaaccaugaaguggagugaguugguuauuccugcaacaacaugaauaaauaucacaugcauuuugcugagcaaagcuagaacuaaaaggcaguguauaguauuauuccauuuacaugacauaccggaaaaggcagcuaauaagaacagaaaacagauaggugguuaccaggaggugggggaggggucagcugcaaaaggggugugauagaacuguuguucugugugguaaugggaugguagauggauucuauccauucauuuguagaaugaacuuuccugguguaaauuaaaaaaucaaccaaaaugucaggggaucccaggaugaaauggaaacuauaacugaugaaucuaacuauauuauaaaugcaugacauaucuuaaugaaagugguaggggggaaaggaacugaccuaaguaacuuuggaaaacagguaauguuuugacuggauaauguaagacuaaagacaaaaacauugaacucuaguugguaaauuuguuucuuacagguacagauuagcaguccuaaaacuacucuaccucuauucuaggaaugaacaauaagugaacauauuguggguguuuagagccaaguuucucucugucagaguaagaaguuacaaguaaacaacagggaaacuagaaugaacucuggcucuggagagauguaugagcagagauucauguuuauuuuaauauguauauggauaaauauauauagaacuaaccucagauaugaguggauacauggcuuaguguacauguguguaaaggccuagaagcagugucaccccgguagcuacagacucauucagcgucuacccuaaucuugguuucugcauaccauuuuucaauaaaaggaagcagggcuuccuggagaaauggcuaaugcugcaucugggacagguaaaauacaagaugagccuggaguaucuuauggggucagaaaguaaggagguacuuuuuuuuuuuuuuuaaagcacggaacaguuucagcaacaaaaugggauguuauauuuuacucagaaaacauccuucaauccauacugauauaaacaaaugaauugaugaauucuucggagaaaacagacaaaucuuccuuaaggaauaauuuuuaauaauuauauaaauacuauccccuucuggaggugagcuuuucucucuccuuguggacuggacuuagugauuuguuuccaaagaggacaauauggaaaagaaaaaaggaauaacuuuauaguuaggaaaucagucagacuccaccuuagucaaguguuaaguguuaaaaucaccagugauaacucaugugguagcacaucugugguauuagucccauaacccacaaucccagccugaucaugagaacauauuaaaacucagauugaaggaaauuuuacaaaauaugaaauaccugauuacuacucuucacaagugucaaagccauaaaaaacaaggaaaagucugaaaagcuaucagauuggagagaccaaggaaacacgacgauuaaaugcaaauggaauccuagauuggaucuuagaaucaaaaaaagauauuagugggaaaacuggugaaauacacauaaagucuguaauucaguuaauaauauuauuguaccaguauuaaucauuuaauuuugacaaauguaccuugauuauggaagaugcuaacguuaggagaagcucaauagaggauaucugggaacucucuguacucucuuugcaacuuucccguaacuuuaaaauuguuucaagacaaaauguuuauuuaauaaagguacauucugucaacaaauauuuaugcaaaugaaugagcaucucuucguugaucauccuuuuauuaauugccuauuauaaucuuuguccauuuuuuagguuaagugcacuauuacauguuauugcuaucuguggcuuguuuugggcucuuuauaaauuauaucaauaccugaaaaagcuuguuuauauuauuuacacacuauuuuugagacuuuguguucuaaaaggaaggcuuauuuuaaaaguugguuguugucuucucugcuuuagaugcugggagcuuuugcacaugcugucucaauccauguuagguaugugauguuuacccacuuugcagauaagaaaacugaaacucggggguuaacccauuuaugccggcggcugcaaaauuuuuuuuugugaaaaaucagaccuuggcgaugaccuugagcagcaggauauaaauaacucccacaagcuuagcguuccaauaauggaacauugggcauaaauguuaauaacuugccaaaaaugaaauuuagcagggacaggauuuaaaugcaguucuugcuuuagucuccuuucuuucuaauaugauaauuugccuuuccugcaauauaauaggaaaaacucagagaaauuauuuuagaugauuuagaauuaaaugacauagauuuacaaaauguaauauaaaagaccauaucuucuuuucugcuuguaagugugccaacuugauuaaagaaaugauaaaaguaaaguauuggcacaugcuacaacaugggugaaacuucaaaaaaugauaaaugaaauaagucacaauaacccauguguuauauagauuucauuuauaugaaauguccagaguaggcaauucuaaggaacagaaaguacauuauugauugccaagggcuggauacagggaggcuuggagaaugauggcuaaggagagugguguuucuuuugggggugaaaacuguucuaaaauugauuguggugacaguugcacaacucugugaauauacuaaaagucacugaauaaacacuuuaggccaggcgugguggcucaagccuguaaucccagcacuuugggaggccaaggugggcagauugcuugaguccagcaguuugagaccagacuggccacgauggcgaaacccugucucugcuaaaaauacaaaaauuagcugggcauggugacacacaccuguaaucccagcuacuugggaggcugaggcaugagaaucgcuugaaccuaggaggcggagguugcagugagccgagaucaugccacugcacugcagccugggcgucagagugagacuugugaaaaaaaagaaaaaauuaaaaaaacacacuuuaaauggggacuuauaugguauguggauuauaucucaauaaguuguuaaaaaauaauuaaauugcaucagaagacaaaaagauguacauaugacuauauuuacugcagcacugcuuguaaugacaaaauacuugaaacaguuaauuugacucuugugugauauguaaccuaaggaugaaaacaaccuuuaaaacuguaaacugcuuucuguagugacacuguggauaguaaaaaagcugacuuauucuaagauuacaagauuuguguuuugugauaagauaauaaguaauuuuguugguauagcaaaacugggauuuuggguucuggagaaagaagaaacaaugaaagauaucugaguuucagucaauauccugaagcgcuaaauuucuacuggaaauaucacuauaaucuuauguugacuuugccuucaaaacaagugcauauauccuagcuccauccacugaauaggccuagaaauaagaaccacuucagcaauaaugaaaugugacuacaaaaguauuuauuuuccacuuaaaugaacaagggcuccugggagaaaugucugauucaagaucuauggcaggaaauagauaagucuggaauaccuuguuauaccaaauagcaaaaaagaugucgaaaacuacuagguuugggucaaaaagauucaggauaagcugaauccaacuugaagagacuuccaaaggccaaagagggggaugcagaugauaucaucuuguauguagaaaagucucuguugauauuagagaguaucaguacuaauaucaaacauguuuaaauccauguguucaugaucuuacuaaagaaaaacucccuugaaagauauuagggaaaaaaauccaacauuuauauccaauuugacuauaccaguuguaacuugagguaagcaaguaauugaguagaggaauguuuucucuauggacauaucuaacaaauaaaugaaggaggaaggaaugagaauuagaguauuaccauuuuuguaaucuuuaaugaaauaaugaucauuggcaauguagagacaaccagccauuauauggcuccuaaaaaagguguacaacaugccgggcgcauugacucaccccuguaaucccagcacuuugggaggccgaggcagguggaucaugaggucagaagauagagaccauccuggcaaacacggugaaaccccgucucuacuaaaacuacaaaaaaauuagccgggugugguggcgggcgccuguagucccagcuacucgggaagcugaggcaggagaauggcgugaacccgguaggccgagcuugaagugagccgagaucacgccacugcacuccagccugagcaacagagcgagacuccaucucaaaaaaaaaaagaaguguacaagguaaguuaugaaguaaucuugccauaaaacaaaaaggcaagccugaagucucugucuuacuaauaaaauacaggaaauacagugccaaaggaacguguuuaaauuuacagaacaagacagguuguucaauauauacaaauuuaaaaucgcccuaaaagagaagacaccauaagcuaaguuagagacaacaugaacaugcauagaacaguucuauaaaaaaacacaacaaacuaauaacugugguuucuaaggguuagaauuugaggcugaugggcagaaaggaaaggguaauugcuuuuuaauacacauuucucucugcauuuugcauuuugugcuguauuacuuuuuuaaaaaacaugaauuuuuaagucacaggaaaagcaccaagauauuaaaagugcuacuucagugaacauacaaaugauaagugaaguagccuuauugcugguauggagaaaauuguacuugucuggauagaagaucaaaccagccauaacauucccucaagacaaagccuaauccagagcaaaauccuaacucuauucacuucuaugaagacugagagaggugaggaagcuacagaagaaaaguuggaagcuagcagagguugguucaugagguuuaaggaaagaagccaucuccguaacauaaaggugcaagguggagcagcaagugcugguggagaaguugcggcagguuguccaaaagagcuagcuaagaugauuggugaauguggcuucacuaaacaacagauuuucuuuucuuuucuuucuuuuuuuuuuuuuuuuugagacugagucucacuguaccgcacaggcuagagugaagugacacaaucugguucacugcaaccucugccuccuggguucaagugauuuucgagucucacucagccucccaagugauucucaugccucagccaccugaguagcugggauuacaggcaccugccaccacgcccagcuaauuuuuugguagagacggaguuucaccauguuggcaaggcuggucucaaacuccugacaucaaguaauccaccugccuuggccucccaaagugcugggauuacgggcaugagccaccaugccugacucaaaacaacagauuuucaauguagaugaaacagucuucuguugaagaaaaugccaucuagaacuuuccuagcuagagaagagaagucaaugccuggcuugaaagcuucaaaagacaggcugauucucuuaguacaggcuaauccagcugguggcuuuaaguugaagccagugcucacuuaccaccugaaaauccuagagccauuaagaauuaugcuaaaucuaucagugcucuagaaauggaacagcaaagucuggaugacaggacaucuuuuuacagcauugaacguuuuaagcccacuguugagaccuacugguaagaaaaaaagauuaauuuucaaaagauuauugcucauugaccacacacuuggucaugcaagagcucugguggagauguacaagaauauuguuguuuucaugucugcuaacaacauccauucugcaguuuguggaucaaggagugguuuugacuuucaggucuuaucauuugauaaauacauuucauaagacugcagcugccauagauagugauuucucugauggaucugggcaaaguaaauugaaaaccuucuggaaagguuucaccauucuggauaccacuaagaacauuugugauucauggaaguaggucaguauauuaacauuaauauauugacucugaaaggaguugauucuaacccucauggaugacucugagggguucaagacuucaggaucggaaauaacugcagaugugguugaaacagcaagagaccugugagauuagaaguggagccugaagaugugacugaauuacuuuaaucucaugauaaaaaucaaacagaugaguuucuucuuaugaauaaacaaauaaaaugguaucuugagauggaaucuacuuguggugaagaugccgugaacguuguugaaaugacaaaagauuuagaaaauuacauaacauuaguugauaaagugauggcaagguuugagagcauugacuccaguuuugaaagucguucuccugugggucaaaugcuaucaaacagcauuguauguugcagaggaauuuuuugugaaaagaagucaaucagugcagcaaauuucaauguuguuuuauuuuaagaaauugccauaagccaacuaaccuucagccacuaccacccuuaucggucagaagacaccaacaucgaggccagacccucugccagcaaaaaaauuacaguucacugaaggcucaggugauuguuagcauuuuuuuagcaauaaaguauguuuuaauuaagguguauacauuauuuuuuagacauagugugauugcacagguaauagacuauaguaucauguaaacauguaaaugcaacaauuuuuuuugcagacacaaguauuuguaugacuugcuugauugcagugguguggaacagaaacugcauuaucuuuaaggugugucgguauuugggaagagaaguucucauuucacugaauuuguagcuuggaaaauauaagucuugacugguauuuaggggcuaccauauucaaauagcuagcuugagagugaaugaaaaaggucaaaagaaacacugagagauggagauaaacugauccugauaacauuuuuuuuacccuucggauccacucaugccuggaagaaaaccugucaguguuuuguuuuguuuucuuuuuaagcaaauacucccucugcccacacacuuuaugcuuuaaaacaaaaggccauguugaacuuguagaaccaaaugauugcuaauuacuuggggcgauacuagugauauauuaucuuacauacacacacacaaaacacacacacacacacacacacacacacacacggcuugaguccagcauggccuacugauuuuaaaauaggaaaugacaguguaaaugccaggauaaaggacaaagugcucugaccuguugccaaaccuuuuuuuccacagcuacagugcaccuauauucuauaauagucagugcaacucuuuuuugugaauuguuuacaugucugacuucuuguuuggauuuuacuuggugauuugauaugaauuuuuaaugugaaagcacuuagcguuaggaguuugacauuuugucugaccugaaucaccaagaggaucaugugagguuuauucagugggaagagaacuguuacagcucugacagaaaugaugggaaauaaguaaacagccuuuuaaaucuucaccagaaaucaauaggguuuaaagaugauggacguugguguuuuuugcugcuuaaggacuucaaccuuuuacgggaaaauaucuucucuacgugucagcaguuuuuuccaugcacacaaugaaucgcugcugcaaauagaacauucugcauagaacacucuucaucauuauuauaagaaagaagcuguguaagacuggccuugguaauguagagccuuuuggggcauuuuuguaugaaaagagaggaccauaucuuacaauuuuguuuucaucauaaguguaauuuaugugccaaacuuuuuccucaacuaaauaauaacaguuuuuauauacugagaaccuccuuuguacugggcauugacugugugauguuuuaagguagauuauuugaccccacuuuauagaugacaaaauuggagcccagaggcucuaaguucgucugacuagugauagaacugauacuuaaaacccuaguccaucugaguuuaaagcuuauccuuuuacuacuuuccagcugugucucugaggacaggcacucaauagguguucuugcccuugguucuauuucuucgguagugguaucucuuauuuucuuucuccuuuucccccuagucaguaaaacuaauauaagugauggccuucacaucauuuaauaagaggauaagagcuacaucauggucauugaauaaaagaauauggguuaagaacugcuucccaguauacucugcagauuugauuuauuaugaaugauuuaugagauauuagauugcuguauaguaguuagcaguguauucacaaucagcugcacucuaaugccaaguguugaaauauuaacugaacguaucauguaguguccuuuguuuauaacauaauaaucuugacuuuacaaaauaguuaacuuuccagcuguuuaauuuguacauaucauuguacaacuguuaucuuugagaaagcagcuuauuuauuuugugauuuggaaauagucuuuguaauucaaacuaagaaaaucaacuuaguuuuguaauaauaaauaucauggaacauacacugcuaaauaaaaauuuucacauaaaaccuccugauuugauguuauuuuacauuuaaaggcacauuacuuaauuggaauuuuuauaaaggaaauaagauagcuucuuaccaguuuauuguaauacauguaauauguuagauaugucgaaugcaauuacuaucagaugaacaguucuuuuccuacucuuucaugaaucuguuuuagagcagucacuuaauguuugucguuuuucauuuccuuauuaaaacugaaauaaaugaaaugaccugagaauccuucuaacucuaaaauuguguaacuuuuuaggcuuagaauuuugacuugaagucauuuuuuccuucacauacuucuaauuaauaaaaccuuaaaaauaauuuuuguuacagcauuucuaaauguucuucuuccuagcccuuaaagcagauauuuuucuaauauccaguugccuucuuugaauuggcaauacuguguuacacaccugacuugcgcucaucucaaauagaauaucuuaccuuuguuuuucauuaaaauacacacacacauauagaauauauguggcauugugacuccaggcaccuucaggugucaguaaaggaaugaugauuaaucagccauuuucuuguguuucugggagccugaaguuuucagguacaugaggauuaauucuauauuugauaaaagagccaguugaucaguucgaauagguaauuaacugcuaagcuuguaagaaacauuucaacuugugaugagaggaugauccuuaggcaaucucaguguggcagaagcuauaaucaauguaugcaucucagauaaaauuauagucucaucuacccuuugcucaacauuuuuacacugacccaguaccucuaaaaagagaauguaguagaaaucaggaauccucuguucuagugugacucugccccuaauuuucuggucacauaaauuggaaggucacauaaccuuuuaaggccugagcuuucuugucugcaaaaugagggugauagaaccuauuaaacaguuauugugggaauuauuuuaguuaacauaugugaaagaauuugaauucuuaaauaacuucugcuuugccagacaauuuagguaucuuauuugcuaguacaaguuuuuguaaccuggauuugguguguaaccuuagauagacuguagcauuuuggguaugaucagauguaaccucuuuaaagaaaaaaaaaaaaggaacagcugaauuuauuuacuucuuguuucaaggaagaaaaucguaguugccucuccuaucaaguaaacauguccauuuuuaaaagacagucagcuccccaacagggauuauaaauugaacaaaugaaagacggcuuuucagaauaaaguauucaauuuaauucauuuucuuuucuuguuugacuuugaacuuuuaaucuucuugguaaauaucaaaggaauucccuaguuacuuugcauuuacauuuugcauugguuacugucauggacugcauauuugugugcccucaacauucauauguugaaaucuaaucccaauaugaugguauuuggaggugggaccuuuaagagguaauuaagacaugagaguggaaccuucaugaaagacauaagugcccuuauaaaaagaugccaaaaagcuagcccacuccuuccaccauguaaggagagaaugaaaaauugguagucugcaacccagaagagggcccucaccagaccugacuaugcuggcauccuuauauuggacuuccaaucuucagagcugugagaaauaaauuucuguuguuucuaagccaccuggucuaugguauucuguuacagcagccugaacuaagacaauuacaguugacccuugaacaacacaaguuugaacugugcaugucaacuucuacauuauuuuuucucuguucagucaaggauggaaaaauacauuauuaauguaaugcaaaaccuauauauguggagggccagcugauaugguguggcuguguccccauccaaaucucaucuugaauucccacauguugugggaggaacccagugggagguaagugaaucauggggcaggucuuucccaugcuguucucaugauagcaaauaagucucacaacaucugaugauauuauaagggggaguuuccuuacauaagcuccucucuugccugcugccaugugagacgugccuuucaccuuuugccaugaucguaaggccuccccagccacuuggaacuguaaguccaauaaaccucauucuuuuguaaauugcccaguugugguuaugucuuuuuuuuuuuuaauuauacuuuaaguuuuaggguacaugugcacauugugcagguuaguuacauauguauacaugugccaugcuggugcgcugcacccacuaacucgucaucuagcauuagguauaucucccaaugcuaucccuccccccucccccgaccccaccacaguccccagagugugauauuccccuuccuguguccauguguucucauaguucaauucccaccuaugagugagaauaugcaguguuuguuuuuuuguucuugcgauaguuuacugagaaugaugauuuccaauuccauccaugucccuacaaaggacaugaacucaucauuuuuuauggcugcauaguauuccaugguguauaugugccacauuuucuuaauccagucuaucauuguuggacauuuggguugguuccaagucuuugcuauuuugaauagugccacaauaaacauaugugugcaugugucuuuauagcagcaugauuuauaguccuuuggguauauacccaguaaugggauggcugggucaaaugauauuucuaguucuagaucccugaggaaucgccacacugacuugcacaaugguugaacuaguucacagucccaccaacaguguaaaaguguuccuauuucuccacauccucuccagcaccuguuguuuccugacuuuuuaaugauugccauucuaacuggugugagaugguaucucauugugguuuugauuugcauuucucugauggccagugaugaugagcauuuuuucauguguuuuuuggcugcauaaaugucuucuuuugagaagugucuguucauguccuucgcccacuuuuugaugggguuguuuguuuuuuucuuguaaauuuguuugaguucauuguagauucuggauauuagcccuuugucagaugaguagguugcgaaaauuuucucccauuuuguagguugccuguucacucugauggugguuucuuuugcugugcagaagcucuuuaguuuaauuagaucccauuugucaauuuuggcuuuuguugccauugcuuuugguguuuuggacaugaaguccuugcccaugccuauguccugaaugguaaugccuagguuuucuucuaggguuuuuaugguuuuaggucuaacguuuaaaucuuuaauccaucuugaauugauuuuuguauaagguguaaggaagggauccaguuucagcuuccuacauauggcuagccaguuuucccagcaccauuuauuaaauagggaauccuuuccccauuucuuguuuuucucagguuugucaaagaucagauaguuguagauaugcagcguuauuucugagggcucuguucuguuccauugaucuauaucucuguuuugguaccaguaccaugcuguuuugguuacuguagccuuguaguguaguuugaagucagggagugugaugccucuagcuuuguucuuuuggcuuaggauugacuuggcaaugcaggcucuuuuuugguuccauaugaacuuuaaaguaguuuuuuccaauucugugaagaaagucauugguagcuugauggggauggcauugaaucuguaaauuaccuugggcaguauggccauuuucacgauauugauucuuccuacccaugagcauggaauguucuuccauuuguuuguauccucuuuuauuuccuugagcagugguuuguaguucuccuugaagagguccuucacaucccuuguaaguuggauuccuagguauuuuauucucuuugaagcaauugugaaugggaguucacucaugauuuggcucucuguuugucuguuguugguguauaagaaugcuugugauuuuuguacauugauuuuguauccugagacuuugcugaaguugcuuaucagcuuaaggagauuuugggcugagacaaugggguuuucuagauauacaaucaugucaucugcaaacagggacaauuugacuuccucuuuuccuaauugaauacccuuuauuuccuucuccugccuaauugcccuggccagaacuuccaacacuauguugaauaggaguggugagagagggcaucccugucuugugccaguuuucaaagggaaugcuuccaguuuuugcccauucaguaugauauuggcuguggguuugucauagauagcucuuacuauuuugagauacgucccaucaauaccuaauuuauugagaguuuuuagcaugaaggguuguugaauuuugucaaaggcuuuuucuacaucuguugagauaaucaugugguuuuugucuuuggcucuguuuauaugcuggauuacauuuauugauuugcguauauugaaccagccuugcaucccagggaugaagcccacuugaucaugguggauaagcguuuugaugugcugcuggauucgguuugccaguauuuuauugaggauuuuuguaucaauguucaucaaggauauuggucuaaaauucucuuuuugguugugucucugccaggcuuugguaucagaaugaugcuggccucauaaaaugaguuagggaggauucccucuuuuucuauugauuggaauaguuucagaaggaaugguaccaguuccuccuuguaccucugguagaauucggcugugaauccaucugguccuggacucuuuuugguugguaaacuauugauuauugccacaauuucagcuccuguuauuggucuauucacagauucaacuucuuccugguuuagucuugggagaguguaugugucgaggaauuuauccauuucuucuagauuuucuaguuuauuugcguagagguguuuguaguauucccugaugguaguuuguauuucugugggaucgguggugauauccccuuuaucauuuuuuauugugucuauuugauucuucucucuuuuuuucuucauuagucuugcuagcggucuaucaauuuuguugauccuuucaaaaaaccagcuccuggauucauugauuuuuugaaggguuuuuugugucucuauuuccuucaguucugcucugauuuuaguuauuucuugccuucugcuagcuuuugaauguguuugcucuugcuuuucuaguucuuuuaauugugauguuagggugucaauuuuggaucuuuccugcuuucucuugugggcauuuagugcuauaaauuucccucuacacacugcuuugaaugcgucccagagauucugguauguugugucuuuguucucauugguuucaaagaacaucuuuauuucugccuucauuucguuauguacccaguagucauucaggagcagguuguucaguuuccauguaguugugcagcuuugagugggauucuuaauccugaguucuaguuugauugcacuguggucugagagauaguuuguuauaauuucuguucuuuuacauuugcugaggagagcuuuacuuccagcuauguggucaauuuuggaauaggugugguguggugcugaaaaaaauguauauucuguugauuugggguggagaguaguguagaugucuauuaggucugcuuggugcagagcugaguucaauuccuggauauccuuguugacuuucugucuuguugaucugucuaauguugacagugggguguuaaagucucccauuauuaaugugugggagucuaagucucuuuguaggucacucaggacuugcuuuaugaaucugggugcucccguauugggugcauauauauuuaggauaguuagcucuucuuguugaauugaucccuuuaccauuauguaauggccuucuuugucucuuuugaucuuuguugguuuaaagucuguuuuaucagagacuaggauugcaaccccugccuuuuuuuguuuuccauuugcuugguagaucuuccuccauccuuuuauuuugagccuaugugugucucugcaugugagauggguuuccugaauacagcacacugauggaucuugacucuuuauccaauuugccagucugugucuuuuaauuggagaauuuaguccauuuauauuuaaaguuaauauuguuaugugugaauuugauccugucauuaugauguuagcuggugauuuugcucguuaguugaugcaguuucuuccuagucucgauggucuugacauuuuggcaugauuuugcagcggcugguaccgguuguuccuuuccauguuuagugcuuccuucaggagcucuuuuagggcaggccugguggugacaaaaucggucagcauuugcuugucuguaaaguauuuuauuucuccuucacuuaugaagcuuaguuuggcuggauaugaaauucuggguugaaaauucuuuucuuuaagaauguugaauauuggcccccacucuucuggcuuauaggguuucugcagagagauucgcuguugguuuggugggcuucccuuuguaaguaacaugaccuuucucucuggcugcccuuaacauuuuuuucugcauuucaaccuuggaggaugugacaauuaugugucuuggaguugcucuucucgaggaguaucuuuguggcauucucuguauuuccugaaucugaauguuggccugccuugcuagauuggggaaguucuccuggauaauauccugcagaguguuuuccaacuuguuuccauucuccccgucacuuucagguacaccaaucagacguagauuuggucuuuucacauagucccauauuucuuggaggcuuugcuccuuucuuuuuauucuuuuuucucuaaacuucccuucucgcuugauuucguucauuucaucuuccaucacugauacccuuucuuccaguugaucgcaucggcuccugaggcuucugcauucuucacguaguucucgagccuugguuuucagcuccaucagcuccuuuaaguacuucucuuuauugguuauucuaguuauacauucaucuaaauuuuuuucaaaguuuucaacuucuuugccuuugguuugaauguccuccuguagcucagaguaauuugaucgucugaagccuucuucucucagcucgucaaagucauucuccauccagcuuuguuccguugcuggugaggaacugcguuccuuuggaggaggagaggugcucugcguuuuagaguuuccaguuuuucugcucuguuuuuuccccaucuuugugguuuuaucuacuuuuggucuuugaugauggugauguacagauggguuuucgguguggauguccuuucuguuuguuuuccuucuaacagacaggacccucagcugcaggucuguuggaauacccugcagugugaggugucagugugccccugcuggggggggccucccaguuaggcugcucgggggucacgggucagggacccacuugaggaggcagucugcccguucucagaucuccagcugcgugcugggagaaccacugcucucuucaaagcugucagacagggacauuuaaguuugcagagguuacugcugucuuuuuguuugucugugcccugcccccagagguggagccuacagaggcaggcaggccuccuugagcuguggugggcuccacccagcucgagcuucccggcugcuuuguuuaccuaagcaagccugggcaauggcgggcgccccucccccggccucgcugcugccuugcaguuugaucucagacugcugugcuagcaaucagugagauuccgugggcguaggacccuccgagccaggugugggauauaaucucguggugcgccguuuuuuaagccggucugaaaagcgcaauauucgggugggagugacccgauuuuccaggugcguucgucaccccuuucuuugacucggaaagggaacucccugaccccuugcacuucccaggugaggcaaugccucgcccugcuuaggcucgcgcacggugcgugcacccacuggccugcgcccacugucuggcacucccuagugagaugcacccgguaccucagauggaaaugcagaaaucacccgucuucugcgucgcucacacugggagcuguagaccggagcuguuccuguucggccaucuucgugguuaugucuuuaucagcaaugugaaaauggaccaguauaguaaauggguaccaggagaguggggcacugcugaaaagagacccgaaaauauggaagcaacuuugcaacuggguaacaggcagagacugaaacaguuuugagggcucagaagaagauaggaaaauguggaagaguuuggaacucccuagagacuuguugaauggcuuugaccaaaaugcugauaaugauauggacagugaaauccaggcugagguggucucagauggagaugaggaacuuguugggaacuggagcaaaggugacucuuguuauguuuuagcaaagagacugccagcauuuugacccugcccuagagauuuguggaauuugaauucgagagagaugauuuaggcuaucuggcagaauaaauuucuaaacagcaaagcauucaagaggugacuugggugcuguuaaaggcauucaguuuuaaaagggaaacagagcauaaaaguuuggaaaauuugcagccugacaauguguuagaaaagaauaucccauuuucugagaagaaauucaagcuggcugcagaaguaaggaggagccgaauguuaaccacuaagacaauggggaaaaugucuccaggucaugucagagaacuuugcagcagcugcucucaucaagcccagagguuuaggagaaaaaaaaaaaugguuucaugggcagggcccagggucccucugcucugugcagucuagggacuuggugcccugugucccagucacuccagcugugauuaaaagggcccaagguacagcccgggcuguugcuucagaggguggaagccccaagccuuggcgacuuccacauaguguugagccugcgggugcacagaagucaagaauugaaguuugaguaccucugccuagaccucaaaagauguacggaaacaucuggaugcccagguaaaauuuugcugcaggggcgaggcccucauggagaaccucugcuagggcagugcagaagggaaauguggggucagagcucccucacagagucccuucuggaacauugccuaguggagcugugagaagagggccaccauccuccauacccuagaaugguagaaccaccaacagcuugcacugugcaucuggaaaaucugcagacauucaaugccagcccaugaaagcagccaggagggagucuguacccugcaaagccacagagguggagcugcccgagaccaugggaacccacuucuugcaucaucauggccuggaugugagacaugaagucaaaggagaucauuuuggagcucuaagauuuuacuuccucacuggauuucagauuugcauggggcguuuagcccguuuguuuuguccaguuucccccauuuggaacggcuguauuuauccaaugccuguacccccauugugucuaggaaauaacuaacuugcuuuugauuuuacaggcucauaggcagaagggucuugucuccucuuggaugagacuuuggacugugggcuuuugaguuaauguugaaaugaguuaagacuuugggggacuguugggaaggcaugauugguuuugaaauguaaggacaugagauuugggaggggccaggaguggaaugauaugguuuggcuguguccccacccaaaucucaucuugaauucccauguguugugggagggaccuggugggagguaacugaaucauugggcagaucuuucccaugcuguucucaugauagcgaauaagucucaugagaucugaugguauuauaaggggaguuuccuuacacaaguuccucucuugccugcuaccaugugaggcuugccuuucaccuuucaccaugauugugaggccuccucagccacauggaacuguaaguccaguaaacuucuuucuuuuguaaaucgcccagucuuggguaugucuuuaucaauagcaugaaaacagacuaauacaccagcuuuucauauaugcagguuccacagggccaacugcaggacuggaauaugcacggauuuugguauaugugagggauccuggaaccaauccccagaauacacugagggacaacuguacuauagguuuuuauguuuaaauauuuuauuuugaugaagugaucuuuaaugguucauucuaguaacccaaggauaugcuuuaaauuuauugaagucaauaggaaaaugugauuuaauacuuaagaaauugcaguaaaacaaaggaaaaaaauuuccuuucugagaauucuuauuugccuuugauaucuaauucuuaugguuaccauuuggcauuuagugaaccccuaauaauauauugaaugauacuucaaguuauguuacagaucuaagaauacuuggccaaacugaucuaugacuacaaaaagaaauucuguugcagugacucauacaacaaaaauguucccaguuugugagugacgcucuguguuauauuuacuucccuaauauauagucaccuuucauaauagugucagcauaauauacuaagacaaagaggaucuacugaaacuucucuugcaaccauuaggacaaacccgguauaagacuaugccuccaguuaccugggugaccuuacccuguuaaagucuuauuuauaaaaugagggcugacacuggauuauugcuaagguucuaucuaucuggagaaauuaucaaccaggagagcuuaaugguauuugucaccuauucuuauuuuuccuaagagaucuuuuucauaugauagugacaugaucauucugaugaaguccuuccagcuucuaauaaaaucuaggaaacacaguuguuauucaccccauaguaaugaagaaaccuguccugugcacuacaaggagcuucuuauguucugagaagaauuguuauucaccuuugaucucuaguccuuaaacucuguagucggcauuuaauggauguccacuaauauuuaguuugguuuguguugcauauuauggaaagcacucaucuauauuuaaugucuaugccacugccugugaauuugugggaagacaaguguauuguaaagucaaauuccugccacuccaauuuucuaccagcaucuaaguccucacagcugugcuuuagugccccaaauuuguuauuaagcccauaaucccagcuacuugggaggcuaaggccggagaauugcuugaacccaggagguagagguuccagugagccaggaucacaccguugcacuccagacuggacaauagcaguggaacucagucuccccccaaaaaaaaaaaauagacauuuuuauacauaucacggacagguuuuauauaugaucuuguuucuuguggacuguaagcuacuugagguuaaaagcucuacuuuauuuauuuaugucccuccacuguuuacuacuacuuagcacauauacgacaaucaguuacauuuacuaaguugaugauuauaaggaaucacacacgauauaauagcugaguuguuaaugaaaaaaaaaucaguuucuuuguaaugauuccucucuaccagaaaaacaaucaagaacccguuguaugugguagcuuauguaagagggaagcuucuggaaaagcaccugccaauugucacuguuauauuuucagagacaaaagacaaauauagucacaaucacugguauaauuuucaugaccucuaaacaguucuguauuuuuuaaugacuacagaaauuuauugguuauuuucaguuuaguuuuaugcagucuggcaaaguaaucagauuaaguauguauguaucacacacuuuuucacuuauagcaguaauccuuuaucugcaucagucuaauuuagugcuuugggcaauagaguaaugcagacuaaaucaaagcuggauaugagccaagaugaugaguuggaaagaucccuggcuuuguaauuagauagaccuggauucccauuaauugagguaaugaauguaaaauacugaacacagugccuggcuccugguaaguugccccauaaaugguagcuaauguuauuuuacuuuaaagagugcauaguuuuuaaaauaaucauuagguaggaagagcugugguaaaggagugaaguuuguuuccuugaaaguacaguuuaccagcaugcaguauaucuuguuauuuguuagcucuguggaaacaugccuaccuaaaaaggagacucagguucugaaacagaccaagaaugaaagcaccaacuaacucuuuugugaggccuugugcuuuuuuauucaauggaagauaacagucaucagauugggguagggucuaaugguggcagccaacuaguguguguuuuaauuguguguguugcaugaugagagguuuaaugccuuaggcaagucacuagaugagcucaacucuaagaguacauuuucuuuaguaaaaauaaggccaauacuauuuguguugcaaaguuaugaagauugaugauuaugucaguaaaaugcccagugccuggcauuuugaaaaugcuccuauaaauugaaccuuaauuuuucucauuauuaucauuguuauuuuuauauaaugaucuguguauuuaagguggguuuguccuuugaggauccucuucgcaauauuuuccuguugcuuagaaacacauccuuuaaauaacaauagaagcucucuaugcaucugaaaguagaaaugcucuuaacuuuuuacuauucccaccuaagcuugucuucuaacauuacuucugaucuuucagaaguacguucucuucguguaaaggaauuauggaagaguuugcugucuggcuaaucuugcuauaugguaguaucugcaguuuucccaagaggaaugcguucauuuugugcuaucuaauugccagucuuaauguauucauauuggcaaguuuucaguauucugucccuacuuuuuuccuuuucccuguuggcugugguuugacuuuguucccccaaaguuuguguguuugaaacuucaucccaaugcaauaguguuaggaggugggaucuaauaagaggugauuggguugaauaaaguaaguccaaucccuggugccucucucuuggucccucuguguuugcuugcuauuccaacauguuauaacauagcacagaggcccuugucagaugcugguaccauauucuuggacuugccagccuccagaacugugagccaaauaaauuucuuuucuuuauaacuuaacuagucugugauauucuguuauagcaacagaaaacggacuaagagacuugugaugauuugauuuaauuuuacuuuuuccugauaguuuuaagauuuuauucuaaauacacucucacugaagaguucguaaugccaucuuauauuauuuuacucuauauuuuugucuuuacucucuauccuuugauguacuuguugugacaacuuuaaucauguuuagacugguuuguggagaagagaggaucacaacagguacagaaauaggcuauagacuuuauauggcuguugucagucuuuucuauuuuauuaucuuggaguugaacuuauguaggacauuacuggcuacgguaaagaaaucaaauaaaaagaaaggacaguucuuucaaucuuguauuagauuuauagccuaccaaaggaacuccauuguugaugcugauaaacaaaugaauggaaauucagaaugguuauaguaguccagugagcuuuggaagguuguaagcuuucugggccuuaguuuucuucaguacaaaauggacauauuaacugagcuuucuauuuccguggauuguauaaagaucagaugaaauauaguucacccuugaacaacacaggaguuaggggaacugacacccccccgacacacccacacagucaaaaaucugagcguaacuuuagacuccccaaaaacuuaccugcuaauaaccuacuguugacugaaagccuuaccaguaaaaugaacaauuaacacacauuuuaguguuguauguauuuguacuauguaugcccuuaaaauaaaggaagguaggggaaaaaucaugaagagaaaauauauuuacuauucauuuagaggaagugggucaucacaaaggucuuuauucucaucaucuucaugucaaggaugcuggaggaggggaaggggcuggucuuagugucucagaggugacagaggcagaaggaguaagccgagaagguggaaggggaggaagaaguggcaggcacauuugauguaacuuuuauugacaaauaucugcauauaaguggacccgcacaguucaaaccugcauuauugaaaggucaacuguaaugugaaacacauauaaaaauaaugugucuaucaucaaagcauuauauacuucaugauuuuaaaguguuagugaccaaguaauccuuuaaggaaagagacuguguugccauaucauacuuauuaacuuauuguugucugucuuccaaaaaggauuugaagcaaaagucacuaaugaagucauugaauugaauauguuauuggugauagaagugaagugagaggaaauccgaggagaaaugcuuuguaagaauguugaauucauuugcuacauaggcaguaaauauuuagguagcacaucuucauagaaggaauaaaaugugcaaauuugauuguuguuggcaaagacugauuuuuaaaacaacuguaauacacaguagaucuaaagagauacugccuaccaaaggguaagagaaaaagauuaggauaauaaauuacaaauuagcuugacuuugagaauuugggggaaauguugaaacuuacagagaaagaauaaauuuagggaaauaauaauguaaccaggauagggccugaauuuuuuauaucuguauguaaagaaggagcugguucuuauuaacuuuucugaagaucugguauguacuuuaaagccuacuuuaucaacaacaacaacaaaacucugugaagaagggguggagggauguuucuaagaucuuagagaaaauuguaaguauaugguagaacuuuaagaaaaucaucuuuaguacaagaaggauuauaaugguuuugguugaaguuauucaguguugauugugaccauguaacuaaaguuugugauucuugaauuuguguuuuuuauacuuauguuuuacaaaaagauuuuauuucuucuucaaggagguuguaagaauuuucccucgauuuucuaaaucuaaugcagaaauuguuccaggcuaugaguaaguaguggagggaagaaauuugagucauguuaccuccauuuuuagugucucucuuuagcuugucccuuccuuuagucaagguaucuguuagauuuauaaaaauuuagaauaccauaucccuauaauuuuucaucuaauaaucucauugagaaaacacaggagaaguuggaaagcaaauaguggucacugagugcuucuuauguaucaaauucuagauguuaauauguaauuuaaucuucagaaagggcuguuagaccauaagcuccuuggagcacagcuuugggucuucaucuauguaaucucucuaauuaacuguacguuuaauaaguguauacaguuagauacacagugaaugaguaaacaagucuguaaauuauuguccucauuuuagagaaaaugaaaugggugucuaagaaauuaagucuaucaauagucccauagcuacuaagcggcaaaaccuuaaccuguauguagucuuuuuauuauuauuauuauuauuauuauuauuauuauuauuauuauuauacuuuaaguucugggauacaugugcagaacauguagguuuauuacauagguauacaugugccauggugguuugcugcacccaucaaccagucaucuacauuagguauuucuucuaaugcuaucccuccccuugccccacacuccccaacaggccccagugugugauguuccccucccuguguccauguguucucauuuuucaccucccacuuaugagugagaacaugugguguuugguuuucuguuucuguguuaguuugcugagaaugaugguuuccagcuucauccaugucccugcaaaggauaugaacucauccuuuuuuauggcugaauaguauuccaugguguauaugugccacauuugcuuuauccagucuaucauugaugggcauuuggguugguuccaagucucugcuauugugaauagugcugcaauaaacauacguaugcauguguccuuauacuagaaugauuuauaauccuuuggguauauacccaguaauaggauugcugggucaaaugguauuucugauucuagauccuugaggaauugccacacugucuuccacaaugguugaauuaauuuacacucucacuaacauuauaaaagcguuucuauuuuuucacauccucuccagcaucuguuguuucaugacuuuguaaugauggccauucuaacuggcaugagaugguaucucauugugguuuugauuugaauuucucuaaugaccagcaaugaugagcuguuuuucauauauuuguuggccacauaaauuucuucuuuugagaagugucuguucauauccuuugcccauuuuuugauagcguuguucauuuuuuucuuguaaauuuguuuaaguucuuuguagauucuggauauuagcccuuugucagauggauagauugcaaaaauuuucucccauucuguagguugccuguucacucugaugauaguuucuuuugcugugcagaagcucuuuaguuuaauuaaaucccauuugucaauuuuggcuuuuguugcaauugcuuuugguguuuuagucaugaaguuaucacccaugccuguguccugaaugguauugccuagguuuucuucuaggguuuuuaugcuuuuaggucuuauguuuaaaucuuuaauccaucuugaguuaauuuuuguauaagguguaaggaagggguccaguuucaguuuucugcaaccccguuucuuaaauagggaauucuuuccccauugcuuguuuuuggcagguuuguuaaaaaucagaugguuguagauguguuauuucugagggcucuguucuguuccauuuggucuauauaucuguuuugguaccaguaccauccuguuuugguuacaguagccuugcaguauaguuugaagucagguagcaugaugccuccagcuuuguucuuuuugcuuaggauugucauggcuauacgggcucuuuuuugguuccauaugaaauuuaaaguaguuguuuccuaauucugugaagaaagucaaugguaguuugaugggaauaacauugaaucuauaaauuacuuugggcaguauggucauuuucacaauauugguucuuccuauccaugagcaugggauguuuuuccauuuuuuuguguugucucuuauuuccuugagcagugguuuguaguucuccuugaagagguccuucacaucccuuguaaguuguauuccuagguauuuuauucucuuuggagcaauugugaaugggaguuugcucaugauuuggcugauauugguguauaggaaugcucgugauuuucgcacguugauuuuauauccugagacuuuguugacguugcuuuuuggcuuaaggagauuuugggcugagauguugggguuuucuaaauauacaaucaugucaucugcaaacaaagauaauuuaacuuccucucuuccuauuugaauaccccuuauuucuuucucuugccugguugcccuggccagaacuuccaacacuguguugaguaggaguggugagagagggcauccuuuucuugugccaguuuucaaagggaaugcuuccaguuuuugcccauucaguaugauauuggcuguggguuugucauaaauagcucuuacuauuuugagauauguuccgucaguuccuaauuuauugaguguuuuuagcaugaagggguguugaauuuuaucaaaggcuuuuucugcgucuauugagauaaucaugugguuuuugucauugguucuguuuaugugauggauuacguuuacugauuugcauauguugaaccagccuugcuucccauggaugaagcugacuugaucgugguagauaagcuuuuuaauguuuugcuggauucaguuugccaguauucuauugaggauuuuucgcaucgauguucaucaggguuauuggccugaaauuuuauuuuuuuguugugucucugccagguuuugguaucaggaugaugcuggccucauaaaaugaguuagggagcagucccucuuuuucuauuguuuggaaucguuucagaaggaaugguaccagcuccuuuuuguaccucugguagaauuuggcugugaauuugucugguccugggcuuuuuuugguugauaggcuauuacugccucaauuucagaacuuguuacuggucuauucagggauuugacuuauuccugguuuagucuugggaaguuguauguguccaggaauuuauccauuucuucuagauuuucuaguuuauuugcauacagguguuuauaguauuaucugaugguugauuguauuucugugggaucaguggugauauccccuuuaucauuuuuuauugugucuauuugauucuucuuucuuuucuucauuaaucuggcuagcagucuaucuauuuugucaaucuuuuccaaaaaccagcuccuggauucauugauuucuuuugaaguguuuuuugugucucuaucuccuucaguucugcucugaucuuaguuauuucuugucuucugcuagcuuuugaauuuguuugcucuugcuucucuaguucuuuuaauugugauguuaggguaucaauuuuagaucuuucuagguuucuccugugggcauuuagugcuauaaauuucccucuaaacacugcguuagcugugucccagagauucugggacguugcgucuuuguucucacugguuucaaagaacuuacuuauuucugccuuaauuucguuauuuacccaguagucauucaggagcagguuguucaguuuccauguaguugugcaguuuugagugaguuucuuaauccugaguuuuaauuugauugcacuguguucagagagaccauuuguuaugauuucuguucuuuugcauuugcugaggaguguuuuacuuccaauuaugugaucaauuuuagaauaagugugaugugaugcugagaagaauguauauucuguugauuugggguggagaguucuguagcuaucuauuaggucugcaugguccagagcugaguucaaguccugaauauccuugcuaauuuucugucucgaucugucuaauauugacaguggaguguuaaagucucccauuauuauugugugggagucuaagucucuuuuuaggccuuucagaacuugcuuuaugaaucugggugcuccuguauugggugcauauauauuuaagauaguuagcucuccuuguugcauugaugccuuuauuauuaugugaugcacuucuuugucuuuguugaucuuuguugauuuaaagucuguuuuaucaagggcgaagauugcaaccccugcucuuuuuuugcuuuccauuugcuugguaaagcuucucccaucccuuuauuuugagccuaugugugucuuugcaugugagaugggucuccugaauacagcacacugaugggucuugacucuauccaguuuuccgucugugacuuuuaauuugggcauuuaacccauuuacauuuaagguuaauauuguuaugugugaauaugauccugucauuaugaugcuagcugguuauuuugcccauuaguugaugcaguuucuucaaugucaguggucuuuacauuuugauuuguuuuugcaguggcuaguacugguuguuccuuuccauauuuaguguuuccuucaggaguucuuguaaggcaggccuaguggugacagaaucccucaauauuugcuugucuguaaagaauuuuauuucuccuuuacuuaugaagcuuaguuuggcuggauaugaaauucuggcuugaaaauucuuuucuugaagaauguugaauguuggcccccacucucuucuggcuuguaggguuucugcagagauccacuguuagccugaugggcuucccuuuguggguaacccaaccuuucucucugucugcccuuaacauuuuuuccuucauuucaaccuuggagaaucugaugauuaugugucuugggguugcucuucucaaggaguaucuuugugguuuucucuguauuuucugaacuugaacguuggccugucuugcuagguuggggaaguucuccuggauaauauccugaaguguguuuuccaacuugguuccauucuucccgucacuuuccaguaccccaagcaaauguagguuuggucuuuucacauagucccauauuucuuggaggcuuuguucauucuuuuucauucuguuuucucuaaucuugucuuuacacuuuacuugauuaaguugaucuucagucucugauauccuuucuuccgcuugauugauuuggcuauugauacuuguguaugcuucacaaacuucucgugcuguuuuuuucagcuccaucaggucauuuauguucuucucuaaucuaguuauucuaguuagcaauuccucuaaccuuuuauugaaguucuuagcuuccuugcauuggguuagaacaugcuucuugagcucagaggaguuuguuauuacgcacuuucugaagccuccuucuaucaauucgucaaacuaauucucuguccaauuuaguuccuuugcuggcaaggaguugugauccuuuggaagagaagaggcauucagguuuuuggcauuuucagccuuuuugugcuguuuuuuuccucaucuucguggauuugucuaccuuuggucuucgauguuggugaccuucggauggaguuuuugcuucguuguccuuuuuuuuuuauguugaugcuauugcuuucuguuuguuaguuuuccuucuaacagucagaccccucugcugcaggucugcuggaguuugcugggggcccacaccagacccuguuugccuggguaucaccagcagaggcuacacaacagcaaagauugcugccuguuuguuccucuggaagcuucaucccagagggguaccggccagaugcgagccggagcucuccugcaugaggugucugucgaccccugcugggaggugucucucagucuggaggcucaggggucagggacccacuugaggagacagucugucccuuaucagagcucuagcgcugugcugagagaucugcugcucucuuccaagccggcaggcgggcacauuuaagucugcugaagcugcacccacagccaccccuucccccaggugcucugucccagggagaugggaacuuuaucuauaagccccugacuggggcugcugcccuucuuuuagagaugcccugcccagagaggaggaaucuggagaggcagucuggcuacagcgacuuugccuagcugcaguggauuccacccaguucaaaauuccuggcagcuuuguuuacacuguaaggggaaaacugccuacucaagccuugguaaugguggauuccccuccccccacaaagcucaagcaucccaggucgacuucagacugcugugcuggcagcgagauuuucaagccaggggaucuuagcuugcuaggcuccgugggggugagaucugcuaagcuacacuacuuggcucucucacuucagcccccuuuccaggggagugaaugauucugucucacuggcguuccaggugccagugggguaugaaaaaaaaaacccugcagcuagcuaggugucugcucaaauggccacccaguuuugugcuugaaacgcagggcccuggugguguaggcacccgagagaaucuccuggucuguggguugcaaagacuggaaaaucguaguaucugggcuggagugcaccguuccucaaggcacaguuccucagggcuucccuuggcuaggcgacggagguccccaaccccuugcacuuccugggugagguggugccccacccacccuucuucggcucgcccucuguggacuguacccacugucuaaccagucccaaugagaugagccagguaccucagccggaaaugcagaaaucaccugcauucuguguuggccucgcugggagcuuuuuguuuguuuguuuguuguguucuuaaugaguuggaguuuugcuguuuuugcccaggcugaagugcaauggcacaaucucggcucacugaaaccuccaccuccuggguucaagugauucugcugccucagccuuucgaguagcugggguuacaggcaugcaccaccaggcccggcuaauuuuguauuuucaguagagacaggauuucuccauguuggucaggcuggucucgaacacccaaccucaggugauccgcccgccucagcuucccaaagugcugggauuacaggggugagccaccgcgccuggccuguccucuuuaauuaucuuacauaugucaguuaugaacuugauuuuucagcacccugcaauucauucacucagaaagagaacauaaaugcaauagucaaaauaguuuucauguagagggugaaauauaagacuauccagaauguugccuuuuuacuucugcuucauugccacauuacaucaaugguugaguaacaguuauaccucugaacuauuuuccacagaacagaaaugaccuguuaggagcauuaucuuugcuuuugaauaaugauaguggucaagagcuugaacuaaguaguuagacaaacuuagucucagucaugcuacuaacuggcucuuuuucuuuaggcaaauuucuuuugucuaaagaaccucucuaagcuucacuuuugccauaaaaugggaauaauaauacuuaccuuauaggucuaaugugaggauagagauaauaugcuuagcucaauaacucgcauauagaagaugcuuguuaagaguuaguuaaaauuggauguuucuguugaugauguugucauugcuauuacaaauauuauuaucaacuuugaauauagugauuuaauuuuuccauugguccccuacaccaaggaaaagucauugggaaauaaucacagggaguguauuuauauaaaugauggccuuuauuacauauuguacguugauaaaauuugcuucuuagcauguugugaguaccuuuaaauuaaaacuuuuggagaggauaaaacaauuuucuuuauuuaaaaaauuuuccagccgggcgcgguggcucacgccuguaaucccagcacuuugggaggccaaggcgggcagaucacgaggucaggagaucgagaccaucccggcuaaaacggugaaaccccgucucuacuaaaaauacaaaaaauuagccgggcguaguggcgggcgccuguagucccagcuacuugggaggcugaggcaggagaauggcgugaacccgggaggcggagcuugcagugagccgagaucccgccacugcacuccagccugggcgacagagcgagacuccgucucaaaaaaaaaaaaaaaaaaaaaaaaauuuuccugggacuggcaugguggcucacaccuguaauccccaacacuuugggaggcuguggcaggaggaucacuuaagcccagaguucaagaccagcccagggaacauagcaaaaaccugucuuuacaaaaauauauauacauauauuuuuaaaagauuagcugaguggguaugguggcacacacccuguaguacuggcuacuuaagaggcugaaauaagagaaucacuugagcccaggaguuugaaguuccagugaacugugaucacaccacuguacuccagccugggugacagagugagaacuugucucaaaaagaaaaaaaaaaauuuauucuaucuuauaucuuugacuugcaaaagccuauauuuuuagaaucaguuuuuuuagacauuagucugauacagaaaccaagguucucugcagcagaccauucugagguuguggggauauuguuggaaaaaaauaugauuaggauuuauuauacauucuuaccuuuauuuguuuuuugucagagaagcagucaccccugauuguugcuuuaggccaucaauugaugugcacugcaagggguaaauuguucuacacauuaguaagcuggguaagcaaauuguugugcaaaccuaauuuguuuccuagagaaagugacugacauacaauuuugaaaauggaaauauucauaaauugggugaccaugguggaauagauccauugugaaauaaccacuacguuuaagaauccuguacucauuggugagacugacaaaaaacaguacugugacugagguaaacacaagguuacagcagcccuuaagaggaguacuuuccucaggcuuggggaagguaggacagacaggagagaggaaucagaagucuucacaauauugauaucuauucugggccuugaagaugaagugggaguuggcuagguagauggaagguaggaggggaaggggguaaauuuuuccagguugugagagcaacauguuugaggaacuauaagauaggggaauagaaugagaauacuggguguuagagaagaaugagauuuuucuagauguaacuuuuuugcacuauauagcccaccaguuagagggucuguuuugugaagaaacuagucaguucagaggaggaaaaugauggaaguaguauucauuaaacuaaauauuuuauucuguugacuuggucaaucaagucagacuuggagccugauaauccauuugggcaucgauuugucuuuauuguuaacuuuguaacuuggaaaaauuuuuucaaaaucuucacaugguucucaauacugguuuuacaauauaaucacacgaggaaguuuuguaaaaauaacacuguggauuugcuguaaaaugucccaauggaaauuuuuuuuaauguuuggggguggggaaauagaugauguaagauuugcaaaauauugcuaaucacugacacuugguaauauauuuccauuauguuuguauauguuugagcauuuacauaacuaaaaguuuaaaaaguaaaauuagaauuuuuucugaacagccaucaaaagauacucauacuugggccccauccuaaaccaauuaggucaaaauuucuugggguuuaggacccacguaucuuuuguuuguuuguuguuguuguuguuguuuuggaguucaacauguuuaugguguguagccaugguugaaagcuuuuauuuuauaagauagacaaagcaggaauuauuauucucauuuuacaggagaaaaacagaagggcuaugugguuuguuaaaaggccacacagacaguaaagaacacagccuuuacauggucagccucacauucuaguacucauuuuauuacacugcucuucuucucuguugccugguaucaaaggaauuaguuuguugcuaguuaguaucacaugauauguucagaacuauacuauauugaagaucuuagucccuacgacucuguucuagagcaucccuaguuccuguucuuccucagacuggcagugaguauugagugcaagcaacaaaguuuguuaaauugcucuuauuugugaguggaugcuuauaguucagccugccauuuuuuuuuucuuggccugugaguaagaaagcaagcaguguaagugccucuaagaaggaaaagaugcugauacuuuucucaugcccucugugcuagggcaguaaaucuacaugcaaauuaaagauuuuggugacaaaugagaacacccaucaugacucuagucucuucuuaacuuuccuggguguuguuaauucauaacauaguuugaauucacuuacuauuauugauuucuauauuuauuagaaugaaaagggaaaucuugccuuacaagggaaauaugguuaucagacgcuuucuuugucauggaauaaaaagaccuucuaggauauaaacugugagaaugacaguuaaauugauauggugaagguuaaugcgugcuugcugcauugauguuggaggucccaaucauuuaccacuaugcuccuauaauacaugccguacaucuucauuaggaaggcacagagcaaucaguuucagguuucuggaugagccuguggccaggccauaauuaaccuuuugaacuuggaauuguagcagaauguucuauuggcuuagguuaucaauuaugguuagagucgauugauauucaaagaaggcuuauuggugauagauauuauaauuuacucaucugccuguugugugcuugacaaauagaaaugucauaacaaauaauuuuguuuuuugcuuuuggaaagagauuauuugccaaacaguucuauaagcaacagcuguuguucagguuuuuucuugaggugggggagggucuuaauuuucaguauuguuuuucaguuuccuauguaugaagcagugcaacuaauaaggggacuuuuagaguuacauaugucaaauuuuacuagaaaaaaacucacacauagcauaucaacauacuuuaaaaauaagucuaaaaaauuaaaguucaagugaaaucauguauuuuauuuauuuauuuauuuugagacgaggucucacucugucacccaggcuggagugcagugguacaaacacagcucacugcagccucaaacuccucgguucaagccguccuccuaccuuacccucccaaacagcugggaccacagccgugcaucaccacgcccugaugauuuuuuuauauuuuguaaagauggagacuccguaugauguccagcuggucucaaacuccugaacucaagugauccacccaccucugcuuccaaaaaugcuggaauuacaugcaugagccaccacccccagauguuaaaauuuuugugucuucuuuuucuauacaguauuucacucaaauaaaauaguaucagaaaaauggcugacugaauuuugcuuuuuuggaaaaacuugcuagaauguuuguuaaucagguaaaacugaaaauauuaauugccaguccaaaugaagggaaguuugccuuuuuuguuguuguuguucuggcaaacuuuauuaaaaaacaaaaacaauauaccaauggacagaauuuucucugccacuugaggagccccuaucccaaaccaaaacuacugaagcugaucacacagguauacacaucacugguaacucuauaagaaauaaaaggaaaaaugaauaugucugguuaccacaagcccaugugauaaugcauggcugugugacacagaaaacgguauacaggucaaaaaugccuuggaaaaauacaaauuuuuaaaauauggaauauguagaccuuaauccacucggccacauuuuuauauuaacacaucaauguauuauauuugcgguuaaguaggaaauuugccuuuuuuaugaauuucaaauuaucuauuauaguuuaaagauaacugcucaaacuaagcagcuguuuguuuuuaagcuauaguuguuuauucuguuaacuuacccuauuaguuuuagaaauaauguuuuauuaaaaucaaauaugccuuagaaguuauuucuagaaaaaaguugcacugagguuuuauuuauugaaguuuuaauuguaauuugacuaugcauauuguuuugaaaugacagucgucccucaguaucuguguaggauugguuccaagacaccccacagauaccaaaauccauggaugcuuuggucacuuauauagaaugguguaguauuuacauuuaacuagugcacauccucucacauacuuuaaaucaucucuaaauuauuuauaauaacuaauacaauguaaaugcuacguaaauacuuguuauacuauauuguuuagggaaucaugacaaagagaaaguccauauauguucaguacgguugcaaccauccauuuuuccccauauuuucaaucugcgauugguugaaucuauagaagguccaacuguauagugagaaauugagaacaugaauauccaacacuaaggcauugguugaguauauuguguacaucacuuugaagaaauauuauagguauuaacaugaugauaggauagaguuuuaauaacuugggaaacuguuaccuuaaaaguuaaaaagcagguuagaaaauugcauauuuaggggugagaugaggguuauugagaaagacuggaaggaaguauacuaaaauguaaacaguggucacuuagaagugguaguauuaugucuuuuuucuuauuuauauauuuuaucauauaaaauuuuuuuuucugauauguuuaucaguaucaucauagcauaguguguaaggccugacugccugguucagauuccaacucuguuacuuccuggcucuguggcucugugacauuggacaaauauuuauacucuuaggcuucgguuuccucauuuguagaauggguacaagaaccuaucuuauaggauugauaugaagauuaauuauauauuaauaauaauauauuuggaguuuaaguaaacacauaaucacauaaugcugugagugcuguaaccuuguccgcucucuucugagcauagcccuucuaguguuguagcauagugcacagccuguugguuuacugcucaccguucacuagcccuuuagccgucauaucuaucuuccuucucugugucuccaucuguaugucucaugagcuuuauaggggaggcaaaaacuuuucccucuacuccuucuacauuuuccaacuguggcccuguacauuauacuaccaaaagacagauuaccaagggaaaagcauacaaauuuuacuuaauaacuuuuacauguauacaggagccuugacaagaaaaaugaagaucaaaaagaacagggccaaaagguuauauacuagguuagauauagaguauuaaauuguagaaacgugaugagacagggaaguucauuuuggaaaagucacuaggaagauaaagguuaguuuaacagagucucuuuauagauuuuucucuaccuggacuccccucucugguaauaagaaugucuuuuuuuuuuuuaauuuuuuuuuuauuauacuuuaaguuuuaggguacaugugcacauugugcagguuaguuacauauguauacaugugccaugcuggugcacugcacccacuaacucgucaucuagcauuagguauaucucccaaugcuaucccuccccucuccccccaccccaccacaguccccagagugugauauuccccuuccuuuguccauguguuuucuuccuacugguacagggagaguuucuuucacuugagaguuugaucugcuuucaggaagaaaaagaaaggucagaguauucuucuuguaucugcuguuuuuucagugccguuaacucaaaauauucuuuaugccaaaguagcauauuuuggaguagcauauucugcuacucaucuuucuuacucagucauuucuaagauauaaccauucagcuucuccccagacuucucucccuuuugcuaagugaaugucauucuuaccucagucacaaaaugaaagauguggaagucaucuggaugcuuuaucuuccuauguucuuuugaaaaccuuugcuuuuuucuuuucccuucugccacaauucagaccuuuauuucccaucuaccucuuaauggguuccccuaauucuagucuuggcuuuccccuucccagacauccuagacagagcuguuagugcagucucucugaagugucagucuuucagugagccccauuucuuucaaagugaaacccagaccuccaagaccuagcccaaaacagggguucugagcuauauucauuccaccucucacuggcuuugcugaauuauuuguaacucuuugaugugcuccuucacuacuuuugggcccuccuacaugcucuuccuuuucucuggaaugcucucuaacuuucugugauuucuucucugcauuagguauuccuccaaauuggcuuaacacauagaacaaagcaaucaaagaauuuaucauacuuuaugguaauugucuauuuccuugucucugguccccuuuagguuaugagccacuuauacuuagggaucaugccuuauuuaucucugugccucuagugcccagaaaaauggcagacacccaggaaacacugaaugaaaaaguaaacuugauggaaaaauagcaaauuacaggugauggguaauguuuuuauaaaauaauauguauggcuaguuauucuucuguucuuauuauacauagcaaagucaucuuguccucaccaucacaacuaucauuauucuccuaauaacuuguuuuuuuauuuauuguucuuacuucuguucaugauugugagccaugguggauacauggagucagaagaguuaguuaaugcuuggugagcagggauaacaguuguccucaauauaacuuugcuugugggcauagaguuaauacuugacaaagccaagaagggccuggauuuuuccuacuuuguuucuugcacuaucuguaaaauuuuuuucaguguaaaauuuuacacuaucuguaaaauauuguuuaauuccuugaaaauuuuauaucuucaauaaauguuuguaggauaaaaauggcauauuguguccaaacaaacaaaaaaaagguaaauacuugaaaguaagauuauaccauggaaacaaaggauauuaugcagcaagcaggucauugucaccacagacagacaauacuauuuuggcuauaugaacucuuuaaaaggagguuuauagacugucaccagacucaugaaaaaggaaacacugauugacggaucugguaaaggaacagcagaacaagaggugauuuugucuuaacuucucuuaaagaguucuuauaaccaaauaguauugucugcuugugguaacaaugaccugcuugcagcauaauauccuuuguuuccaugguauaaucuuacuuuccuuuuaaguaucugccuuuuuuguugggacacaaucugccauuuuuauccuguaaacauuuauuaagauauauaauuugugaggaauuaaacaaagcucuauaaaaaaauuuuagagauagugcaagaaacaaaguaggaaaaauccagggccuucuuggcuuugucaaguauuagcucuaugcccacaagcaaaguuauauaaguugccagagucuuggcuuccccuuuaaaacuuggggauaaaaaucccuacuucagaaucaugucuggcauagaguagauacuuaauaaaagcugguuuucuuucuuucuuccugcuuccccauauagcauguguacagcauaauuguaaucagggaacccacccaaacugcagguugcaaaucuaucugaagauguaucacuaaacaaucuccugcugaaauagucacugucacaucaucugcccuucaugugaucacacaucuuuucccugccuacuaaacuaccaaugguuaauuuguuuagauuugagcauucuuggcaauuauuacccgugcuacuacaacuuacaaauagagaaaaauuauauuacucuugggaugggaaugcagucauugugugugaacagccauucauccauuaacucauucauuuacugacaaaaauuuuaguaccuccuauguuccagacauggaacagacaugcuccagacaaauaccauuaacucuuauaauguaauagauauuuuaaucuuagcugucguauuauuauccaauaucauuauauaccaagccaagcucuugaaauaaauuauuuaauuuauacagugguuccuccaagguaggugcuauaauuaacccucauuuuacagauaaggaaauugaguccuagagaaguuaagugauauccugaaguucacauagcuaauaaaaaaaggagcuaggauucagaccuaggcacuuugagucuagaaugugugauuuuaacuucugugccaggaggucucaaagugaguuucagggacuuauuagagauccccaagacccuuucagggagucagugagaucaaaacuacuuuuaaaauaaugcuagaauaauauuuaccuuuuucacucucaugaauguacagugaaguuuucuagaagcucuaugucauuauaucacaacagauugaaugcagaagcagauaugaaagaaacuuauaaaauguaaaacagcaccacucuaauuuaaaaaggcuuuguuucagaaaauacagcuuuuucacaaaaauguauuauuuauauuaacaugccauacauuuauuauuuuaaaauaaauuaauauuuuuuaauucucaguuuuaauuucuaauaugguaaauaucaauugauagaacuuacauaaauaaaagcuuccuggguucuucaggaauuuuuuuaaauuaccaaagcguccauguacaaaaaguuugagaacugcuacucuacaguguuagaaccuuccucauauuucagaaccucauauuucagaaccuuucuuuuggcauacauuuuguauuuuuuaaguuaaccucccaauuucagacaguccagccauucuguuaagaaaagccuuccuuacaaguugucagaauuguuagcaguaauacuugagaccuuuguauauucuuugacccuguuuaccugcuccaggagcuuacaguacauaccagaauaucaugauucugguguacuugagucacuuuuaaaguuaauuuuuaugaaauacauagaaugauuuuauaauuaaagcagauuggguauaaauguuuauauuucaguauaucacugguaugacaacugguauaucacuaccuccaaaaguuuauccagccacaaagagggaauauucuguuuucuuucuuagauaaugaaaaggcugaauguuuuaauacaguuuauugaauaauauauuugccagcauuuuagaagcauuauagaguauggcacacuagaugguuucuaacagaacuguuuauuucauuuaacaaacaguuguuaaucauaugccagacccuuugcuuaaguacuagggacacagacuaaauguggucuugguucuuaaaaaucuuaugaguggccaaguaugguagcucaagccuguaauccuaucgcuuugggaagccaaggcaggaggaucacuugaagccaggaguuugaaaccagccauggcaauuuagugaaacccugucucuacaaaaaauuuaaaaaaugguuggacaugguggugugcgccuauaggcccaacugcuugggaggaugauugcagcccgggaguucaagaaugcaguuagcugugauuaugccacugcacuccaaccucggugacagagcaagacccugucucuaaaacaaaaaaaaacaaaaacuuuauguuaggggagauaaaaaaagaaaacaaaugaaagagauuuuugccaagcuacuacuaaacuucuuaaaaauagcaucuuuuuuguucuugaugaaugaugauuaucauugauucuacgugaauaaaagguagccuauuugauaugaguauaguauauuagcaaauucuacucccauuaugaaauggaaauuauugagaucuaauacaaugauaaaguauuucauaaaacaaugacuauucuauuucuaaucucucucaagauaaaagauaauauugucuauguauauaguggacacagagacuguucacucuaagauaaaguuaauugccaugaguuuguacaugugaucaucaaaaagaacaguauccuaaauuucccagaaaguugugaaacauguagguauagauuuuaaauaacuagacuacauauccaaauauuacaguggauguauaccccuuuuuaugccgaaugaacugaucgcaguuuaaauuuuugcagcuaggaaugcuuuguaggucugccuuacuuauauacuuagugcacaaucuaacgggauuccaacaaguaucacauuacugguauuucacaggaaaggggaagugggacucccgugugguaaauaucguuagcuuagaauucauagaugacaguuuguccagaaacaaaguuaaaaaucuaaaacuugcuagcaaaauuuuuacuacuaaaaguuuuauucuaaugaaguaugaacuugguauuaccuaaaacuuaauaacaucuuuugagaugcacagugucaugcuaaccuagaacgguaucugaguccuagcccagccauuuagauuauguggaguuucuagggcccaguaaaaauggacaugaauaaagagguacauuuuaaugaaauugugacuuuguuuugaauuuauaaauguuguauagaauaaugaugaguuuuacuaacuucuuguagagagaauuaaagacagguaaauuuaagauuucuuggcuugguauuacuuccuguuagaggaggagggaguuguaguuagaaaaguauacaauguauugcuaauuuuuggaaaauaaaaaauguauuuuuauaacaccagcuauuacugaaauaaaacucaaugaaauauuccugacugguaaagauacugugauuuuuuuuuuuucuggggaaggggcaaguugccccugcccucccaucuucuacaaagagggacucagaaucucuggggugauuugaaaacuuuauguuuaucaaaaugaugauggaugguggaaggacggggagaaguauucaaagaaugggaauuaaaauauuaauaacacugguguaauggccagaguccugagcacugucuuacuagccuguugauuucuuuuuuuaaaauucguuuuucucauuuuaauguuuuaaaacauuuucuaauugacacauaauaauugugcauauuuauggggcacauagagauguugugauacauauaauguguagugaucagaucaggauuauuagcauauccaucaucucaaacauuuaucauuucuugguaauauacaauaucuucuauuuaaaauuguauaauauauuauuguuaacuauagccauucuacuauaguuagaauuuauuccuccuaucuagcuguaauuuugcguguguguguuuuuaaacaaaucucuccuuaucuuccuauucucccuagccuuucccagacuuuaauauucucuauucuacuuuuuacuucuaugagaccaacucuuucuuagccuccacaugugagugagaacaugcaguguuucacuuucuguuugggcuuauuccacuuaacauaaugccugcaguugcauccaugauucugugaaugauaggauuuccuucuguuuuauggaugaauaguguucccuuguguauguguaccacauuuucuuuauccauuuauccacgaauggacauauaggcugauuccauaucuuggcuauuaugaauagugcugcaacaaacauggcagcggggguggugguacagaugucccuuugauauacugauaucuuuccuuuggauaaaguaccaguaauaggacugucaaaucauaagguaguucuauuuguaguauuuugaggaaccuccguauuuucuccauaguggcuauacugucacauucccaccaacaguauauaaacaguauuuuguccacauucccaccagcauuuuuuuugcucuuuuugauaauagccauccuaaugggaugaaaugaugauauuucauugugguuuugauuugcauuucccugaugauuagugauuaaauauguuuguuggccauuucuaugucuucuuuugagaaaugucuguucagauuauuugcucauuuucuuuuuuuauuauuauuauuuuuggaggauggagucuugcucugucgcccaggcuggagugcaaugguuuggcuuacugcagccuccgccucccagguucaagcgauucucuugccucagccucccgaguagcuaggauuacagaugcacgccaugacguccagcuaauuuuuguauuuuuaguagagaugggguuucaccauguugaccaugcuagucucgaacuccugaccuuguugauccacccgccucagccucccagagugcugggauuacagacgugagccacugcaccuggccucuuugcccauuuucuaauuggauuauaugugggguuuuguuguuguuguuguuguuguuguuguuguuguuuugcuguugugacguuagaguuccuuguauauucuagauauuaaucccuugccaauuaauaguuugccaguauuuucucccauccuguagguuguucacucugaugauuguuuccuuugcugugcagaagguauuuaauuugauauaaucccauuuauuuacuuuuguuucuguugccugugauuuugaggucuuaugcauaaaauauuuuccagaccaauguccugaaguguuuucuucugguaguuuuauuguuuuaggucuuacauuuaggucuuugaucuauuuugaguugauugucauauaaagugagaguuggaggucuaguuucguacuucagcauuaauuuggauuaauuugggaguucucuauucaguuuuauugguccaucuuucuguuuguaugccaguaccauaccguuuagcuuacuacagcuuuguauuacauuuugaagucuaguagucuaaugccugcagcuuuauucuuuuuacucgaugucauuuuggcuauauuuggggucuuugugcuucuauacgacuuuuaggauuuuuuuuucuauuucugugaagaaugucauuggcauuuucauaaagagugcacugacuauaaauugcuuuggguacuauugucaguuuuacaauauuaagucuucugauccaugagcauaggauguuuuuuucuuuguauguauccucuucaguuucuuucauuuguguuuuguaguuuuccuuguagaggauuuucaacuccuugguuaaauuuauuucuugguauuuuuguagcuaguauuguaaauuugcauuguaaauauuauaaauaguagcuacaaaaaauggauugccuucuugauuucuuuuucagcuauuucauuguguauagaaaugcuacugauuuuuguauguugaggguguauccugcaacuuuacugaauucauugaucaguucuaaauguuuuuugguagagucuuuagguuuaucuguauauaggaucaugucaucugcaaacagggacaauuuggcuuucuccuuuccaauuuauaugcccuuuauuucucucucuugucuaauugcucuggauacgacuucagugcuauguugaauaagagugagaguggaaacccuugucuuguuccaguuuauaaaggaaaagcuuugagauuuucuucacucaguauaauguuagcugugaguuugacauauauggccuuuauuguguuaagguaguuuccuucuauaccagauuuauugagaauuuuuaucaugaagggaugcugaauuuuuuuauccuucauucuauugaugugacauaucucauuuguugauuuacauauguugaacuauccuugcauaccugugauaaaucccacuugauuaugguguauuaucuuuuucaugugcuauuugauucaguuugcuagcauuuguugguuuuugcaucuguguccaugagggauauuggccuguagcuuugauuuuuuguuguccugauuuugauaucgggguuauacugaccuuauaaaaugaguugggaaaaauuuccuucacaucauuuuuuuaauagcuugagaagacuugguauucauucuuccuuaaagauuugguagaauuaagcagugaagccaucugcuccuggacuuuucuuuguugggacuucaguacuauuuugaauaacaguggugaaagugaacauccuugucauggcucagaucuuagaggaaagucuuuugauuuuuccccauuccagaugauacuagcugugggucugucauauauggcuuuuauuauguugagguauguucuccuugguaaggcuuuuuagguauucaaagggacuuggagcacaagcccaguaaugcugugguuuuugcagaugcuuaaaaagaggugccaccuggcugggcaugguggcuuacaccuguaaucccagcacugugggaggccaagacaggaggaucaccugaggucaggaguucgagaccagccugaccaacauggagaaaccccgucucuacuaaaaauacaaaauuagccgggcauggugacacaugccuguaaucccagcuacucgggaggcugagacgggaauugcuugaacccaggagguggagguugcggugagccgagaucgagccauugcacucuggccugggcaacaagagcgaaacuuagucucaaaaaaaaaaaaaaaaaaaaugagagagagguaccaccuugauggucuuggauaagaucccaaagaauuuucuguuuaucagacagagcggcuccuguucuuuucccuuacuuucuuccaaacaaauggagucucucucucuacgugcugagccaccuggaacugggaguguggugauucaaggcccucuuggucaccaccacuggaacugcucugggucagacuugaagccagcacagcauugugccuugcccaaggcccuucuuuucagggcagagaguuucccugcacauguccagagaugcugucugggagccaggaauuggaguaaaaaaccuuagcaguuuaccugcuauucuauucuacuguggcuaagcuggcacucaagucaugauacaaaguccuucccucucuuugccugucuccaaguuuagaaauucuuucuucuccuuggucuagacugugaagcugucaauuguauuuuucauuucacucauugacuucuuuagcuguagucuguucuuuuuaugcucucugucucuuaauugcauuucucauucaaauugggaauuguuuucuugauuuucuugaauugucuagcuguauucucuuguaucucacugaguuuucuuaggaauauugcugugaauuauuuuucuggcauuucauauauuuccuugugauuggagucuguuacuggugaauuauuguauuccuuuagacauguuauguuuccuuacuuuuucauguuuggugugucccuagguugauuucuauacaucugguuucaaaauugccucuuccaauuuuauuaagucgguuugacagacaaugauuuacuuguaugaauuaguuuuucauugauagacaaagauuuauucauaugaauggguuuguuaugguuugguggcuuugguuuuauguggaugcagcagugaauucuguguagcuucuuuagcuguaauccacgcuagucguguaugcaagugucucaauggccuagaaugagagacuuuaugguggcggugguccagcuuugcugagggugggcucacaaggcuguuucuuauguuaggagcauaugugugccacagugggucugccaacuuggagcugguguuggggcuauggguuguuacucugaccaggagcauguguacgcaguugcucggcuguccugggggugugcuugccagggguggcccuuggggcuauuucucaggcuugggacaugggugcauaacugcuccaccagucugagggcaugugugccaggggcagccuguggggcugcuauucaggccuggaacgcaagugcgaggcugcucugccagacaggguuguaucuuccaagagcgccugcggagcuguuucucaggaccuguugcaggcacagggccgucgcgcaggucaggaacuuaucugcagagcuuggggugcuacagggcugcuucucagguucugaguuggcugauucgcuguucugcuggcccaguagcauguuggcuguucagaggcuugagaucucccacucagggcagaacaugcagcaguuuguuaggcugaagggcggguucacaccgggugagacugccagacuguuguucuggguagaagugaggacagugggaggugguuuuccuacugcgcaggaccagagucacugccacuccugggaccaggcuccaugcaacuagguuugugguguucagccaccggugugggcuugcugaaaugaagaugggagcugcagugcuggauaagugcaauaguuacucacccccaccacacccccaccccugccaagaagggcacacuccagaggugccucugaucucaagauggcacugugcuacagcagcguggggugaguagagggugggagaguuguauuccuuacucagggcagugcagcugcaugaauuuccagcaauacuuuaaacugggcucagggauugagaggacuguugcauucuccuguaguaaggacugccauuguuuuugguggcauugggggcuggugggguucuucugcuuacuuuuucccugcaauaggaccucccucauggcucuacgcagauccaguccacacagggacaauagagugcggaggucacuggugccucaaugcugcccuccuggacuuccagucaccacaggucugucugcacuccccugcuguacucuagugcucuccuuucaucacuccagucaaaucauaucuguuuauuuguugccuuguuuuuuuucuuuuggagucaacgagcaucaggugucucuagucagcuaucuugcugacaucuugccuguguauuucaaggaaguuugaaagugugcuuugggugugacuucaagauggcugacuacaggugcccuacacucgccuccuccacaaauaagagaccaaaauaguaaaguauaaauacacauugaauagagcuucuaggaaaaaacacuggaauuuagcacagaagugacagggaaccucugaggcacagcaggaggaagugaagcagccagccuggccaggauuggcucagagccaggaggagcaccacacugcaaauaaaaggcaagcaagagaucccuaacaguccauguucccacugcagacuccugcaguccuagccauuggagugccccuuggccuuuggaggcccugagaguaguauaggaagcuacuuguaguccacgcaguggcauuguucuagagagggaguuuguacuguuucucacaccccucccugcaaacagcugcagcauagugccauuuugggagcccagccacugccagauuacauucugcccuggagcccagcagccuuuguauccccacauaccuggagcccuacuggcauccucccauguccacucagagggcuucagugcugugaugcugacuggacccaguggugcagccagguucccaaaacucuagcuaaugcaguccucugcaccauaugaaacaggcagugcagcacaccaggaguaggagaguggcccugggacaaagggagccaaagcaugcacuccccagagccugagaacugccucccugguguugcugccauauacaguaacccugacccuuccacugguaggguugcugacauaccugcaugugccuucagaggcccuggagauugacccaccagagcuagcacccaugugcaccaccaagguaccugaauacaggcacaugccaccugcugguacccacacaugucauccagggacccaaggacguaccugcccugcucaccaucacugcuuccuauguguaccauccagggauuggccucacuuguacaccagaugccagcacccacacacagcuaccaagacccagcucacccaaacugccaaugccaaugcuggcacacauguaugucauuuggggggucaaggguuuaaguuaggugguugcccuuccacugcuacugccacugcucaugucauagacauugccuagaggguugauaaacugcccaccccacugccacugccacuucuaaacacaccaccuggaggcccaaggacuggccugucaguaccugcccaccauuggcacccacgugcauucccugggggcucaaggacuggcgaacauggccugcuacugcaugguugccuaaggaccaacccaccugguguccccaucuuaagcaaagccucaccacagccuccgcuaacaacuguggccuaaaccauggaggaacuuacaggcaccacuguaaggaacagccaaaggaauuggcuacugcacccacgcagggagcacauuacugcaccuccccagaaucaaaagccaaagcacucuacuuaaccaacacuacagaaacuauuucccuguggaagguagucuauauaauuaaaagaagcaacuuaccaagaugcagagauaucaacauaaggacaugagaaacaugaaaaagcagggaaacauggcaauuccaaaggagcacauuaauucucuaaaguaacagauccccaaaaaaagaaaaucuguaaaaugccuuaaaaagaguucaaaauaaugauaagauacaagaaaacacagguaaacaauaacaagaaaucaggaaaacaauucaugaucucaaugagaaauuuaucaaaaagauagauggcacaacaucgugaaaccaaagaauucagugaaugaaauuuaaaaaaaugcagucaagagcuucagcaauacacuagaucaagcagaagaaagaauaucugaacuugaagacagguugcuugaaauuauacaggcagagaaagaaaagauaaaagaauaaaaauuaaugaagaaacccaguauaccauaugagaugccauaaaguaaccagauacccuaauuuuguuaauuuuuagaaggggaagagauggaaaagucauagaaaaccuauuuaacgaaauacuagcugaaaacuaaucuugcaaaauauauagucuugcaaaagauacagacuuccagauacaggaaacucaaagauccccuaauauauucaacccaaaaggucuucuccagaucacaucauagucaaacugucaaaagucaaaaauguaaagauaauuacaaaaaacaacaaaaguguucaguuaacauauaagggaauguuuauaugggacaguaucuacuguuaugaaaacacaugaaaguauaaaacucacugguagagcagauacacgcaaaaaagaagggagucaaacaucaucacaacaaaaaaaaaccaccaaaucauaaauguaaacaacaaaagaggaagaccagaacaaacgauauacaaaacaaucagaaacuaauaaaguggcaggaggaagucaucaccugucaguuacaaccuugaauguaaacuguuuaaauuccuccaauuaaaagauauagauuggcugaauggacauaaaaaguaggacccaacuauaugcugccuacaaguaacucacuuugccuguagacacguagauugaaaguaaagggaugggcugggggcgguggcucacgccuguaaucccaacacuuugggaggccgaggcgggcagaucaccugaggucaggaguucaaaaccagccuggucaacauggcaaaaccccaucucuauugaaaaaauacaaaaauuagccaggcgugguggcagaugccuauaaucccaccuacucgggaggcugaggcaugagaaucacuugaacccaguagguggagguugcagugagcugagaucacaccaaugugcuccagcgugggugacagagugagacuauguaucaaaaaaaaaaaaaaaaaaagaaagugaagggauggaaaaagauauuccacacacacaguaaccaaaagcugccagaaggaacuguauaucaaacaaaggguaaaaaaaaaaaaaagagagacaaagaaggucauuauaaaaugauaaagagaugagugcaacaaaaggauauaauaguuguaaauauauaugcacucaacaguggagcacugagauauauacagcaaauaccauuaaggcuaaagagaaugaugaaguccccagcuauuauuguauugguguuuaacgcugugcuuucagcauucaacagaucauuuaggcaaaaaauccacaaagaaacauuggacuugaucugcacuguagaccaaauggaccuaacagacauuuacagaacauuuagcccaauaccugcaaaguauauguucuuuuuaucagcacuuggaacacucucccaggauugccacauguuaagacacacaaaaacaaucucaguaaauuuuuuuuuuuuuuuugagacggagucuugcucugucgcccaggcuagagugcaauggcacaaucucggcucagugcaaccucugccuccuggguucaagcaauucugccucagccuccagaguagcuaggguuacaggcgcgcaccaccacaccuggcuauuuuuuguauuuuuaguagagauggaguuucaccauguuggccaggcuggucucaaacuccugaccucgugauccgcccgccuuggccucccaaagugcugggauugcaggugugagccacuacgcccagccguaaauuuuuaaaaauugaaauuaugccacauauuauaucugaccacaaugggauaaaacuagaaauuaguaaugagaagaacuuugcaaacuguacaaauacaugcaguguaaacauuaugcuccugaauaaccacugggucaguggauaaauaaagaaggaaauuuuuaaaaacucuugagacgagugaaaauggaaacaaaacauaccaaaaccuaugugauacuauagcagcagucugagaaggaauuuuauagcaauaaccuccuacaucaaaaaaguagaaagauuucaaauaaacaaccaaaugaugcacaucaaggaacuagaaaaauaagaacaaaccaaaccccaaauuaguugaaggacagaaauaauucagaucagagcagaauuaaacauaauagaaacuaaaauaaaaauacaaaauaucaaugaaauaaaaaguugguuuucugaaaauauaaauaaaauugauaagcugcuagcuaaacuaaccagggaccaaagagagaaaacccaaauaaauaaauccagaaacaaaagaggagacauuacacugauagcacagaaauaccaaggaucauuugagaccauuaugaacaaaaauacgcuaacaaaauuggaaagccuagacaaaauuggauaaauuucuguacacauacaacuuaccaaaauugacccaagaaaaaguagaaaaccugaacagaccaauaacaaguaacaagacugaaucaguaauaaaaagucucccaaaaaagaagagcccaggacugcauggcuuuaguacugaauuuuaccaaacuuauaaagaugaucuaauaucucacaccaaugcuuuucagacuauuucagaaaauugaaauggagagaauucuuucuaagacauucuauaaggucggcaauaccuugauaccaaaaccagacaagaacacaagaaaacauaaaaacuauaggccaauauuucugaugaacauagaugcaaaaacccucaacaaaauacuugcaaaccaaauagcacaucagaagauaauagaccauaaucaagcaggauuuaucccagggaugcaaggaugguucaucauauguaaauaaaugaacgugauacaucacaucaacagaaugaagggcaaaagccauaugaaccucucaauagaugcagaaaaacauuugauaaaauucaacaugccuucaugauaaaaauucucaauaaauuuguuacagaaggaauauaucucaacauaagaaaagcuauguaugacaaacccacagcuaacaaacugaacugggaaaaguugaaugucuuuucucuaauaacuggaacaagacaaagaagagacgaccugcagaaugggagaaaauauuugcaaacuauucaucugacaaguuacuuauauccagaauaugcaaggaauguaaacaacaggaaaaaaaauaguuuuauuaaaacaugggcaaaggauuugaauagacauuucucaaagaagacauacaaauagccaaaaaguauaugaaaaaaaucuucacuauuacuaaucauccaugaaaugcaaaucaaaaccacaaugaagugucuucucaucgcaguuagaaugguuauuaucaaaaagacaauaaauaacaaaugcugaaaaagaugaggugaaaagggaacugucauacacucuggggauguuaauuaguacaaccauuguagaaaaauaguauagagguuucuugauaaacaaaaauagaacuaccaugugauucagcaaucucauuacugggaauuuaucuaaaggaaagaauaucaggccgggcacgguggcucacgccuguaaucccagcacuuugggaggccgaggcgggcagaucaugagcaggagauugagaccauccuggcuagcacggugaaaccccgucucuacuaaaaauacaaaaaauuagccaguugugguggcgggcaccuguagucccagcuacuugggaggcugaggcaggagaauggugggaaccugggaggcagagcuugcagugagccgagaucacaccacugcacuccagccugggugacagagugagacuccgucucaaaaaaaaagaauaucaguauaucaaagagacaucuguacauucauguuuacugcggcacuauuagcaauagccaagauauggaaucaaccuaaguauccaucaaugaaugaauggauaaagaaaauguuguauauauacacaauggaaugccauucagcuaugaaaaaaagcgugaaaucaugucaucgaagcauccauucauuccauuagaugaaacuggaggucauuauauuaagucaaacaagcaggcacagaaagacaguuaucucauguucuuucucauaugagagagcuaaaaaaaaugaucucauggagaucuaaaguagaaugauggcuaccagaggcugcaaagggaagggaugggaugaacccucagagggguuaauggguacaaacuuaguuauauaaaggcauaaguucuaguguuugauaguacaguaaggugacuauaacuaccaacaaugugucauauauuucaagauagcuacaggagaggauuugaaauauucccaucacaaagaagugacaaguguuugaggugcuggauauccuaaacaucuugauuuuaucauuacacauuuuauucauguaucaaaauaucauguguaccucauaaauauauacaaugauuauuuauuaauaaaaaaauaaaauagucaagaccccccccaaaaaaaauuuggacaugaauugcaauaaugaaaacucugcccucuacacuuacauaaauggcaacuaauauauuugccuauuuauucuuucaauagauauuaaugagugcuuauaaagaauaccaguauaaauaaauuaguucuggcccugcccuuaaugagcauauaauacaguugaagagauuaaguuccuacuuuaguugugaacuccucaaggauaggcacucuauccugucucucuccccaacccccaucaccauucucuauuacagagccugccuggugucuuaaagguuuuuaaaauccuuaaccucaacguugaaagggaaagagggaagaauggguagagagacaugaagcaacaagucuagcugucauuguuucugaaaauuaaucaaaaugaaaauacaguuguaucaguucaugaaauuacaguguagaucaguaggaaacaauuuauagcaauucuuuuaccacacauuuguugcaaaaaugcaaucuguuucuacuaccugacucgggugauauuucagauagcuaaguuauaauuaauuaaagcuguguggacuuuuagcuuagaaaacggcuuccucuuccuucugcucaccccgugacccaacccaucccuguauugccaccacucgcuucaaucuggcacuguagucaagcccagagcaacuucugugggucaggggaggugacaggcauucugugccuagcuguuuggcuaggcauugcagcuucagaacucuucucuccauuucuaaaucaugucuaaugggacuguuaaccaguggccaccaaagcuaccauuuccaaugagcaauucugcgaaauuaugucacagaaauaaauuaguaugaaauuuauagagaauuuucucuucaugacaaucuaagaaaucacagucacaccuuaccaugcauaguuaucauacugacuuuguccuagacugacccagguccaguuccacccucugggcuuguagaguuucucuguuacgaugugcagaaugcuuagaacaggauaggcccccagaagugaguccuguuguuaucuuucacaaucauaugaauaguauuagauggagccagaaaacaauaaaaauucuacaaaaauaaugaaacuaauuugugcaacgugagaaaagaaaauggacauuuugcaaaucuauuuggugucagggcucuacuuuuuaaaaggaaaaucaaucauggucugugguguacauguuaagggaaggacuuaaauucacaguaauagguauucugguuacagcauggaagaacuauaucauuguugaaguaaaacucaccgaggcuucagcauacaacuaaauuguacuuugcauaagaacauuaaaacaauucuuggaacacucuccucccccaucacuaaccacccaccgaaauacaagaaauuauaguaagaaauaucacucucuuggaauaagcacaggagaagaaauugcaaacagauuauuagaaaaugucauucaucauuuucauuuucuuuggaaauuuagcuuuucucccugaauauaauguuuucuuuuuucucacauuuuuaaaauaugcucaaucagaauacuuuaaaaagacuuuuuuuuuuuuuuuuuuuuuugagacggaguuucgcucuucuugcucaggcuggagugcaauggcaugaucucggcucacuacaaccuccuccucugggguucaggcgauucuccugccucagccucccaaguagcugggacuacaggcaugcgccaccaugccuggcuaauuuuguauuuuuaguagagacgggguuucugcauguuggccagacuggccucaaaaucccgaccucaggugaucggccccacacccaaccaaaaaaauacuuuuuuauauauauguagaaacaccguuuuauuuguaaaauaugucaggugcuuuuuauuaagaaguauuuugagaauacagauacaucaucaaauugacuguuaucuuuguauaauuguauuacaaguuauguugugaagaugaaaagcuaguuucccuucuagcuacuuuuggugaauagaaauuaggaguguuacagcauuuuauuuauaauaaaacuauaguauacauguuuaugauuauuuaaagaaauuuguuauguuucacauguucagagacuuuugucuuuggaauuccuuugcuaacucuagcaauaauaagggcaugaacuuuucaguuacacagaauuggguucacauaugguucugucacuuaguagccuuugggcgaauuuuucaaacucagauccucagcuuucuugucuacaaauuuacaauaguaauauuuaacucacaaggcuguuauaaggauuagaggagauuaccuguaguaagcucucaaaauauuaguucuuuuuccauauaaaauauaaaauucuccuuaaaaauauuaagauuaugucauaaagguuucuaagcauugcaagugguuccuauuuauaucugcuacuauugcuuuccagauccagaaauagcuugcaaauaaugggauuccuguagauggaauaauguuaauuuaccuagcucacugcuacuguauuguacagcuugggaaaaugugcuguuuuugcagucuguucauucagauggcuuaugaauuaaaagcagaggcccaucauguucuaagauccaguaguucauuauugcaaaauaaaauauccauuuauuaggcaaggauugucuacagugcaaguguaaagagacccacucauaagaauaaguguugccuucaaauuuguacugaaguaugcugaaaaacauguauacuauagcugugauaaugagcaguacaguagaaagaggugauuuaugauaccuguuucugacagcuauagugcagagauucccaggguagcugaucauggcauuagcaugcugacagcucagcauuuagaacauuaugguaauuuauccugccuaugcugucaccugcacugucagaguuucuuuuuaaugaugguauaacuauuuuguuuguuuguacugcauucuuuucauuuggcuaaugcuuucucauuagauugaaccuaguaaaugagaguaauuaagugcuuccuauagcucagaugcaaugauuaaguugcagagcugcuacugauuauguuuugucauuuaucucuauuaaucugagaauaauccagaugauaaacacauguaauuuuuugcuaauguucaauagaugaaauuuauaguuucuccauggagccaagcaguaaauguauauuuauauauaaauaauagauucuuacaugugaacuugcuuuaaauaaacauguaaguuacaacuaaaguuuuuauaaagggaaagacacuuuuaauuguccuacuaaauuuauucuauccugaaauagccuucuuuacucuuccaagcccuaccccccacccaagggaaggaaggagggaaggaaggaaagaaaggagagaaaagaaggaaggagguaagggaaggaacaaaggaaggaaggcuggcuuaaauuauuauuauggagcaaguuguuuuucugacuuuaguuguuuuuuuuuuuuuaauugucugcagggacaagacuaaaauuuguuuugauaauaguuuauuugggcugagcaggguagcucaugcauguaauccaaacacuuugggaggccgagaugggaggaucacucaagcccaggaguucaagaccagucuagggacauagggggaccccaucucuacaaaaaauuuaaaaauuaaccagguaugguggugcaugccugucgucccagcuauucaggaggcugaggcaggagaauccuuuuagccuuagaguuugaggcuacagugaacccugaucacaccacugcacucuagccugggcaacagagcaagacccuaucucaagaaaaaaaaaagacuucauuugaaguccuuucauucacucuguacugacaguuuuucaacucuuuucguuuacucugauuuucuaagcuauaguaauuuauuauuccagaagaaaauguguuucaacuaaacuguuaaauaauucuugagauuagucagaauguuugucuuuuuuuuuugagacggaguuucgcucuuguugcccaggcuggagugcaguggcgcgaucucagcucacugcaaccuccgccuucugguuucaagugauucuucugccucagccucccgaguagcugggacuacaggggcccgccaucacgcuuggcuaauuuuuguauuuuuaguagagacaggguuucaccuuuuuggccaggcuggucucgaacuccugaccuuuugauccacccaccucagccucccaaagugcugggauuacaggcuugagccaccgcgcccggcugaauguuugucuuuuaauaaauuaagcuaacauguuaaaauaauguggaguuauguuuuuugaaaaauaauacauuuacacauauuauuugcuuauaucugacauaauuugcuguaaggagauacacaguuuucagaacucugaugugacuauuauaguuaauaguuaauuagcuuuuuaaaguuucuauaaaaaaugccaaauaacuugauacauuuuguuugcaauuagugacaagacaguauuugccaacuucaugcauuucaaguaucauuauguaaagauuguuuccuaauucuuuauguguaaagauuuauuccuaauucuuuauaauuuauuuauaaaauuauaguuucaacaaucuuucauauauacuaagagaaaauaaaagauuguuuuuaggaaauuacauuuuugcagaauuuucauaaaugcuugaaaagaucauagaauugcuaaacccaugugggcauaggcuacccggaauuuucagcucauauuuagaugguaggaaaauugacagaaacuuaguuacuguauuucuuugugcuuaaauguaugaccaggagucuggugaaugugauuucccaaacauuggaguaggaacacuagcaguucuuauuuugaaaaagaacauuguacuugagcuuucagguuguggcugugcauuguaaugcaucaggagcugcuuuuacauuuuauuuaagagaaaggucuuuuaaguaucuauacauguacugccuuuauuugcacauuuggaucauuuaaugaauuuuguucuaugaacaaaugguaccaucuaagauaaauacuugaaacauugauguuaacccuaccucaguuaauuuucaugaaauauuauuuuuugaaaaugaauacuuauugcauaaguccuaaaguccuaaauggaauaugcuguuuuuaaugguuauucauauauucuuuggauuccuuucuaaaauaagccauuguuaaaagauggauauacauuacccagugggcucuucuuccccuuuagguguagaaaugccuuccaugaagacuaacugggaauugagaugaucauaaauauugggauuuuauuaaguuugcuaguaguuuguucacauuguuuuuccagcaauuuuagaagauacaauauuuagccuaauaaggauuaucaucuuucagagggaucaaauaucuauccuguacuuauggcuagauugaagaaauuuuucauugaaauaaucagauuauauaugaagugaugauuuguuaaugguuggcauagucaaagaaucuguuuuugaaguugugggaaaugucucugacaggcauuaucaguuaaguaagggacuaaaaguagaaagcccuaaguucuaacccaaacauuuuucccuaauaguuauuuugucaaauaaauauugcucuugcacacugagguauuagggugaguaauagugagcauuaggccaguguaauacucuuuugaauauuaaauuauaaaauaagcccaggucgaggcagguggauugcuuugagcucaggaguucaagaccagccugggcaacauggcaaaacccuaucucuacaaaaaauacaaaaauugacugggcguugguggcucacgccuguagucccggcuacaggggaggcugaggcuggagaaccauuugacccugggaagcagagguuauagugagcugagauugugccacugcacuccagccagggugacggggugagauccugucucaaauaaaauaaaaauaaauuaaauucccaaaacagaaaaguaaguaaguaaagagaaaaguuuaaggcugggcaugguggcucacgccuguaaucccagcacuuugggaggcugagauggguggauaacuugagaugaggaguucaagaccagccuggccaacauggugaaaucugucucuacuaaaaauaaaaaaaaaauaauaauaauuagccaggcauggugguucacaccuguaaucccagcuacccgggaggcugagguaggagaaucaguugaacccaggaggugcagguugcagugagcugagaucaagccacugcacuccagccugggcaacagagugagacuccaucucaaaaaaaaaaaaaaaaaagaauaauuuuaaaaaguuaugauuucuuaucauuguuuacugacuuuuuuaaaaagcaaaaauuggauaaugcuuuaggauggaauauucacuaaucuagaaaauauuucuuccguauuuuaaaagguggagacaaugguuuuaauuaacuggagcacuuugguaccugaaccuaugggaauauuuucaguauggaauauuuauuugcuauuucuguauuccugcguagucaauuccuaaauacgcuuucuuaagauagcaguuuuaaaaauuauaauuacucuccacccugaccccuugccccacaacaaacaaaaaucacuuugaguuguuaauguugaaaucacaaguuacaagucuuccuuuguccuugguuaaaaaauaauuauaaaaauagaguaaagagaaaauucuuuuucucuuuacuggucaguucuauagaaguaauuuaaaauaccguauauugaauucuuugaucauuucuccuggguggauugggaaagaaguccuagcugaggcaauugcuucugggcucucuuucugugugccugguaaaugaaacacaaggaaccucaccaaacuacaugacuaauggcaaccuccagugccgccugcaaucaaagauuaauuugcuuuaucaaguuuaaagaauacugggugauaaaucaugucaaaaagaaauaaucagucaaaggcugauguucuuuucuacaugugaggacaggugcuaugaggcaugcacuugucauauacaguuaauuuucuuuucaugcauuuauguucaucuuaauuacuauuuaguugaugcuugaaucaaauaauuucucucauuaagaucaaccagcaucccaacugcaaggcugcaguauuauagauucaaaauaacauuuuuuuccuuuuaauuuguauaaggguauuuucacaugaguauuaaucacaaauuuuuuuauucaaacaugagaaugccaagugggaagcgaaauuauuuucuccauuucaagauacccaagaauaucaacuggauguucauguuuauaauauaugucuguguguguguuauaucuacguauuuuauauaaaauuuucauuuuacucggauuuucucaccuuuuuuuuucuuuucuuuucuuuucuugaaagagagaaagcuagagucucuaauucugucuccuggguucauaaugcaggacucacuuuagguaagauuauauuauaaagaggucaucuuucaggacuuuuagcagcaaacacauuugagcaggaucaaaaaugaaucuugugucuuuucagacaccgugcuaucaggacucuuuaaaagcaagacucagauuauugucuuaggagagucucuuauuucuaauuauagucuuaugaacuggagccucuuuaaauguuuuugguauauguagauauguauuacuuccuagcuuaggucuuuucuagcucacucugccuuugguggcuaauuagagauuuagaaauuaauuuuccgcuugauguacacaauuaaauaaaaauucaucauagacuugaaacuuggaacugugaagcuguaucguuugagugguuguaggaaaucuuaucccuagaguaacucuucauuuucuuuuucuucaugguuucucucaguuuuugucuagaucuugaccuuuuucacuccaguaaauugucaguagugcaggaagacuuguggcuggcuuuuguuuaccuuuuauucugcuucugauuccugagaauuauuuuaaaauauuuauaaaguucuauuuuugacaucaguagcauccuaaagagagaauaucuuauauuggcuggguuuuaagacuucuuuuuaaacuggauaggaauuuaacuugccuauacuuaauauauauuuuuccacaugaaaguauuuauuguguucuauuucauuuccaaaaugagaugaugggacaaguugaugaggucucuuacaauuugaaaguuuuguaacuccagacauaccuauuuugauaguaacugagucaccagugcucauuagcaguuugcauaauagacaucuauucuagggaauugcuguaguauagacugcauggugggguaaauagauuuagauuugaagacugaacacuuccauccagggucuaacuccagcauuuguauaaacuuggacaauacuuuugcuacaggguugucauugaaaguauugccucauuauauuucuuaguggucccuguaugaagccauauaagagaaacuucuuaauuuagcacuaggaaaugcuucuguugacuugagaugugugugugugugugugugugugugugugugucugugugugugugugugugucuguguguguguguauuccccuaauugauaaacuauaaaauaaucuuucucuuuucacuuuggccaucuggaaauuugccaccaauuuaugguucaacuguauaauugcauguaacauuuauaaucugcuuucaugaauuuuuauccuuguauuccucccacucugauucaauuuuauauuauaacugguccuugugucucauuuuauuuuaucucuacuuuuuuaauguccgggauuuccuauaugucaccccaaauacugagucacuguguaaauaaguaaauauauaucuacucuauaucuauaaguagugugauauaugagauauauauauauauauauauacacacacacugaaucacuuuguaaauaaguagaauugcccugacuccaucacuaaguauucaaaagucaguuauuucuuuuagagcuuuaguauucucacuuguaaaauaaagaaugaacuagauugcccuugagaacuuuuuagacccaaauucuaggauuaaaaacaacauaggacuuccaguuuccauuuggagccuagaaagcuggaaagagcaucacuuucaccucugaaacaacaauaaagcugggaaaacugcaagcuuaugacuuuucuugaaucugccagagaacugaaguggaaagacaaccaaauagccagaaauguaagcagagauagaugcuugcuaggaaaaaaggaacaugagcacuugcuuacauaagguugacucaugaaugccauaagaauaacugggcuagauaguuaauaaguugguagaggcugagugugggcuggcaagagaaagugaagccccagauggccuuagauauauggagauuuuauacccucuugcaggcucuuuuaucacagucccaccaggcaguuucuccuacccuucccuacugcaaaaaaaaaaaaaaaaaguccugagaaagcauccuucauagugcaggcuuagagaacgaaagcaacagugaaagggacacaaaacuccaccugaaugcuucuuccuauuuccccaacuggaaauauuuugauuuuugacaaauaugccaugguuauauaggauguuaaccuuagggaaaacuaaauggaugguauauaggaauucuuuguacuauauuugcaacuuuucuguauaucuaaaauuaugccaggccaggugcaaugguucacacuaguaaucccaacacuucggaaggcugaggcacucaggaggaucacuugaggccaggaauucaagacuaucccggacaacauaaugagucgucaucucugcaaaaaauggaaaaauuggcugagaaaugguggcaugcaccuguagugccagcuacuugagagacugaaacaggagaaucacucgagcccaagaguucacagcuacgaugagcugugaucaugccacuugcacuucagccugggcaacauacugagacccugucucuuuaaaacaaaaaaagaaaaaagaaaaauaauaaauuuuaaauuuaaaaaaauuguaaauaacaauuuacaaguaaaauuauuucaaaugcaaaguuuaaaaaaauaggcagcaacuguagccccacccgcuuuucggguagcauuccuuugaaguagagauaguucccucauuuggcagauuagaauucuuuucuuauuaaaauaauuuuauauaguuagaaaauccugaaagucuucuccauccaucucuucccuacucuaccccauuguuggcaugagcaucuuuucuuucagugcuuaaccuuguuaugguuuuuaucccauuauaugagacuuaucuacauacuuaucuuucuuucagaauccucagugcuuggcccaugguaggcauucagugguauuuauuguaauaaaccuggucuucuuuaauugucacuugucuugaugaauggcaccauucuaguauaaaccagaaaccuaggaaucauuuuuauuucauuucuuccuuacucucuaccaaguucuacuauauauuuuuugccucauaaauaugucaccaaucuaucuguuucugucuccucuauagcccaacuccaagcgaccgucucuuuuacuugggauauuacauuauacuccuaacuugaauccugacucuuuucucaccuucgcccacuuucagccuacuauugugcauuguacaauuguagccaggguagucuucaaaaauauaaaccugauuuugccuuucugccuguuuaaauaacuuucuauuguuuuuaggauaaaacccaacuuuacauagguauguggcccuuacuggccuagccucaauuuuccccuuuaacuuacauguaaaccccacucgucuagccagcccacuggucuucuuuaagacccucagcagcauaaacucucuuauaacuccaggacuuuacauacaucacuucuucagucaggaacauucucuucuguuucucccaaccuuccccuuucaccguuauuuccugcuuaccccucagcucucugcuuaaauuucaucuccucauggaagcccucccugaucucccaggcuagguuauguuaucuuuuucuauacuuucacagcacccucuacuuuuccauuauagcaacucgcacaguuuguaauaauguuugugugauuauuaaauuaauaucugucucuuucacuagaacuguaacuuccaugaggauagggaucauguuugauuuuguccauuccagcaucuggcacaguacucaacacauauuggaauauuuaucaagcucacauuaaucaaauucaguucaauguuuauuaaaggaauaaaagaauaagcuauacugugcuaagugauggagcuggaacuacaacugaguacauauacccaacacuagauuagccaccucuucuguuagcagaguuugggcuauaaagagcagauaucaugucauacuccaguuuauaaaaccucaccccaaguccuuuugaugcucagucuuuuucuguuugagaacagguccugccaaacuuaagaaucccugaguacagggaugggagugggcugagagauuuguacaaggcacaauggagcauuuugcaguaauggaaacuuuuauuguggugguaguuacacauccauaugcauuugucaaaacucauaaaccucuaugcuuuugagaagguugaauuaaaaaauuccuauuuugagguagacaucugcuuuguauccaaggaccucuucauccuacucuuacauuacugugaaggguagauccaugugucaugaagacaugaaaagcuauuccaaguccagaauauuccacacuaccugugucuuacucccacccuuuaaucuaaucaaguuuuaugaaaauugaaugaauuaaugaaaagcagaaacuaucuuuggcuguuugaucauaucaggacagcucugaggccauucuguucccaugauaggcuguacuuacucaucucuaccugauucuuccucacaacauucauuuaagaaacauuugcagaaucccuaaaaauguuucuuuuuuccuuucccuacucuuuacuaaaaauaaaugugucagagaggaccuuucacuauaacaugauuuccuaaauccaggccaagauaagaucucuuucucaguggaaacaaaguauacucagacuuacaaguucaauugaguuaguauuuaaaguugguuuauuaaggaugggaaguuaaaaauguaaagauaggcugggcgcagugccucacaccuguaaucccagcacuuugggaggccgaggugggcggaucacaaggucaggagaucaagaccauccuggcuagcauggugaaaccccaucucuacuaaaaaaaaaaaaaaaauacaaaaaauuagccaggcgugguggugggcaccuguagcgccagcuucuggggaggcggagggaggagaauggcgugaaccugggagguggaguuugcagugagccgagaucucaccacuacacuccagccugggauggaguguagacugagauggagcgagacuccaucucaaaaaaaaaaaaaaaaaaaaagugaagauauauacuuugaucaagcaaaaagccuaaacuggagaauugguuaaauuaauuaagaggaggcugaaaucacagugcuuauuugacgggagugucuauucugacuuuugcuacugccaacauucaacuaagucacucaauuuuuuuaugauugcauccuuauucaagaguucauuuuaaacauuaugguugaugaccuaacgcugaauaauaccuguagcacagaauaccuggcauauccaucuuggguuuuauauacuuucauuuuuugguuaacucuuuguuuucuuuuauaccuauuuaguaugucauauaaaaugcguaauuugcaugccuucaaaguaaaaucaagacuaagaaauucaaacuuauuggugaaauaccagcagauacagauugcuugaaauauacaagguccuaucauuaguuucaaaucuuuuucauaugcuguauuggaaauagagguguuaaauuucuaccuguuacgggcaugaguuuacuuuugguuuuuaaugauaauagagcuuccauuuuuuugucuucugugcucuauauuuuuaguagaauguuuguggagccccucucucaagaugauaggugauucuuaaaaguaagacuggucucuuuuucauagaauuuucugccaaaauguaguuucaaauauuuaaacaguaauugaagaaaaaaauauuguuagaguacaacuauacagcucuagaucccuaacuggauguucaguaaauaaaugcucuuguuagacagugaggccuuggaacccaggcuauuauugcuguuggugauacagucugaaccaaguguucugcccuauccuuuauagauaagauuuuauacccaucacaaauauuaauuauugcaaauuugcuuuuucaguuauaauucaaguuugggauauauucaagcauggucuucucaucuuaguaaauugccaguaguaagauggcuaguugugaaugcuaucuguccaaaacaugacuuuuuuuccuuagaagaagaagccugucucuguauuuguuagcauucaauaaggaaugaaguauagacugucucaaaggccuaccauguaccaguaugcuggauacuuuauuuacuuuggucauuauaacaacuacauaaagcaaguaucauaccaguuuuagggaugaggaaaugaaaccucagaauaaaugacugucaauaauagcuaaugaauuauagaccaguguuucagaccuugagcucuuaaguacagaggcacaugaaaauugaauuauaggcauuuacauuauuuuucuaggcauaaguaauaaagaccugguuucuuaaaagauuaauaaacaguuuguuuuuuauuuuuaaaaucuauuuuauccauugcaguauuuuguaccuaaaauuaaugauugucacaaaucaccugcucuuaucugguaagcuagugggauaaacagcuccaugaucacucacuguuguguagcacagcuaguccagauuugauaccuccacaaaauaauccacugugggaaaacagaguuccaaauggaaguuuuuguuccuaaaggaugacagaacaaaggaauuuuccacuuaauaauucuuguauguguugcuaugaaacacuauugaauaacaucauggaaucagaauacuugaacuggaagagaucauauaauauauagucuaguaguuuuucuguuugcuccgugguuggggcagggaggggaggaggaggagcuuggcaaguuaucuucuccuuccgugaaacagagcacuuuaaagugcuuacuuucuuuaucacuuacuuucucauauuggccuuccagguaagcccuuauuuaaagaaaugguuccacaucuuuaaaaaaauuuuuuucaccauuuccugauuuuacagauggcaguuuaaggccuagagauacgaauuaccuuuccaaggucauuccacuugcuggaguaggucucucaguguuguaguuuauucauuucuucgguaaacaucuauugaauaucugcuguaucccagucccuaugcuuagagcucacagaugaguggaagagacagauggaugaacaaauaauugacagcacagaaugacaauggaaauguaugaaguuccauaugaaagaggucaagagaagcauccuaagagaaauuauauuugaacgaggucuuaaagauggagaugauuuugccagguugaaaaggagaggauaauuauucucagcugagggaacaguagacagaaagccaugcgaguauuacagagcaugacaugauuagucccugucagagggacuggggguguaaaauacugggaagauaaaacagcaauuaggggaaggguuauuacuauaguugggaagggccagaacaggaaagauccuccacagcaagcuaaggaaggaagguuuuacccuguaagaaauaggcugccgucugggcgugguggcucauaccuguaauuucaacacuucgggaggccaaagcaggugaaucacuugagcgcagguguuugagaccagccugggcaacaugaugaaacccugucucuaccaaaaauacaaaaaauuagcuaggaaugguggugugcacuacucccaguuacucaggaggccgaggugagguaagaggaucgcuugagcccaggagguggagguuacagugaaccaaaaucaugccgcugcccuuacagccugggugacagagcaagacccuaucucaaaaaaaaagaaagaaagaaaaagaaauaagguaagaaauagggugccauugaauauuuuuaacuagguaagagaugugauugaucauuuauuuauuucaaaaaaagaauuauucugguggcaguggccuaguccuagagggaaaaaaauacaaacugcagguugcccuucagccaucuugccucuuucacuuauugauggcugcgaauggugcccccauugccuuccccaauggcaauaaguguucauuaugucuuguuuuguuaaagguguuuuguccuuuauggucucugccugccacaacagcauagaucagauuuggaggaccuuuuaaaacugaguguuugacuaucugugaaaucccuuuuuguguuuucuucacuugaaaugacauuaugacuuacugugagacaggauaauuuguaguuucuuuugucaugaucuucuuuggaugucauagaccauggagcgcucugcauugguucagaggaacugagaaugggaaggacacaagauuuuuauauuacuauuucucuugaguauucucgcuugugauggauuuuggcuccaggcauaaagauauauggagaagcagccuguugggagagaauuuuauauuucgcuuggcuauuuugugacuaaauacaguguuaaauuauuugugugaugcuugcaugauauuaaauugaaagagcuauuguuuuaucaaaaagugcuuuagcauauacuaugaaggcuagauauuaaauaccagggcuucuguauauaaagaaaagucaagccagauuucuuaucuuaaauuacuuuaguaaguaagcuuagcagugguuccuaagaaaccuaaagcucucuuucucaucaaaagccccaaacaguuggucuuugggggccauuuuucuugacauuaugcuccagacucaaucagaauucuggguaagcuaguaucuuagcauucucugucuccaaaccuuagaucaccugugcuuuaaaauaaaaucuguauuacacuuucuccuaagcaagauuugucuuuuuuuuuaaaugaaauacagaagagaagcagaaacuuuucuuuaguauaaauucuuagaaacaaugcauauucuaaaggccauaggaguagacuugcccuuacuucguuccaagguuccucugcucccugguccuccauacuuuuaucaacagcuguuuuggagauuucugaauguuuugauacuagcaaaaauaaugaaauauuuuuaucagcgcaauagagaaagauugcauaacaagcgagaaccaauuacacaacuucaagaaggcucaaaccaaaaguugcucauaacaguaaugaaauuguuaauugaaauaggcccaaaguauaugucaugucucgucuccuggaagccgcauaaugggauccauauuucauucccaaaaaauaguguuucuaugaagucguguaguggauuaacucuucuuuaaaaacuaauccccccaaaaguaagggaaaacauauuacuuuaauuaauaauguggguuuuuagauacucaaaggauaacaucuuagaggaaacuccauauuguguguaauaggccccaggaagaagaaaaaacauuuguuaaucaccuguaauaggcaaucucaaacauuuuacauaaauuuuuucuauuccuugcaacaaucccauaaaauucuacuucuaacauugguaaggaaacacagccaaggaggaaugccuucuuuuccuucuuuuuuaccuuaagccuugggcauuggggugaggugaccaaauaauauccucuaagguaacaaauaaggauaaagaccuaauuuaucuucuaugcguauaagaguugaaggaagacauggaugauaagcagugugcccaaaaaucucggagcauauugaaaaguggauaaggcuuucuuuguagaaagggcagaacaagaaaauguaauuaucaagaggaggaaugcuguuuauugugugacuucuacgugccaguauucugcuagguguuucacacauguaaucauuuuaagcuucacaacaaucauguaggguaaaugcacuuuucuucauuucacagaggagaccuuaggggucaacauaguuaaguaacuuuuucaaagucauacaguugguaauuguugggacagaaauuaaacucagguucugcagguaauauccucuaagaccaaaaaaaaacgguauguaauguguuguauauuuuucugggagaggguaaauaucuuugaucauauucacaaagaaguucuuaaccccccaaaauagaacaacuucuauauuaugccaucuuaagauaagcaguacagagcagggaacuuggagcuaugugagcucagucuuuauaucccccuuaacuucuacccagguaauaguagcaaguuaaaccagaaaauauauacauauauccuucauaauccuuuagggcuaagaagucuacuuuuuauuuuguuggagaagagguauagugugcuaggugaauguacaguugcuagaguugaauugcuuaaauuuaaauucuaacucuaccacuuauucucuuacaucaaauuguacuaucacaguuuccucauuuauaaaaguagaauaguaauaguacuaucuuaugguauaugugagcguuaaauuaguaaauauguguaaauuacuuagugcagacagcaguuuccaaaggacauuugaugauauuuaaagauauuuuugguugucacaauuugggagaggggugccacugucaucuagugauagaauccaggugcauuuugcagugcacaagacagccccacaacaaagaauuaucugaccuucagugucaguaguauugaaguugagaagccccugguuagcacaaugaguggcauauacauuuuuauaaacauuugcuauuauuuugugcugaagucuaaaaaaaaacauggaagaaaaaguagaauuauuauguaaucaucuuuucuugguuguuuugugugugugugugugugugugugugugugugugugugugugguuguuuguuuuuuuguguguuuuuuuuuuuuuugguuuuguuuuuuguuuugagacagagucuugcucugucacccaggcuggagugcaguggcgguaucucugcucacugcaaccuccaccucccagguucaagcaauucuccugccucagccuuccgaguagcugggauuacaggcacccgccaccaagcccagcuaauuuuuguauuuuugguagagaugggguuucaccauuuuggccaggcuagucuugaacuccugacuucaugauccacccacuucagccucccaaaguacugagauuacaggcaugagccaccgcaccuggccauaaucaucuuuucuaagcagcuaaagaaagguaaaauuuuuaaucucaggugggggggucagccccccgcccggccagccgccccguccgggacgugaggggugccucugcccggccgcccuuacugggaagugaggagccccucugcccggccaccaccccgucugggaggugugcccaacagcucauugagaacgggccaugaugacaauggcgguuuuguggaauagaaaggcgggaaaggugggcaaaagauugagaaaucggaugguugccgugucuguguagaaagaaguagacaugggagacuuuucauuuuguucugcacuaagaaaaauucuucugccuugggauccuguugaucugugaccuuacccccaacccugugcucucugaaacaugugcuguguccacucaggguuaaauggauuaagggcggugcaagaugugcuuuguuaaacagaugcuugaaggcagcaugcucguuaagagucaucaccaaucccuaaucucaaguaaucaggacacaaacacugcggaaggccgcagguuccucugccuaggaaaaccagagaccuuuguucacuuguuugucugcugaccuucccuccacuauugucccaugacccugccaaaucccccucugugagaaacacccaagaauuaucaauaaaaaaauaaauuuaaaaaaaaaauuuuuaaucucagauauuaaaugacuuuaauuaauagaaccucaauauuauauggaaaaccccauuuaaaguacgaauuuuugauaguauaaaugaauaugaaaccacauuugaugcuaucagauacuuguaaauaguguauaguuuaauccugucuaguauugagguacuugucuauauaucuguauugauauauauauauauauagagagagagagagaacauuucaugaucauauauauaaaguaauugguuaagaguaugggcuuugacauuauucugacuuggguuuaagucccagcccugucacguacagauaugugacucaauagacacauaacuucucugggucucaauuucuuuugugguaaauugugauguuaaugugauuggugugauauuaaugugauuucuucagugguaaaauugugauauuaaugucuaccugcuucauagacuuaccauguugauuaaaugagauaaaguauauaaagugcuuagcauagugcuugcccauaaugagcacucaguaaacgauagcuguucauauuaucgucaucaucccugucccugaaacuucaguacaagugaugugguaaaaacuagaauagucaaccaagaggcugauugcugguaaaguaaaccuaaccauagguucuguagcuaccacguacaagcuaucuaacuuuaccuacugucuucacccauucuauaaaaucaccucaacuucccuggccacuguacaaaggccccuuuccucauuugauaucuaccaacauccacuguuagcaucccuaaccucuuuuggagauaccauggaucuuuuuuacuguuccauuuuuuacugagcucugagcuaugcucauuuuucauguguccacugaaguccacauaguuauauauauuuucuccccaaaaucccauaucacacaaauaaaaauaucuaaacaggagaacuguuuccuaucuuggguucucucaacacaugacuguuaauuuuauucuuuucacuuaccguauuucacuuacuguaucagccuccuucuaaauuauaucauaaucucccuuaagucccuagauuaguuuguucagaggcaaaacaaaagugaaagauuuugugagaaaugcauaguuucauuacacaucugguaaagacacgcuaugauugcuuucuuacaguguccagaagcuaauuuaugguacuuucuuuguuuauuguacuugagcaauauagaguauacucugcagacaugguuuacacuuugaauuaguuugcaucuaucuauauuaauguguuuuguaagccaggccuuaauaucucuuuauugugcucuuuugaaaauaauucucuuaaaucuauggaacgugucuuacuugugaagaaagacacauuuuuccaccuuucuaagauuaaaauagugagagaaaccucaaagaagaggaaauccuauuuuaaaauaacagcgaucuccucuguagacucuugguuugcagguuguuagucuucauccucugugucaauuuaauguaucacguaaguacuagugaacagauguggggguagggggaggcaagcagaguguugaagcaggaaccagcagcauuggcaaacuggcaaaugcuucuguuuugcuaaacaccugcuuuucuuguauucagauugucugaaccaucuguuuuuauauucuguuuaccuacugucagccauuuuggaguuguuaaaaucuuugaaaguaguugggaauuuuucacaguaagcugggaaucuauaccacucuuuaaaaacuuuguguuuuuaggguauucccauuuaauccuccagagaauaauuacuuuuuaauuuaggugcaauguguuaaauauuauauaauuaaaauguuuuucucccuucccaauuacuuauucuuagaaaucaaaguuuaaauugucuaaauagguacuuggccauagugugauaacacuaauaacagauucguaaugauagaauguaaauauuaauuuauauguccccucucauuaaaaaaagaaagaaaaaagcauuacacaauuugaugaaagguacuaauuuuuuauaagcuuaccuacuagaugauaugcaagugauauucucaauaaaaauauauaguauuuauaaauaccuuuuugcaccagauacuaugcuaggcauuuuguccacauuaucacaacucuucucuacagccuugcaagguagauauuauuguccucauuuuauagaugaagaaaaugauucuuuaagaaguugaggaaauuguucaugcucacauuugugacuggagauuugaacucugguuuuuacauugcuuuucaaaaauucugucauacccaagagaugauucugugauccaaaguuucugcauaaggagucagagguggugcauuuuguuuaguuagaagugaacacacuucauuugguuuguuaaauuccuagcucuuuucuaauugucugcagacguuuuguuccuuuugucauugaggaacacuguuggaacuugguccgcugcuuuuguguuuugcaagguuuuucaaaaaugcuuuuacuuuaaaaagaaaaugaacuaguugaggucucuguaaaaaauuccagcagagaauuugcuuuuuccuuaaaguuuauaucugucuacuggggccucuaguaaccuuucaagauaauagucagaauagaauggcuauguuaacauuuuuuugaccuuugucacuacccagaaaugugaucugugcaaaauagaccuuaaagaugcuauaaguggagguucaguucaaaugauuuaaaggcaugguguuaauagauauaauccauauuuauauuucacuuuucuagagcaaagcucacauaaagaccaccgaaaucaauauuaugaaagagucaggccucuuuggccuaggaauuuaaacacuugaaaggcaagaucagguuuuugguuuuuuaguuaggauauuggcaggacuugaaaauuucugaaauauuuaaauucaagagucgccuuaaauauauguuaauuucagggaaaauaagaagcaauuccacuuucucuggucaauaauaaaauuuacagaacuucucccaagcaauggcacaaauuaaaaauauaaauaggcuuaauaaguucaugaauuaaagauucucaacaaguuauuaugaaaagauauaaauaucugggcuacauuucuaacccugugagguuaauggucauugguggaagguaguucauugaagccuuaaugagagacaguuaugaacuaggugagccauugagcugauggauggcauucuuauauaauuaaccuagcagugguaaucgccuccuucaaguuccuagccuuucucgaaccaaggaaaaagagccaaaauuguugccauuuugccaccuugacauuucuuuucaauugccaaaccuaacuaccuuucuucaguaauacaacuaaaccagagagggcugguuuuucugcauucagaacuguggauuuagggucauuuugguauauauuuaauugaacucuugggagcagaugaacucccccaaggaacuggguauaugagggcggagggcaguuucaauucaagaaugugaagaauagaaauuucuaacugaaaauaaauaauuagaaagugagaaaccagaguaagauguccaugaaacucagaauaucgaggagaaagaacacaugguaacagaggcaauaaagggccccagaagcugggcacaguagcucacucacgccuguaaucccagcacuuugggaguccgaggcaggaggaucacuugaggucaggaguucgagaccagccuggccaacauggugaaacuucaucucuacuaaaaaaaaaaaaguaaaaaauuagccaggcaugguggcacaugccugcaaucccagcuacucgggaggcugagguagagaaucgcuugaacccgggaggcggagguugcagugagcugagaucgcuauugcacuccagucugggcgacagaacgagacucuaucucaaaaaaaaaaaaaagggccccaaaaagauacaagcuuuaccccucugacucugaacuaucaugcacaauguagucagacaaaucuuaaacgucacucuuguccuaggguucuucccacuuagaaaucucccuguugcucaugacaucaagccaguacucuggcuuuuaagguucuccauaaucuagcuccaucuacuguccaguuuuugguuuccacagcucccuucugucaugcugacucccauuuuuaacuuggaucauacuguucucuuccuccuucugcccacacucauacaaacucauaccuggaucauauuugcuguuaaaacuuaauaauggcaaugcucgcacucauuuauuguuuauuauacaccagucacuaugaugauaaaccuucuaugugcauuauaucuuaauaagucucaaaauaaucuuaugacgaaggugucauuaaccucauuucuauaguagaguaacucaacuaagaguacauagguaggaaguggcauucacaagauuugaccuuagguccuucuaacucuaaauccauuaaaugaugaaguguaauuccugaucuugcuccuaaagcauuuuaugcucuguguccuuauuuucuuagcaagguuugagauucuugaggaaaggggcagugucuauacauaucuuguaucugucauacaacuaggacagugcuagauuaucaccuauuuucucauugauugauuggauauugauuagagugagauggucagacuuuauggugacagaaggagagaaauuuuauucugauccuagucauauuucugaaguagguguuguuaauuagagcagcaucuuauuaagaaacaguggguuggaaccagccaguguuuaguuuucaagaauuguacauuagaaaaagauuuauacagagucuguaagaauguuauuuuuggcuagauuaguggcacucuuuuuuuuguuucauuuauuauacaaauacuuaucauuacaaaucuguuuauuauaugcuaaacagugggacacacuauugccuagggaaagauauuccugccaucacagacugguggagaacacaaaguuaauagguaaucauuguucaauguaaugaggcccaugacugauaugcagaauacugggaacauauuggaagauaacugaugaaaucuuggggaagacaggggaagacugacacccagggggugcuuggguuucuuuuagugucauucacuucugcauauaacauacacagggaaguaagauaggaccaagaguugcauauuagugcaaaaagagaacagaaguguucagcuucauguuuuccacuuuuccauucaagauugcaaacaggcugagugcaguggcucaugccuguaaucuucaggcggaucaccugaggucgggaguucaagaccagccugaccaacuuggagaaaccccaucucuacuaaaaauacaaaauuagccaggcaugguggcacauaccuguaaucccagcuacucgggagggugaggcaggagaaucucuugaaccaaggaggcggagguugcagugagccaagaucacgccacugcacuccagccugggcaacaagagcaaaacuccaucucaaaaaaauaaauaaauaaauaaauaaaaauugcaaacaagaccaagaaaucuaaauaacaguucacuuuaguuuuuuuuuuuuuuuuuuuuuaaccaaauuaaggggguugaggacaaagugaauauuccaucuuuucuaagaagauaauuaguaaaacaaaugaauuuaaccuacuccucuuaguuggcaccaagaacuaccugcuauuuccacugucugauaggugccaagauuauuuuaugugcaagucaagguguuuuuuucugagacggagucuugcuuugucacccaggcuggagugcgguggcacgaucucggcucacugcaagcuccgccucccgaguccacaccauucuccugcgucagccuccugaguagcugagauuacaggcaugcgccaccaugcccagcuaauuuuuuuuguauuuuuagcagagacgggguuuccccauguuggccaagcuggucuugaacuccugaccucaaaugaucugcccaccuuggccucccaaaaugcugggauuacaggugugagcuacuaugcccagccaagauuauuuuauguauauugaaugaaauagcauuuaauauaguguuuacuuuggauuuacuagaacaaaugucagugaauacauauuuuucccuagcagcuaagaaacagcauugucaaacagugaaaacaggaaguuggggaaaccauuuaacuguauaaccucaagaaaucuaaccacuauuugauuuugccaucuaaaguauuguguuaggcugggcucaguggcucacgccuguaaucccuacacuuugggaggccgaggcacguggagcaccugaggucaggcguuuugagacuagccuggccaacauaaugaaacccugucucuacuaaaaauacgaaaaauuagccgggcaugguggcggggcaccuguaaucccagcuacucgggaggcugagacaggagaauggcuugaacccgggaggcagagguugcagugagcugaaaucacgccacugcacuccagccugggcgacagagugauacuccaucuagaaaaaaaaaaaaaaaaauauauauauauauauauauauauauguacacacacacacacacacauauacacauauauguauauauauggaguuaaugauaccuagcugugccuauuuugauuguacauucuuagcgaugcaagagggagaauacaauuagccuucccccagccaaaaagaggauaauccaaguaauuaaagauuuaaaauaaaauuuuaugaaugagauguaggagguagagaaaguagccauagagaaaguggauauuuugucaguuauuuuucuugaucacuauuugagaauaauaucauuuaauaucaacuacagugugggaaaaggcaaugaugauuucagcaaaugagcauuuacuauuaaaaaagaagcaaaaauaaguuaugaaauauagcagaguucuccacauacauugauguuauacaauuaugauuuaugaugauaauaauuccccuaauuccauaaucugugaaaaugaaauaaacuuauuuccgugaacccuucaaaaaagauaacucccacaaauuccuaaucaaacugauuuuaaaagaaaagagaaaaaguagauuugaauggagaaaucgagugcuacagaauauaaaauuuucauucauuuguauaguggauugucaucuugaaguaaagaugaaaugaaacaaaguuguuugugcuuugaacauugaagcauuguucaucaugcauaauuaacaaaguugaaauuuuguaaguaugaaucaugcacaaaagagccacagcuaugauagcuauuacaggaaauggaggaaauuaauaauaaaaggcaauacacuaccucauaaauacauucucaucauaagauuggagcaugaaagcauuaagaaaaugcccugauuaauuuaacaacuuaauccuguaaauuggaguauaguuauuucagaauucauuuguacauagacaaagcagagacacaaaauagcuuacuuucauuaagauuuuaaaagcaauucuuauggauaugugaagauaauauucuuucaaaagaaagauuauaagcggauguuccuuaauguuuccgaaauuaccuaguuucuauaucuuucuacaaguacuauauuauauucauuaagaaucagaauuggcacauucuggguuacauuccagugaucuuaccuucuauauaauuuauuuuaaguaacugcuaaaauuaugauuuuuaaaagacuaugugauacuaggaacauaaauuagaagaaaaagguacuuucuuaguucucaguaauugaguaaaguuuaauccugauuagaagauccuugaguaccauuuugaugugugaaauaauuuauuuagauguuuuuaaaauaaauuuuggaguauuuuuguaaagugcaaauacaugaguaguuuucuagaacggcuuuuaugucaugugaacauguguggaucacuauauuuuuuuuccuauuagcuauuugguaaaaguccacaauuugccaagaugguuaauaggacacaaauauagacauuucauaugauguaccauguaaauguaaaccuuuguaguuacauguuuuuguagcaagagaauuguuuuaaaaggcauguaauuuauuagcuaucgguagcuucuuuauugccuugccgcacugcaguaauaaauaaaagaaagugaacugauuuuacaaauggcacacaaggugcacauuuugugggaaaaaaagucuuuuuuuaaagaauuggcauuaaauccuuuuuuugugaugacaaagaggcuaagagugcaaacuguauuuucuguuuaucgaaaacagucuuuuuuucuccggggcauuuuucccuaugaucaucaagggauuucaaaagcaauaaaguguggaaucauuguucgacuugaacaguauuaaaacuuagguuuuaauuucagugaaguaauaagauuugaaccugucucacauuacagcacuguaaggcauuuagcaauuguauuuuaaaggagguuuuuaaaaugcagcucacuuguaagcuaacugucugucaguaauuaauaguuuuucuucagcauuggcuguugugaucagaccaagaaauaucuggguuuuuaguaacacauuaugauaauugugaauguuuauuccuaauuagucuaaaugucuaauaauuuucagcuugcuucucuggcuguuuaaaagaaaacagagggugauguuuaaagcuacagugugucuuauaaaaaauaugaauguacaucugcauguauauuucaguaaguuuuacacccggcaagauuaugucaguugacucauucauuaacuaaguauuuuauucuucaguaccauuuccuaguuuuugauauuacaucauuuauauagggauugccaaauaagguacuguauguaaagcuaaacccacacugaugaucuggacucuucagugaugaacauugaaacuugucuuuacuucuuaaaaagggcuuuaaaauaugagcauuucuacuaaaacaauguggcaacauauuugcugaugaaagauuguauuuaccauauugaauugccuuagaaaauaauugccucuacaaaaggaaacaucuguaugauagcgcaugguuaaagcugccaucaauuuuuaacauuugaggguugagcuaugaccuuuuaugaugacugugaacaguaacugcauccauuagccauaaguuuuguuucuuuauuuuaguagauggucuagacuguaaauauuagagaaucuaaaauaaaucaacauauuauccuaaggauacaaaauguaagagcuauuugugguugggaaccuuugacagauaguuuggaugaagcagaugauugccugccuagcguaucuggucuccauugcuaugccugcaggcaguuuagugcuaugguuguauauugaugucaggguuaguacugaguggcuagcagugacagaugucuauaauuacaggcaaugcuuccaguauuucugaaaagccagccuauguugaacaauuaucuuauuucugccuugccaaagagcauguuccaauugcuaguauuagcaauggugaauauagugcuuuaucugcugccuugggacaaaugugagaaaagcacuugguuauaaaacauaaaugcaaaauauuuuuucaacauuuuaaauuaguuaaguucaguguuuuccuaauuuuuaucuccccauaauguuucuuuugaaggagucuugaaauauaaaagcacauuuggcauacuuauuggaauuuuguuuuccccuaggccuugcguggcuccccagcgccaguaucccuugcuuuacugaauagauguguuuaagcaaguuggcuuugaaacaaguuucuccuaugugaauugcauuuucugguugacacccauuacaaaauuggaaaugcauuuccauggaaaaucuccuaugcccaguaaguuuaguuggaaacuuuuaacaagaaaaauuauaacauaauagaaaauuuugaaaugugcuaaacaccuuaguacugguggcuuuccauuugcugagaauugcaauucucaaguuuuguuguaaccuuuuuuuuuuuucuuaagccuuugaccauuuauuguccauuucugucucucaauuuucauggucacuuccuuccuugcucccucuuggcccacuuuucugacucauuagaaauguuuucaugcuuguuggugccaguucucaccugcccuuuuuaucuggucauuugcauucaugagcuaugggcugucauaccacacuuuccagcaggugcggcugccuaacacaugauacucucuaaccuuccuaaagauuaagguguuggggguuaaaacauuauccauguuguaaguuaugaauccuguauuuucagguaauguagaaugagaaauaucuaggaaauaucacuugagaaugcaguuuaucuucaaccuuaaucuaaccugcaauggguuucugcuuugcauuuaaccacuuugcugaauuauucauuacauuuucucauuuagucuucucaacaauguucuguuuaauauacaugaauaucauuuugcagaaauaugaaacaauuucagaauuaaaagcuuguuuaguggcaggcccuugguuucaaccagaucaucuuacucugaacccaguuugcuuuucgcuguaucacauuggcuauguauguauuuaggcaugaguccaggaaugaucaguuucagaguguguugacugauaaugccaauaucauaaguuucaucuccauacuagcuguuuuacuucccaaggaaaagacucauuucuuuaacugaagauuggaugucuaguccuggcucgccaucagucacaaaagaacuaagcuagauccuugauauuuuauguccuacaauaggagaagcaaccuagaaccaauagucuagugucagagaucaguaauauuauauuuauuucugaaagguagccccuuucuguucccacugugagagaaugccccuugggagcccaucaccuaaaaacucuuaauaauuuuaaacuaaugauaguguucuggacccccgugucuguguacauuaauuuaguaaagaaaauuugggccgggcacaguggcucacgccuauaaucccagcacuuugggaggcugaggcagguggaucacgaggucaggagaucaagaccauccuggcuaacacggugaauccucgucucuacuaaaaaaauacaaaaacuuagcugggcgugguggcagucgccuguggucccagcuacucgggaggcugaggcgggagaaugaugugaacccgggaggcagagcuugcggugagccaggaucaugccacuccagccugggcgacagagugagacuccaucucaaaaaaaaaaaaaaaaaaaaaaaagaaaaaagaagaaaauuuggacaauuggauggaccuauugaucugaauggggaaaacuuugauaacuuauuggacacagugaucaucuacuuacucagugaguugaaaacuuaccuuggagauaggaagcaggaacuuguauugacucaaaaaaugaggaugaaagcuuugaaucuggcaauauaggugaugcagauaaguucuugagauaaaauaacaccaaauaccacagaucauucuguuuuucuccugacuuuuuuucuaucacuuuucuuacuacuuuauuucuuugcaagacucaaagacuagacccauuauuuaauauuagaaguuauguuaccuuucauuaagacccucuccccucuaacuacuacuaaagcuacucacauacccacuuagaacauauaucuguuuucuaguaucuaguccagauaaagcacaaagaaaagagacauuccaauaaaaauaauagguaauacuuaugaaaauuuuacuguauaccaggacuguuauagguccuucacauaaauuaaccauuuuaaucucaaaaauuccacagauuagguacuacucucauccuuuuuauauuugaggaaacuaagguuuaaaggguaagcaacuugcucaaaauuacuuaguaaguggcagaaucucacuagucuugggcuucagaaucuauuccuaaccacuucacuagauuaccuccuauuuugugauauuauacuuuguaacccuaguuaaaagauguacuuuugccaaucagaagguuacuuugccugcuuaagucauuagccucaguugccacacuucuauaaugaaagugcuucaugggaaacaguacuaagagauucuuuuugguuuuuuuuuugagaugaagucucacucuugucgcccaggcuagaaugcaauggagcagucucagcucacugcaaccucugccuccuggguucaagugauucuccugccucagccucccaaguugcugagauuacaggcgcgugccaccacgcccugcuaauuuuuuguauuuuuaguagaaguagaagcaggguuucaccuuguuggccaggcuagucuggaacucaggugauccacccaucucggccuccuaaagugcugggauuacaggcgugagccaccgcgcccggcugagauucuuaaaaaucauucugucaaauauuauuuaugauuuauucuuuuuuagggcuagcuuuuaguaacugguuucuggaauuaucucacugaagcaaucccauugucauucauauaaccacauccagaauuugaacaggacuucaccaugucucugcucaugggcuccagaauaaaaucaaagucccaagaauaucauaaguaacaaccacaaagauugucagccacuuucuccuuuuauuugagauuggggaggccuuuugcucuuauuucuggugccagguggcaggucccuaaacuuugugcuuuuuagguuguacgccugaggagugauguacccagaguuccagagaaggcuuggaaaauaguuaaggugaguuggguugcugguuaugaugguggaccagcaaucuuuaugcuugucucacuacagccucagauucuaauuaguaaaacaggcauaugcauacaaugauuaaguguaggcaugcauugucuucauucccuuuuuaugcauuauauaauucuacaauguucauauuuuauagccaaagguuuaguaguccacuaauaagcaguauuagcugcaaagccuauauuuaaugugguugcauaguacaaaagcauccuagauuucuugaugcuaacauugcugaguaaccaauuauaaucaguuauuaauacuuaagaaaguuuuauuuggcuacauugaauagcaucuguuauugaacagugucuagagcacauguaucccuugugucagaauguguuucuggcugacaccuuuaggagguacgggggauuaaacaaaauauuuuacuucccaguuccccaccucugcuaucacccucucacaaacuucauccagcaucagcuucuuugcccuaaaauuuaaucgucaucuuauaaacuugcuauugcaaagaauuauaaauauuccuuuaacugucugaaaugcucuuucaaaccauggucccaaaauccucuacuaaaauuaagccuucuucccaagcaucuggugccauagccauaguuagcuucuuuuugaaugggcuuggggagauaauauauuuacccagggcuuuaccauggcuuuauccauagaagacuaguuuaacagaagcuuggccccagacauggagugaauuggcagccaacaggagcaaagcugugucaggacaaauguacacucuccauuuucucugguuggcuuucagcugguugcaccacaggagucuuucuguggacugcauauccugugaccaguaacuggugcacucaacccaggucccucuuggcuagggaaggccugucgggaggcauuagguucaugcugguggagauccuuagucaguggcucccugaaggaaaguaaggcaaacagccagcuucuguugaacaggugguaguuagacccuagaucugcuugggggugggaggaaaagaaucucuccaaaauuaccagccuugcugguuuucacauuauaccuguacucuuucuaauaaauuauuguuuagaaacugacucagaaauaucucugacagcaucuggagcuuucugacuuuuccaccuuccuuagcagucuggauuugggcccaaguuagaaauggaaaccccacuggggugcaagcaaaagaggaagcauguucuuagccaugcaucaguggaggccccuacugggagaggggauuaucacaaggcagcaggcagcccugcaccccagccugcugaguucaugcuuugugccacaggauguggagcgaaggaaaugugaggccaaaguggucacuccaaguuuucuuauacaauagcuuauucaagcagacugggaaugccucuuaagagauuuguuagguacaugugcccuuagcaagauggccaccacagaugguggguucagauauucuaauugaaauaaauguuuaacauucagauguauuuuauacuuccauaaccaguuuuucuuuaucagaugcuguuccuuauucaacugaaugaggcaagcaggauuauucaccuuuuaccacuugauuuccaacauaaauuaugguuuuaaaaucaaauucuggcaaaagauuuuucugucuaauuucaggcuuauauuuagugauguuauuugaaacgauauggaaaaauuagucacccaggauuaauguggaucuauucagugucacuaaguuuguguauuuaauauacagcaaugauguuuguaccauuaauucucuuguuauggugauaaguuaauugugauuaucauauuuuauccugcuucaaauguuaaugaaagagcuaaguaccuuuaguuccaaaugguuuagauccaagucauuaaaugcucuauucuuucuuacaccucuccuccucccuccucuacuaaugccuuucacauugaugaggucuuucuuauagaaagcacugaauugaccucaaaggcacuugaagccuaaaacaaaaauaugaaaauugauuucuuauucauaguaagugauuucauacuguguuccuaaauucucuuccuaaggaacacuaaugcuuucauuauauuggauccuuuccagugacagguuuuguuuuaccaauuuagaaccaguuaaaaaccuucauuaauaagucauuccaauagauugaaacaauacuugaaaauucacaguaauauuugggggaucuuuugugguaucacuuuuguauuaccugauauguuuuugagaauaaauugguucagagaagguuugucauccaauggcaaaauacuuuguuguugacuucuacugcacuguuaauuuucugcauugagccugcuuaaacaaugcacuaaagcucuuugagaaguuauagcaucuuaaacacuuauagaaggccuaaggguauuaacuuacuauaauuuucugaagauucauuauccaaaaucuuaauucauuauaaaaacucuuuugaaaaccuauagaaccaguguuuucucuuauuuucuuauuugcacagaaugagagauucguuguucuuuuuaauuuguuucauguggugcuuuugaguacauuucauaaaggacuguuauugaauuucugugacugucauuauauauccauacaaucuuuaggaacuaauauucuggguuucccaguucuguaaucuacuccaaauuuaaagauugacauaauuaguuuccucagaguuauaaccagaauguuagagacagugcuccagauaccuaagacuaaggauuaggauugguaaaagaaauuuuaaaaauuauuucggcacaugcuuuuuuuauucuuuauuaaauguacaacucaaaauuauguugcuauuuguaguuuauguccgcaucuguuuuucuuaccuaguucccuuuuuaaaaccauauguaacaucuuuuaagcuacuugcaaauucuacaggcaauauuugucauuugaugaguugagaauuuggagaauguauuggcucauugaagcauuauguacuauccaaaugcucuuuucuuaaauuuauaagaaccuuugcaguaaaauaaauacggcuaagaaaacaaauauauuaaaacaguuuuuuaagagcaugccuucucaaaucuguaauaaugauaauuccuuacauuucuaaucacuuuccauauuucaggagcaagagagauggguaacugguuaaaauggguaauuuuucuaguuucuaagacaauacacauugagaaguagaaagaauuugauuuuguaucaugaaauuuugaagcaguuccuuuaugccuuuaacaaaugcaauuucugaguguuacuagaagguguuaauugaacauauuuguaaagauuuaagaguuauggauacagauuauaagauuuuguuuauuuguuuuaaccgucuuuaugcugugugaaaaucuucaaagcaccuucugauuuuuucuguuauuuuucaugugaagagccuucucuucaaaagguguuaccugaccacuucagcaccuacugugcagaagggucaaugaaagguuguacagggaaacagcauuuguugaguaacuauuaaaugucaagcucugaguucgggaucaucauuuaaucuaaucaaaagcccauaaaguagguuuuuuuguuuuuuuguuuuuuuugagauggagucucgcucugucacccaggcuggagugcaauggcacaaucuuggcucacugcaaccuccgccuucuagguucaaacaauucuccugucucagccucccaaguagcugggauuacagguacacgccacgacgcucggcuaauuuuuuguauuuuaguuugggguuucaccguguugcccaggcuggucucgaacuccugagcucaagcaauccucccaccucggccucccaaagugcugggauuauaggcaugagccaccgcgcccagccuaaaguagguauuauuauuauuauuacuauuuuauggguaagaaaccaagauucagagaccuuaagaaacaccuaguuaguggcagauauagaauucaaaugcaguaucuuugggaccaaagucugugcuuuuucuacuugcuaaguuuaucacgacaguguucuaagacaauauaccacuggagauguaaagagaaauagacauuuccccugcauuccaggaguacaugcugaaaauaguggaggaaacguauucguguggaaauuaauacuacaaaaauaucauauucuauuauauguuuugagaagugcccguaacaggcuggcaagguuucaaauuaagacucuucuuacugaauuuauagggagagcuucuuccagaaauauuauuuaagcauuaaaaccacaccuuuuaaaaugacaacauuuuaccaguguucaucccagauggguaggauuugggguauauuauuucacagggggaagaauacaugccuuuuaugcguuuuccuuuguuaaagaaucauauaugaaaugggauugaccaaaauguacauuuuaaccauauauucuuuuuauucauuuaagaaacauuauugaguaguaggcacgugagauuuuaaaaaaacagagcaucauuucugcucucagggagcuuacagucuauuaugcaggcauauuaugaaaugcagaagaaggaaagaagggaggagggcucagacaggcaaaaccuugguuacagaaugugcaucucugacuauauaaaacucauaaccaaaggcauaaccauauauucagugucauuguauuggccauccuucucugaaggaugaccacacagauagguuuagucucuuauuucuuagauuuugacucauuuuucauugugaugagauuaucuuaauacauucugaaauaagagacaaggaaucuguggacugaaagugaguuuuuuuuuuuuccuuuucuugcauuccuauguaacuccuauauacuuccuuaaaauagauacugcaauaugguuucuucuuggugucauaaaaauuauuucgguugaaauaauacaaguuguagaaaguguuaaaaacucuaaauacuguguuagaagauuuuucuguagaagacuuucauugaccugugcuugaugauaaacgauuuuguagguauuuccuaacugaacaaauuacuucucacucccaaauuauccauguuuaaaagggauaauuaaauuucaaauguuuggagacauuuucauguuuucugcauguuaucugaaugauaagguaccuugaaaaaugagaaacagucuuuuaaaagaaacacuguaaucauacauugauuuuaaaugacccugucacacaugaaaacaaaucagauuguugcucuuaaugagcuuuucaauuuacuauucaguagaucagauaaguggauuuaagagguaaugauccuguuuaguacucaagcuugacugucagauccuaguaguggagagaaauccccaaggacaaaagcauugacacaguucuagaugggauaaugggaaucaaagcuaauggaugauaaaaggaauggugcaaguuacaaggauaauuguggauuaaagcacugccaugugucaauguugacuguuuuucuaguauauuauugggucagaucugaugcuuugagaaacuguuuugacagcagaacacaacagaccugccugccuagcuuccuccucuuuugaaugccagggacacgguaggaaaacuuccuuguaggacccauugaauuagaaagcacauuuuuuaauguuaaaauguuugaaauguuuaaaaucacauuuuaaaaugcauaauaaaaugauuaaaacaaaaauuaugucugaguuuugccauaaaaaaggcauuuauaaugucuugaaaauguaaaauuugauuuuacgaaaguccacuguaguuauuuaucgaaaacaagaaaauuaaccaguaaagauguaaauacaauaagaagaaaauaaguaauuugagauaaugccauggacacauccuuuccaaaaccaggaugucauggaauuuauuauuaauuucauuuaucuauauaaaugauccuguguaccaucaaagaauuugugcuuugaguugugguaaagcuaguuuaaacauacucauucauauuuucaucuuuguuaaacaaacgugccuuuuaaauuccagucagaguuaagggcacacagucucuggcccuggaacugagcaaguggguaaagcagggcacacaguagggugucugaucccuacuguuaguugauuuuauaaaacugggcuuauuuuaaggaucucuugacaggggugccacuaaaauaaaauuaaagacaauugcuauaaucaguuacuaaauauucaagcuguucucucuagcuacuuuucuuuuucuguuguaauuuacgauucuauguauuuugucuguagaauccaauaugugcuuaaugggaaaagucguuucucucucuuuguguaaaaacuauucacauuauaauauaguccuaguagauccagaccguguccuuccacugcacauuaaagccacguaguauucacuugacacauauugcccuaggugcaauaguagggacacaaagaauaaggcauagugucaccccucaagaagcacucagugucaugagggagauucacauccaaacaguuacagugugaaaagcgccaugacagaggaauggacuggacguugugggaacauaaaggagaguucaacucacugugccuaggaagccuucagaggagaugacuuuugaaugaguaugaggggaaaaagaggaagaagacugauugaggcaaaaugaccagcacaugaacacauaaaaaucugaaauugcaugagaugucucagugauccaucagcauuuuauuguggcuugagguugagggaaauguggaaguugagguaggcugaggccaaguugugaaaugcuuugugugccauuaaucaugucgaugcuagguuuuccaagggacccaauuuguauacuucuauauacgagagagguuuggcaucauggugagcuuagggaaacuuucuguucuacauaucauucuucauuagagcccucuuugugcuuaaagguuugugauuauugaggauuguugguaacugacuucuuuagauucucucuccuccuuagcucccucuuucccccaaacaucuuacaagcaacaauggucacuuuaaucuuguuagagaugaaggccuacucucaugggcaaagucacagauauauaaucacugaaaugcuuuucuguagggcucagaaguuaguagguaaggcagcaggaauuugaaucucagucuuccuuucucucucucuguuucucucucucucucucucuuucuuccccagcuucugcucuccaccguucagcccuuccugccuucugucacccucuacaccuaacccuuccuccucucccucuuuuucucucccucugauucacuccaucagccugaggagaaggcuuccagacacaggacucagguugaaagccuggaacacaaccugcugguucaaaugguauuuaaaauccagaaaagaaauuucuacaauggcagcuuuccuccccucuaugacccuauaccucugggugauuuguguugccccugugauaccuucaugaccuauggugguguaucaagcucguguucagauauaaaaaacaaaagacagagggaauagaagcuauguugcuguacauaagaaauaggcagauuaggagaaagugagagaacacaaucacagaggaucaaaucacagaagagaaaucccauacagcuggugacuggcagggauaaccuggaaucacaccagagcaucagggaguauggaggugucaacccaccucucagcuuugccaggcuaguaagggguauaaguggcauuuucccacuugaagugggauauguguuuauaagcuuaauguggcuuggauugagacugaaauguugcaccccaaacucugcaaccaacacucccuaauuggaagcuuaguggauucccaggcccugauguuuucaacagggaaucccugagcuugggauuucagugucaacaugaaaaguaagacguaccuguauauuuggggaagcuuaauuagguaauauuugaggagaauuucuauaaguuaacuuccuuugauuuuuuuaaauccuuauuuuuauaacugccuuaaauaauccugaaaugguuaauauuuugcugaaaucuagaauagguggaaaauuuuuaaguguuggaaccuuuuguugaaguacucuacuuuccagcccuuugcauaccuacucccgucuuccagaaagggguggucuaccacuuugagaaaaaaaaaaaaugugugugguguggugggaguaaaauggauauaugaguguguuuguguguaagcguuuauauauuucaaaauaggagcgaucuggaggaaaaaguuagcaaauuuuaaaauuauaagauucuuuuuaaaaaauuccuuugcucucccacccacucccuacuucaguguggauaccacagugcauuaaaucuuauguuuguucaauucgaauagucuuuugaaaauauauguuaauaguaaaacuuuuaacaaugaaauguuuuaaugcagguauaugcucguaugucagaagucuuaggaauaacagaugacaaccacguucuagagacguucaugacaaaaaugugaguucuuguuuuggucuuuaauuuuucuuuuguuguuguuuuaaauguaauagaucuuuuuauuguauuuaaaccuuuuuauauauuaauuuuuaaauaaaagacuuaaaauuaugcuuuguuagaauguuagcauuguucuuaauugaaacuuaauuucacauauugaaaagucaccauccaaaggacauuguaauuugucaaguuuccauacaacggcagcgugcagcaucagaugaugauuuuaaaagauuuacagaccuugacucuucagaucaauugggcagcauuuuuuuuuauuuaaaaagaaaagcacgcgauuugaaagaccacgugaagagauuauugcaaauugaaaucauugagagaggucugauagggcauucauuaguucuaagagaaaccuauggcuggcagagacauauucauggaaacuguccuuauauuggacuuauaacauuagcagaauaaacuaguuucuagucauaacuuuguacacguagccaaacuuguaugccuccaccuggcaccccgcuuuaucuguguaacagacaaacaacacugucuugauugcagacagcaaaguuagauaaacagucgugaucauaagaagugaguuuuggagccacagauugaugguucauuauuuggcaguaacagugagccucuauuuggcuuucuuuguaacuccugcuucuccucccuaauauguuuuggguacaaacuugauguuuuccagugaaacacuuagacaacuuuuuaauuuacaaaacuaaauauguagaauuauacaccauuuggagagcaauauucauugcagauugcauauaauuuugaauaugcuauugaaagaauagacaauguuuuugagccuguuuuucacuuucaaaauauuugugauuuaggucaucaaacuuacauaaauuuauguguauucucugguucuccuuagacaagcaaauaucuuacuuauaauuaaagacuuuuuuucauauuuaguguuacaaaccuuaaauacuggggaagauaugagccuguaauuucaaggacucuucaguuccuaaaugaccuuucuguuggauauccuuuucacuguauaucugacauuauguguaaacaaccuagcagaugcauuuaauuaaccagguauucuccuuguuuauaauuuuugcaauuuuuuaaaaaaauaaaaagaccuuucauuuagccuuaucuguaaaugcauguuuuugaaagguuuuaauuagcuguauacuaugaagcauuuagucggaaucacuguugaauuuauauggacauauagauuccuaaguaguuacaguuauauuuauacucacccaggcuaauaaaugguuauauaagaaaguccacauguauuuuaguucaugcuuuuuuguaauugucagaaauucguguccuaaaagaaaguauguaacuuaauuuuaaggaggucaaaauguucuaaaaauauuaccuuauaaaaacugcauuccugugaguaaauauaucucuaauauucuucaguugaaaagaacaucauuuucauuaguugaaaggcacaauggaguaauacaaagaaaauaaguuuuuugaccauuucuuugauuauugcccccaccaaaucaacaucuaaucuaaucuaaaauaagauuccccauuauacauuaaauguuuagauuucucugucuagcagauuuuuaaaauucuaaaaccaagaaucuucuuacuaaagucuaguugacaguauugucauauuucuaacaacuagagagaaucauguagauuuucuuuucuacauuagcuaucaaauauauaggacuugugaaagauaaguguuggauuaaucacuaagauuagcugaucuuuuaauaugaggacaaauucugaaaaugguggcauugaauggaaaccuuuaauguagguucauuccaggaauauguuuauguuaguuaaguuuaaaauuguauuccuugguaaaccauaaaagauuuccaaaguauuagacacccacuuuugugcuggaauuuaauaugcaacuuuuuauuggaaaauaaucguccuugucuggcaaaauccaccaugcaauauuucuguuaguagguauaaugcaauaaagccagggagggcuauuuaucacuacaaauuuugaggauuucaggauucuuuuuauuauuuuaauauauuucuuugauauuaaaucagaaaaaugauaaauuacaccugucuaggcuguuuuuccuuuuuacuggaaagugauguacaacccaauuccaauggucauuuggcuuuuuaagauauguauuuuuucuuauuaaaaaaaaaacucaacccauauuuuuuucuaauaauaaugcugaaauacucuuuauuucuaacauaugaagugguuuauaaguacuuccuaguauugcaaacucuggccuuuucacaaugaauuacuuugaaagcauauuaucugcaaagaagccucaguuauuuuauagcauauaucuauuguuuagauuuacccuauuuuuuuagguugaaauugauauuuaguauaaaauuaauuugauuuguauucuuuuaguauaauuugcauaaugccuaauuuauuuguaucugcuauuuaagaucuuuuucuauccuauuaagccuauuauauauucuuuaauucaaauauuauagccuuuuauuuuacaugcuguuuauugcuuuugaguacuucucaaagugaauuaaaaaaucauauuuucagaaaacuuacuagauaaaaguuuaaaagcuauaauauuuuaagccaggggauaggaaugauuucaacauggguacauugauuuauauuuuuuagcaauuauuucagguuugcauauuuagaaauauauauuaguucaauuugauuucagugcucaguuauuugaauuauaaaucauuaugucccuucuagcugaucagucaugaaauaucuuugaauucauuuacauaauggaauaugugagugguguaucuguuuuagugcaguuacugguuaccuaaugcauguuuuguuuuuccaauggauuucuuuauuauaauguguuuuucagucuugauuuuaaagcaauacauuauuucuauauuaggaauaagaugacauucuucagcaauagaaacacgcaagaucaaaaccaucaccuauaggcccuuguuauuggaaaucuguuuauauauuaauauucaaaauauuuuuauuuaaaauauuagaaguaaaugaaaagcauguuucucacuaugaaguuuuuuaauguucuuuauuuauaguacaugucuucagauacuuucuguuuuauuuuuucuauuuuaucugcuucagaugaaccuuacucaguguuuauggugcucaaagccagucucugaacuuugguggucuuuuaucugaccacuuguuagaaauugaaaucacacaagacccccauuuuuaggaaguauuaaaaagccuuugguugccuuaaagcaguagucucagacuuuagugagcaucggaaugugagugcuuuuuaaaacacaaauuguuaggccccacuccccagaguuucucuuucaggagguguuaggccuaggccugagaauugcaguuuucacaagccucauguuaaguugguggcuccaggaccauacuuugagaacuucugucuuuagguaguuagaaaauagagcugcauuguauguccugagcagaaaagucugguacuucccucacagacacuuuuucauaggacuucauaaaacucacuagacuuacaguuuuagagauagucuaguuccuaaauaaugauguggggacguaaguccccagauuguaacuggaugacuguugcauuuuaccccagaauugcuguuugccaaauuugaaacuuuucaaauugguaagauuauuguuauuuuaaaauccagugaccuuuuugacagaaaguuaauguuuucccaucagauucauuacauggguauuuauaauaaauuuagcaaauacauuugaguaacuguuuaacauacucuuuauauuuucaagaccaaauuccaagaauuucugaaguagcuuuuuugaacaggcacagagcugaaaugacucuguacagagccagcccgcuguguucaaguucaguacuuggggaucuuucccuucuuugaaauguuuccuggucagaaauuuuaguuucugucuaaaugggaaaaggagagauuguucaaaugauugaaucaaggaagcuccugggaaaacuggagagagaauaagggucauacagagcaaucaaguaaacuuacuuauuuuaaaugcugaaaacggagaagaguaucacauuuuauccaaaauucuguuuguucgguaaucauuauuucaaguuuuuauucuuuugaaagauaauugaucaguauuucuacugcaauuuauucuuuacucaaauuuguagcaguuaacaugcuccacuuggguuucagaaaggaaauuucauucucuaucaggcccucuguuggugguuggccuuuauuacauaaucaucaaacaugagaaaacuaaaaauaucuagaguguguguguguguguguguguguguguguguguguguguguauuuugagguccuuuuuuuaaauauacuuuaaguucugggauacaugugcagaacguggagguuuguuacauagguacacgcgugccauggugguuugcugcacccaucaacccaucaucuacaucagguauuucuccuaaugcuaucccuccccuagcccuucaccccccuacaggcccuggugugugauauuccccucccuguguccauguguugucauuguucaccucccacuuaugagugagaacaugugguguuugguuuucugucccguguuaguuugcugagaaugaugguuuccugcuucauccaugucccugcaaagaacaugaacucauccuuuuuuauggcugcauaguauuccaugguguauauguggcacauuuucuuuauccagucuaucauugaugggcauuuggguugguuccaagucuucaccauugugaauagugcugcaguaaacauacgugugcaugugucuuuacaguagaaugauuuaucauccuuuggguauauacccaguaaugggauuugcugggucaaaugguauuucugguucuagauccuugaggaauugccacagugguugaacuaacuuaugcucccaccaacaguguaaaagcguuccuguuucuccacauccucuccagcaucuguuguuuccugucuuuuuaaugaucaccgaucaucagagugaacaggcagccuacagaaugggagaaaauuuuuuuaaucucuccaucugacaaggcuaauauccagaaucuacaaggaacuuaaacaaauuuacaagaaaaaaacaaccccaucaaaaagugggcgaaggauaggaacagacacuucucaaaagaagacauuuaucuagccaacaaacauaugaaaaaaagcucaucaucacuggucauuagagaaaugcaaaucagaaccacaaugagauaccaauaucuagcuuuuuaaaaucagacucuauaagagaguuccacauucguuuuugaguuuauccaaacuuuuuuuuuuuuuuaccuuauggauacuguuaaccgcaacaguucucaagauuaaugacuucuccauguuauugcaaggcuagcuacauaauuugcagggcccaccucaaaaagaagaauguggaguuacuuggucaaaaaauguuaagaauuucaagaccucaacagcaaagcauuaaaccaugaagaggcucuucuaggcacaggguccacuaugcaaguauacagcccgcaugccuguggagcuggcucugguuugguuugauauaaagaaauaauuccuuccauuuggccucagacugacucucuaagauuauccccuuaaguuccuguacaccugaauuuggugaauguaagucccauccauaugcaugauaaaucuauuuaucuacuaguuuauuucagucauuuucguuucuacaagccaaagaaucuauuuucuaucaaagucacuugaugaccaugaaaauuuuauuuuuuaccccuaccuuucccagcuccauuugucuuucuuuugcuugcuuguuuuaaguacaauaauuagaacuucauccuuaucuagaguuaacauuuaguaagacuaaaauagugauuuuuaaauuuaauuccauacucaucuugaaucuuauugaccucuuucaauucagcaaauauuuauuaagcauuugcuaaguacacggcaaaagaacaaauaaaacacagacccugcccucguggauuuuaaauucuaacagaauugacacugauugcaaacuuccuuuucuauauuucuccaaagagcuuaaagucaguuguuuuauuaauauaguuucuauuucuucuguuuaaauuuaacucagauaaauuacauacgaauuuucugaaaaucuacacauuaaaaauaauguggguaugugacauugugauauggcugauuugagggagccccuuuuauucgaggucauuuagacauaagcuuauagauaaaccauuaaguaugcagcuuuuaaacuuaccaaguaaugugcaaaccagacauccucacaucuguuucugaccuucccaccauuugggugugaauccugaaugugguaggugucaggaaagaguagaggaugagagaugaagcaaagggcaagaaugaaacaagggugauggaugaaauuaaaauuguuuaugucuguuacaggaacuauuuagcaauaaacaguaauauuucugcuuuugugaaacaguauuaaaaugcauugcuuuauuuuacugaauaccaccaucuccagaugguuugugagaauguuaaauaaaacuaguuucagcuuacaucccucaggcauacuucuauuagcauuuuuuaucagaggaaauguugauuuauuucauuguuuucugucuuuaucagcuacagaaaagucaucccauaauuuaucuccucuguuuguuugaauacuagaaucagguguagaauccucccuauuccucuucuguagcccccuuauuuagaccuucaccaaguucuuuagauuuuuguuucacaaaauuacguaccuugaguauuguuuugaucugaucauuucucuucccaaaagcccacaaucucuuccaccugcuucuuaggucaagcaaaaguauugacuuaaauuugaguccuuugaccguacuugacuuacugaguucccauagcuaacuuccugauacuccauuagaccacaauuuguacuuuauacuugggccaaggaaauuuauuuuaccuaccccuugauaaccuucauuaucuuucacugaaucaccacauuugccacucucccucauuugacacacuguaacucaacuagguuuauucaauuuuucagucuuggcuaaagacuuaguaaagccaucaugaaauagcuuaauccuuaguccuuuaauacuaaauguuaauucccuucauuuucuuucaagucgugguuuauuuuucuuaauguuugugaacaccuuguuuucaaucuacauaucuggguaugaauguaauauaguuuaguauuugcugguccugucuccuauuagauuguaaauuauuagagauuaagacuuguuuucccuuccuuuauaguuucaaaacuucauacagugggcauuuagaacuuacuguugccccuucuguugagugauuaugacuuaacuccuguuccuuguaaauaauuauuaguaucccuuaagaugcuucaucguuguuauaccuauuuggauuuuuuaugugguuuuuuuuuuuuuguuauacuuuaaguucugggauacaugugcagaauauggagguuuguuacauagguauacacaugccauggugguuugcugcacccaucaaugcaucgucuacauuagguauuucuccuaaugcuaucccuccccuacccccccaccccccgacaggccccugacgugugauguuccccucccuguguccauguguugucauuguucaccucccacuuaugagugagaacaugugguguuugguuuucuguuccuguguuaguucgcagagaaugaugguuuccagcuucauccaugucccugcaaagaacaugaacucauccuuuuuuauggcugcauaguauuccaugguguauaugugcacauuuucuuuauccggucuaucauugaugggcauuuggguugguuccaagucuuugcuauugugaauagugcugcaauaaacauacgcgugcaugugucuucauaguagaaugauuuaucauccuuuggguuuauacccaguaaugggauugcugggucaaaugguauuucugguucuagauccuugaggaauugccacacugucuuccacaaugguugaacuaguuuacacucccaccaacaguguaaaggcauuccuauuucuccacagccuugccagcaucuguuguuuccugacuuuuuaaugaucaccauucuaacuggcaugagaugguaucucauugugguuuugauuugcauuucucuaaugaccaguaaugauaagcuuuuuuucauaugguuguuggccacauaaaugucuucuuuugagaagugucuguuccuauccgucgcccacuuuuugaugggguuguuuguuuuuuucuuguaaauuuguuuaaguuccuuguagauucuggauauuagcccuucaucagauggauagauugcaaacauuuuucucucauucuguagguugccuguucacucugaugauaguuucuuuggcugugcagaagcucuuucauuuaguuagaucccauuugucaauuuuggcuuuuguugccauuacuuuugauguuuuagucaugaagucuuugcccaugccuauguccugaaugguauugccuagguuuucuucuaggguuuuuaugguuuuaggucuuauguuuaagucuuuaguccaucuugugaauaaauauugauguuauuacccaaauuaucagaaauggccagguaucauaugaggauaacuaauuaguauaguuuuuggccuauauagucucccuuaguacuuuuauaauggguaguucuuccuccuauucuuuucuuuauauuugcuuaaaaggaauuuugucuguuuguguguguguauaugugugucugugugugugucuaguaggguucaugagcaaaauuccacuuuugagauaacuaaacuuacauuucaguuacucuacuuugugcauauaaccuaaguacagcaauuucugacauguaauauugucaucugugaacuuucuucuuucaucaggaucuaacucugucugcaaaaagugucuaugaacauguaugacuuuuaaauauuugcccagauucaguaugauuacccacucucuuguacuuagugaauaucauguaucuaguacacuaauauaauucuaaaugaaauuuuuucacgucuuuacacuuuuguaaauaggauauaucuuauaauugaugguauuuuuaaguacuuuuucuuaguaguacauauuauagugguuuuuuuguuuuacaaucagugguguuuuagauuugauuaaaugggguaaauacucagaaaaggccugguacugugaauugaagucauacuugguguuacugugucaagcagcuacugaauuguguaguacuccuguaaccuaagaaagcaguucauucucaauuuaguauccuccuuuucaaaagauauagauuuucagaauuuucagccaucuaugagauucuuuucuuguuuuucuucaugugucauccuagcuaucaauaagacugucuucacccucuucgauguuuucauaaccacauggcuagagacagggauuuucugagaauuuaguuuaauggguuacugccagccagacuauagaguuugcucaauccuggaugugaugcuggcucguuaaugaauuggucccuccuaaaauaaaauguuucccugucccuucugggaccugauuccgauuucaauuguauuucaagaagcaaaugaucucuggaggagaacuagccucuuuaaaaucaaauggaucugauauagccuagugaaaagacccuauguuuuagagucagacagaucuggauuugaaucgugacucuucuguugacauguuccaugugugacauuuccuauauuaauguuacucucaagacuucuaguacuguugcuacuguuacuguuaccaccauuaccagauuuacugcuaagagguguuuugaauagaccucugaagucuaaccuaguguugccauaauuuaucuagugcuccacccagccaaaauggcacaacucagaagaacccuagucucuuagagaagaauaagaucagaguguaaagaucauaaagaugauggguucauuugccuuuuuuaacauuacagacccacuuaagagccagaacuagcuuugaauuggauuucuauaagauaacauaaauauucagaugaacucucauuuuuuucuuuauugaaaaauauaaaaauucuuaaucauuuuuuucuuuagaauguaauuaaaaggcagugaggcuggccuugguacaaagugcacagaugccguucugcagaaaaugugucuuugacagaugagauucuuccugugaauguucuguuuauugcuuucauaaauauucuauugucaaaacaugacuugcuguuuauuaacagcacugacaggaagauuccuauuaauggcagcauucuuauuacccauagacccugucacuuuuaacuucgcaauuuuaagagaauucuauuugguaauuacuuaagauauuucuaaguuuauugaucccaccccaguuuaacugagugaaguuugaguggcaggucuucagcccagugacugacacuaggaauaaucaucaaaucugcaucuuuggaggcaaggaaaaacuugcuaccugacagccuugaucuuguugcccugcagccugccagaaaaacccagugcuuuguggccaggcacgguggaucacuugaggucaggaguucaagaccagcaugaccaacguagugaaaccccaucccuacuaaaaauacaaaaaauuagccgggcgugguggcccaugauuguaguccuggcuacucgggaggcugaggcaggagaaucacuugaaccugggcgggaagagguugcagugagcugagaucacgccacugcacuccagccugggcgacagagcgaagagucugucucagaaaaaaaaaaaaagaaaaacacagugcacugagcaccugcugagagcagugcaauagggaaaauccauggauguagucccugcccuuagaaaguuuacugucuaauacagauacaugcugaaauguagauguauauuuuaaauaagcagguauauggcuaagccaaacauacaugcuucauaugcaacuggaaugguugcuuuggaaucagaggaacuugaguauaaaucauacuaauuguuuaucuuuugaaaaauuauuuaauuuuuuuuaguuuauuuccuuaccugaaaaauauaagugaugugcuaccuaucucauggaauugugaaaauuagccuugcaaguugcacacguugugugaauucucugcaucuuucuuuuuccgugauugauaauuggcaaagacauuugcauuaucugauccucaaaacaauccuguaagguagcuugggcauagguuucauccucauuucuuggagagggaaacuaaggcugagacaggcuagguuuauuacuuggauucauugacugguauagucaagccuaggucuccugacucauguuccaauguguuuuccacucuuugauacccaugccugagugacuaacauuuagaauuaugcuuuucagugccccugugcagaggcaauagacugaggcauguauuuggagaugaugugaaggaaaaagaaagccaguauuuuccuuguaacaucaauggagccauauaagauuauuacagccuucaagaaaggcgugaguagguauuagggaauggccgagagaugcucuagcugugguagaaaacacaugacuaugguagaguaagagaagaggguauuugcauacugacuagauguguuuagaauccacaucauaccugaaauuauuuaguccuuguauucauguuuccgauuucuuaacuuuaugcuccuucuaaguugaacuguucagaugauaaugugguacagcagaaagaacauggccuuuggaaccaaacuacaguucaaaucucagcacugucaauccauggcuguauaaucuugggcaagcaacuuaauuucucuuagcuccuguuucauuauuuauggacuaaaaauaauaaauaauacuuaacaguguaauugugaagauuaggugaauuaacauauggaaaugccuuuuacguacuaggcacuugagaaauauuaguuccuuuaagcuguccuucuauacuugaugacaugcagucugcuauauccuccuaauuauauucugaucuuagguuucuaccaagagagcucacuauuucuuagaauugaauaauuuucucuuuuuugauagccuauuaugggucuuuuauaaaauuauuucauuaugaaauaacauuaaguaaguagaaguucguaaguuacacccaaaauauaaaaagggaucaguuuuaauuuuccacuaucaagacuuuaauaguaaaggaguucuugucuuaauuauaaaauucauucuuucuuuccauaacuagaauauguauaagauagaaaaaguaauugcauugguuaauaauagauuaucauucuuaacagaaggaaagacguuucuauaggaaugcucuuuagaaauuauauuuuuuuauaaguagaaauugaugccacuacaguucacuguuacuuugugauuuauuacauacugauauuacaaauauauuuccuuagauuccuuaacuucuauuacuuauauccuuuuaaaaaaacuugugaagauagaugcugugaaauucaugcuaaaaaaccacacgguaagucuuauuucuuuaauuaaugaauaacauuuuacgaauaguugagguaaaguguuaguaacuuggauuacucuuuugcuuucauuagagugaacacuucccuuuucuuggcaucagugacaaucauagucucagcgacuucaggugucgaacaaccuucuacacagcgcucacucgccuucugaugguagaucuggguaagguuaagaauuuaaacucaauuaauaagggaucagcaauacacuugugugaauaaagaaguggaguacuaguggguacaacauuuaacuuauuagaauuagcgucuucugacaguuuucuacaaccuucuaagauuugaguguucacuuguuagcauuagagccaaaagacaaauauuuguacuuaagguggcauuuuucacuucacauaacacuugcacugauuuuuuaccucacagcuuacuuucugccuauccuuugacacauuaauuuuacugcuaugaaucuaggaauaaucuuaaacagagaaaaacuuuacacacaaagauuuucgucauagugaugucuaaacuagagaaaaaguagaaaugauguaacuguccaacaguagggaauuguaaaauuauggcacgccuacuuacuuguagaaugauuggcacgcaauaaaaaugaagauuuaaagacaaggcaauacaugaaauuuuauauuauaacauuaagugaaaaggcaaaguguuacacuggugcaaaugguaugaucauguauguuggggauggggggacaauacuucagaaaaggcuuaagugaaauucuucaaaaaugguuaguacagccauugugaauaacaguguagaggauccucagaaaauucaaaauaaaaugacuguacaauccagcaauccuacuacuggguguauagguauccaaaggaaaugaaaugaguauaucaaauaguugcauucccauauguuuauugcaucguuauucacaauagccaggauauacggaaucaaccuaaguguccauccacagaugaauggauaaagaaaaugugguauauauacacagugggauacuauucagccauaaaaaaggaaaaaugucugccauuugccacaguguggaugaaccuggaggguacuauguuaagugaaauaagccaggcacagaggacaaauacuauaugauaucacucauaugugaaaucuaaaaaaguugaucucauagaacuagagaguagaauggugguuacuaagagcugaggacuuugaggugaugcuggucaaaagauacaaaguuucagguagaaagaauaagagaucuguuguacguagauggugacuauaguuaauaacaauauauuguauucuugaaaaaugcuaagagaauggauguuaaggguucucaccacaaaaaugguaacuauagagguaaugcauuugucaauuaguuagauuuaguuacucuacaucauacauauguaccucaaauauauugcagguuuaguuccagaccaucaugauaaagugauacaguaaagcaagucacaccguuuuuguuuucuaguguauauaaaaguuaaacuuacuguacuguagucuauuaaguguguaaugucaugauguagauacaauguacauaucuuaauuuaaaauacuuuauugcggccaggugcgguggcucacaccuguaaucccagcacuuugggaggcugaggcggguggaucaccugaggucaggaguucgagaccagccugaccaacauggugaaacccugucucuacgaaaaauacaaaauuagccaggcaugguggcaaauaccuuguaaucccagcuacuugggaggcuaaggcaggagaauugcuugaacccaggagguagagguugcagugagucgacaucgugccacugcacuccagccugggcaacaagaacagaacuccaucucaaaaaacaauaaaaauaaauaaaauauuuuauugcuaaaaaauucuagcaaacaucugagcuuucaguguguuguaaucuuuuuccugguggaaggucuggccucgauauugauggcugcugacugaucaaaguaguugccaaagguugagguggcuguggcaauuucuuaaaagaagacgacaaugaaauuugcugcaucaauugacuuccuuucacaaaagauuuuucuguagcauacaaugcuguuuguuagcauuugacccacaggagaacuucuuuaaaaacuggagucaauccucucaaacucugcugccacuuuaucaacuaagguuaugucauauucuaaaucuuuuguuacuucaacaauguucacagcgucuuuaccacaaguagauuccaucugaagacaccacuuuuggucauccagaagaagcaacuccucauccauucaaguuuuuucaugagacuggagcaauucagucacaucuucaggcuccacuucuaauuauaggucucuugcuauuuaaaucacaucugcaguuacuuccugcccugaagucuugaaccccucagagucguccaugagaguuggaaucaacuucuuccaaauuccuguuaauguugauauuaugaccuccccacugaauaacaaauguucuuagugguauccagaauggugaguccuuuccagaagguuuucaauuuacuuuucucagauucaucagaggaaucacuaucuguggcagccuagagccuuacaaaaucuuuuuuucugagcaguaggcuucaacagugggcuuaaaauuuucaguaaaccaugcuguaaacagaugugcugucauccaggcuuuguugcucuauuucuagagcacaggcagaguagauuuuagcauaauucuuaaggacccuaggauuuucaaaauggcaaaugggcacuggcaucaacuucaagucaccaucagcauuagccccuaaugagagagucagccugguguuugaagcuuugaagccagacauugaccucuccucuguagcuaugaaaguccuagauggcaucuucuuccaaugaaaggcuguuucaucuacauugaaaaucuguuuagugcagccacuuucaucaauggucuuagcuagaucuucaguauaacucacugcagcuucuccaucagcacuuggcugcuucaccuugcacucuuagguuauggaggcaucaucuuuccuuaaaccucaugaaccaaccucugcuagcuuccaacuuuucuucugcaacuuccucaccucucagcuuucauagaauagaguuagggccuugcuucacauuaggcuuuggcuuaggaaauguuaucacugguaugauuuucuuuuuuuuuuuuuuuuuuuuuuuuuuuugagacggagucucgcucugucgcccaggcuggagugcaguggugcgaucucggcucacugcaagcuccgccucccggguucacgccauucuccugccucagccucccaaguagcugggacuacaggcgcccgccacuacgcccggcuaauuuuuuguauuuuuaguagagacgggguuucaccguuuuagccgggauggucucgaucuccugaccucgugauccgcccgccucggccucccaacacugguaugauuuucuauacagaccagugaaacuuucuuuauaucagcaauaggguuguuucacuuucucauuguguguuuuugcuggcauuuuaauuuaaucgcuuuaauuuucuucaauaauuuuuccuuugcauucaucaccuggcuaacuggugcaggagacccagcguuugaccuauuaaagcuuuugacaugucuuucucacuaagguuaaucauuuccagcuuuugauuuaaagugagagacguguaacucuuccuuucacgugaauacuuggaggccaucacaggguuauuaauuggccuaauaucaauauuguugugucucagaaaauagagaggccugagaagauggagagauacaaaggaauggccgguuuguggagcagucagcauacauaauauuuaucaauuaaguuggcuacccuguaagggcacaauuuguggugccccacaacaguuacaauaauaacaucaaagggcacagauuaccauaacagauauaauaauaaugaaaaaaguuugaaauauuaggaaaauuaucaaaauguggcccagaaacacgaaguagguucaugauguuggcagaaugaugccaauagaauuguucgacucagguuugccacaaaucuuuaauuuguuuaaaaaaaaaaaaagugugguaucugugaagcacaauaaaacaagguaugccugucuauauacuucaaaacauguuguauacaauaaauaacauaaaauuuuaucuguaaauuuaaaaaauaauuaaaaaugcuaaaugucgacuuuggguuguagcauguagguaauuuuuucuauuucugaucauuugaauuuuuuuaguguauuacuuuuauaaugguaaaaauuaacuuauuuuuaaaauuuguuacuaaaaagcuaaaguuagugagaaguauuuacagauaggcaguaccuuaggauggguacuuaagcuucuuuguagugaccauguuacucuagacucccauuucucauauuugaauacugcagguuagaccaguuauacaugagaggguucagucaguggcaauaucauccuuagacaauaccaauaauacuuuuuucuuuguuucucuugaagucuauuacuacaucaacuuaaauaugaauuuuuaaaaauguguucauacaaacagaagaaaaauaauuuuuuugcccauaaaaggcauugaauuuuuaaauggaaaggggacuacaccccucuauguuucuugcuuuuuuuucaugcuuuuccacagacuaaaucaccagaaagacaaacugccaaaaaguugagagacaugcaacuagaaugauuaaagagcuuagugggauugauuucuaaggaaagauuaaaagaaccauguauguauaacuuggcuaagugacaacuagggcuggaggcaaagagaacuaucuauaaauauuugaagagcguaaaccaggcaugcaaaacccaaucaucugcuaccuuaggcaagucggagauguaacugagugacagcuuuucguacugcauccuggccuauuuuaccucuuggcugcuguguuggugagaagaggcgcagccccagacugugucauugcccuugacaaucauuuagaaagcacagugugcuaaacucugagggcaagacaaagaugaaucaggcauacuggguccuggccucaaggagcuugucuucuugcuuucccaguuguccaagcauuaaagagaccuugaaacauuugucuggacuuaauuuauuucccaggccuuaaaaaugcucuuuuaauaacacggucacacagagugaaagaaguggggagaccaaaaagagaaguaucuggaggagaguuuuuaaaacuagguccgugucacucacauuuucagaaccuggaaauggaauggguuaacauuuccuuuuugauauggucaucacagauagggaacccacuauguaucugugguagguuaaacaacaggauagcacuaucggagccugcacacagccccaacucuguauucucaguacuacuguacuuauuacugcauugauaauugauauucaugaugaugcccagaaagacauugcacacuuuuuggaaagcaaauuugcucuuauuuaguauugcuuaauguaaacuaugagguaugagaaacugaaauaaacacauauaauuugaauaauuggauuuuauuaguuuacccaggauucuauuccuuugaaauacuuaacccauaacaguauaaagaauaaauucacauuuuuaguucaaaguuuuuuuuuaaauguaaauaucuguugcauuacaagcacuuuuuagacaccuugagagaaacagaaagaggcuaugguggaagugcuuggugcaugguaggugcucaauauaagucaguugaaucuggauauaaauaaaauuuaaaaucauaguagcuacccucauagaacuuccacauguuugaaaagaaacuccuuccuuauuuaucaguaauuuuuacuuuuuaaaauaaugaaauguaugugauaagcaucaaguuaugauuaaaagcaucaaguaugauuuguuguguaaacuaccagagcugcuuucuguuguuaaaaacuggaguuauucuucuucccaaaauuauguugggcaccuucaagguauggacuaucuuuuuuauauuuuucuagcaccagucagggucuuuacauugcagaugcucaguaaaugcuuguugaaugaaugacaaacaaguauacaguaaccaagacaccgucauuguggcuccuggaaucagcucuggcugccagguucuuucuggaaguagcucugaucauuggccucucccaagacaaaacaaaucaaguggcugauuacuuucacaagugauuagcuacacuuggccacucuugugcccgauuagucucuuguugcucucuguucagaguguuauuacuuuauagacgaugauuuguugagcguuguugaacacaguuuuuauuauuugaagccuugucucacaaacuagguugacuggaacauggcugucagaauuucuguauauauggcuugauaguuuucuauuguguguucauugucauggaaacaaggaagaaaaagauagugcuguugucaagagcagcauagauucauauauuaaaugaaaaaaauaaaaacauuagauaaugaggauccuccucaaauuaaaaaaaaaagacaaacuuuuuauaucacugauuuuggagagugggaguggggauaagaaucacagaaaaaaaaacaccuacuuucuugcaaaaguguuggaugugauucuuggauggaaauacaaaacauucuaauugaauccuacaaaaauaaauugaaaaugucuuguguauaagccaugcacauuggagugauuagaaagggggaaagaaauugggugucacauuaauugguauuuacuuugaaaugcauuuugguuucuacucagugauuugcacuuuguaugaauuuaauuagaugcuaugugccccagguuguauuucagaugaaaauggcggcggggcagggggugguuggcaauaaacaguuguaccauuuuaucggauugcuuuagcuaaacuagacaaaauguucacuugcauaaagaacagaauugaaagcauuucaucauuagaauagugguguuucaaaacaugugagagauguuggcagguuuuuuugguguucgaagaaaugaucaaaaugaaugcagaaaaucccuucacgugcagaaaaaaauggaugaccaaccagaugugcauguguguuagcccuuccaagaaucacuucaaguucccuagguuauuuaaaauuaacuuggucgaucuaauaaacuaaaggaaagauaguauuacccgagccaguaaauggagacccuccagggagcuauucaguauaaaauacuugaauaaauaaaaaucuucuauuuuguuucauuugaaugcaggugaauuuaguugacaaauacugaagaggguagguguggcaaggcacuauaacaacgcuuuucauuuggugaagaaccaaaauuauuauuugcaaauuaaguuuuuaccagccacaaauuuggaagugcucagugucaccaaugguugauuuuuccuuggacauuucaugauugcaucuuauguuguacuacuuagaugagaagcacguggauaggauuugagugagcaaugcauuccucggguauuuaaacucuaagaaacagucauauuuuuaauuacuagggggauacuaauauuaaaaugauguuuauggauguaaagagauaguucuaucuuuaggggugaggguagcacaguauccauauacuuuggcuuauaagagguaauuggcaucugaagauaucacuagcuuaaauuuaagaaaucuugaaugacgaaugacuugaauaacaagggaagaguauucuagaaauagcuacuaaagauagaaauaaaaacacagaggaaggaauuuuuuucuuuauuaauaauaguuaacauuuguuuaaaaauauauaguuuauaaaccacuuucauaggcauuuauccuuuuugauccgccugcccacauuaaauagguauuauuccauuguuuaucuguuagaaaacugagguucagaggccgggcgcaguggcucacgccuguaaucccaggacuuugggaggccgaggcaggcggaucacgagguaggagaucgagaccauccuggcuaacauggugaaacccugucucuacuaaaaauacaaaaaauuagccaggcgucauggcgggucucuguagucccagcuacucgggaggcugaggcaggagaauggcgugaaccccggaggcggagcuugcagugagccgaggucgcgucacugcacuccaaccugggcaacagagcgagacuccgucucaaaaaaaaaaaaagaaaagaaaacugagguucauagagauuaaaugaccugcccaaggucagccauguauguaguggcccucugaccacauauuuucauccacuuuuacuaaacuauuacuucaucuuucaccuuaucaaccaguggagaaauacaacuuuuuuccuucauuuuuauuugaacuauuugguccaaaugauugauuuggggcuugggggcagugaaagaaaaugagaaaugauuacuuucuaagcgucuaugaaauaaacagauagaugcauguuuauuguuuguucuguauagguauauuauaguuugauggugagugaaagucaaauguaguuuuuaaaauuuguucuuaugccuaauaauuggccaaagcguauuucuucucauggauaaaggaacacagagguggauaucucaggaagguuuagcaagugaggggcuugaucagaaauagcugauagauaggaagaauacaucaauguaucaacuguguccaugacuuggcagagauuaucugaaaaauagacauggggggaugggggagugggcaguaagggguaaagaagcagcuggaaauacuuaaaaucuguaaugagauaauuaagacuaauuagcuggcccuguaggcagaaagcagcccauuaaguccagauccaguuuuaauaacuuaccugguuuugaggcuagacaguccagagcaccccagggaaugagauguuucauggaugagacuuuuagggugggauucuuugaaaauggguagcuauagucugcagugggcaguguauuuuuuuuccgggaacuaaaauaaacacucugguucccuagggagaagaauuaaagggcaccucaguuuucucuucuguuaaauggagaaaacuacguagaagaguugucaugugguuuaaauaagauaaagauacauaaaaaggccuagagcaauuccuaucacaaagcaaguucuuagaaaauauuaagaaacguuuauugagugcacuauuagaagaagcauugacuacugcugggaccucaaaaugaggcaaguuuggcucucuuaaugccaucuacucugccuucaauauuuagggcuauuauuuuccuguggaaguaagaucugaugacacuucccaacacauacuaaaauauccugaccugccugaagccacaggucauuucaaaacuagcuagcacuccuaagcaauuuagagggaaacugaaaugaaaaacaaauuguggcccaaguuucaggggccaguuaagcacauuucucaaaguuuuacuguaauauaacuuagaagugguaucuuaaugaagcauugggaaauagcagaugaucugggccuagaccugcagaagucaucagcucuucugagauugcccauuguuacuugguuuugaaugguuuauuuucuucgcccagugccuaugucuccuuguuuaucucuccucuuaauuuuccuuaguuuggaccagagcuucauuacaccuacuuucuugcaaaaguguuggaugugauucuuggauggaaauauaaaacauucuaauugcauccuacagaaauaaauugaauaugucuuguauauaagccaugcacauugcagugauuagaaagggggaaagaaauugggugucacauuaauugguauuuacuuugaaaugcauuuugguuucuacucagugauuugcacuuuguaugaauuuaauuagaugccaugugccccagguuguauuucagaugaaaauggggggugggggugguuggcaauaaagcugaccuuuacugacuauauugguuuucuguuauuauugcuguaacaaauuaccacaagguaguagcuuaaacgauacuaauguauuauuuuauaauccuggaggucagauguccaaaugggucucagggagcuaaaaucaaggugucagcagggcucuaaggaagaaucuguuccuuugccuuuugcggcuucuagagaccaccugcuuuccuuggcucauggccucccuuucuccagcagcgucaggccaaauccuucccaugcugccaucuuugugguucuuugacuucugcuucccucuugcacuuuuaaggacccuugugauuacauuggacccaccuggauaauccagaauacuuuucuguuuuaaagucaguugauuagcaacuuuaauuucccuuuaucacauaaccuaauauacuuacagguuccaagaauuagaacggauaucuuugagaggguaauuauucguauucuaccugccauauugauuuaucacaauugccaaaguguuucacacaguacuuauacaguaaauccucaguaacuguuggcuaccaucauuuacaguuaucauaucauuucuauuacuugcuucuccuugcccacuucccccaacuccccaguaauccagcugcuauuugcauucaaauuuaaggaaauuagaaguuucacuguuuuguguacauuucggagggggagcaaacccagauuuuuguuguugguauuauuguuuuagauucacaugccauaaaauucacuuuuguaaaguacguaauucauugguauuuaguauauucagaauauucauaaaauugugcagccaucaccauuaucuaauucuauaacauuuucaucaccccccucaaaaacccuguaccauuaaguaauugcuucucuucuccccucccccaaacccuggaaaccacuaaucuguuuucugucuguauggauuugucuauucuggacauuaauauaaauggaaucauacaauuuguggccucuguaucuggccucuuccacuuagcauguuuucaaggcacauucauguuuuggcauguauuaauacuuuguuccuuuuuauggcugaauaauauuccguaguuuggaugugccauauuuuguuuagccauucauuaguugaugaacauuugaguuuuuucuaccuuugguuauuaugaaauaauacagcugugagcauuugcauacaacuuuuuguguggacaaauauuuacaguuuucuuggguagauaccuaggaguaaaauuguugggucaacuggcaacucuaauuuuuuaagcaacugccaaacuguuuuccacagugacuacaccauauuaacaaugguuguagcauuuuacauuuccaccccuggagguuuuaaauuguacaaaauaauaaaugaaauguccuacaaacaaaauaucugccagccaacauacuaaaacaguuacucuuauauuuuaaugugaugucucugaaggaaaaaaaauguuuagaacuuacaaaaugaauaacuuucuguuuaaacauauucucagagacacagcggaggugauuagcuuuggguuuuaccuaaaagcuaaggaauuuauaauuuuuaucuauacaugacugagaacuuacaauguuauguucacauuuacuuuuccugauggcaaugaaaauauuagucuauaaauuggcacuuuaccuucaaaucauauugguuucuguaccuuugucuuauuaagaaaaaaacuaacagcuucaauuauuauucauaaaauaaucauauauacauuuggaacacuaaauauaugacuacauacuugaauaugaaguuguaagaaagugagcucauguuuucuccuuuugcaccagaaauaguaaaugauaccuguaugguaauacagauuagaaaaaucucuaauaguaauguuguaaaaguuguuugcaugauauaaacaacaauauccaguucuccagcuuugguggcacaacauuucacguugcaaucacaggaacagugcugacuaaaaacguaaacauuucuauaguauaaugcaccaaugucuuauauuugccuacuuuaaacccaagugauugucuaggaauuccauuuuccucaccagaaccaagcuggcugaucuucacucucuucugacuucaugcagcuccaaauuuaggauucugugacaauaacauuaguccccaucucugaugccuuccaccuuaucagagaccuggaaaagcaugagcuugggaguaaagcagaccugauugggaauccuggcucgcugacauuuaccagcuggaggauguugggcaggcuaucuaauuccuuugagucucucugcucacauguaaaaugaagaaaaucguacaacuucaugagauuguucugaacaguaaugacuugcaacaguacuuugaaaacaguaagagccacauaaguguuuuuuaagcaaauaaaguaccaaauccauugccugcguaagcacucaaggaauaacagcuguuauuuagucaauccacaaacauuucuugagugucagaccuuauucaaggcacuggggauacucugugauggaaauagaacaauuuccuucccagggaacuuacguccuaauaggauaaacaacaaaugaauaaauaugucaaugaauggccaguauaguaagucccauaagaaaaguaaagcagguuaugggguuggaaagugauguggcgggaggggaacugugauuaccauuuuagauagaguggucagggaaggccucucugaggaagugacaguuaaguagaauugcuguucacauuacuguauuuauaguauuugcuccuugacuucucccugcacauuuugguggcuugucucuugugcuccugcuauccuuguuugccuuaaaauuugaauggagaaagagacggaaucagaaaguuuuuuuaucugucgcucagaauauuaaguuaggaguugaaauguuaaaagucugaauuugucuuuguucugaacaagcauccuuaccuuggaaaacuuuguucccaaaggaagggcacugggcuggcaaucuugcaguuauacuuuuuuugaucaccguaaucaccucucuaaguccauguuagacucaagacaacaauagugcuaauggcugucauuuauuaaguaccagacacugagcagggggauggggcgagggggugguuacagauguuuugucauuuacuuaauucucauggcuaacuuuaugaaguaaauauuaugucucuuaauuacaggugagcacacuaaggcuuugaugacuaaagugacuuuauccaaaaccagacagcuaacaguggcagagccaggauucaagcauagauaaacuuuuuuuucuuuuuuuuaagagacgagaucucacuauguugcccagguuggucucaaacuccugggcccaggggauccuccuaccccagcuuccaaguagguaggauuauaagcauucaccacugcucccagcuaagcuuagauaaacuuuguaauuucaaagcauccauucuuucuagcaccauuacaugccugcagugguaguuaccacuguucucauuaauaauuccacauuuagaaaauacuuuaucuuagaagaguaagauuacauggcuuaaguauaaugagcauauauuuuauguauuuaggauuugauaauguauauuucaauuauuuauuguauuauucuaugucaaguguuaagaaaauaaagauguucuaaaauucaccuuaauugagaaauuacuuuuuaucuaaacacaguauuucccuaauaaugccaggcucuauucugugcuaauacuauagugcuaguaucaccacuaauauuuauugagcaucuucuguuuuccauguauuauaacauuuaaucuucacagugacccucaaugauaaguauuuuuauacuuauuuuauagaugaggaaacugagacucagaguaauuaguaaaauauccaaagguaaauaauauacgguaaagucagacaccuggaccuguuuacugccgagcccuacauaauucuccuucacugagaaacucaaagauacacagucucagugccauagaagcuaauccgaagauacuaucagcguaagcuaguagagcuaguaauuuacauguauacuuuauaaauuuuaucucauuuaguucccgcaguaacccugaucagaugguaguugugguauaauguaagugguauuauuguugcuauuauuagauguaugcuuaaauaucugcaauucaaggcagaccgguacaauaguuaagagccaggcggccgggcgcuguggcucacaucuguaaucccagcaauuugggaggccgaggcgggcggaucacgaggucaggagaucaagaccauccuggcuaacacggugaaaccccaucucuacuaaaaauacaaaaaaauuagccgggcguuguggcaggcgccuguaguccuagcaacucaggaggcugaggcaggagaauggcgugaaccugagaggcagagcuugcagugagccaagaucgugccacugcacuccagccuggaugacagagcaagacuccgucucaaaacaagccaggcaaaaugcuaugggaauccaaagggagaagggagauaacuugauugggauuuaggaaagcuuagcuuagacauugggaaagauauuauuucaccugggccuugaaaaauaacaucuguauaggucuauguuaucaccaguuaacagagaagaguguaucuaagaggagucacuuggucacacagccaguugacagagaagagauuauaauuuggucugccuuacucuuuacucaggauacugaccuucguuuagaacggcacaccaguaaagauuuguuggcccuuuggcaucuguuuguaacaaagcuaaguccccaauucuguuguacuccugaaacaaugugaaauugaaggaaagagauaaaucacagaagauuagagucagccagaucagccacuccuuaagagucaaaagaucuugauccugccaggaccuccguuacuuugucugaaaaaugacuauagaugccaguguuuuucgaacauucacaggcaucugaaucaucuggagggccuauuaaaacaaaauugcugggacccacccccagaguuucugauucaauagauaugggauggaaccugggcauuuacaucucacaaguucacaagugauguugaugcucccaggucaaggaccaaacuuugaggaccuucucugagcucauuuccucucuaauacucuauugaaaaacucuacuguuagaauagaaauuaggaggucugaaccaugucguuccaccuccaacuaaguauuccaccuuaagcaagacacuuaaccuuucucugccuguuucuucaguagagugcagcucguagcucccugugacuuaggaugaaugagugaauucaaucucucauuuaaaagaaaccccuuuugaaaaagaauacuauauaaauuaucaauugugcauauccaugugugaagugaagauucugcuuugacagaauccuugaggaaacugcagucuaccuuuaaaguaaaaaguuaauaggaaaugucucuuuucccucuucucuauuuaaaaaaaaagagaaaaaaaaggaagcuuaguguaagaaguguacccauggagaauguauuuaaaauccaaaugacccauaagggaccccauccuuuuuggcagauaaaaguuucccugccauuuauuugauaaauuaauuaaaaagaacauaaauaaaagagaauaauaacuuagagcuaucugggcaccugagucuuugagcccuuuagggccuuggcacccaaagagaagggggaaaaaaaaaacacugcgucucugaggcuuugaaaguggucuuccuugaggcauuagagaagcucuaggggcccuaggagcuaaaggacugagaugccuggggcaugagucuauuagauccacuaaagaaccaggaaaaaaaaaauggcugguaaguaauuuugcuauuucauuugaugcaaaagagaaggcacaacaccagaauauucagugagcaaaaguacaaaauguggcauggaugugaaugcaggcugaccccuucucgggaauauuucuaagccuaaaugaagcacucaaugcugaggacaauguacaauucuaugcauuuuaaaccguagugacccuuuuguuucucugauaggugaagaugaggaugaauuugagaauuucaugcugccucuuacaguugcuuuugaaacaguauuacaaauauucaacaacaacuuuaaacaagaagauguaaagguggguuuguuuccaaauaugaggaaugacaguuuuguuuuuucuaggauaucuagauccagaaaagggcuuugcauaucuguguguacucuuugccuccucagaccugcuuucccaauugcaugucuuuaauuuuuacuuuuauuuaagcauuuuucuaguuucuuagacaaauggacuuugaggucagcaaauaguuuuggacagucaguucaugauaagaugacauagauuuguuuccucuggcaguuacuaucuuuaauaggauauuucuuguggguacaccacuuuaaacaccccuauucccucaucuauccugcacuguuauguuacaacagaucuauauggaggaaugcacaaacauacacauacuaaaacacuacaucucuaaauauuuuuuuaaacaagaauuuauauaaaucaagacuuuauuaaauggcuaggcauauauguauaaauaggaacuggucuugaaguauugcauucuuaaacggaacaaagugauuaggauaacugauagcuaaauaagguuuuuaugugccugugggagccauauuaggauugauuugacaagucaguucagcuguggcaacagucauaauaucuaagacaacauuauguuuuauuaguaaaauccuuaaguguagcaagcugucugugacaaaacagccccguauuuuaaggagggggaugggaagcacaagcacugcuaaauagaaauaguaucuucugaaauuauaauguaucagggaaauauuaaauaaauugacacugauuauuauuuuuaacagacuaauaaaugcacuccagagaauguagacaccuuuguuggugauaauugagucauauauuucauaguuauuugaaguauguuggaaauauuaaccaucuuuugcauagugucucuucaccaaaaaaaagaaaacaaaaacaaaaaaacuaacaguaagaagccaaauagaaaaaugacacccuuugauaauuaucuuuauguaauucuucuaccaaaaaauaaucagccaaaugcuauaccucuuaauuuaaaagaauuuuugaaauuaauguuuaucagcaugcuauaguuauagaauuuuaaaaccaaaagaaggaucuuacagauucuguuuguguuuauagucuuccugaaauucuucaccagaguuuccacucagguuagcuguaucuuuuagaugucuuccaaauauuuucagugaccaacaaaaucuuugcagcuuuuagguugcuauuucugcccuuuaucaaaaaggagcagugaaguugaaaaacaucaucuuuaugaaaauuacaucugucucaucugaagauuucauuauauuccaagaccauuuuguuguaaucccaucuaguuugauagaaaccaucuuccuagagucauuuuuaauggaguuccagugauauaucccuaaaccagcaaguucuuaacgacccuggaaagugacugcuugauuacacuuuaacgguauuugcaaauaaaaucacaaguaauuaaggggaaaucuccaggcuuuugagcaaguuugaugcaugauaacugccugauucagcuucaucuagaguaaugcuguguaggcaacagcuacugagaucaauagcaacguaaugauaguggcagaauuaagugaguaaccugagaacugugccucagaaugcaugcagcugccacgaaccaaggccacacagugcacuccgugcuuccguccuaaauguucaucaaaagacgcccugcaggaaaauggaguuagaugcucuuuauugcugaucgugucucuugccacauuuaucagggaaauuggauuagcaguuggcagcugcagguagacaagauucugcagugauuaaauaugcagcuuggcugcauuuguugugacagaccuuuaguaaauucuacuguaagcaccaucugucuaauuuguauaaagaaaacuuggugcuuuaagcuaccgauaaaaaacuaaaucuguugcuuuaucauaaacaaaacuuuugcacuaaaugcuuuuaaauguaauuuauuagguuaaggcuauuuuucuaucacgaugaauaaauaauacaugcaaaagugcuuucagguacuucauuuugcaaguacuagagauaaaaacauuucuguuuuguucuucaauaaaguauuuaguauuccaauccacaggaggugaugcuguuaaaauaucucuaugaaaaugccgcaggacugccaaauucauuuaauuugcaccucuuaccagcauuuucuaacucccuauuuauagauaguuucaaaugcagauuucaggauaaacuuaaacauuaaggaccuguguugccaaauugaaauacaguuguuagaggaggaaaugcagcaaaaguguuaaauuuauagcuuuauuuucuuacuuauucuuaauaaaauugaagaaaacauugaaauuuugucuuggguuuuucucuucaaaguaaaggggaaaaggaaaaaauacucugacaaauccuagcuuuagaguacucuuucaaaacguauguuucccccuauaauuauguccaugguaaaauauaguccaguacuccccugacucgugcaucguuuuugauuuggucaugacaucaucaguuucaaggaaaaugaaugaaaacuucucagagaaagagaagcaguuaaauaggaaccugcuaucuuuaguccuuuuguaaaaacuccacaauguuaaauuauuuaaaauccuugauuuucagcaugcgcacauuaaaaguuuucgcacuaagugccaaauguugcaaacagcacuuuaacagaaugauuuugcuuugaucccuguagcaguuccugaauaauuuaucacagguuauugccuuaauucuggagagggauagagcaauaaaggcagaugaaaacacuccaguugaaacaccuuggggccugcucauuccucugacacggcucuuuuguuggaacuauuuagagguuauuaagaugugucuucagaauuaagaguaugcuguaaggaugaagacagccaucuuaauucuaaagacaaagcacaaugacccuucaccuucuuuuucuuuguuguuauuauauaguagaauuaugaggauaauauuauagcugcccccaguagugccacuacaguaaagggucugugagacuuuccauuagaaacccuguuuugggggucaggguggaaggagccucguuucagcuguuucccagcccauucgucucacacuuggcacacagacaacuguucaccaugcagcagacugaagaacucagcaguuucucccuaacuacccaaaaaggaauccauaggguuagaucuccagacauaucccacuccccaaaacagccucacuaaaaauacaagagccugucacucuucagaccaaucuuguguugaccaacuauaggagagaggcaacuuuuaaaauaaaacucuuugcacuauuuuaaaugagaugguaaacuguagcuccuccuuuccucaaauucaauaagaucaccucuuacgcucaaauuacuuaguaggcugguugagcucuuaguuaacagcuuuccuuuuucauaugggggcuggauauguuuuggcuauugagaaaacacucucuuuaguguuguuuguguauccauguagauuauugcaguauuaucugcugcuuugagauaaaagauauuguuugagcauaagaaaucuauuucuuauucacauuaacacugaauuuuucuguucaguugaauucauuuaaaacauuauuauaugcuuccucuguaguaacauuuucuagaaugaaacauugauauaauuucauagccacauuuugccacuuuaaaaaaaaagccaauagauuugaguccuauagaccacuucuauuaauuugauaucguuuaaggaaugaaaaaauugugauaaaauaaaaauuaauauuuuuguauaacgaggauagucuaaaauauuuuuagagcccuuuguacuagacacaaagaaaguaaaacucaugguucuuguugacuaauuuagacuuaaaugguagauaucucauguguauguggaagcuuaaaauuauuugaagcauagccugaaacuuguaaguguaccuaauaaaaauagaacaaaaagccuacuuuaauagaaacacugcaaagccaaggagucagaauagaauaguuugaagaaggcuucuuagaagauguauuuuguucuggaggcuuccaggagugugaaaagcugagaaagagaggaacaggcuucagguggugaaaaaaggcuauauaaaaaggcaaaauguuuaaaaacaagcagcagguuacaugagggaacuacaaggaggccagcugguuauagaaaaauaagaacuggugagaguaugagaaaaaaaggaguaaguaauuuaaaggagcagaaacaaaaauucagaguuuucaagauucagaaauucagauaaccaucauucugugaacuguuagacagugcagaaacugaauauuccuauaaauaacauccaguuauauugagucaucucuuaggcagaaagaauggagaagaugagaaauucuagauacuucugagaguuaaacuauuauuugcuacuuugaaauuaaauuaauugaaucagccauuaagaggagggucaggauucacuguuugcuuaauaauaauuugaacuccuuccuaaagagguuuucauuuauuaccaaagugugagaaaggagaaaaucugguagaaaaaaaaguucagagaccauuuucuagcugaguauuugcaaugaaacaguaucuuuagaagucacaguuguauaucucaauuaucgcacccccuuguuuuguaauuauguuuauuugugcucuuuguuccgacauucuagcaucuguucauggguuuucuuuuucucuucccaagcaucaaccuaaggacagcuuaauuaagaguccagaguacaagucagaucucuucuauucaagagucaaguuuuuguuuuuuuucucuaaaacuaaauacuuauggaacauuuacuguguaucaagcucugcuaggcauuuucacauaaauuuaucacauuuauuuggcacagugccucugugagaaaugcauuauuagccccuuuuauagaugacaaaaguaagccugauaaauugccuugccuuaaguuuuaaagcugggauucaaauucgagucuuaugacaucaaauauagaacucuuuuccuuacaucuuccucacuuggggaaugugacugccauucugcguauaucauaguacauguaggucacuuggccaguuuuauuuuguccugaaguuauuaaggauauucauuaggaauuuuuaaaugccagugccuuucuaggauagacucuaaauuauguuguggggccgcuugcaugcaagccgauguucaagauuugcuguuauuaaauaaugucuagacccuguacauaucuguuuuguguaauuaucaauccucaucuuuuuuuucagauuuggcauuauucagaaacaaaguauauuaagacucuaaaugcuuagcuacacuacuggaauuaugacuuagcuaaauuuauaagaaguaaaguggaguugaucagcagauuugauggucuguuuaaagagucugugcuuuucuguagaaagaggucugaacgagacauuuuagcuaaugaaucaaaaucagauauguggucauuauugccugauuauuacuccaucugcucugcgcuaacgugaaaaucaauuacugugucucuuucccacugacagcguauguugaucgggcuggcaagagaucuucgagggauugccuuugcacugaacacaaagaccagcuacaccaugcuguuugacuggauguauccuuauuacacugugacaauaccagcucugugcacagagggaugccaggccccucgcuuucguuuaauaguauggcacaguagggaagaggaaacaaagcuaaaugaacuaauguguaaucagcuaaaaauuacagcacaguggcagcagagcagauaacugagcacaguauuuggagacccagcucagagaagucacuuuuuuggugccguuaaauauugauaacuuaaaaaugacuucccccaaaugauuguuuauguuggaguugaagggauaaucuggcuaacaucuuuagggaucaaugaauccuaccauuugacauuuuugaggggagauuugaaucuccaucucaauuagcaaggcugggaagaucauuuuaucucuucaaggccuaacccaucaugccacaguuuuucauuaucaugaagauaaugaauggacauggaaagggaaaaauaaauaagucaagguuugucauuugguguaaaauuugaauugaccuuugccaaggguuaguacagacaggaaaaaaaaaaaaaaccccccacagaaaugccuuaucauguaagaguuaaaagagcauagacuuuggugauagacagacccggcuuaaaaucccagcucuucauuuacuguguugugaaccuuggcaagucauuucaccugucugagucuugguuuucucauuugaaaacagauacaauucaguaucaugguauauuguaaccauuaaaauagguaaaguguacucuguauaaugucuggcacauuuuugguaguuguaaauggucguuaauauuguucuaauaguguuguaugacuuauguuugaucccagcaggaagugauauuguaugcaagucaucuaaguguuauauaaugcuuucaugucuuuuaugcaugaaaccaucagagcaugugaaaaaaauuauauaaucugaaagcuaauuuacuuuuuaaucuaaacuauuucucaguuacuuuuuuuaaacccuccuuauccaaaguuuccuguaaauuaaauugcaauagaaacuucuuaaagguaacugucaacuacuaugccacaguuauggccaaaaauauaacuaauaggggaucuaggcauguuuuagggagaacucuacauauuauaaaaauuuuuaaacauuaauuugauacugacauaucuuuaauuauuauuaaaauauacuucaucagauuuauguacccagagaaggguuacagauaaaauuuuuaugucauugaguaaucaugcacaugguuuuuaucuacauauaauauguacagagauuaugaaauuucaacauggaaagucuuaaaauucucuuaacagugacaguuaaacuggaauuauauaugacccuuuuauuucugccuuuuuuuuaauuuuuaagauacggggucuuguauguugcucaggcuggacucaaacuccugggcucaagcgauccucccaccucagccuccugacuagcugggacuguggugcuacaggugugcuccacugcacccagcuugacucuuuuauuucucuaaacauaaagagcaacucucaaaaucaaaauuuucauuauuugaaaaauaauaaaagucuacuuugggcacuguaauaucgauggugaucuugaaaccagucuacaacucuaggcuaucuagugauuaacauuucauguuuuucucuucaacaguuucaaccaagagucaaggucagaaaccuuccccucagugucaaagaagaacuaucugccguaauugauacugcccaaaauuuagagaagauacuguauuguuuuccauuuccuuauuuagcuccuuuggggguagcgggggaaccuuucugaaaugaaacuuuuguccagcagauggcagaaaauagcaaacggaaaaucuugggacuuaauguuuucuugugaacuagaaaccuuugucuccuccauuugaccauagauguugaaguuaucagggucaggggcggagagaagugucaguuaugccagaagcuguguuagauugccaaauggggugguuugguacuggcguugcuuauaauaauugaguuucaguagcaaaucagcuuccuugggaaaaggccaagggcuuuucauaauuguauugacaacaaaaugaauaugauaaaugguguucauucaguugagacaagauuuauaguuuuccuuugggcgagggaugaagagcaaauauuuauaauaauaguaaaauuuguuuaaaaguuauauuauuugauaauucaaaaagcuuuauuaaaauauuuugaaauacuuuaagcaguuucaggugauaaaguacagauucuuuucaaaguauucaaguaaugcaaaaaugaauaaguaugauaaaaaaaugccauggauaugaaagucauuuauuuuuccugaaauauugauaugucaaaccgucagugaugauuuccacauuacugcuggggaaaguuuauuugccuuuuauccacauaaauguguguucuuuaauuuguuauacaauccuuagcaugcagaagaaacauccuguaagagcacaugucaucuuaaagucaaaaugcauuuuauuuauggcgauuauuugauaaaaugcuauuuuagugguuagcuauuuaauucaaaaacauuucuauaaacacugacugcauuaacugccacacaaacuacauugcuuuucacucuguccuuccaaaacuaaauugccugaaacuacacagcaaccaucuugauaaaugguuuccagggcuggagaauugaaggaagaucauugacauacuucuuugccccuaugaugggaaugcaacaauaagaaaacaccuuagcuugcagugcaucugaucuccuuguuuaaaauuuuccuagaucauacuuaaacugaaguaucaaaaauccagagggaaguugggaaaaaaauuaagaauuuguaugacauuauuuccucauaugcagucuuuuaacuguuaaaaucugaucauugaacucacugauuuuuaaucaggaagucagugcuguuauacaguggcaaggcaagauaacaagauacauagaggagcacaaacuuuggaauaggacaguccuagauuccaguccuggauucaccacuuaaacugugggucuugaguaagcuacuuaauaucccagaaucacaauuucgcuuuccauaaaacaagacuaauaaaaccuaucucacagguauguuguaagaagugucaugauucugugauuauguaaagggcccaguacaguggcugacauaaaguaaauacucuacagcuguuguuaguucuguucccugauacauaaugagacaaaggaaucccauuugcucacuuauucagcaaagugggcuaagggcugugcuagguucaugaggaguauagauacuaccccaaacaaagucaguuucuuauuuacauaaauuacuauaaucaaauauagaaagugcuaagaaccauaacaaagauacaaacaggacagugagugcauuuagcuggggaaucaggaagggcucucuggaaaggugaagguguuuccuugggucuuaaccaaauaaguaggauuggaccauauggaaauaggaagaaauacagguuuucgguuggccuaggcaucagguuuagggagucaguagugaagauguuuuguuacauauaccacucauuucaugguuggaaauguaguuuguuugggacucuugaauaucagucuaaggaauuuagacccuuauuccauagguaguauaaagaaacuaaugguuuugauugacuaagaaaaucagaauuguuuucaagaagaaaguaauuggcaguaucauuuugggcaaacugaaauagagaagaaaguaaagcugaaaauucacuguucagcaagcuauuuuuuuuuaguuuuauuucugugccagacaaaaggaaugaaagaaugaauaaaaugauugcucuuuagaagcccacucucuaguugaucacacaugacuaauaaacaauaaaaugucagugcguuauaacagagaugcaugcaaagggcuauaugagcauguaugggaaaaagagcagugcuuuuugcaagauauagaaagcuucucaagagaagugaaaguugagcaaagccuugaaagauggauaggcauuugccagacauaagaggaaaggcuuccagcagcaguccccuugugaacaaagguccagauguuuacauauucauggaguaccuuuaagcucugaacuggcaagcuauuucuauucuggaaccacauccccaaacccuugucuccuaacacuuuuaaugaaaauucuuuugccuucugguauuaacaacugaugaauagauggacggacggacagacggacggauggauggauggauagauauuguaaagaagcaaacuugauacuuuucacauuuucauauuugguauccuguaaggcagugucacaucauuaaugccuuugauuuuuaauuuaucugauguggaccuuagaaauucauagagaagaucucagugaaagcaauuagaucugugcuucuucuaccuaagggcucccauucucuucuuccuacucauauguacauaguccucacaaggccauuggaaaauuaaacuccuagaguggguucugguucucacccuguaauugagccuggcacucucacucugcagcccuuuuaaccucucuauugugcuuuccaauaaucccucauuuucucuguggcagucaccucugucagaagcauauuagaauuggcaccacucucauuccacacagaaaaaggagcauccccuuauaucucccugccuuaucccguagugaauacugugugcucugaaaaauauccugguccuaaugccauuauaggaugccuugcagaggccuaugugugccucugauauucuuagguucugagauuuggguugaauccauuuucucaugagccuuccagaugcauucccacuaaugaguuugugcucaggaggucccuugguggaauauuuucucaccuguaccccuguggcauugguucagaauuucuguacucaaagcaucccuauuauauguuggucacccuaauuugagcauguguuccccaagauuaaaagcuauaucuuccuggccgggcaugguggcucaugcuuguaaucccagcacuuugggaggccaagguggguggaucaugaggucaagagaucgagaccauccuggccaacauggugaaaccccgucucuacuaaaaauagaaauauuagccgggcaugguggugcucaccuguagucucagcuacuugggaggcugaggcaggaaaaucgcuugaacccaggaggcagaaguugcaaugagccaagauugcgccacugcaccccagccuggcaacagaacaagaccccgucaaaaaaaaaaaaaaaaaaggcuauaccuuucuuaacucuggauccccagcccuuagcauaguacauagcacaugguaucuacaucuaucaaaaauaacagcuuuucugguccauagaaacaaaacaguaaguugucugauaacagucaaaauaaaguuaaucaaguggauugacuuuauuuuuguuauuuucauccaacugaaaccuuauucucacauauacacucucuucuuaucccccuucccugccuuauuuuccuuuguaguacuuuuuuuuuugagacagagucucacucugucacucaggcuggagugcaguggugcagucuuggcucacugcaaccuccgccucccggguucaagcaauucuugugccucagccucccaaguagcugggauuacaggcgagcgccacuaugccuggcuaauuuuuguguuuuuaguagagacaggguuucaccauguugcccaggcuggucucgaacccuuggccucaagugauccacccaccucagccucccaaagugcuaggauuauaggugugagccaccaugcccgacuuucuuugaaguacuuucuaauguguauuuauuuuguuuacuagaauauaaauuccaugagggcaggguuuuuuuuuuuuuuuuuuuuuuacuggugucucuggaaagugucaaacaaugcuuguuauagaauaggacuucagaaaauaguugauaagaaaacuguuucaguauauacaaaugcagccuuaacaugguaugucugucuaauaggagaaaguguugcuuuuugcacuuuuaggaagcauaccacucuuaaaguuauagaugccuuauuuucauugaacaucaugugaacuguuuucuaaagcucccaagugaaauacacaauuaaauaguucuaaucaaauaagcuacacuucauuuuuagguugcaaguuuauagcaacaaguauguauugaaaucuauuuugugucaggccaugcauucaauaaguacuuaguauaugcccucaaaaagcuuauaauaggagagauauacaaguacuaugauugugcuagcaccggguuccaccaccauacacaggagacacuccuaacccauuagggagagguaggaggcaagugcaugugaugucagagaaggccuccugggauaauugacaccuauauugaaaucugacauucaaauagaaauuagcaggaagaugauagggucucugcucuuuagaaaugcacuaucuaauggggcagacaaauaacacaagcaaccaacccuaacauacuguguuguaagagagauauggucaugagugcucauugaacauagaugaggaagagacugaugccuuuggauaaaauagagaaaacaucccaugggagguaaaacuugagcuagguauugaaagacagggauauguuagagagaagaagugguuuauaagggaauggagauaagagcuggcauuagugguuuugcagggaguuaugaaaagcuaaaucauagagcagaaaugcuaagagaugaagcuggagguagccaagaaccaaaucuuaaaggaccuugaacaccgugcuacggaguuugaaauuuauucuaagagcaaggaagaaaauugugaugaccucaccauggagauuucuacccggaccacacugaaaagaaacaccauuaagugauuuaguugagcauuuugaucugaaacaaaagacaaguauguuggaaaacaucggaaagagacuugaggauugggaaaagaaaagagaaauuaaggcagugacauagaguuuuucugcuacaguuugggaccuuaauccuauauucauaugucuacuuggcaaggagauacccaguguaaauuaaagggccaguggagcugggucaguuuuccagguucugauggccuucagcauagauuuaucagaggcauauacuccuuagcauuaauaaggauguuagagaaugucuccuuguguguacaugggacuaucuuuagugacacugauguugaguagauuaauaguuacucaaagcuuuucgucaagccaacaucccagauauuccuuggagcuacagugagaccaaaaagagcaauucaacaauauuuuuuuaaaaagaauaauguaauuuugaaacugagagauaugugagguuuauuacuaguuccuucuacuuuuacauauuuauuaauuucauaauaaaaauauuuuucuaaguaguauaguacccaagaaacugauaauaauaacucaaauauauuuuuauccucauucacuaaauuuauuuuccuuuccuacaacauuaggcauaaaucuuuaaauguacugcuuauaugauacuuuaaaaauguguauuuuauuuauacaguauucuaagaacaaaguaauauaacguguaggacauguuacaaauaagaacaaauugccagcaaccccaaaaauguauguauaucugugcagguuagggagcgcaauuuauaaaaugccauuguauaguauagacauagaacaaauuaguauaaauauagaacaaauguggauucccuuuuguguguguguauguguguggcacuaauuuucagaaacaguauuucuuuagacccuuaaauucuuuaacaggcuuuauaaaagguacccaacguaccuuccccuucuucagaaugcuguugaacggugguauggagagccaacauguacaacucccaucuugaaacuuauggcagaacuuaugcaaaacagguaagcagugugacaggcagugagaaaaacagucuacuauuagcggaaaucuccaacagucagacuuucuuuuuugguuugugucuuuccaagguaguuagcaagagcccaggaaccaagacuuaagaugauuagugaaaacagaauuagagacauacgauugaggccuuuugagagaaaaaaguacaguauacuuggcugucuauggggacuagggaaauggaaaauaaauuggaagacugcagccaccauuauuuaaaaauucaaagguacgaaaugaagggagggcagcuauuuuaacuauuucagugcuuaaaugcaauucuauagaauuuuaaagcaggaaagaaguuuagaggucucugaguugagaugcuuuauuugauggauaaggaaacugguucucacagcaauucaauucaugggaacauaguuugccucagaagcucugggaauuauuccugcuuucacuucuaagcuauacuucuuccuuuaugccaagaugcauguauuuggaugauuuauacacucacaguuuucauugagagagcaacuauaauacuucucugaaauugcccaguugaccuuauaauuugcauagacuggcagaaauucaaauauucuccauauaaauauuaacaaagauguagcuaaaagagaaaaucuggcaauaagcuaauugggcuuaaaauaugucauuguggauauggcuuagcaccaaauuacaugucacuuagccauccuguuucaugaguugcccuuuguaaacuauguguuuagaagggagguauccagacagggaaggguauggguugcagcucuaauguuaucucuggugcugaguuuuucacagcaauaauuuaaaguuuuuacccuaaaacaagagaugaagaaagaccuugcaaauaaagaaauguguguaucauuuuuuuuaaagcuuuucauuuuuaaaagccacucucauaggugccuuaaaggaaggguggcuuuguauuuuauauuaaaaauuuaguuugcuuuuuaauuauauuuccauuuuuuuaaccagaaaauuaauauuauguauuacugauagaacauuuaauacuaaagggaaaaaaucauugcauuguauauuauaaaguauuuuaugucagccacaggcagaugauuuuuuuuuuaaauuuaaguucugggauacaugugcagaacaugcagguuuguuacauagguauacaugugccauggugguuugcugcaccuaucaacccaacccaucaccuagguuuuaagccccacaugcauuagguauuuguccuaaugcuuuccauccccuugccccccaucccccaacaggccccggugugugauguuccccuaccuguguccaugugaucucauuguucaacuaccacuuaugagugagaacaugugguguuugguuuuauguuccuguguuaguuugcugagaaugauggcuuccagcuucauccaugucccugcaaaggacaugaacucauucuuuuuuuauggcugcauaguguuccgugguguauaugugccacauuuucuuuauccagucuaucauugaugggcauuuggguugguuccaaucuucgcuauugcaaauagugcugcaguaaacauacaugugcauguauguuuacaguagaaugauuuauaauccuuugguauauacccaguaaugggauugcugggucaaaugauauuucugguucuagauccuugaggaaucaccacacugucuuccacaaugguugaacuaguuuacacucccaccaacaguguaaaagcauuccuguuucuccacagccugaccagcaucuguuguuuccugacucuuuaaugaucgccauucuaaugggcaugagaugguaucucauugugguuuugauuugcauuucucuaaugacuagugaugaugagcuuuuuuuucacauacuuguuggccacauaaauaucuucuuuugagaagugucuguuuauauccugugcccacuuuuugauggaguuguuuguuuuuuucuuguaaauuuguuuaaguuccuuguagauucuggauauuagaccauugucagaugaguagcuugcaaaaauuuucucccauucuguagguugccuguucacucugaugauaguuucuuuugcugugcagaagcucuuuaguuugauuagaucccguuugucaauguuggcuuuuguugcaauugcuuuugguguuuucaucaugaagucuuugcccaugccuauguccugaaugguauugccuagguuuucuucuaggauuuuuaugguuuugguuuuuacguuuaagucuuuuauccaucuugaguuaauuuuugcauaagguguaagggguccaguuucaguuuucuucauauggcuagccaguuuucccagcaccauuuauuaaauaggagauuuuuucuccauugguuguuauugucagguuugucaaagaucagaugguuguagaugugugguguuauuucugaggccucuauucuguuccauuggucuguauaucuguuuugguaccaguaucaugcuauuuugguuacuguagccuuguaguauaguaugaagccagguagcaugaucccuccagcuuuguucuuuuugcuaaggauugucuuggcuauacgugcccuuuuuugguuccauaugaaauuuaaaguaguuuuuucuaguucugcgaagaaagauacugguagcuugaugggaauagcauuuaaucuauaaucuauaaauuacuuugagcaggauggccauuuucaugauacugauuucuuccuauccaugaacaucaaauguuuuuccauuuguuuguguccucucuuauuuccuugaguacugguuuguaguucuccuuaaagagguccuucacaucccuuauaaguucuguuccuaaguauuguauucucuuuguagcaauuacaaaugggaguucacucaugauuuggcucucugccugucuauuguugguauauaggaaugcuugugauuuuugcacauugauuuuguauccugagacuuugcugaaauugcuuaucaguuuaaggaguuuuugggcugagacgaugagguuuucuaaauauacaaucaugucaucggcaaacagagacaauuugacuuccugucuuccuaucugaauaaccuuuauuucuuucucuugccugauugcccuggucagaacuuccaguacuucauugaauaggaguaguaagagaaggcaucguugucuugugcugguuuucaaagggaaugcuuccaguuuuugcccauucaguaugauauuggcuguggguuugucauuaauagcucuuauuauuuugagauauguuccgucaauaccuaguuuauugagaguuuuuagcauggagggauguugaauuuuaucgaaggccuuuuaugcgucuguugagauaaucaugugacuuuguuauugguucuguuuaugugauggauuauguuuauugauuugcauauguugaaccagcuuugcaucccagggauaaagccaacuucaucguaguggauaagcuuuuuaaugugcugcuggauucuguuugccaguauuuuauugaggauuuucacgucgauguucaucagggauauuggccugaaauuuuauuuuuuuguugugucucugccagguuuugguaucaggaugaugguggccucauaaaaugaguuaaggaggggucugucuuuuucuauuguuuggaauagcuucagaaggaaugguaccagcuccucuuuguaccucugguagaauuuggcugugaaucugucugggcuuuuuuugguugauaggcuauuaauuacugccucaauuucagaacuuguuauuggucuuuucagggauuugacuugcuccugguuuagucuugggaagguguauguauccaggaguuuauccauuucuucuagauuuucuaguuuauuuguguagagguguuuauaguauucucugaugguauuuguauuucugugggaucaguggugauauccccuuuaucauuuuuauugcaucuauuugauucuucuucuuuauuagucuagcuagugguccaucuauuuuguuaauuuuuucaaaaaaacagcuccuggauucauugauuuuucaaaggguuuuucauguaucuccuucaguucugcucugaucuuaguuauuucuugucuucagcuagcuuuugaauuuguuugcuuuugguuuucuauuucuuuuaauugugauauuagggugucuauuuuagagcuuuccagcuuucucuugugggcauuuagugcuauaaauuucccaccuaacacugcuuuagcugugucccagagauucuaguacguugucucuuuguucucauugguuuuaaggaacuaauuuuuuucugccuuaauuuuguuauuuacccaguagucauucaggagcagguuguucaguuuccauguaguugugugguuuugagugagucucuuaauccugaguucuaauuugauugcacuguggucugagagacaguuuguuaugauuucuguucauuugcauuugcugaggaguguuuuacuuccaauuauguggucgauuuuagaauacaugcuuugugacacugagaagaauguauauucugucgauuugggguggagaguucuguagaugucuauuagguuuacuugguccagagcugaguucaaguccuaaaucuccuugcuaauuuucugucucaucaaucugucuaauauugacagugggcuguugaagucucccacuauuagugugugggagucuaaaucucuuuauaugucucuaagaacuuguuucaugaaucuaggugcuccuguauugggugcuccuguauugggugcauguauauuuacguuagcucuucacguugcauugaucccuuuagcauuauauaacgcccuucguugucuuuuuugaucuuuguggguuuaaagucuguuuuaucagagacuagauugccacccuuuuuuuuuuuuccuuuccauuugcuugguaaguauuccuccaucccuuuauuucgagccugucuguguuuuugcaugugagaugggucuccugaauacagcacaccgaugggucuugacucuuuauccaaguugccuucuguguccuuuaauuggggcauucagcucauuuacauuuaagguuaauauuauguuucaauuugaucaugucaucaugaugcuagcugguuauuuugcacauuaguugaugcaguuucuucauagugucauuggucuuuguauuuuggugcguuuuugcaguggcugguuuuuccuuuccauauuuagcacuuacuuuaggagcucuuguaaggcagaccugguggugacaaaaucccucagcauuugcuugucuguaaaagauuuuauuucuucuuugcuuaugaagcuuaguuuggcuggauaugaaauucuggguugagaauucuuuucuuuaagaauguugaauauuggcccccacucucuucuggcguauacaguuucugcagagagauuugccauuagucugaugcacuucccuuuguagguaaccugaccucucucucuggcugcccuuaacauuuuuuccuucguuucaaccuuggagaaucugacgauuaugugucucagguugcucuucucaaggaguguguuagugguguucucuguauuuccugaauuugaauguuggccugucuugcuagguuggggaaguucuuuuggauaauauccugaaauguguuuuccaacuugguuccauucuccucaucacuuucagguacagcagucaauggcagguuuggucuuuucacauagucccauuuuucuuggaggcuuuguucuuuccuuuucauucuuuuuucuccaaucuugucuucauacuuuauuucauuaaguugaucuucagucucugauauccuuucuucugcuugaucgauuuggcuauugauacuuguguaugcuucacaaaguucucaugcuguguuuuucagcuccaucaggucauuuauguucuucucuaaacagauuauucuaguuagcagcuccucuaaccuuuuaucaguguucauagcuuccuugcauuggguuagaacaugcuccuuuagcuuggaggaguuuguuauuacccaccuucugaagccuacuucugucaauucaucaaacucauucuccguccaguuuugugcccuugcuggagaggagcugugaucauuuggaggagaagaggcauucugguuuuuggaauuuucaguguuuuuugugcugguuuuuccucaucuucguguauuuaucuaccuucaaucuuugaggcugaugaccuuuaaauggaguuuuuguauggggguccuuuauguugauguugauguuguugcuuucuguuuguuaguuuuucuucuaacaggcccuucugcaggucugcugcaguuugcuggagguccacuccagauccuguuugccuggguaucaccaguggaggcugcagaacagcaaauguugcugccuaaucuuuccucugggaagcuuugucucagaggggcacccggccuuaugaggugucagucaccccccuacugggaggugccucccgguuaggcuacucgggagucagagacccacccgccuucugcauuggucucgcugggagcugcagaccguagcuguuccuauuuggccaucuuggucccuccccagaugauucuuuuuuuuuuuuuuuuuuuuuuuuugagacagagucucaccuuguugcccaggcuggagcgcaguggcccuaucucgacucauugcaaccuccaccucccagguucaagugauucuccugccucagccuccugaauaacugggauacaggcacaugccaccacaccuggcuaauuuuuguguuuucaggagagacaggguuucgccauauuggccaggcuggucuugaacuccugaccucaggugauccacccaucucggcuucccaaagugcugggauuacaaacaugagccaccgcgccugguccaaaugauucuuaucuagcacaauuguccuaagaauuaccuugugaaauuuuguuauuuuggaaaauguuaucuuuucuauauuucucuagaauuuaaugcaaauuauguauaugcauuucuuuaaucagaacuuguaugccagcaaucauguucauaauaauauuucuaauagguaaucauuguacuuaauacuaaagcauuuuuaaaaagcauggaaaagcaaaaauuuguuuuauucuugguaaacaggucuuuagcaaugucuugcuuuuugguaguuuuuguuuugcuaauccuuuuuucaaaaugccacuucuucuuaaaagccaaagcaauuguuuaaaaaucaaauaugucaggaggucauguuaguucuuuacccuguucacacuugcccaaccccaguaggaaccaggaaaguagaauugcuacucauaggugaacuuaugagauuuguuucucuuuacugaaguuguaugcaguggaaacuguaauguguuugaaauaugccugaagugucagguaauucuuuacacauaugugcaguauuuuaaaaguaccagauuuccuacucaucacuuuagaauuuguuuuaaaaauguguaucaggcacuguaggaaaucucaaauggaaauauauaucauuauccaaguauuugucuaaacuuagacaccugggguguuuuauuauuauccaucauccaguuggcaugaaagaaggggcaagaaaucugugauaaagaaugucaggauauuguuuugacagauaaaaaaugaacucuuugaauuagcaaauaaaugaaaauaauucuucuuaauuguccuacuaucuuuagagugaagaaauuagcauacguauuuuaucaacaguuguuuauaaaauggaguggaacuuuaagagacaauuguacugcugcuacuucuuauaaaugaaaauccuaggcauuuuaaaucuguguuugguuucuuuaucuucacauauaggcaauuuuuuucuauauuucuuagaucccagcguuugaauuuugauguaucaucuccuaauggaauucuucucuucagagaagcuaguaaaaugguuugcacuuauggugaguguccuuuuccauaugugccucugcaauauaguuuuaucucuuuagaggaaagaaagauguuaguuauuuuguucuuuugaacuuucauaucuuuaugaauuugugaagucgguaauacaagugcaaaaagccaguuagcuaucauauuggcaucaggagaaguaagcagcaugccuuugacuaaaucaugccugaccaacuugaugaauuucuuuuggauaaaauugcagugucaguagaugagggaauacacuagguagaauauugaaaaguuacagcauauucaaaauugcucaaaguuacaucagggaguuugcuauguugaaccaaggaaugcuuaaagcagaaugucacugaauugugggaaaauauccuuguaaagagcaguaaauauuucauuaugaagaacuuuuggguacugcgccucuagaagcagaguucuacaggaaagauuguccuauucaauuaaaguccaaaauaguauuugguuagcaguuugggccuuaaaacuauaauaaacucuaauaauugccaauucugacacugucaucaaugaaauucucuacucucugagaccuuuauguagauaaggaauggagaugggauggauaaaaauccucuguaaucuaauuuggcacacagugacugaauggcaacugagcugggcucugugcaaugcacuucuccuugaggaauguuucccuguguccuuuuuuucccucucuguucuuucccaaaucuacagcaaacuguuaaguaaauuuagucuguaaaguugccuguuauucuuuuuuuuuugagacggagucucacucugacacccagacuggacagugcaguggcacgaucucagagcucacugcaacauccacaucccaggcucaggugauccucccaccucagcuucccgaguagcugugguuauaggcacgccaccacgccuggcuaauuguuguauuuuuaguagagaugggguuucaccuuguuggccaggcuggucuugaacuccugaccucaagugauccacccaccucagccucccaaaguaaugggauuacaggcaugagccacugcacccagccgugauucuaauauuuggguacccagaaacaaauuguacaaaauuuuguaaaaucucuuuauuuuaauucuguauguguuuguguauguauguaagaacaaccaauagaagccuugucacuuuuuuuaaaguaaaagccuauuuuaaaaagaaaaaaauggguguuuuaaguuguuuuuaccucauuucagaacacauucuggggaucugagcuguauacauuguaggccuccauuaaaaauacuucauuuuaauugcacaucugauuuguagaauuugagauuuuuucauguguaaaaacuagagaaagcaccuguauaggacaguaaacuuguacucucuuauuuucaucuguaccaguaacuacauugccacaacuuuuguauccuguuugaaaauagacacauuaaaaucauauaaagugggcugggcacagugguuuaugccuguaaucccagcacuuugggaggccagggcgggcggaucacuugaggccaggaguucgagaccauccuggcuaacauggugaaaccccgucucuaccaaaaauacaaaaaauuagccaggcgugguggcgggcaccuguaaucccagcuacucaggaggcugaggcaggaggaucguuugaacccgggaggcagagguugcagugagccaauauugcaccauugcacuccagccugggcaacaagagugaaacucugucucaaaaaauaaaauaaaaauaaaaucauauaaaguggaaaugcuuugccuccuagagguaaaaaugaaccccuuuaaaaaauuuucuaaauacaauuugccauacuuuuuguauauaucuaauuccauucuauguuuuaucauauaagaugugugucuggaccuuuuuucaaaaacagcaugguauauuagaaaaagcacaguuuucagauuugcaagaucucaguacuaauccuguuaccaauacuuaccgacuucaugaccuucagcuaaaauacuauauauaccucuuuguggcuaguuuucuuuuguauaaaauuaggacuacuaaauaccuacugacuuaucugccuaguugggauuaagaaggcuaauugagcuauucugguaaaaggccuggcacaggagguaacauggaagaguuacucgcuguuuaugccucuccuuccaaagccuuucucuuauacucaccaacccagccuucuuuggacagggguucaacaacccacaucauuguuuugcucagcaguguuuccuguuuggaccacacugcccugcuuccucugccuguagccagugauuaguuuuuauuuccucucuuauuuaaaggaaauaaacagcauauauguauaagaaucucuuaguaaucaguagaacuuuaacuaugcauauguuagauuccuguuaccagucacaguugugucauuccuaccccuuuuucuggaucuuucuuuucacuaaauauauuuuuuccuuuaggguuuauuuacuguugcacuagggcuguuaagggaagugagcuuccucuuccagugucacugacuuucuaggacagaauguauguccaguaagugacaccaaaaggauucucacagaauaaugccaaaucuaugggcuucaaagguuguucuguucucuguuggguugucugacauagaaaaaggcauugcagcaaaaguugagaaaaauaacuaugugaggauuaugucggaggaggaggaagaggagacagaagagaaaggaaaugaagggauaggagaagugaaguggagugggggaagagacaaaacguccagagcauucuugcaaagaaaagccaguaaggaguuuucuuacacggaagaaagaugagauuagaguaaggcucugcuccucaauuuagacuaauaguauugguagcuuucacuuuguuauaagcuuuuauaguccuauauuagaccauuuaccauacauuacccuguugaauccucaagguagguauuauaugcuacucacuaguuaauaugaccuugguuaaguuguaagccucucuugcuucaguuucuuguuagagaaaauacuucaugccucaaagacaugguugugagaauucaguuagguaauguauggaaagcccuuagacuaguuaacgacugugauuacuguugugaagaaauugaagcucacagagguuaaaaaaaauugccaaauauuacauagcuagcaaguagcugaauuggaauuucauucagucauacugacaguggucuuuucauauucuuuacugccucuugggaguugccaaaguaagauuuuaccauggauauuuaugaugaagcacuguucuuuaaaguauggugauuucuaucucaaaacuuaaaggaaaucaaaguuucaaugaaaaaaauguccuucaacugggucaccagugacuuugacagugacuuugauacaugcacuuuacauagaauaauagaaaaauguuucuuaaccucuacugauucucuugcugguccacaucagccaucugauuugucugucuuuaccuucuguaauguuuuauuacccaggcuuuuaccucuggaaauucuaauauacacauuggaggaagaucauguaguugccauucaggagucuagaagaugagggaaagagugacugggagggcacagaagagccagcacuguuuaucucuuugguaagcccaggugaaggaaagggaagccaguggaggaaagaggccagaacauucugugaucccuucuguuuccauccucacuggguucuucucugaucaccucuccugagcaguuuuugguuaugaucagggcggugcagagagggaaggaagcauuuccaaaugcaacugacuuguuauguauuuugugaaauaccuccgccucacugcucugugagacuggcagaaaaauaauacuuuugauaugcuguuuuauuuaucuacagucugucaugauauacuuugauguaaguuuuuaauuuugcuucagcucucagcuccucuugccguuacagcucagggucagcaaugagguuagccacaguagcacaaaacaauuuccuguuuguacagcccagguaacauuuggaugaggauuaaauuuuaccacauuuucuacuagcccaagccuauuauuucuaaugaguuuuaaauugcuucaagaacauguauuucaaaacuuagugcuacgauccguucagccugagcaacuuaauaaaagaaauuucuuucuuaaauuuuugguuaaaauguugcaugcaguguaauaaauguuauuacuuuggaaaccuacuucucaguuuuaagaacuggaugauuuuuauguucaauuuccauuugucuaaucuuuccuucucuuugccucuggguccugguaucuuuagugacaucuguugguugaagagugcacagaagggagaaauaaugauuguuuucauaagacuggccaaaauagaacugccuucauucuuuccuuagguaccugauuuaagaacgcaauauauaaagauucuaaacuuuaaaaauggauaguacaagcuaugauuauucacugucauaagaauuuacaucaggauccuuuuaagcaguguaugcucuggguguauguaagguauaacuuaauaugcauaaauugaauuuguaaaguguuauacaagccacuguuauucgucaccaccuagauaauaggccauugguuuucacccuugguuuugcagagcuguagaggccugugaaagugccacagcagcccuccagaaaaagggggaaagaggaccacuuugccaccuugaccagaaccacccagcuauguaguuacacuagacuuguucguaaaagcuaucaccuguuaggacuuuuuuuaaaaaagaggcugaaaaucacuugcauguacuauuagaaguguuguaagaauggaagauuaagauuguauacaggcauacuucuuuuuguuguacuuugcagauacuguguuuuuuauaaauugaagguuuggagcaacccugcauggagcaaguauaucagugccagcauaugauuucuuugugucucugagucauauuaauaaauguguauucugacugcucugcuuuggccauuccccaucucuucccuucuccuccccacucccuauucucugacacagcaauauugaaaucaggccaaugaauaacccuacaauggccuacaaguauucaagugaaaguaagaguuguacaugucucacuuuaaaucaaaagcuagaaaugauuaagcuuagcgaagaaggcaugucaaaugcugagacaggucaaaagcuaggccucuugcaccaaacagccaaguggugaaugcaaaggaaaagcucuugaaagaaauuaaaaauucuacacuagcaaacacacaaaugauaaaaaagugaaacaaccuuauugcugacauggagaagguuuuaguagucugagaucaaaccagucauaauauucccuuaaggcaaagccuaauccagagcaaggcucuaacucucuucacuucugugaaggcuaagagaggugaggaggcuacagaagaaaaguuggaagcuagcagagguugguucaugagguuuacagaaaaaggccaccuccauaacaucaaagugcaaggugaagcagcaagugcugauggagaagcugcagcgaguuaucaugaagaucuagcuaagauucauuuugaugaagguggcuacacuaaacaacauuuuucacggagacaaaaugcuauuggaagaagaugccaucuaggacuuucacagcuagcgagguguaaagucaaugcuuggcuucaaaggacagacugagucucuuguuagggguuaaugcugacggugacuugaaguugaagccaaugcucaauuuaccauuuugaaaauccuagggcccuuaagaauuaugcuaaaucuacucugcaugugcucuagaaguauagcaacaaagacuggaugacggcacaucuguuuacagcaugcuuuacugaccacuuuaagcccacuguugaagccuacugcucagaaaaagaucccuuucaaaagguuacugcucacugacagugcaccucgucacccaggagcucugauggagauguacaaggagauuaauguuguuuucaugucugcuaacacaacaugcauucugcagcccauggaucaaggaguaauuuugacuuucaagucguauuauaucagaaauacauucuguaaggcuguagcugccauagauagugauuccucugauggaucugggcaaaguaaauugaaagccuuccagaaaggauucacuauucuagaugccaucaagaacauuugugauucacaggaggaggugaaaaucaauauuuagcgggaguuuggaagaaguugauuccaacccucaugggugacuuugaagaguucaagacuucaggggagaaauuaacugcagaugugguugaaacagcaagagaccuauaauuagaaguggagacugaagaugugacugaacugcugcagucucaugauaaaacuugaauggaugaggaguugcuucuucuggaugaccaaagaaaguggugucuugagauggaaucuacuuguggcaaaaagcuuuaaaauaugacauaaccuuaguugauaaaguggcagcagaguuugagaggauugacuccaauuuuuaaagaaguucuccugugggucaaaugcuaacaaacagcauuguaugcuacagagaaaucuuuugugaaaggaagucaauugaugcagcagauuucauuguugucuuauuuuaagaaauugccacagccaccucaaccuuuggccacuacccugaucagucagcagcuaucaacaucaagaccagccuuccaccaggaaaacgauuacaacucacugaaggcucagaugauugcuagcaauuuuuagcaauaaaacauuuuuaauuaugauauauacauuauuauuuuagaaacaagguuguugcacacuuaacagacuacaguacaguguaaacuuuuauaugcacugagaaaccagaaaaaaaaaagugugacuaacuuuauugggauauuugcuuuauuguaguggucuggaacugaacucacaauauuuccaaagugugccuauaguuauguauaaaugauacuuauguauaaaugauuacaagaagauagcuaaauaauucauuggucuugaaauaacuagagaguuaauaaaauaucaccaaaaaauaacaguucucgagagaauagauuguccaggaacuauggauauggucuucgaucuugucaguugguuaaggcauauaauaacaaaguagcagaguaagguucacagaagucuuguggacacaguggaaugaucaacaccuugggaucccaaaaucaggaucagguggcuuacaaagcaaggccuucaggaugauagcugaacacaugcuuagauuucaguggauuccuucauccaugcaccuaacauuuguugagcauuuacuuuuuuguuguuuuuuuuguuuguuuuuuucagucuugcucugucgcccaggcuggagugcaauggcacgaucuuagcucauugcaaccucugccuccuggguucaagcaauucuccugccucagccucccgaguaacugggauuauaggugcccgccaccaugccuugcuaauuuuuguauuuuuaguagagaugggguuucaccauguuggccaggcuggucucaaacuccugaccucaagugaucugcccaccucggccucccaaagugccaggauuacaggcgugagccacugcgccuggcugagcauuugcuguuaauacguuucugaugcugugagagauaggaagauaaauaagaugcaaaaggaaaaaaaaaaaaaaaaaagaauccaccugggcgcaguggcucacaccuguaaucccagcacuuugggaggccagggcgagugggucaccugagguugggaguucaagaccagccugaccaacauggagaaaccccaucucuacuaaaaauacaaaauuagccgggcgugguggugcaugccuauaaccccagcuacucaggaggcugaggcaggagaaucgcuugaacccggaaggcaaagguugcagugagccgagaucgugccauugcacuccagccugggcaacaacagcgaaacuccgucucaaaaaaaagaaaaaaaagaaucuuauagauucuucccuuaaggaacuuaaguccagcaggggagucggacaaaucaagaaagaauuaugauguguugugcuauguguuauccuugagaaguauuuagagugccauaggagcccagaagagauuucuagcugaaacuggggguuuagagaaggcaauauuucuugaagggaaaagaauaaggcucagaaguuuuagaagggcauuuaaagaagagaauagauuuuacaaagcacauaaauauagaacagccugguugguuaggaaacuuaaggaauuucaaaauugcugaagacuaaagcuaauguuaaggagcuuuaggcagugagagacgcccaguuaguuauguaguaacuuuugggucaaaguaaagaauuacaacuuuaggcugggcacagugacucaugccuguaaucccagcacuuuggaaggccgaggcguguggaucaccugaggucaggaguucgagaccagccuggccaacauggcgaaaccccaucucuacugaaaauacaaaaaauuagucaggugugguggcgggcaccuguaaucccagcuaccuggaaggcugaggcaggagaauugcuugaaccugggaggcagagguugcagugagcugagaucgcaccuuugcauuccagccugggcgacagagcaagacucuguuaaaaaauauauauauauauuacaacuuuauccuuaaagauauacauucuuuaaggaaaauacuggaugguaugaccauauuuacauuuuugagaaaccacuuugauagcguugugguaggugaauuauuugguguaaagcuagaagagagaggaacagaauuaggcuuuuuuugguuuuguuuuguuuuuuuguugagacaagaucucacucugucacccaggcuggagugcagugucaugaucauaauucacugaacccucgaaguccugggcucagguuauccuccugccucaacuuccugaguagcugggacuacaggcacguaccaccaugccuggcuuuuuuuuuuuuuuuuuuguaauuuuaagucgagauagggccucacuauguugcccaggcuuuucucaaaacuccuuaccucaagcaauccuccgcacucagccucccaaaguccuuggaucacaggcuugagccaccacgccuggccagaauuguuauuuaaauuagcauacaaucuuaguagacauaaaauuaugucuaccuuuccuaucucaacaugauucccuccuauaugauaaugugauuuuacaaaauuuauauuaucacacaaagaaaaguauaccaguucuugggaauuuauagaaucuuguguacuguuuuguaccaaauacuacucuaagacuauacguaggauccuugccaucuucaauauaguuuucuuuuuguuaauauucagucuaggacaagacauuccccaauaccuaauucuauuguuugcacaugagaucacucaagaagugguugcaucugacugagagacuagaaguagguuuugcugguagcuaccaguuaacaauugugcgucuaguugaaauuccuuucaacaaauaagaaaaaauacauaauuauuucaaaauaaacucuguaagcuuuaaauacggggaauuuauuuuuuuucuuuuucgguuacuugguauggcuccauggaaaagcaagaauuauaaaaaugucccuaaccuuuauaaacucauuucuauuuuucuucuaauguuggaaaugaucuaauaauggaaauaaucuaaugauagaggacagcuaacuacagcuaaagauccuugauguuacauuauucauaauagugaaaaaugggaaaacaaacaaaaugcuacaaauagcaaaaugcuugaaauaacauagaaggauauaucaguucaauggaauaaauugcaaccauuaaaaauuaucuuuuaagauuaccuagcuuaugggaaauacaaauaauaccauguaaagguagaauucaaauuucaccuaugcucuagguaauguuagacuucuauauauguggcaacaguugaaagaaaacagaaacuucaaaauaguuugaaauauugagguuaaaaguuaauguuuuuaagauuuuuauaucuacuaauaugcuuauaaaauaaccuauacaaaaucuuuuauucaaaaaagguagugaaucauacuuaaauuuguaauuaaauuauuggacaacauuacucuugagaguucagaaacaaaauuacaucagugcugaaauuccaucuucuaugucagcaacuuaugcuguaaaguuaaggaagguauggaaccaccauaagcauacagccugggguccacuuguacuaccaugucuuuuucuaucauguuuuucuguaccuaucacuuucuuucucaucuuuuuucaugcaaaauaauuucuuuucuuuuuuuucuuuucucuaacuauaaaauaauauacccaugggggggaaaaauccagcaauguuauuucaaaauaaauucuguaagcuuuaaauuuuccauuuuucacuugguacaggaaaagaaaacccccccauucaucacccaaaguuaaccauuauuaacaguuuaguguaugugcccuucuaugcuuuuuauguguacauauacacauauuuucccaaaagugauaucauaauauacuugcuagucuguaauuuguugguuuuuauuuauauuauggucauuguucuauguuaacauauauaaaucuaccucaucuuuuuaaauagcugcaaaauauuccauuuuauagucauacuauaauuuauuaaucgccuuuagcugaacaucugcuuuuccauuaucauacauagugcuucagucaauaacuuuguacauucagcuuugugaguuucagucauucauucaacaaauguguaauaagaacagcaguugcuguuccagguucuuuggauaccucagugggcaaaccaaaaaagaaauuaacuaguaauuagaagguagacugggcgcagcugcucaugccuguaguccuagcacuuugggaggcugaugcaggauugcuugagcccaggaguuugagacuaaccugggcaucacugugagaccccgucucuauaaaaaaaauuagaaaaguaaaagaagguaauaagugcuauuaaaaaagaaagaaagaaaauagauuaggauaagggggcaucuaagucccagagagugaaacaacagaaacucuuaauucacugcugguagaaugcagaauggcgcagccacuuuagaagacaguuuggcagcuucuuaugaaacuaaacacagucauuguacgauccaguaaucaugccccuugguauuuauccaaaggcaucgaaaacuuacggucacacaaaaacaugcacacugauacuuauagcagcuuuauucucaauugcuaaaacugauuuuuuucaauaggugaguggauaaauaaacaacaguacacccagacaauggaauguuauucagcacuaaaaaaaaauaaauaaagcuagaaaacuacaaaaagauauguaggaacugcaguccucuuacugagugaaagaagccaaucugaaaagccuuacauacuguauaaucccaacuacgugacauucuggaaaagggaaaacuaugaagacaguaaaagcucaguggcugccagugguuaggggacagugaaggaugaauaggcagagcagaggauuuggaggcauugaaacucugugugauacuauaaugguggaugcauauucauuauacauuuguccaaacccauaaaagguacaccaccaacagugaacgcugauguaaacuaugacauugacugauaaugauaugucaauauagguccagauuguaacaaaugcaccacucuagugggggauguugauaguagggaagcugugcaugugugggggcaggagauguaugguaaucgcuguaccucucucucagcuuugcugugauccuuaaacuccuuauuguaaaaaaaaaaaaaaaauacacacacacaucuuaaguaccagggauuuagggacauguugcauuauuagaguggucaagguaggucucauugaaaauaugacauuugaguaaagacuuccaguaaaugagggaguuagucacguggauuccuugaagaccagucuaggcugaggaaacagcaagugguagagucuuaaggcgggaguguaucuagcuugucugaagggcagcaaggaggucaguagcugaagcagauugaacaaaagggagaguaguaacaagaacaguaucauauaaggccuguagcccacuaacaucacuuugacuuuaacucuaaauaaaauagagggccucuagaacauauugagcacaggaaugacaugaccugaccuaaguuuuuaaaaaauuacucacgcugcuauauuaaggauagacuauagaggauuaaaguuauaagcagggaagucagauaggacaauauugcaguaauucaggcaaaguuugauacuggcuuugaacaaaguaauagcagugggaguggucagauucuggauauauuaugaaaguaagacaaaucaaauuucuugauucauugggcaaaugguaggacagaaaaaauguagucaagagauuugagcacaagcaacuagaaagaaguaguugccaucaacugagauggagaaggcuaagaugggugugggggaccaaaguucccuuuugguuauguugaauuugagauguccauuaauacccaaguagagauguugaaugccaauauggauuuuugauucuggaguuuggaaaauaggucuagggaguccuuugacucauagaugauauuuaaagcgcagaacuagguaagaacuaggaaugagugugcaugcuucagcacaccuacuacaacuaggggugaguguaaauauagaggaagacuuagguuugagcucuggugcacuccaauguuggaagguaagaaagaaggaacuggcaaagaagagugagaaggagcaaacacugaagaaaaucgagagaaugugucuuggaagacgagguagucaccuaugaccuaucgaaagcugccagucaaucaaguaagaugaaggcuaagagucagccauuacauuuagcaaccagaagucacuaguaaccuugaaaagagcacuuugaguggagcgggcauaaaagagaaugagaagagaagaaauggaaacaaugaauugagcaauaucuagcaggggaaguaaggccaagagaaguuuuugcaugugucuuuuuuuuuuuuuuuucauggaagagacaguagugugacuuguaugcugaugagaaugagccaauagcaaacaaacaaacaaacaagauugcauauagagaagggcaaaaauuguuggugccuugucuuuaagcacauaagagagaggagaugggaacuaguuggacauguugagggauugacuuuuacuaaagacaguauaugugagugcaaaugcuaguagaaagguauaaaugguagggaauauuaguauuagaaaauagaaauugauguacacacacacacacauauauuuuuucaagauggggucucacucucauccaggcuggagugcaguggugugaucauggcucacugcagcuucagccuccugggcucaagugauccucccaccucggccucccaaguagcugggacugaugaugcaugccacuacaccuggcuaauuuuuuguagagauggaauuuugccauguugcccaggcugaucucaagcuacuggacucaagugauccauccgcuucagccucccaaagugcugggauuacagaugcaagccauuucacccagccuuuuuaaaauauuuuuaauaagugucaccaaauugccuucuagaauaguuauacuaauuuuauauucccaacaauuuuuuauuuuucuaaauccuuaucaacacugcauuguguuaucuuuuuuaaucugaaagggaaauauuauauucccuccagucuuugcagcuucaauucugucccacaccauuuauguccagagaccuugcugguuugcagagagacaagaguggguugaguggccugaaguaaaggaaugucagcaaguugcaguucucuucgcauaacugcuccuuccaaugauaagugaagacauucagccuguacaguugucagcuagcuaucaaauucacuuuaaaauuuuagagauuaaaagagaaaaagaaaagguaaaucaaugugauugauugcuuuguaagccaagaaauaacauuguuuauacuguuaguuucuccugguauaagauacuacggugguauaucuuaucccuugcaucacuuuucuaaguauuuugaggcguagcaaauugguggaaugggaagcaaauagcaaaacuguaauccccugcagcuaauucucuauugaagaaacacaagaggcugucaaaugauagaguauugaccuuacuuugaauuguguaaaugaaaaggacuagagggaagugacauuauuuuauaccgcacacacucagcuucaccuccuccucuuuuugaggcuauaguuccuccaaaugugaacuuacaggaaaaaaaaaacugagccccaaguacuguguauugucauaguuuacauuuauagagcacugugccagcuacuuuacauaugcugucuccuuuacuccacguaagagccuugugaauuauagguguuauuauccucauuuuguagaugaggaaacugugaaguacacaaguuaauaaucugcucagauaccuagauaguaaggaaagaucuaggauucaggccaggucaguaugagucaaaagcccacacuguaaaucaguaccuucuguacuauauguuuaucuucuguuacaauauuaucuuauuauguaguucuccagcugaggccugugaaagaaagccauucuucuuuggguaaugggagucucuucugaagaggaagacauccuggagucagucacucagcaaaaaggaugggucucaggagaaaaaauaauuuuaaaaaaauacaccugagagucggucgcagaugagcaggagaugugacaucuuccuauguguaucccucuuuaaaaguacaucuugcaaguugucuagaaggguacuucugaguguuggaagcuaauaacaacaacaaaguccucuccaugaaggacagagaguggaggugaagaaggagaaccccaagcaguucucuuaagcuauuaaugaggaaaauauuucuaauaagccaaauuauguagaucaggaauuaucugugcucauuuccuaguuguuuucccucauuauuuaaugagauuucuuauacugcuacagcaaguacaagaguaagaaugggaauuccauaguacuugugccuccauuccccguuauugccuuuggccagguuaaucauucaauucacaguauucuuuuccccugagccccaacauagccucagcaucuaucuuacccagcuuacggauguuacaguaucuuuuuccccuccccaaauuauggcaaauguacucagugggaaacaauuagaguuuuuccuuuuaguucuagccuuugaaagucuguuuuauuucaguaaaguaugauuuauuugugugcugcuacaguaguaccaaaguagcagcuguuacugguuuuaguagcugcuaaccuggcaaugccaucaucuccuagcuguccaucagugcaauguagaucucccucuuaggaaggaaaugcugacaaggaaggaauagaacuuucuagguguggaguggagcagggaggacaaggagggauaucauaccuagagaggaagaucaaaagcaaaccuaagcccugucacuuuuguuuauacuaaugugagucuaacuccuagauuuucagcuuuuugagggcaggaucaacaauuucaguaaguauugcugaauaauacauauugaauaaagcugcauuccaguaaauaaauggauaacauggccaagccuucuuuuccauggucuuuuauuaucgccauggaaugcugaggcacuugagcaaaaugagguaguuuccuauuucagaaguauucaucauucuguugcaaggucaaaauaguauauuaauuacugucuuaacccauuuaugccuagucuuccauuauuaagacgcuaagcuugugggaguuauuuguauccuacugcucaaggucaucaccaaggucugauuuuucacacaaaaaaauuugcaaccuucggcauaaauggguuaauacagauguaucugacauaguccaaaaggcaggacauauaugccaaauugcaauauuaacauagagauaacaguuaugauucuaaauauuucuugaugauagauuaugcaguccuuuacagauuuuuuuucccaaucaggcaguucuuggccugccuauuucaucuguugcuacagaauauaggaccuuuccuuucccucuaaggauaucaacauaaaaaggccccaaaaguuuucucacuuuuacccuggccuucccaacaaacacaaaaccagugaaaauuaccaaaauuacccuagcucuuuucaucacauggguauacagugcuguucuuucuugggaaggggaaggagggaaaaugucuaaccuugguuuaaauugaauuugaggcaaagguagaaaaacagugguguagaacuguucuuuucugaaguaccuggcuuucuuagaccuucaugccuuugcacuucaucuacccagaguacaguccucuguuuacaaguccauguggcaacuucaauuauccuucaaacuuagccuguucugugaagccuuucccccugcccuccugccaaaggaaaguuagucucuuuuucuguucacauaacaucuugacauaccucucugauggcauuugucacauuguauggaauuauuuauuuacagaucgauuucccccaacggacugaacucccucagggcagagauuuuauuuuauucauuuguuuauacuaacaccucacacauaguagcuguuaaauaaaugcugucauauugaguugaaucuuuaugcaacuauuguuaucucucuaagguaaguuacauugagaucaugaaagaggguacagaauuugguauugaguaaauuaccagauaugcuucagccuucuagacagugguuuugucauucagauauauaaauuauaagcaaaguuauauggacuucuaaggcuacacagaagagaauaugcauauggaaaugcuccacauacauggaacagaucaaggcagaucaagaagagggaaccuuuacccugugcugguccuguguuucaugcucugcuagaaguauugguccuucuuaaccucuuaguacacaugugauuaccauaauauauauaugucagucaagcuucaaaccaggaaaaacaagcaugauaauacuuuuggaauggauaacuuauuuuagaaauuagaccuuauacaaucuuaggcaaagauggggaaauagggccaaaguggggaguuggagguucaggggaaaaauaucacugaucagcccuccugaaauaauggcauagacaaguuggaauuugcagggaaaucuagaaaccaggcacauuuaggugcuagaguggaacuaugaaaggauuaggggugagaagguagcugguguuaugguauagaagucaguagaaggcuguugcgucugcauagcuauugcuucuguaagugugcuaccaccuguuugguggugggcuuggagauauuggucagcagggcugguaguucuagacacaaacaggacaaggaagaacaaggacaaagugaaaccgagcagcauuucuaccuguuacucuuaccaccucuaaccacagcaaccuuuaaaaagucauggcagcuacuccacucccagcauccaaaucucacacaaaugucucuuuuggccaauucuagcccacaaccauaaagggaaguggauucuaagaaacuuaauucuuguuagcuaaguugacacaguguaagccacuauauuauacuucuaaauuuuguaaauugaauuuaguuucaauuuuagaagcaauacucauuugaccaggaaaaagcagagguaagaaacauauauuacuuuauauuuuuuuaaaacauuaucaaguauugccuaguaacauacuuacuagcacacauuucagaaacagaaaucauugauuguaaaugcuaacuguacuacagaagauuuuagggugaucauacaaacauuucuuugucuucugauggucaacgcagaauuuaaguacaauuuuuaaaacaaucaucucuugagaucuucugaagaaggaucuaagaagaaaaaggaaguaauauuuacuguacacugcaccaagaacuucuguguguguuauuucauugaauucguauaccaaaccugugaggcuccuaaaaaugaaguaacucaagaucaaauucauauaaaaggucaaaaauuugccgagaauuuaggguaauuuacaucucagucagguuaucuuuuucucuugacuuaguuuuauccuacuuuuuaaaauuuuuuacugacaggauaacacauagaguaaaaugaauagucuuaagaguacaacuuaaugaaauuuuacauaucuauguauacaucuguguaaucaccaugcagauaaaaauauagagcuuuuccaauauaaggauauugauuuuuccuugggccuuuuguacuuccagguaaacugccauauguauuuauauuuuuuauuacaaugaauaaaaaaaaauucuuaaaaauaugcugggaggaagugaacauuagcaguaaaguaaaaauguuaaauagugugucccauaacuacuuugaaugacaucuacuuaugucacuuucugcuuuuauccugaaacagguaaucagauccugucccuugggagccucucaaaagaucagauuuauccaaugaaacucaagggcaucuccaucugcuauucagcucucaagucugccuuguguggaaauuaugucagcuuuggcgucuucaaguuguauggggacaaccauuuugacaauguacuccaggcuuuugucaaaaugcugcugucagugucccacagugacuugcuaguaagcaaucaugcaucaugggaguguuuguaugaaaugugaaguaacaccaccacaggccuggaaguguuauaaugaagcccagggaguuagccuagaacauuuuauguuuuaagacagcauacuugaucuaacuuacagaauuuggaaaacuauaguggcuuuuuuuuuuuuuuagcaucucugccugauuauauagaaaccaauaugugcccaauguaguagcaguaauuacuugaguaacauagccaaaucaugcuuaggcuuaguucaggcuuucccaccugcucccacucaagguuacaaguaaaaucuggaaggccuuuguuagucaaccuguguaagaaaugcuucuugaucuccuaguggacuagugcaucaucuuccaccuuuauaaacuaaucuuggaauggcugcaucucaagccaaagagaggacuuccuuguaguagaauggaaugaucauugaaggauaugucuguuagacagaaauuacaaaguagaaacuugagucaaaucagccauauguuaaaaucaccucaucaaagaguuacuucacuacaguuaaaguccaccaagacaacugguaugguuccaagaauuuuucucuaauuuuuuuauucuaauagucaaacaaaccuucaacucaguaauucuccaacuugaaggugcauaagacucucuuaacguguguuaaaaauauacauuucagagccuacacuagagcuugucauuuagcgagucugaaguggggaucaggaaacugcguuuuuaacaagcaccccaagugauuccuauugaguuggucuuaacaucacuuuaagaaaugcuccucugguuucucuuuuuuucuuuuuuuuuuuuuagaggcagggucuugcuguguugcccagccuguucuuagacuccugggcuuaagcaauucuccugccucagccucccaaguagcuggaauuaccagcaugaaccuccaugcccagcuucucuaauuuaucuuacaaguguguuucuuugauacugguuuggauugcauuugagauuuuucagguaucuuucucaugcacuuaucuuuugccuguaguguaugguaaauauuaagcccuuuaccaaauuauuauuuaguuagauggauuagcauuauauuaauacaacagacuauggugccaaaucccauuauaacagcaaaugucuuuguguuuaaaaaaccaacaaaaaaaagguuuccuagcgacuguuaagcacuguucaguguuacaguauuccaauccagaaaaauaauucacacagucuucuaaauaucguacugcagggauuuuacuuuuaagugcuaaccauauaagguaaagagaucaagcgauuccuaucagaaccccuuuaaaugcuggauugggacucauuaugucauuugcucuauauauuuauugaccuuguguuuaaauaaguuuacaauuuccaguauuauaaaugacaauuuucacuggacuguaacauguauuuuucuucucuguggcuugacauuuaguauaucucuguguuguagcaauaccggaaacugagccagucuuauuauccacuccuggaaugucucacucaggaccauaugagcuucaucaucaacuuagagccuccuguacucauguauguucucacaucuaucucagagggacucacuacucuugguaaggaucauagaggacauuguuuccauaggaaaaacuugauuaugggcuuuuaauguaugugauuauugagacuaucauccuacaaagggggaaaagauauugugaacccaaacugaaagauuauaauuauuacuugcaagugggaaaaauguauuucuucauauuuugauacauagucaguuauguuuuaaucagcuuuacugagguauaauuuacauacaauaaaauucagugacuuuaaguggauaguucagugaguccuuguacaaauguguacauguacacaaacauaaccaccacgaccaauauguagcacauuuuuaucaccacaaaaagcuccuuuuuuuccuccuucuaaucaaucccuucccccuaccucucaccccaggaaacuaaugcuuucucucacaauaguuuucuuuuccagaauuacauucaaguggaauuguauaauaugaaguuauuugcaucuggcuucuuucauuuagcauagugacuuugagauucauucauguuauuuugaaaaucaauuaguuuauuccuuucuauugcugaguauuauuccauuguauguauuauuaguuuguuuauucaccagcugauggacauuuggguuacuuucauuauuugacuauuuugaauacagcuauuaugaacauuccuauacaaguauuuauguagguaaauuuuuuuuauuucucuuggguacauaccuagaagugggauuucuagguuauaugcuaaguguauuuuuaacauuauaagaaacuaacaaacuguuucccagagugacagugacagcauuuugcugucaccaacaguauaugaggauuccaguugcucuguauacucacuaacauuauuaacaucuuuuucaucuuagccaugauagugggugugaaguagaaucuucaaguugacuaaucuuuucuucugugauaccuaauauucuauuaauacuguauuuggggcugggcgcgguggcucagccuguaaucccagcacuuugggaggcugaggcggguggaucaccugagaucaggaguucaagaccagccuggccaacauggugaagccccaucucuauuaaaaauacaaaaaaaaauuagccaggcaugauggugggcgcauauaaucccaacuacucaggaggcugaggcaggagaaucacaugcacccagaugcacccaggaggcagagguugcagugagccgagacugcaccauugcacucagccugggcaacaagaaugaaauucugucucaaaaaaaauauuaaaagauuuuagcugggcacgguggcucaugccuguaauucuagcauuuggggaggccaaggcagguggaucaccugaggucaggaguucaagccuagguuggccaacauggugaaacccugucucuacugaaaauacaaaaaauuagccaggugugguggugugcgccuguagucccagcuacucgggaggccaaggcaggagaaucacugaggaugcaauaagccaagaucgcaccacugcacuccagccugggcaacgaacgaaacuccaucucaaaaacaaaaaaaggaacuguauuuguuuucauuuuagacauuauauuuuuauucucuagaauuauuuuuuauuuauuuauuuauuuuuagacagagucugacucuguugcccaggcuggagugcagugaugcaaucucaucuuacugcaaccuccaccucccagguucaagcaauuauugugccucagccucccaaguagcugagauuacaggcuugcgccaucauacccagcuaauuuuuauauuuuuaguagagauaggguuuugccauguuggccaggcuggucuugaacuccugaccucaagcgauacacccaccucggccucccaaaucacugggauuacaagcaugaacccccaugccuggacuucaauauuuuaauauugaauuuuuaaauauuuuccauuuuccccucaucagguuuauguuuuuuuaacauugaucauauguauaagauuuauaauaggccaggcgcgguggcucacgccuguaaucccagcacuuugggaggccgagcugggcggaucacgaggucaggagauugagaccauccuggcuaacacagugaaaccccgucuguacuaaaaauacaaaaacaaaauuagccgggcuugguagcgggcaccuguagucccagcuacccaggaggcugaagcaggagaauggcgugcaccugggaggcggagcuugcagugagucaagaucaugccacugcacuccagccugggcaacagagcaagacucugucuccaaaaaaaaaagauuuuuaauagcuguuuuaagguccuugucuacugaugugauuucuggaucuguuccuauggauuuuucuccuuaugggucauguuuuuuucauucuuaauauaacuuguuauuuuugaaugugugccagacaucaugaauuuuacauguugaauuuuauuucugugcuagauuuugguuuuuauuuuuuggagacagagcuucgcucuuguugcccaggcuggagugcaacagcacaaucucagcccacugcaaccuccgucucccggguucaaguguuucuccugccucagccuccugaguagcugggauuacaggcaugcaccaccacacccagcuaauuuuguuuuuuuaguagagacgggguuucuccauguuggucaggcuggucucgaacucccgaccuuggaugauccucuugccucagccucccaaagugcugggauuauaggcaugagccacugcacccagccaauuuugauuuuuuuaauguggauuuuauucuauccugcaguugaauaacuuuuggaucaguuugacucauuugagaucggauggcaacucuuauuuuggaguaacugggccccaccacuaaaguguuaaccuuaugacauuccagugcuccauguguuaugaaguuccuccacaaaugacuuccagcuuguaaucuucaggaauuauuuggccuauugcuuuucagugguucuuuacccagccuugggaguuucuucucauacuuuuuuuuuuuuuuuuuuugagauggagucucgcuccaucgcccaggcuggagugcaguggcaugaucucggcucacugcaaccuccgccuccuggguucaaacaauucuucuaccucagccucccaaguaccugggauuacaggcaugugccaccacgccuagcuaauuuuuuuguauuuuuaguagagacaggguuucaccuuguuggucaggcuggucucaaacuccugaccucaagugauccacccaccucagccuccgaaagugcugggauuacaggugugagccaccgcacccggccuuuucucauacuuuuauaagucacuguucagacaaacacuggagaggacucccuuggagagcuguagaacucucuuacguaggucccacacucugguacucuguacuacaaguuuuagcugcuuuagccuucccagauuucaaccuuuuauucuccaacucagugagccuguuuggcuuuguuuggguuuucccuuuacuagccugcaaucuggaaacugcucugggcaguaaacuugagcaauuguuuuccuccucucugguuuaaugauccuguacugcuuguuguacaauaauugaaaaccauuguuucguauaauuuguccuguuuucuaguuguuuggcaggagggcaaauucucauagcaguuaauucuucauggaauaagaagaaauucugucuucuauuauuacaguuuggcuggacauucuuuuaucuuacaucauaguaauacuugaagauuuugaauuaguuucaguuagcuauguuauuuucaacaugugaucuuguuaagacuuagaaucugcauuuuaacagacuuucaagggcaucuugacaaaguggcauuacgaagggaauacugaacuuggauuuaagucccagcacuaccacuuacuacuugugugaccaugggcacauguggugugccugcugcugucauagguguuucauguggauacuugacucucuucauucucagaaccauuuguauaccaaaagcagguuagguacucuaagagcacucuuuauucuuauauucuacuugguuguaagcuucugaagggcagaaacagugucuuacucacuauuuccagcuccuagcauuauaguaaguguucgauaaauauuuacugaaugcauuaauuagauaauauuauuuucauuauacagaugagguaagcuguggcucagagaggugaaacaauuugccuaagaucauaaaacuaauaagugaaugaccuaggaaucauucaaacucuaaaaccccuucuuccucaccacacuacccugcuagaucuaccugauaaaggucacagcuuugacagcuagaggccugguagagauuauuuucuuuguacauauuggugguuuaucuucagccucuuguauuguugcagauucacauuguaaccacuggauaacucuagcaggugaauuugggcccugugucaucaagaaaggggacuauuuagaauguugaaaguaacuacuugaauuuuuccuuucccaacaaugauauauuuuaaaaagaggaauuuauugguauuguuuggacuacaggcagguuuaauuucuauuguugccuugauggaaaaaauaaggagguacagaaaaguugaaucagugauagagugaugacuugccgaauauuccaaaaaugauacaaaaaauuuuaguuaauuucauucauuagcauuuuuaauuucaugcuaucuuuuuaaucauccauccauucucugcccaccccaacccgcaacucuuaugcacagacaccaagcacagugucuucaaaaagcugcucuuacuaauggcucugaacuccuucauucaguaauuaucaguugugcauauacuauguaccaaguaccuuucuaaaccuuggcaguacugaagggaacaagacagauaagauuccugcccacaugaaagcuugcauucuagugggaagagauaagcaauaauugaacaaacaaauacacaugccaaaaaaaucaaaucauuauaugcgcuaaacaaagaauuaaaauggggugguggaaaaagaauaagucaagauggcugacugaagacaucagacaucugcccucucccaaaagaagaaccaaaauuaugaauagauaaucuuauaccucgaauagaacaucuagaagagaagacuagaguccuauaaagaacucacaggaaggcugggcgcguuggcuaacgccuguaaucucagcacuuugggaggcagaggcgggcagaucacgaggucaggagauugagaccauccuggcuaacacggugaaaccucgucucuacuaaaaauacaaaaaaauuagcugggcgugguggcgggcgccuguagucucagcuacucgggagacugaggcaggagaauggcaugaacccgggagguggagcuugcagugagccgagaucaugccacugcacuccagccugggcaacagagcgagacuccaucucaaaaaaaaaaaaaaaaagaacucacaggaaacauuuaaggcacagaaagagaaggaagcaagcagccagcucggccaagauuggccagaaagcccagaggggcucaguauugcagagaaaaggguaaaugagagaacuuaggcaguccacgugccugccacagacuacugcaaucuaaaccacaugaaagcuuuucuacccuuaugaacucaacauuaacaugagcagugauuugaagacccuguaaaggcauugcaccagccagggaacuggugcugggucacucacccuuccagaccugaaaaggugcagcaggguaccauuugaagagugcagccaucacaggacugcaucugccccuggaaaccacagcccuuguaucuccacauccugagaauuccugcugacauuccccaguguccacccagagagcugcacucacccagccugcaccacucaagacccaaagggucauccuaccacugcuacuuccaucacccaugccacgugggccacccaaggacccuagaaucugcucgcccacccagcccaccgcugcuacuaccagcauaugugcaagccaccuggaggcccaagaaucagcuugcccauaacugccaacacaagugccagccuauacuacccuggggcacaaagacaggcacguucaucccaccauugccaccacugggccugaagacugagaccugccugguuucccagcucccagcacaaaauuugccacagcuuccacuaauaacugcacccuaacccuccaagaaaguuacagaaagcacuaaugcuacuuacaaccaaagaaauaauacuacacuacuauacuacugcauacauccacaaucaaagccaaagugcccuacccaaccaauaccacagauacuucuucaggaaaaaugccuccccuaugaaaguaaauucaaaaacaagaaaaagugacuguuaaacuggauguacagauaucaacauaaggccacaggaaacaugaaaacaagaaaauaugacaccucccaaggaacacaguaauucuccagcaauagaucuuacucaaaaagaaauuuucaaaaucccagauaaagaauucaaaauacugauuuuaaagcagcucaguguguuauaagagaaaucugaaaaacaauacaaauacaauucaggauaugaaugggaacauuaccaaagagauuuaaauaaauaaauaaauagaaauucuggaacugaagaauucauugagggaaauacaaaauacauuugaaagcuucaauaguuggcuagaucaggcagaagaaagaaucucagaacuugaagacaggacuuuuucaaauaauccagucagacaaaaaaaauuugaaagaaaaagaaugaaccaagccuucaugacauaugaaacaacauaaagugauugaauauucaaauugccagcauccaugagaacagagacaaaggauuagaaagcccauuuacagaaauaauagaugaaaauuucccauuuauuacaagaaauguagacauucacauacaggaaacucagugaucccuaggaagauacaaugcagaagggucuuuuccaugguacauuauagucagaauaucuauaguaaaacuuaaagagcaaauccuuaaaacugcaaaagaaaagcaucuaguuaccuauaaaaggaaccccaucaggcuaacaguggauuucucaggagaagcuuuacaggccagaagacaauggaaugauacauucaaaguacagaaagaaaaacuggccaagaauacuacauccaguaaaauuaaccuuuguaaaugaaggagauauaaagucuuuccaagagaagcaaaugcuaagggaauuuguuuguuaccacuagacugcagccacaagaaaugcucaagggaguccuaaaccugaaaacaaaggaugacauuuaccaucaugaaaacacacaagaguuuaaaauucacuaguaaagcaaucacacaaagagaagaaaggacuaaaaugguaccacgacagaaauucaccaaaccacaauuaguaagagaaaaagaugggaaaaaagaauauguaaaacaaccagaaaacaauuaacaauaugacaggaacaaaccuucacauaucaguaauagccuugaacauaaauggauuuaaauuauccaguuaaaaagauauagaauggcugaacugauuuaaaaaaaaaauuugauccaacuauauacugcuuacaagaaacucaccuuggcaguaaacacauauagagugaaaguaaagagaaggaaaaagauaauccacacaaacaaaaaacaaaagcgaacaggaauagcuacccuuguaucagauaaaaccgacuuuauaucaagaaaaggggaaaaaagacaaagaaggucauuauauaaugauaaagggaucaauccagcaagagacuauagcaguucuaaauauguauguacccaacacuggaacaccuggauuccuaaaaugacuaaauuugaagagacacacuacaauauaauaauaguggaggacuucaacaugccacugucagcauuaaacagaucaucuagacaggaagucaacaaagacacuuugcauuuaaacuggacuuuagaccacauggaauuaacagagcuacagaaucuacucaacuacagaauauacauucuuuucaucggaacauggaacauucucuaggauagaccauauguuaagccacaaaacaggucucaacaaaaauuuuuuuuagagacagggucucacucugucacccaggcuggagcacaguggcguggucauggcucagugcagccuuguguucccaagcucaagcaauucuccugccuuagccucccaaguagcugggacuacaggcaugugccaccaugcccagcuuuuuuuuuuagagacagguuuuugcuauguuguccaggcuggucucaaacuccugggcucaagcaaucugcucaccuuggccuccuaaagugcuggaauuacaggcaugagccaccgcaccuggcccaacaaauuuuuaaaaauugaaaucauaucagguaucuucucagaccacaguggaauaaaaccagaaaucaauaccaagaggaacuuggaaacuauacaaauaaauggaaauuaaagaacacgcucccggauaaucauugggucaauguaaaauuauaguggaaaaaaaaaaaaaaaacuucuugaaacaaaugagaauggaaacacaacauaccaaaaccugugggauauaguaaaagcagugcuaagaaggaaguuuauaggcuugagcgccgguggcgacgaaggcaguggcggcccagcgggcucaguguguggguccguggcggcucgggguccacccgcgggcugcggugcgagcagguggccccguuccccuccucccgcgcccgcccccgccucugugauuggguggaagauggugcuggccggauguaaauccuaaugacagucuccaaauucgcuuccaucuguaccaugagugccaaugcuucggcauuagagaaggagauugguccagaacaguuuccagugaaugagcacuauuuuggauuagucaguuuugggaauaccugcuacugcaauucaguucuucaagcacuuuauuuuugucguccauuucgggaaacaguucuugcauagaagagucaaccuaggaaaaaggagagccuucuuacaugcuuagcagaucucuuccauagcauagccacucagaagaaaaaguuggaguaauaccucccaagaaguucaucacaagauuacagaaagaagaugagcuuuuugacaacuacaugcaacaagaucccccaugaauucuuaaauuaccuacuaaauacaauugcugauauuuuacaagaagagagaaagcaagaaaaacaaaauggccgcuuaccuaaugguaauauuaauaaugaaaauaauaacagcaccccagacccaaugcggguucaugagauuuuucagggaacauuaacuaaugaaaccagaugucuuacuugugaaacuaugagcagcaaagaugaagauuuuuuagaccugucuguugacguggaacaaaauacaucaauuacucacugcuuaagggcuuucagcaacacagaaacccuaugcagugaguacaaguauuacugugaagagugucgcagcaaacaggaagcacacaaacggaggaaaguuuaaaaacugcccaugauucuagcuccacaccugaagagauuuaaauauaaggaucaacuucaucgauuuacaaaacucucuuaccagguaguuuuuccuuuaaaacuuagucuauuuaacacuucaggugaugccaccaauccagacagaauguacagccuuguugcuguugugguucacuguggaagacuuauuuguagacuugcuucauaugaaaguguggagggugugugcagccucauugucagcauuggucccagucgaggccauuguauuguaauaguuaagagucaugauuuuugguuguuguuugaugacgacauuguagaaaaaauagaugcacaagcuauugaagaagucuacgggcugacaucagauaucucaaagaacucugagucugguuacauccuuuucuaucagucucgggauugagggggaaccgugaugaagagauacuuucugccgcauuucuucucugguuauuuuggaaaggaucaagcacugauuuuucaagaaaagagaaaaugcaggaagcucugggggcaguagcacacuuugcacacgauaaagcaaagacgauggauugacaagcccuuccgaucacaguaguugauuuauuugcucagguaucaugcugucuguacaguuccauucaacaaggaggugaaaucagagauaccaguuccucuuguaaaacagccuuccaguauuaacaugcauuuucucuuuauuaauugcaccaauaaugccaugaauuccuugggggugcaguagaaagaaucggaaucugugcuguacugauaaggagaugauguugaacacacugcauaaauuugccugguucaguauguauagaagcauauucaguggucuuuucaagaguaaaccagaaacacuuuugggcccaacacuugcaguugccuuccugauguaaaaacuaacaugcuagauaauccagugucaggaagacaaagauguuuugguucucugaagaagcuuauaauaauacauguagggagcaauuggucaaaaguggcuuuuuguuuccccaaggggaaagacuggcuuuguaaucauaauuuuuuccuuauuuauuuuacuuaaaacugguagagucuaaguauuguaugaagugcccaugauucugucaguaaauuugagcauauuuuuauuaguuaaugucaguuuaaguaguccuuuuguuuguuucuauuuuuaaggugaauuuuaaauuauaucugaaaucaguaagauaccuugagaaaaacugcaaugagaggagguaaauauccuuuuucaggaggaacugauaucucuggccaaauauuuguccuuuuauuaugguuucuaaaucaguuauuuucuucagcuuuaauuucauaaaauuaaaaaacuauaaaaaauauuccuggcuaggcgcgguggcucacgccuauaaucccaacacuuuaggaggccgaggcggguggaucacgaggucaggagaucgagaccauccuggcuaacacggugaaacccagucucuacuaaaaauacaaaaaauuagccgggugugguggcaugcgccuguagucccagcuacuugggaggcugaggcaggagaaucacuggaaccuggggggcggagguugcagugagacgagaucaugucacugaacuccagccugggcaacagagcgagacucugucucaaaaaaaaaaaaaaaaaaauuccuguaguuguuggaauaauuaaaaauucuagugcaguggugguauaccaaucuuuagaauucuuaaguauucuaauguuccaaguugaggucaugcuugggaaaaucaugucauagcauuuauguuauuuucagaugucauuuuuuuacccuggaaagaaguaauaauguucaucauaacccuagcagccuggauagugagcuaaacaaacccuuugaagauuacauuuuaaucaaguagacuaggaauacaaaaaauaagucuuuacuccccuuccacccaccuuuacaaaucuuacuggaaggguguucagaaauuaaaauuuguguuugcuaagacuuuauucuguuggggguuuuaagaaguaauauauguacauaauauauguaaaccauugcaguuuuuuuggacacuuuuccaugcauuaguaaguugucugacaguagccgaauguaacuugcagaaaauuauugaaaguuauauucaggauaauagcaaucaggcguuggauguucuuuauuaaacucuuuucaggcaguaaauuuuuaaaaaaaucugucauuuucuaaaauucuuuugcuaaaacuguugacuauggaaaaacaaacaacaaaaaggaauguuuuuagucugcugcuauuauuaacauuuauuaucuguaucuuuuggcucaguaaaugacuucaccuauuucuuccauaagcagaucuuuaacagggucacuuagguaauugggcugcuuaaacagaugugcuggaagaaaauuauaauauuuaguauuuguacuaaauaucaaaaguauuuugacaaguuucucuuuaagauaguuucuaaagccuuacccuggcuagagauguuuuguacaaauuauauauagccugccugaucuaccaacaugccacagagaaucacagucaacaauguggggaaagucagggcaguggaaguggaugcacacuuuguauuuugagggcuuaaaucaaauugucuugaaauuaaagcuguauuucugcagcuuucaguacagagaaaaagaggaaagugaagcugugucaguuuuaacauuagcuauaucacaacauguuuaagaaagauagaugaagucauuugcauuaaaguacagcauugaaauacuacauuguguuuauuuuuacauuuuugcauuaaaaaaaaacaugcaguaaaagccaaguuaaauuucauauuaaagcaaguucuaguauauguauugaguuccugguagucacauaccuuguucacaucuacaccauacuucauaguaugauuuguaaggggagggacuguggggugacaguuuuacauuuacuuuuucuucuuaaugcagcuggaucuaaguaaaauguuuugaaguuuaucaaaaauucaauauacuuuuaaaacauauagggucaggguugggggagaaaauacagguauaguaaguaagaagugaccuaugaagaaagcguugugagguuauauguugguugacugugauuaaaauguggggcugguuuaaguuguaaaugguggcugauugcuguguaacuauguacaugauuguuaggauggcuguccuauauuuuguauauuggaauaaaaauuucuauaaauuauuguaacuaaaaaaguaaauauucuaaauuaaaucccacuucuuaaaucacauggcuucugucuuggaaauuuuaccuuuaaaagauuauuuaagacaggaaccaggaggcuugggaauagggaaaaaaggaaauguuguauuauaugggucuugugguaaccaucgguauaggguuuuuucuuuccuugauggcaguagaaagaccacauuuucauaacauaacuacucuugauacuuucuuuaaaaacacuuuuuaucaaagauucuaucaugagguauuugacugggagcugagaggcuaaagcgcucauguccuggcucuucagugaauuuaacugugugaccuugggcaagucacuuaaccucucugugcuucagucucacugucuuuuaaaaugggaguaauaccuaccuuacaggguuguuguggggauuaauuagagauaaugucuguaaagcauuuaagguucuugaagaaggcgcuauauagauacaaaauaauaucuauuaaaguugguuuauuuguggaaaaaaagaaggaaguuuauagcaauaaaugcuaauauccaaaaaaguggaaagauuacaaauuaacaaucugacagugcaccucagggagcuagaaaagcaaggaaaaaccaaacccaaaauuagcaguagaaaagaaauaguaaggaucagagcagagcuaaaugaaguagagacuaagaaauaaaaaauacaaaggaucaacaaaacaaaaaguugguucuucuucaaaaagguaaacaaaauagguaaaccacuagcuagacuaaccaagaaaagacccaaauaaaaccagaaaugaaaaaggagguguuacaacugaucacagaaauaugaaagaucaucagagacuauuaugaacaaugauaugcccaccaacuagaaagccuagaaaaaaauggauaaguuccuggaaacauacaagguucugagauugaaccaggaagaaauagaaguccugaacagaccaauaacaacuagugagaucaaaucaguaauuuaaaaaaaaaaaaucccagcaaaaaaacucaagaccagauggauucaaauccagacguacaaacauacaaaaccaaauauacaaagaagagcuaauaccaguccuccugaaacuguuccaaaaaauugaggaggagggaacucucccuaacccauucuaugaggucacuaucacccugguaccaauaucagacaaggacacaacaaaaaaacuacaggccauuaugaacauaggugcagaaauccuuaacaaaugcuagcaaaucaaauccaacagcauauccgaaagauaguacacgaugaucaauugggauuuaucccaggaaugcagcguuaauucaguguacacaaaucauuaaaugugauacaucacaucaacaaaauuaaggacaaaaacccauaucgucaucugaauagaugcagaaaaaccauuugauaaaauccagcauccuuccugacaaaaacccucaacaaacuaggcuuagaaggaacauaccucaaagcaauaaaggcacguaugacaaacccacagccaaaaucauacugaauggggaaaaguugaaagcauucccucuaagaacuaaaacaagacaaggauucccauuuccaccacucuuauucuacacaguacgaaaaguccuagccagagcagugaggcaagagaagaaauaaaaggcauccagaucggaaaagugaaagucaaauuguccuucuuugcugaugauagaucuuauauccagaaaaaccuaaaaauuucaaaaaacugagauuugauaaauaaaugcacuaaaguugcaggauagaaaaucauuguacaaaaaucaauaguauuucuauauaccaauaaugaucuauccgagaaugaaaucaaguaggcagugccauuuauaauagcuauaaaauaccuaggaagccaggcacgguggcucacgccuguaaucccagcauuuugggaggcugaggugggcggaucaccugaggucgggaguucaagaccagccugaccaacauggagaaaccccgccucuacuaaaaauacaaaauuagccggagaugguggcacaugccuguuaaucccagcuacucaggaggcugaggcaggagaaucgcuugaacccaggagacagagguugcagugagccgagaucgcuucauugcacuccagccuuggcaacaagagcaaaacuccaucuaaaaaaaaaaaauacacacacacacacacacacacacacacacacacacacacaccccuaggaaugcauuuaaccaagaaggugaaagaucucuacaaggaaaacugcaaaacacugaugaaagaaguugaagaugacacaaauaaauggaaaaacauccuaugcucauggaucggaagaauauuguuaaaauguccauauugcccagaguaauguauagauucaguguaaucccuaucaaaauaccauccuucuucacagaauuuuuuuuuaaauccuaaaauucauguggaaccauaaaagagccugaauagccaaaguaaucuugaccaaccagaacucagcuguaggcauugcauuaccugacuucaaaauauauuacaaggcuauaguaaccaaagcaaaaugauauugguaugaaaacagacacauaaaccaauggaacagaauagagagcccagaaauaaagucacauacuuacagccaaccgaucuucaacaaagcugacaagaauacacaauggggaaaggacagucucuccaauaaaauggugcuggaaaaauugggcagccacaugcagaagaaugaaacuggaccccuaucucaccauguaaaaaaaucaacucaaaauggauuaaagacuuaaagcccaaaacuguuaaaaaaauacuagaagaaaaccuagggaaaacucuucugaacauugaucuaggcaaaaaaauuaugacaaagaccuccaaaacacagcaacaaaaacaaaaauuagacaaauggggcuuaauuaaacuaaaaacugaaucacaaaagaaauaaccaacagaguaaacagacaaccuguugaaugggagagaauauuuauaaacuauucaucuaacaggagaccaauauccagaauauauaaggaacucaauuaauaggaaaaaacaaauaauucccuuuaaaacugggcaaaugacaugaauagacauuucucaaaagaagauauacaaacagccaagauguaugugaaaaaauguucaacaucacuaaucaucagagaaaugcaaaucaaaaccacagugagauaccaucuuaccccugucagaauggcuauuauuaaaaaggcaaaaaagagcagauguugucaaggaugcagagaaaaggaaacucguacacuguuggugggaauguaaacuaauacagccacuauggaaaacaguauggagauuucucaaaaaacuaaaaauagaauuacuguucaauccagcaguccuacuacugggaguauauccaaaagaaaauaagauaguauaucacaggacugccucacucaaauguuuauuacaucaguauucacaguagcaaagacauagaaucaaucuaaguaucuuaucaacagaugaauggauaaagaaaaugugguauacauacacaauggaauacuguucagccauaaaaaaagaaugaaauaaugucuucuguagcgacauggauggaacuggagaagugaaauaaaccaggcaaagaaagacagauaccacauguucucauucauaugugggagcucaaaaauuuaaucacguggagguagagaauggaaagauagauaacaagggucagacaugguggcucacgcccguaaucccagcacuuugggaggcugaggucaguggaucacuugaggucaggaguuugagaccagccuggccaacauggugaaaccccaucucuacuaaaaguacagaaauuaacugggugugauggcaggcgccuguaaucccagcuacucaggaggcugcagcaggagaauggcuugaaccugggagguagagguugcgacaaaccgagauugcgccacugcacugcaaccugggcaacagagcgagacugucucaaaaaucaauaaauaaauauaaaauaaaaauaaaaauuaggucgggcgcaguggcucacaccuguaaucccagcacuuuggaaggcccaagugggcagaucacuugaggucaggaguuugagaccagccuggccaacauacugaaacccugucucuacuaaaaauacaaaaauuagccgggcgugguggcaggcaccuguaaucccagcuagucggggaggcugaggcaggagaaucgcuugaacccgggagguagagguugcagugagccgagaucacgccacugcgcuccagccugggugacagagugagacuccaucucaaaaaaaaaaaaaaaaaauuaucugggcaugguggcacacacaccugugguggcggcuacucaggaggcugaaguaagaauagcuugaacccaggaggcggagauugcagugagccgagaucacugcacuucacccugggcaacagagcaagacuccgucucaaaaaaaaaaaaaaaaaagagauagauaacagagacgaaaaggugagugggggcaagggagaggaugaagagaaguagguuaaaagguacaaacaugguaagauggaaggaaaaaauugaauguuugauagcagaguagggugacuauaguuaacaaaaagguauuguagucaggugacagaaacccuaaguaucauauauugaucagaaagcauuauauacuuauaacaaaacuucacauguacacuauaaauuuguacaaauuuaaaaaacaaagugggguguuggauagagagugucuaaauguaggcugauggaggaaggccucuaagauuagucauagcagggauggaugcauuucaagcagaaaugaaggguagccuaaaagccuaaacaaggaaagguaagagcaagcaaaaaguugaaccaacuaggaacuacuagaucauuucccaugaaguucauuauuaauaaaacguauauaaagaacaaaagaggauauguuguuauuuuggacacauuauugaauuggaugucaugugguaugaauguaauaugcgagugacacauuuaggaaauauuuagaacuuagagauuuuacacauuagcuucaccccccaccccccccaaaaaaaaaaaccaaaagaaaaaaaaaaaacccuaaagagagaagaaugcuuugguguuuaauggauugaaacagccaggaaaacaaaugggaagggaaaaccuuguauguguugggugcuguauuacaguuuuugcccacuuaaucuuaaugccaaaccuuacaaagcagguaauauuaaucacauuuuacagaggugcaccugaaccucaagaagucaagcaucuaggaaauaauagauucaaaccuagacucaccuauuuccaaaaccacugccccacccaaauaggccuuuugucucuggaauugcccuucagacuauauuuuucuaagaccuucauucuccuuuguguuguggugacaaguuuugagcuuaaggcagauuucgguucagccucauucuuccugauucucaguuaagcaauucuuuccuauacaguuaacuuuucagcacagcuuucaaugaugggucuuagugagcaguaggcuauuaaugaugcaugugcuuccuguggagacugguuccagaagagaagcacuugauuguuuucaaugccaaacaacaaguugcuacagaggacaaaaugccuauuaggcuuaaaaauuauuuccaaaauugcagauguaaucccuuuuaaaauauuuuaaacaccaagaacuaggacaaaauaugaaaauucaugaccucugccuguguuuuaugucuggaaaauaucaugauuugaaucucacauaguagcuugagcugcaaauaaagaaaaccaauaguuaacacauagucuucagcaccauucauucuguuuuugaccaaaugcccugugauccuuaugauuccacacuuuaaaaucuaccuugaaaauaacauuuaucuuuuucaaaguccucaaccauaaaucaaccauaauggaagcucuucuugcuuuuauugcgaggauauaugcuccaaucuucguggcuaaaguguuuaccuggcuuuuucacagcugacucaguagaugggaaccuuuuaaugcaaccugcauggcauguggucaccaaaucuaugugaagucuuuauaauuuuuauaugauugauagcauauugcuuuucacuggugaggggaaccauaucugcuuccugcuuaucuuuguagaugucgaguuacauaauccauuuacuuucgugacugggacuugaaauguagaaauaugaaggaaaagagaaaagcaaccaggcucaacaagucuguauuugacuuuuaggccuagacauuuuccauuuauacuaugcuacaucccagaguuguaaaaccaaagcucccuuuucuacaaaguaacccaguuaauacggagagaugcagaagaaauuaacuaauuaaucaguuauugauuaaucaaucaaaugccaugucuuuaggagggaaagcucuauuuuuggcuuuuauuauuuuuaauugacacuugauaauuuuuuauauuuauggaguaccaugugauauuugauauagguauacacuguguaaugaccauuuaggguauccaucacugcaaacauuuaucauuuguuuguguugggaacauucaaaaucugcucuuuuagcuacucaaaaauauauaacaaauugcucauuauagucaccuuauuagugcuacagaacacugcaacuuauuccucuuaucuggcuauacuuuuguauccauuaaccaaccuuuggaaaagcuccuuucuuaaaagcuuuguaguuccacaguuuuccaaaacuaugguccacggcugucuucuagaccuccauucaaccccucaucccucaugauccuguauuagcuaccauuuuccucuguguuaaaugcauacgacuguauuucaaaacuugccccaaaacuucccucuuucuguuuuccaugacauuucucucuaaaaugauaaaugugagcuuuuaaacuguaguguuuuaucaaugcuggguuuuacuacuaaacacaacuuaagacuucuaagaaaacuuucugggguuagcuuuagcuacucauucuuuaauuaauucugcugauauuucaccuguaaucuacgucaggcauacauaugucucagaaccucagagaugaauaagaugaaugagaaacuacucccuuaggaaguuuauaaucugcuucccaacccuacucuuuuagucuccuucuccucuucugagucuaccugcucaccauuuuaacuguugcucuuguuaacuguuucucuuacuaaucauaaacucccagggaucaugugcaaauguugucagccaaaaaauguggguggugucaugcugauucaaaaccauggacuucugauaagcaacuuaaucucuaagcuucaguuuucucauuuaaaaugcaaauuauacuuacuauaccaaguaguuguuagaaguaaaugagauaauaauuuuaguguacaaaggagauaauaaaugguugcucuaucacuuacuugucaguaacaccuccauuaaccuuucauauuaaauguaaaugucgcacuccacuauuggaugcccucaaguaagauccucaaccugcucuguuggccuucucuuacaucuccucuacacauucacucucugaaaccaaaaguucuacuucuugaauauacccuucucuuuuuaccaugaggcaaaccaguaguuacugccauguuuugagugcccauugugauucaagaagguguuuuagccugggcaugguagcacacaucuauaaucccagcacuuugggaggcugaggcuggcagaucgcuugagcucaggaguucaaggccagccugagcaacaugcaaaacccugucucuacaaaaaauacaaaaaguagccaggcaugguagugcacagcuacaguccuagcuacuugggaggcugaggugggaggaucacuugagcucaggaggucaaggcugcagugagccaagaucacaccacugcacuucagccuuggugacagagugagaaccuaucucaacaacaacaaaaagguguuuggugcuuacauauauuuuugcuuauuaccuaguuuuaauguagugguuaagaauacagauccagaaaaaacaaaugucguauguucccauugauaagugggagcuaagcuaugaggacgcaaaggcaugagaaugauacaguggacucuggggacucagguagaaggaagguagguggggugaaggauaaaagacuacacaauggguagaguguacacugcuugggugaugggugcaccagaaucucagaaacugccacuaaggaacuuauucauguaaccaaaaaccaccuauuccccaaaaauuauuggaaaaaaaaauacaauaaaauuuucaaaaagaguacagauccagaguucaacuccuuguuuauuuucauaccuuggcugugcagucuucuagcugugugacaauggacaagucaccuaagcucccuaaaacucaguguccucaccuguaaauggagauaauaacaguaacuauuauagugcuguaugagaauuaaaaauaauaacauguaaagcaguuaacacaguaacucauaguaagcucuuaauaaaugucagcuuuuuuauuaccaaugaacuucuugucauuuucuucucauucaacucugcaaggucuuuuauaaauggugaaaaaacgugaaguagcucuuucagaucagcaacucagaaaguaauuggcaaagauaggacuugaaaccagaacugucuggcuccaaaauccauaucuuucccaccacacuguugccuugugcuaaucccucuaccugaaaaguguccuuccuuaugucuaauuggaauaaucuuuugaaacccuaucaggugcugccuccuucaccaaacucuccuugauccccaucuaaaugugauccgucccucaaaauccucaauuugucauuuuuacacagcauuaugcuacagugacuugcacacuaaaccaugaguucuuugacaccaggaugagguuagaccacuguuuccuguaaaacagagcacuuugcacuaaguagauacuuaauaaacagucacuugaacugaaaagagguuguuaaggucgcagauggaaaaaucugccuaaucuauccaggaauuauuuauuuaugugucucuaggccaggaccuauaauagacacuggguucaaagaguuauauaagacaaauuccuggcuggauacgguggcucaugccuauaaucccagcaccuugggaggccaaggcgggugaaucaccucaggucaggaguuugugaucagccugaccaacauggagaaaccccaucucuacuagaaauacaaaaauuacccaggugugguggcaggcaccuguuagcuacucaggaggcugaagcaggagaaucgcuugaacccaggaggcagagguugcagugagccaagaucacgccauugcacucuagccugggugacaauaaugaaacucugucucaaaaaaacaaauuccugcccucaaagaacuugcaauuugauaaaagcacuuugaaaccagaaaguaauuauuuuuaauggagccguuagaaaaucaaauggagcaaaaacuuaaguaaugcaaaugaauucuuauuuacuauuuguacagauacaguugucuccuccagcugcuguaccaguuuagacuacaucgucaccuaccucuucaagcacauagcaaaagagggcaagaagccacuucgaugcagagaggcuacccaggcuggucagagacuauuacauuuuaugcagcaaaacccagauguccugcagcagguaacuggugguugaucaccuggcuuaagaaacaaguguucccagaagccauaccuggccccgaauuuaucuuagagcagcuggucuugccaagacuuuuuauacugguaaaaaauauauauauauauugucugggaguauuuucccugaacguggagggaaaacacaggccuuaggauuacccacccucaagaaauaccuggguuguucaucucaccucaguggagcuagaauucaaaaagaggauaguuuuuccagaggccugagaaaaauuagacaaaaccggaacuggaaacagucagccucugauuucucuccuggugacucugauaaugucaucuuaaguuugccuuaugaauacuccgguauauugggaaacuacaauuugcugggcuccuaguguaugccaggcagcuugcuaggaauuucucauucaucauaucauaguugcuauuuuucccauuuuaaaaugagaaaucuugguucagauagguuagguaauauguucaauaacaucuaacuaauaaguaauaaaaccacuauuuguuuauuuucuaguguauguucuaacuagcuaauggguuagguccaaguuuaauaccauuuuuuaaaaacucacuugugcaaauaauaguaacggcaugcauaagaaaugaauauugcaaggugcaguaccuguaguaccagcugcuccagaggcagaggcaggaggauugcuugagcccagaaguucaagaccagccugggcaacauagcaagaccccaucucuaaaaaagaagauuuaggccaggcacgguggucaugccuguaaucccagcacuuugggaggccaaggcaggcagaucaccaggucaggaguucaagaccagccugaccaauauggucaaaccccaucucuacuaaaaauacaaaaauuagccaggcgugguggugcucaccuguagucccagcuagucgggaugcugaggcagaagaaucgugugaaccuggggaggcagagguugcagugagcugagaucacaccacugcacuacagccuggaugacagagcaagacuccaucucaaaaaaaaagaaaaaagaaaauuuaaaaauuuuuaaaaaaacauacaugccaaaaauauuucaaaaagaacaauaccauuuuuuauggcuauaccaucacuauauuuucuuuucuuuuuuuuuuuuuuuuuuuugagacagggucucacucuguugccuuugcuguagugcaguggcacaaucugggcucacugcaaccucugucucucaaggucucaagcgauccucacacuucagccucuuccugaguagcugggacuacaggugcacaccaccacauccagcuaauuuuuuuuuuuuuuuuuggagagaaggaguuuugccacguugccaggcuaguaggcuaguuuugaacuccugagcacaaacaguccucccaccucagccucccaaggugcugggauuacaggugugagccacugcaccuagcccuaucacuguguuuucuaauuccacuaaauuuggaaaguaucuucauccuguuuucaguuguuuucuuuugccaaauuacauccauaauaguuuguaauuugcaaauguaaacacaucaauaguguguugcuauaugaccguuagggagcaaauaaguugccugcaaucaucagaaaauguuggccgggcgcagugacucacgccuguaaucucagcaccuuugggaggccaaggcagguggaucaugaggucaggaguucgagaccagccuggccaauauggcgaaacccugucucuacuaaaaauacaaaaauuagcugggcaugguggugugugccuguauucccagcuaugugggaggcugaggcaggagaauugcuugaaccugggaagcagagguugcagugagcgagaucacaccacugcacuccagcuuggcgacagagcuccaucucaaaaaauaaagaaaaagaaaaagaaaaugucacucuauaucaguaaaugaugaaaauagaaugagacagcuaugaaagaagguuccuuccuggcugccauuuuuugcuaauauuuaaaugaaauuauguaaacuuuauuugugguaauguuucaguuaaccaauuauuuuccagggauaauggaugucauucauauuuuguguaacuaggcaaagggcuguagacuuauaauuauuuggugugacccuggaacuguuacaacauguugguaauauaaaggaaaaaggaagguaucucacauuuagugagaacuuauuaugugucaggugcaagagcuauuaagauucacgagauauaauuucucuccuuacaaaauuucuugccaugggacaaagagacaaguaacucaccaguuauuugaucauuucauuaauauagugaugacaaagaaaguaaaauucaaggggagggaguauugucaaagaguucuccucauuuagaccccacaacaacccugaaaaauggauaucagcauccccauuuuacagaugaauaaauugagguacagagagaucaacuggaaagugguagaguuggaauuugaagcaaggucuguuugacugaaaagcgcaaguucuuacuacucacaccauugguauucaaggugaggauaauaucucagcuucaccuggaauggcuuuucaaaauauacaugcuaucaaaaugucagcgcgucucuccucccuccccaccccacccaaaugcaguaaccacugguacuggugggagugugucacagcccucauguguuuugcaugaagaagguugaggaucacugacuuaaagcauguccacacugaagaaaaaaaaaaaauucauggauuggcuaggaaucagacccagccuuuaccccaccauggcaagggacaagucugccaccaaaucacuccuuccagcacucaaccauaaucacaguauugucccauaaacuuuggcagaaacuuuuaaguugguagaaaauuuuagcacaaaucaacaggcuauggcccuagacaaaauaccauaucauguuuugcaaaggaaguaaugugguugggcaggagacaaaucaaguuugucuuuacucagaauuagcgugcauuuguugguuuaaguaauuucuguguguuaauaauacuuguuaauccuucacuuuauagcauaugacuaaguagugauauaucuuuauuaacaguggaauacuuucuauuuauuuggaauguaggcuuucagauagcauuuuaaauauuaaugacugggcucugguagucagcauaaauaugauuugcauuagcacuagguuauaucaucuugagugccucugaugucagcuauuagguauaguaauaucugacaucaucuccuuagguuacugacaacuuugaccucuauucuuaugcacaguuucugucgucucaaaagcucuuuugaauugauuugaaauuuugacucuucccuuuaugaggcaguaaaauugauaauuauucagaugggaacagagugcugagugaaaaaucaauuccacccgcucucugcugcguauaaaauuacuucugagucggcuggacugaacggauggccagaguaaaagcggcaggcaggaguagugggaagaauuagcuggacagaacuaauagccugaagggauggacuugaaaaagagggagugggccaguuggggguuauuauuagcagggaugggucccauugaucaucuguuuacaucagcuuuccaagaccuuauaaaucagcccugaagaggagcagaacccaagauucagccuguuaccagugggauuuuguauuggauuauuuucauuuucacacucagaugaaaagugagccauugauuauucauugguugcccauuaaaugcuguuuuuaauagaugauuugccuauugcagaagguaaugaacaagguugcugcuuuauaacuugagguuucaguuuucaaggcaucugugucgguuaaguaaugccuaacccuauuaaaaggaauggauuacaaauugcuuaacagugcugaaaaacuagacccuaaugacuaauugugcuuggaguuuagagaggguuugucagcucuuuaaacuaaacugaugcaaugauacugcaauuauuuacuaguuugaacuguuuuuccccccaaccugguccuauuuugcuggaagcauaauugcaugaggaauguuaauuccaaauugcaaaaguuaucuccucaagcuuccguaguaaaggaagcaugaacccccacauaaagguuuuccaacauccuuacaggccuuuccauuuguguauagcagccugggaaagauauuuuaugugccucccaccuggaauuguguuuauuauucucuucuauguggcuuuagagcuucaaaauuuuuaaaaauguucuccaaauaauccauuuuucauauuuugcaaacaacucuaacuuugcaagcauuaaaauuuaguccauaugaagauccauuguaaguaagugaaucuauuugaaguaaaaacaauugcgucaccagcguugcuuugaccuaacaguugagaaaaacccaguuuacagaaaugaagguggaaaauucuccaagcauuuuuauguuauuagaaggauaaacuaaaaauuuaaggagagcccaaccguaacagugaucagauuacuaauuacuacugauuaguagcagauaagacacugaucugcuacaauaauucggaagacaacauuucuaugugaaauuuuuucaguuucgucacugaucaguaaguauuuguaucuauaauacauaguuauagauacauagcauucauuucguuauaucacagugaaagauuuugcccaaauuagguaaugaaaggguguguuuuauagaauuagaggggcaucucagagauaugaguaauuccuuauaagauuauuagaauaagacacugauccugaaagcuucucuaaaucagaauuccaguuaaaacuaauugcucuagaaagaguaacaccuuccacagaaauuagcaagaacuauuacgcaauuaauuuguuaagaguguauuuuuagcaauuaucgucuugaaaaccuuaauauauugcauaaaggaauuagagcaguuaggguugaauucaucuuacucuugucuauuuaucuauuuugcucaaaucaacuguacugaaauccaaaagaaauucuaauugugauuuucuuucucucccuuuucucccuuuucucccuccuuuuuauguuauuucuuuuuuuuuuuuuuuuuuuuuuuuuuuuuuuuuuuuuuuuuuugcuaacauggcauuuaacuacaaauugugaagagcugucaggagcuauaaaaaucauacuucaguagggacuuaagcugaaagaacauucacccuuuuccucaaucagucagucagucaaugaaaauugcuuuuguauagugcucuucaugacaugcaucccaaagugaauuacagcaaaagggaaaucaucugcucuuuuuucauuucuguguuuagacugaaaugauauugcucaacauuuugacauacuaaccaagacaucuuucauacuuaagauuccauuccauaauacugaguaggagaaaaugcagucgcauauuuaacugauguugagauuuuggccuacaggaaccuuagcaagacuauuacagucaaaaacacuuaagcagaugaaauacagucauaucucuuguccucuuaaaaagaauagucagauuuucuaauguuaauaaagacauuuccagugauccuuaaauaaaaaauaugcucuuuauguaacccauuagcucucucugguugauuuacaacuuuauucucaauaauacaguaguauauugauaucaaaaacaaacugaaagaacauucacaacuggaucagguaauaacggauuuaaaaaguuuaaaggaagccagggauaugucauuagacacugaaauuggaaaauaggaacucaaauuucauaacagaauuuuugcacauggugcuacaaucuugguuuuaacagcaaucaaugcauauauuaugcauauacauagugggaagaaaaauaauauuggcaaaauguaagugcuucuauucacaauagcacauggaaucaaccuaaaugcccaucagugguugaugggauagaaaaugugguacauauauacaccauggaguacuacacagccaucaaaaagaaagagaucauguccuuugcagcaacauggauggagcuggaggcuauuauccuaagcgaacuaacgcagaagcagaaaacuaaauacagcauguucucacuuacaagugggagcuaaacauugaguacacauggacaugaagggaacaacagauaccggggccuacuugagaguggagaguuggaggagggugaagaucaaacaacuaccuauuggggguacugugcuuauuaccugcgugacaaaguaaucuguacaccagaccccugugacaugugguuuaccuauauaacaaaccuguacauguaccccgaaccuaaaauaaaagcuuuaaaauuuagaaauuuaagaaauaaaauuuuucaaauguaagugcuuacuaucugcaagcacuagcuuaacuuacuuacauaugcauuaucugguuuaaucaugacaguaucuuugugaagguguaguauuaucauuaccauuuuacagauauagaaacugaggcacaaaaaaaaauaggaaacauucccaaggucacaaagucaguaacuggaagaacuaaaauuuuagcugaaaucuguuuaacugugggguucacaugcuuaaacacaaagcuaucucuguuccuuuguuuaguggcuucuaaucuaaaguauguauguuuugagcacauaaaaugaggcaaguugagcuuccaguaagucccacuggggccauccuuaagguagaaugguuuaaagcagucauucuauaccccagcauuauacuacagccaggacaaaacagaugggcagugacccaaagaggcagcgggcaagagagaaggaaguggcuuugcaguugcugcagaaaaagcccuguggcucccaccaccaccaagacagaccuaaccaagcuuccacuuucuuacgcuacacccacacccauucauuaauuuuauagccagauguugaagguauauaauuuaguaggacacguagucuugagaaggucagaaucuaguuguacagcuguguuauaaugcccuuugugacuuuucuuuaaugccuccgagguagcucuugagguuuaaccugauuuuuccaggacagaaucaauauggcagcugugaaaugaugauagggaagcaccaugugcuuugcaucucucucccguauccagcacaucucucuucauuguccugacuuucaccacugauucaucagcauagaaugccauuuuuaaccucuuucugguuguaaacugcuucuguuuucuaaaggaaauuucugcuguugaguaccauuaacucuaucaguggucauucuuaaggucugaaucuacaccugaguuccuuugacccuccuucucacuuuccuacccauuauaacuauaccaggugucacaaacuaagaugccuguagggccaagaagcagaaaaccugaaugagguagacaugaaggaauccucaaguugagugcacaucucugucuaaagggggcagccucagcacaccuccagcuaauuguugccuuauaagaaggucagacccaguguugccagauacauugaaauuucucccuugaaaaacagccagaaauucagauuuuaaauguagccacugauugaaaauuaaaaaacaaaaaauugaaacauuuggcaggccaacacuguaugccuggauaccagcuuuccacuucuguaguauacaaucuuaaggaauuucagaacuaagaucucccagugcauguuaccuuguauuucucacagccaacccaaacagcacugcuacagugauauuuuuauuuccaucugguucuuuuuaaacuucugaagcauacuuuuuugguuaguuuuaaaaggauguaguuauuuugauuuuacuuaaucuggggcuuuggggguuauuucuuaauuuauuuugcucuugcuuuuacuuuuacuauacuugucuacuggaacuuaaaggggccauuuuaucacuuuuggguuacaucuuugcacacaaggaauacaauaaacaggcgaugaagugaaacugaccuaauacuuuucaaacuuucuuuuucuucaaaauagccagguuuguuugagauaaaaauaaaguuuaguuugaucaagugugugugugugugugugugugugugugugugugugugcgcgcgcgcgcgcgugcgcaaaaucuaacuacugaggaucaaaauaaaauaagaggucugggacuggacaaaaguaucuagguaacaaccagguaauaaaaguccaaaagagaguaaaccucuuaagaaugaaaaauuugugaccauugccucaagagauccguuuagaaaguuaaugcuuauaauuuaaaaauagagaaacacuaguuuuuuuaauauuaagaugacauuuuaccuaugauguuaugaaaguacuuaucuaucuuuucaagaaugaucuaguccagauccuuuguuauuaaccauaucuuugcuauuuuaauuuaauuuuuauuauagaaauauuugaugaaugacuauuucaaugguaacaaaauugguauuuuaaaacagaaaaagcaauuaaaaaauauauuuguuauugauuuauaagucaucaaauuaacauuguagccauaagaauacauauuuauagagugauuuuuuucucccucagagaucaccuacauccugauacuugucccagcaccuaccagagccugacacuucaugauagucaauaaguguuugcaaaguaaacccccaaaauauuaguuuucagaaguaugaucugcaggcaaugauuuuaaguaucaaaccuaguguagucauagacugcuacauaauaaaccaaauggaaaugcuaagagaagauuauaucauaauauacuauagaauaacccugcugaacuucuacaagaaaauuuuauucuaaacaugggugaagaaagaaaaaaguacuucaaauauuguuccaaaugguuaacagaacagagaggaacccccuucccaacccccacuaggacauguguuuuucuaccucuaagcacaguuuaaggauguaacccauugauagcauaacuugccuuauuaauugaaagggauggaauccaccagauguacccaaaccagcagagaguugggugacuaagcaacagcaaagacaccauauugagugagccagaauccagucuccaagucauuuauuucagccagugacaauacauuuaaacuccugugccucagcagugauugaugguuuaauaucauauauaauuuuuuuaaugaaggaaaaccauuuaaauauguuaccauuugcacugguauucuccuauguacauaacugcauuuaaucauuauggggauuguuuuuauacuuguguaauuuguauccaagaaauaacugucaaagucaucucaugcuguugcuggaaaugguacagugugcuucauacuugaauagauucauucuuccuguacauaauuaagaguauuggagcuuucacuauuaccacauaggaauuccauguuuacauuucggagaaugaaaaauuagccacaaugugcuuuuucagguucccauuuucugaggcuaugauauuuaagcaccuuaguuuugugccaguguaugauuugaagaguuugauuuuaagacuuuuaauauuaaaauacauaauaaaauuuuauugucuaauuacaagaggguuuagccucuuauuaaaguugcuaaaucaggccuagauuagcauuauaauggcacaguuugacauggaauacucaaaagucaaguucgagggagcagaggguuuuuuuguuguuguuuuugguggggagguuccccuacccccaccccucacacaaaauaacauggaugaaaugcacguauggaaacaaacaaggagcaauuuggaacgcugaagaaggaguggaggugucagucuaggaugguacccuuaggcaaggcagcugguauauguagccuuuuguuuaucugcuacugguuuauguagccuuuaggccggcaccagaaacaaucacuccuacagggucagcugcuggucagaagcaaaguaagaaaagauuuugcguccaaacacagcagccauaauuucuguacagcuggcaccugcuacuggugcacagcaugaaggugaaaggucaaagaggcaguuguucaaaacucaagaauggcuuaaagggacuuguagauuaaucugcuuuauuaacuucuguauauuagauaacuauugcugugaaugacaguacaucuuuuugaauaagucacaucucuuucucuuuuaaauuagcuuuugaguaaugaauauuaaauagaaagcauuucagggguaauuaaaugaaaacagaaugaugucauuuuacaauuauauuuguauguuuauagaauaggggaauuauaauguuuuacaaggagcuaaaagaaaaaaagaagccagcucuuugugaagaagaauuuggaauacauaagccacguauccauuuggcuuugucuuuaaacuaaaaaauaugaugugguuuggaacuuagugugaagucauugggugccaguggccugauuugguauucucaggggcuccaaaugcuuuccuuauaaauuaaaggggacuguaaucugucaucucucuuuuaucuacaguuuagcuauuagucugcaacaaauguucucaggauagcaaaggagugguaaaaaaauaaacaacagccauaccuuuuugcucacauucauguaaagcagauagagaauauuucauaagggaagaaaggacagcuacacaggguuagcccaauaauaauuaggcaugcuuuauaacagucacucacaaguauggcaaauggcaaccaaaaugguuuuuaaccucuucauuaauagugguuggcauaauugcuauuauuuuaaaucaagaauaaaaagaauucacuaaauguaucuuaaaaaaaaaaaaaaaaaaaaaaaaaaccucugcaaggaaaauuucuaacccauagauuaaauacuaaccccaacucugggaagcguuuuaacaauauguauucaaaaggaauugcuuuuaucuguugacauucagugauuuuugguuugucuuuuuuuuuuuuucuuaagaauucucagaaaaagaagcacugcagagaacaucugugucuuuaugcuaacauaacacagauagcagcauuuaugucuauuucacacauagaaguuauuuaggauuucacuugcacucccaaguuuugauacaagugcagccuuucuacucuuauuguuuuuaugacauaagaaaaugacaccuaggaucgucucccugcaucacacgaagcuagccuaagacuuaccagacagauccuaaaucuguaugacuaccacaaaaaggauggcuaccuuggccagaaaauaaugauucaguaauguuuucuuaccauacuauuccaaagaaccuucauacauccuucuugaagaccuaagcauuuccuucauucuguaacagaagccuuauuuccugcaggguuucugggacauaagaugucgcuauagaaggaaaaccucaggcucgaacagagaauuuuaauaagaaugauuaugaugaaaaaaaaaaccacuagaaucaauuauaugcuaggcugugugcuaagugccuuacguauacauauauguauguauauauauauauauauauauauauauauauuuaugucuuacagcucugugagguagguauuuuaucuccauuuuguaaucaaaauauuguaauuauagcucugagaaguuaaaaaacucacccaguaucauacagcuaauaaguagcagaaccugugcucuuaaccacuguacaguacuauuaacuaacuggccuagaaacaggauuggcagugauggaagaguggcaggaagagccauacagcauucuucaaucaagaacugaauugagucuucaguccuugagccuaggacuucuuucuuuuuuuuuuuuuuuuuuuuuuuuuuuuuuugauuuuuuagaacugauuggacaggagguagacauuugacccaagcuggcucaguuugagucguuccucccuagauuuagaaacuggcacuuaacagaugcugguugccaggcacaguggcucaugccuguaaucucagcaauuugagaagcugaagcuauuuaggauuucacuaaaagcugaagcaggaggauugcuugaggccaaggguuccugaccagccugggcaacauagcaagacucugucucuacaaaaaaaauuaaauuggccgggugugguggcucacgccuguaaucucagcacuuugggaggccaaagcggguggaucaugaggucaggaguucgagaccagccagaccaacauggugaaaccccgucucuacuaaaaauauucaaaaauuagcugggugugauggggcaugccuguaaucccagcuacuugggaggcugaggcaggagaauugcuugaacccaggaggcagagguugcagugaggcgccauugcacuccagccugagacuccaucucaaaaaaaaaauuuauaaagaugcuggucagccacuaguccucaccuaaauugaagacgugaaaacucaagagccaugaggcagccauucccugccauaugcucagagaaauagccaguccuagaggagagaaaaaagaagcagacaugccgaggaucucaaaugagaggccaagcagccccagagaaagaaaaagacugagaaauacccugccagcugccuuguccaugguuccaagcccuugagagacuuaacugcacugccuugucugggggugaaacuaccccuuauagacuuaaguuuuaucagagaccacucuugacucgggagaguugugaggacaaaaugaaccaaugaguauagacuuaccuaacacaaagaaaguauucgauaaacacguaaaauucgccuucacuuugaaaaacgauaugcagguaccacuuuuuuguguccuugaggggaaaauaucccugcuauuuauacuauaaaugugaaaaauacccuuucaggagauuccaagcccaagacuucuuuucaaagauaauuugauuuugaagccauaucacugagaucuuuccuggucccaucccuguguuuugccuuucuuaauguucuuucugugauaagcauucucaaaaucacacucacuggacugggugagggcaugguguggugugaguuugaaauucuuggccccaaacugacuuuuuucuuaccuguuccuccugcauacuucaggcauugccuugcaguggccaaaaugaaauaaaucuaauuucuuaguccauuaugugcuauuauagcagaauaccguagauugaguaauauguaaugaacagaaauguauuugccucacagucuuggagacuaggaaacccaacgucaagggucugcaucuggcaagggccuucuugcugugucaucuaauggagguggguggaagggcaagaaagagcaccaggaggccaaacucaaccuuuuuauaaagaaccaaucccagaauaauggcauuaauccaagcaugaaggcagagcccucaugccuaaucaccucuuaacgcuguugcauuggggauuaguuucuaacauauucuuuuugggggacacauucaaaccauaguaccucauaauucuucccauucauauaaugucuucauaccuaaugucucugauucucacaauaacccuaacagggagauaaggccaacacggauuuuuuuuuucuaacugaggagucuagguacaucaacaaauuuaauccugcagugacuguaugagagaccuaugcagagauucagagaugugugaaagaacuugcccaagucacacagcuaggaaauaguagcaucuagauuauaauuaaggcuucuuaucacuagaucucacacaguuuuuauaauaccacacuaaguuuucgcagggccuuaaccuacuauuucucuguggcauuucuucuuaccuuuucaucccugucuaagagagacagcagaguaaaugagaagguuuccccugccuucauuucucugcauggaauugugaguggugugagaagcucuuugaauuucuucaaagaauggcacaguauaaaguaagagugggcuuaauaaaucacaugacuuauuuauuuuacaguuauuacugguuuuucacauacuugcagguuagauuaugugauucccaaaguguagugugcuguagugugcuggaaaugugaauccaaccuuuacauucauuucucucuuaacucauggaaaguuguuuuuugggcuuuuuggggguuuuguuuuuguuuuuguuuuuaaauaggauaucaccuugucgcccaggcuggagugcaguggcacaaucucagcucacugugaccucugccucccaggcucaaacgauccucucaccucagccucgcaaguagcugggauuacaguugugcaucaccacacccagcuaauuuuuuuguauuuuugguggagacgggguuucaccauagugcccaggcuggucccaaacuccugagcugaagugauccacccaccucccaaagugcugaaauuacaggugugcaccaccauaccuggccuuaacucauggaaaguuuaaccagcaguagccacugauggagcugugaguuuauauaguguguugaggaagacuccuuguuugucuguaaucuuaucacuauuugaagaacaagguaaaaagagguucccucauccucuggccuuucaugaauuaaugcugccucuuaugcuuugcaaccuagaagaguucuugcuuauucucugucccuuggcacgcuuagaagaauauagacugagugcuuucaaaugacugaaauuucauccuccuuucuaaguuuuuaaauugcaaauucuccauauuuguugggacuuucuauuuuacagcaaucagggcagacagguuuuacagucgguauaccugguuuugaauaccaguuauacuauuugcuaacuguauguccuuggaauaguuacuccaccucuuggaggauaacaccaccucacccaagggaauucuauagcuuaccugaacuggccuccaggaucagauaacugaaccacucccuccuguggugucauucccagacuuuaguuaagacucacugucuuagauucucucccaguccaucacucccucagccuagucuguagucuggaacauugguaccauggaaaaggagaacauuugaguauaugcuucguugagauccuguaaacaaaaaaugucaaguaaacucccaagaaagacagugauggaaagugcaaggucugaagagaaaucucuuaggcaccaaggcaaccuaccagaaagaaaacccuaaaaaagagcucagugugcaugcccauauuuaauguggcuucuuauuuuacauggggcaaacaaguuccacuaaggucagggaacuaaaagcaucaauuagagauaagugcauuuagggaucucucugaaccccuuaagacuggaaggaaacaacuugaugggugggcaguagaagauuaauaaauacuaaggcuacaugagcccugaaggccgcagagaccacacuugauccaauuccguaccaauggugcuugacacacaguaggaggucagaaauuccuugagcagugaguaagugugagaaaugaagagggaggggaaaagacagaaggaaaagucccuagcacaguaccagacacacuguagguccucaauaaguaugaaguuacaugugugcaccuagcacauaaaaagagcuaauaauagaauauuauugacuugaaauauacacaggugaaagaaaccuuguagauaacgagaggcauucauagucccuccugaggcuuagccuguuuuggagacugcaccuuaagggcagaaguuccacgcuaggccauuuaguacacuuaccccucaagagaguaagcccucccuccccaacuucaucuuuuuccuuggccccuugcauugcagagagccugaaaacaaauugacagaaaucuggaggaaagaaacucaagugauuuaggagaauggaagggcuggcuuaucggggcagauuaaagaagcuaaauauguauagcuuaccuaagugacaacuaaauggggcauuugauaagucuauaaauacuuggaaguuguaaaugccaagaaggaaagggaauuacuuagcauggcacgauggacuauuggcauaauggaauaauauuaagaaagggaaaaugaagguugaacaucaauaaaaagcuuccugacaaacagaacuauuccugacaggguacacuauuaaguuaugugcuauaggccaagggaaguaaugucagugccauuucucagaguacuggcaacagagccaguaagauaggacccaagaaguguccucuugacgaaggcacaggagccaagcaggaaaccuucugugucuguggcuucccaauccuagaaaaggaagaaagcugcauguuguuguuguuguuguuguuguuguuguuguuguuguuguuguuagauggaguuuucugucgcccaggcuggagugcagucacaugaucucagcucacugcagccucugccucccugguucaagcaauucuccagucucagccucccaaguagcugggauuacaggugcgcaccaccacuccaggcuaauuuuuuguauuuuuaguagagacgggguuucacgauguuggccaggcuggucuugaacuccugaccucaggugacccaccugccucggccucccaaagugcugggauuacaggcgugagccaccgcaccuggcugaaagcugcaucuucuugggaaaaaucagauggcccagaccuccuaaaggcucagacccuguggagaaugguuaaaccagcaguucacuaccacaucacugccagaaagauuuauucagcuuuaauggcaccccauuuccugcacacaagaucugcgcccaaccuauguaaucacccucaucugccaccaguacuccccauccacccuuuccauucccacagaacugcuccucauucccccagacuccucuccaaaccuuugcaccugcuugcccuucuuccuaccugacugucaaacuucucuuauucucaacaacagauccaaaugucaccuucucuaugaagccaucccuggcugcuuccagcccuaggcaggguuagccuccucugguuucuaaaagccccuuguguaagcuucuguuuauggccacuuaaacuguaucuucugccauuguuucuauacuguguaucuccuccccuacucaacuguaagcucuuugagggcugggacugugacuuguucaucuguauauucccaggguuugacacagagccuugcccaaauuagguggucaguaaauguuuaaaugaggaaugagguucuauucccaacgcuuucagucacuagcauuccuugggcuauguaauuauuagggaaaaagagcuuccaaaucucaguagcgucuuugaaucaucucccuggccucuuggccagcacuuucugugccauuagauaacuauaaauaaaaacucucaaaucugaaaauucugcaugguuuaaauauaaacucuaauacuuaauggaaaauauuucugaagggucccaugaauuguccacaagaauaauuuucccccauaugaaaaaugaaaacauuuuggauccuuucguaguucaugagcaugaugauuggguguucacgugcauaugugaacccuaagcagugugcauauccaugacagagauaacuauaagcacauguuuguauuauucaguaauaaacucuaacugaggccauucaaaagaaagagacuggggaaacacugucucuuacucacagcucuuucuccgcaucucuguuuuuaugucugacucugucucugagaguuucuguuucuuggucucucucacagucucuuucuucuugguacauuacaauauucauugcacucuccuuugaugacugcaugagacgcccucgugccauuaugcuuaugcuguucuguugugaaguacgauaauaauugggaaauguuuggugacuguuuaguaacguggagugcuguuuccccgcucccuuccuugcuuuugaauggccucaguuagaguuuacuuucucacugaauauuuacuauaaacgugugcuuguagccaucucugugaugcauaugcacgcugcuuaggguuccauucauugccauagccaccuaaacagcagccaccucuacacuaccuguagcauuucuggaacagucuggcauccuucucuucauuggaagucuugacuuugaggccauguucuuuuuauuucauuuuauuuuauuuuauuuuguuuauuuauuuuggagacagaguuucacucagucacccaggcuggagugcaguggcaugaucauggcucacugcagccuuagccuccaggggucaagcaauccucccaccucagccuccuaaguagcuaggacuacaggcacacaccaccacaccuggcuaauuuuuguauuuuuuuguaaagguggaguuucaccauguuucccaggcuggucucgaacuccugaacucaagcaaucugcccaccuuggccuccaaagugcugggauuacagacgugagccacgcgcccagccugaggccauguuccuaaagcucugaauuuauccacagcuucaguauguuucuaagguuaugcuucuuagaaguauuucacugggaagaaaaugggguaugcagucaaggauucuggccauuucugucugucucugcuacccuaccccucaacuccccucauuuugaauuucuugcaguaucuaaacuucuuaccuugccucugguacuuacccguaauugcuguucuccagaaccuaaucaguauuguucuaaauggcagaccucaucaugucaccuucuccuggaaaauucuuugaaggcuacccuucauguauuagcccaaacucguuucuauauucagcauggcauaaaagcccuuuuauagccuggaccaagcccagucuucuacuccuugccccuuaaaucuacucccugccacucaaaaggucuuuuucaaaaaccuccugugcaugggcuguucguuccucaaacaugccaagcucugucuccagugucuuuucucauuuuauuuccucuuccaaauauauacuucuucccagguaaugcuauaugcaucuuuuaagauucaacuuaaaaucaccuauccuaugaagauaggcuggucuuuuuagauagaaucagagcacaugugccuguguuagucucucuuaagcuugcacacauuguuugcuaguugggggacccccagaggcugguauaggccauuagagguucuagaaccuaugugguagucauucaggaaguaccaugaaccaaaaauaagugucacuugaauaaaaauuaggggaaaguggcuuuggaguugaaaguuguuccucaaaaauacagaucuucccucauuccuacccagaggaaauuuagaugguauuuuugacaaguaauccuuaauuuuuacaucaaaucgaaaaguguucuguuugauauuggcaagagugagaguuucccaaauagugcugaguggcaaacccugcagccuuccaaugccccagguuuucugguuuuauuuuaaugcagcaagcugcuuuaugagaucugcagccacuugaaauaugauuuacuacucguaaaaaguuucaaauggauaaugaagauucaggaaugagacucacagugguguaguguagucaauuuuguugcuguugcuccacaguacaucucugccauugaaaugaauuauuuaucauaauuuauuucaaccauggaaaauaaaacugcuuucauugugaugugugcaguaacauucagaauagacacauuacaugcaguacucucaauuaauuaauccugaaguuucauucuaacuuuaucuucuuucuuacaagcuaggagacugacagguaauucuuuccccaguaaacugugauuaaaauggauguuuugagaacuagggguaauguugguaauagaguaaauugaaacagcaaaacuagguuguguuuuuccuuagauguaacaaugguuggaagaguuucuuaauuuuugaagcaauuaaucacuuugagcaaaagcaucccuuagcuuuccguaaggaggggauggcagagugggggaugcuuuuaguugagauguggaagcaugcagugcuaauauaugaccaaaaccagcugaguuuccugguccugaggugcuuuugagguaaaaagcuucuuuuuuuaacagcaagacuagcauugugcaaagaacaaguuggcagggauccccagugauuccaggggagagcaggucaucuguaauugauugcagucuuguuuuuuuaaaagagaggugcaccucauccugcauuucauuugacuuuuuuuuaauuuaaaaugcuaaauacuuuuauuauaaggcuacaaaaacacuauaagcaguuaguaauguuauuuuuauauauagauaauuuuaaaauuuaauguaacuuagaugguagaacuuaguuaauccaggcaggaaaauauaacuaauuauaugcuuauuuauccauuauguucauuuuucauagcauuccacuaauaucacauaggcgaauagcagacagagagaacaauugauuucuuuucccuaaagauaacuauuaucuaauuugagcaggaucacauuucaauauccgcuguacacauggccucaggaacagcauuucaaaaugacagaaacccccuuacuuccacaaacccugaaaaucuggaagcuuuuucucuuucaguagcacucagauuuugccuaauccugggucuccaaccagggcauggggcuuaggugaaauugcuguggagauggguagguuucucugcuuuuucaaauccuacucuacuguaagcaaucauguuuuuuguuuguuuguuuuuguuuuauuguuuuuguuggggccagccuuccccuucucuuuuacugaccuucugaaaggccaaugacaagugccagaaaauuccugagacucagaagcagcucuugaaacuuagaugcauuuauuauugguuguuccucaaaacaugaccaacuuacugaaucagaaugaaggacaaucuagcuuggucagaaguacagauaauuuuguauccuauuccucuucccauuaaggcugacaaauuaagauuaacagauuggccgggugcaguggcucacgccuguaaucccagcacuuugggaggccaaggugggcgagucaccugaggucaggaguucaagaccagccuggccaacauggugaaaccccauguauacuaaaaauagaaaaaaagcugggugugguggcccgugccuauagccccagcuguuugggaggcugaggcaggagaauugcuugaaccccggaggcggagguugcagcaagccgagaucacaacauugcacuccagccugggcgacaggagcgaaacuccaucucaaaaaaaaaaaaaaaaugauuaacagauuaaguuauccuauucuauggugcauacccuauugggcacagcucugaucauccuuuuuuuuuuuuguccucugcccuccccaguccccacccccuauccagguccagauacagggaugcuuugucauuggucucucaccuuuucuuuggucugucuuuuuggucuguccuuccuucgccuaaaccagagccuucuuuuuuguuguugcuguuguuuuuuguuuuuugagauggagucucacucugucacgcagacuggaguacaguggcaugaucucagcucacugcaaccuccaccuccuggguucagccaggcuggaccaggguucauaucaucacuuuagcuucaguuuugucuuuaugguaccaauggggagcaggagggaauagucugaauuuuuuucuccuguuucuuagaacuuuauggaauuuuuuuuaguuauauuauucaguaugcuuaacauuaacaauaaaaaguguucauuuuacucaagggaaauuggcuuaauuuacuaaugcuuccuauuuuguuaauuuaaauugcuguguacauuacuuuuggugggaggaaagucauuauuuuuaucaaaauguucaguggaccauuuuccagagacagccuguuaaggcugccauuguucaucaugagagucugaaaauguugaccaacucugcuauaaaagccuuaggugggaggcaggaaggucugcugagaacucuccaggaaucacuacccuggauucuaaccacaagaauuucagugguggccucacucaucaguaggcgccaagggugucugaauggaggagguacacauggaccacauaccuaagagauucacugaagguggaagaaugagccauggccagaaaugagccuuuuuugucacaccaucaguccuccagauguguaaaguaggucguacagccucagccacuaugcugguggucuugguccucacucagacaacaagacaguggcagccagcagacuggcaugauggacuuaggcagaccuaugcacauaucccgguucagcuucacauccugguagcugcaguaccuugaacaaguuauuuauuugcccagaaccucagauccuuagucuauaaaacgggaauaauaucuacuucccaugguuaguugagaauuagagaugauguaugcaagugcccagcagagcacugagcacccagaagaugcuccauaaaugagggcuauuauuguuguuggauggugggaauacuugucaggcacagccuacuguuaggugaaaguucuugucauuagaaaugauggugcccuggccuuugaccuuugcaaccugcaagccccuacaaaggcacucucuggagcuggcuauaggacagcaguggcauggaagaguucucaggcuguacacacaaaaacaagauccuugcaaaugaacaauguauuaauuccaguauguaaccauuuuaaguuuuagucauagauuaagacaagaacuucccuguuuucuguacagugcccuuucaacucuuuagcucuuuauacuuuaccuuaugauacuucauucauccuuuugcauuuauucauuuauguauuuacucuuucaguugcucuuuccuaaaucucugaugugugccagugccuaacccuaggcccuggggauacaguaccacaggaguuugcaauccagucuccucaccccacugccauugcaaucaucacccuguacucauucaaguuggcuuuuuccauuuucucagccuuugcuccuauuucuccaaccauccugcucuuugauaagguccagccaucagauucuagacccacugagccuucaacuuucuuagaaaaaaauacaguucacucucuagcaguaaagcauccaacacaaaccacaucuuugucuauucuauuucagcaggagacagaacagacgggguuuaaauugggcauuucggccaggcacaguggcucacucccagcacuucgggaggcugaggggggaggauugcuugaggccaagaauuggagaccagccugggcaacaaaaagagaucuggucucuacaaaaaaaucaaaccauuagccaaguaugguggcaccugccuguagucccagccacacaggaggcugagguggaguugcuugagaccaggaguucgaggcugcagugagccaugaucacaccacugcacuccagcaugagcaucagaguaagaccccaucucuaaaaaugaacaggcuaggugcaguggcucacgccuguaaucccagcaccucgggaggccaaggcaggcagaucacuugagguuaggaguuugagaccagccaggccaacauggugaaaccccaucucuacuaaaaauacaaaaauuagccaggugugguggcacaugccuauagucccaguuacuugggaggcugagagaguaggaucacuugagcccaggaggcagagguuguagugagcugagagcguaccacugcacucuagccuuggugauagugacaggugaaauccugucucaauaaauagugagcauuuaguuaccgccuugccauagagaaaguaugacucgggccagacgcaguggcucaugccuguaaucccagcacuuugggaggcggaggcagguggaucacgaggucaggaguucgagaccagccugaccaacauggugaaacccugucucuacuaaaaaaauacaaaaauuagccgggcgugguggcacgugccuguaaucccagcuacucaggaggcugaugcaggagacucacuugaacccgggaggcggaggugcagugagcugagauugugcuauugcacuccagccugggcaacagaguaagacuccgucucaaaaaaaaaaaaaagaaagaaagaaaaagaaaguaugacacagcguauuuggguaggaaaguccaauuugcuuuaugcuugugcuuuacaucccauguuaggguagaagaauaagagaagaguuggggaaugaacagagauacagaucacacaacauugcuuuguuuuacuuuuccaggucagauauuuguagaguaauuuuguguuuuauuuagaauuacagguuuucagaacaacagaaacauugucauucaaaauccuuacaaauaacaugugccagaucaaauaaggaugcuuucugaacuguuuccuauuuugguuguauaugugucuguguuuuaccuuaacccucaacaaaguuagauaguugugaagagacuauaaucucauuuaucuguaucuaaucaggacaugaauuggggcccuucauugagcgaugaaauuccacugggcuagaccugagagaguagcugcaguagcagugaaggagcaguagauugaaugccuacuauguggcaagcacaguaucaaaugcuugauauauaucagagaaguuauuccucacagcagcccuuugaaguagcuguuauuguccuccauuuuauauguaaagaaagaaaggcucaaauaagugaaaugacucgcccaaugucucaaguuaaguggcagggccagauuggggcuccauucugauuggcuccaaagccuggcuuuaccauaccacguugguuucucuucauugagagaaauuuccuaaaacuccugccaaauccugugggaagaauggaggagaaugaggaagcagcugaggcgguguggggcaugcuuuuccuaaguggaccaagucauacaacucugccucagaaaugggcccuuuccugguauggcagaauagcugcucaggguaaugcaguagauaucguauguguuuucagacauaggcccuagaaaauguagccuagguugggcacauuuguuuaauuuuauuuuauuuagauauagaccuccagaagcugggcagauuugaaacagccauuccagccaucccuguagcaguauuggaagugagcagaaguugaaggauuggagccccagcucacgcagccauuccuuguaccaaauacugaugguaccuugugacucaccgugggccggguggugcagaauugccaagagcugucuccuuuuaguauuccuguauuugugucguuaaccacagaaagccucccaccagagauuucauaugaccugggaagugauucugugcuuaagcauuucauccaguauucuuccacaugccccuucuccagaggaauuugcccccauugguuggcuguuucccccauacccuacuguaagauauuacaaaaaauaauucuggauauggguugccaugucaguaccauuuaagcugauuugcucacuaauuuucguauuuccaaaagaauaaaaaagaaaaaaaaaucacccauuuuagcacaguuuauuuuuagaaaaguguuuuauucaaacauauccuuacuuauuacagacauaaauacaugcauucagacaaaugaauacacaggagaaccauauaaaguaauuggcacaucacuucaagaugcuuuuucaguuacuggaggaauuugaugccucuaacuuuaaucuuuuccauuaaaauauccguucugccuucagauugugaagcccauaauauuuuagacugucuagauggaucuguuaguuuugcuugucaguuuaauuuguggcucuaugacuuuggguggcuuguuagauuguacauggaaacucgugaucugcaaaugauguucaacaucccaagcuuaaguccucuccccagagagacuggacauaccauaaauaugcaauuggcagauuucauuugcaaccagccuaauugauaugaugauguauagaauggcagacguuuagaacggcaaagaagcucauugcuguuacuauaucccuuaaauguuuauagcacuuuuuacucuuugcaaugcauuuuauguacacuaucucauuugauucucagagcuuccuugugcuggauuauuauuucccuccuuauaguuaaugaaacugagacacagagagaaguucaguaacuugccugagaucacaggauaaauuggauuucaaaaaauaccagaggacaaaaccaacuguguuccaaacaagccaggccaccaaagcccaguaagggauggugugugcaguggucuuugccacguaauugccguuuccccugcccucuuuuggggaaaggaguucuggagcugugggaacagaagagcuuagagguaggagguaaagaguccaagaagcagaaacuaucaucagcuccacaugaaugacagaaaccuguuucacagccacuugccuggacuaucgcagcagccucaucccuggucuuucuccuuuaguuucaccugcacaguacacauucuacauguccccaaagagaucuuucuuaaaugcaaaucagagcaugucucaucugugcugcaaacauaucacuagcuccccacuaccaucaggaugaaauccagauuccucagcagggucuuccagucuggcacuggcgucucaccucuggcccaccucucuucucuccugucaugcuaaguuucuuaccauggcagaacccuuugugugcauccccacccuccuuuuuugaugccuucuuugcuuagaacacauuuauaaugaacucuuuaaauguuaccuucuccgugcagucuucccugacuucuccucaaggacccagagucaucccugccuccucgcaugcccacugcacuuugcccagcccuauuuccuguuauuucucuccuaaguagucucccccaggagguuucaaacuacuuaaugucagagguugugguaaaugccuguauaaucuuaucuccccuauggaucuuacaggcugaauuuaagagaacggaugaguaauguacauguaggaaugaaugagugagugagggaauuagugaacgaagagugaagagaaaccucgaacagccuaagccagcaggaaacaugauguuccaggaucacauggaaugugucccauuccccucccucucuccaagaggggccauggagagauuucaucucucuauaacauaaccucuuaggugaaauaggaggcagacaggaaggugagcugagcuuuugccuggugcccuagcauagaggaaagcauaucaggguugagaggcagggacugaucaucuuggcccagugaccucuugacuuaugcccaucuggaauguucucaccaaggcuuucagagguagaagcucuuccacagggagcuagcugggggucuuugccaacaguuucuacaggcagccuuauaagcuuccagagucuaguccguuuguccagaaagagcuuucauagcuguuagcaagauggagggguggaaucugagcacaugaaaggccugggauuagggggaacucugagacaaggcaucucaaucuuuaugugauucuaucuucuagaugaugucuguccucaugaacaccauugucuuugaagacugucggaaccaguggucaguauccaggccucuccuggggcucauccugcucaaugagaaggugagugugauugcaggaagucacgggagguggucccugggagaagagagcagcuauaagcuagggugagcugugaugacgaaggacagaggagcagagccaauugaauuugaacugggaccuugcgaacucugugaggcuguauuccccuacaaggcccuuccccaaaggccucagaucuucuucagguaagcagaggccucaaaacgagugcuucuggagcccagagcccccacucaccaggugggugguuugcucaguaguauuuccagcuugcccucacuccacuccccugauuccaggagaauucugagcaacaacccuuuuugccuuccuuggccacccuuuauaucugagauccccacugcccuagguggugacagcagcagcccaucaggcauuccucacagaaccagcacccuucaucuggggagcacacaucuccagcuucuuuggaggacucaccaccugggcuaccucccaagccucuccagcuuccucuugaacccacacaucucccuaguaguaggaacagugcauuacagcuugggagaaugaauugucuauacaauaagauaguacuggggaaaaagacagugagauuagaggcaggugcaugcauuaaaauucaaacuaaaaucccagccuuggaaggaaacuaauagaagaagaaaauauaucaaaaagagaagagcugucucaucauucaccugugcugaaguauccaauuuuagccacauucaguagcacugucauucaucuucccucgguguuauugugauuuaaauccaagcucuauaaaagagagcaguucuuuuaaaaugauugagagggaauaagggcaaauucaguguuuagaaaaagcuuaugacaucacaauauuauacuuuacugauggaggcaauauuucacaguuuaggaugaaaaacuaauaauuuucuauuuggugugagucacugcaucauuauaaaagggaaaaauaaguaguuuugugcauucccaaucuuguucaguaagacauugugguuuaaguauaaugccucugauauauaguauuuaaguauuagucugacuacauauuaauuauguguguuuuuugauguaagcuguuuuaauguaugauggaaauuaaauaucaugcuuuuggggcugggaagaauaaaugcaugacuggcaaaauguugucuuugugcugaaauuaggcuguuuccaaugauuaggagcuguguuuaguaucagaacuuguguguguauaaaagcccacaguccucagcagagaagaaaaggcugugcagguguuugugagcaggccugacagacauuuuccuuagugccacaaagcucuccccaaacuaaagcacgccccucuaguaccccaccucagaggaguaaacccauucuaacccccaaggacagagacuuggaaaaaagcccaaagucauuuaaggagugacucacugaagccaggaaagaugauaaggccugaggaaagacccuuggccuugccuucagucacuuaaaaugcucccugggcauuuuuaguuauuuucuucagucugggggccccucccauuucagucuuucugugguuaguagagaugagagucaggaaaagcaugcauucagucccccacagaggaggcaaggacuucaucagccuaagcagugacacuagaacaauuacagcaagacauuuuauggaaggcaucauagaauugauaacuaggagugucucuauggcauggauuuucucuaagggcuuaaaguucaaaguggaccuagacaaaaacuccucugagcauuagugagcccugaguagaugagagcugcucuauccauccccugccagcugucuucaggcgggacuuggagucggagcucugacacuauucugucucccaucaguauuucagugaacugagagcaaguuugauaaacagccagccccuccccaagcaggagguccuugcccagugcuucagaaaccuaauggaaggaguggagcagaaccuguccgucaagaacagagacaggugagcauugcccaguagugugucacugggggaaguagacauuccagguuuguugaaaauaacucucucgugcuugacacagcucacacauggaugucccuuuucuguuacaccuugugauccuagacucaguuccauuccauucaguaaauauuguugguuauuugcuuuccuccaggcgucauacuaggcauuauacagggaugcagagauuaauaaaauguagucucugcccuuaagcaguuuacaauucaacaggagagauaugaaaaaauaacuguaauugaaagaucaaaagaaggaaagugcaaauccacuauggaaaaugaagaaagacuucuuggcauuugaacaaacauaggccuugaggucagacagacccgagauacagcugaguuaggauccugacuauagcuaacaauaauguauuguauauuucaaaauagcuaaaagagaggauuugaaauguccccagcauauagaaaugauaaauacuccaggugauggauacccuaaauccucugacuugaucauuacacauucugugcauauaacaaaauauugcauguaccccauaaugauguaaaaauauuauguaucaauuaaaaaacaaauuggcugggcacaguggcucacgccuguaaucucagcacuuugggaagccgagguggguggaucaccugaggucaggaguuugagaccagccuggccaacagggugaaacccugucucuacuaaaaacacaaaaauuagcugggcaugguggcacgugccuguagucccagcuacucaggaggcugagcuaggagaaucacuugaaccugggaggcagaaauugcagugagcugagaucacaccacugcacuccagccugggcaacagagugagacucugucucaaaaauaauaaaauuaaauuaaaauuaaaaguuuuuaaagauauuuuauaucuggccuuuuuagguuguguggcaguaggcaguuaacuucucuacuccucagguucuuuaccaguaaaauggagaugaugauaaucaguugugauguuuaaaugacagaacgcagugaaacauggcaccugggaccuaugaccuacaguauuaguuucucccucugccuguucuuuaagaauggcugguaucucaguugccaaugagaucuaaaugaaaggagauagguucaggcuuaucagcuaggucugacuucauucauucauucauuuaguucacaaaacuuuauucagaaucuacuguguaggcauugggguuaccagugguaaaccaauuauuuaagguuccucccccucauggaucuuacauucuaguagaaaagacagacaguaaugaaugauggagaaaaagcauguguucagggggcgaaaaaaaaggccugcaccauccuuuuauaaaugugguagcauucaaaugcugcuccauuugaaaugcaaaucaucagucaucccaguagccacaguguauucuggaguuaccagccugggcuuugguaauacaugaccaagucaguugggguaugcagacauauucccuugacugcucacuucaagauccucuaucacgcagaaagggacaaccucagaagccagcagaugagaguugaauggggaagcccuaggugucucgguggaaauuacuucaccuaaggcuuggaaauuuguguacugcguccugagcugcucugugaaaugauggcagguggcccucguaguuuaaugagaguaauaggcagugaagacugacuuuuuuccguguaccaggcacuguguugaguacuuacaggcauacaggcauugccucaaacugacccaauaaauucuuuuuuuuuuuuuuuuuuuuuuuuuuugagacagagucucgcucuguuucccaggcuggagugcaguggcgugaucucagcucacugcaaccuccaccucccagauucaagugauucuucccaccucagccuccugaguggcugggauuacaggugcccaccaccacaccuggcuaauuuuuuauauuuuuaguagagacgggguuucacaauguuggccaggcuggugucaaacuccugacgucaggugauccacccgccuuggccucacaacgugcuggaauuacaggcaugagccaccgcacccagccuaaauucucacuuucugcaaucccuugagguaacuacucauauuagguaccaagacaagagguuaaguauucauccaauaucaccggacucauaagugguagagcuaggauuugaacccagguagucuaacccagugcccccucuuuuucagcuacuaaauucaguuuucucucuguaaaaugaggauacucauaccuaccucagggaagacuugugaugacuaaaugaguugaucaguaaacucaauccaaugccuggcauauaaacuuuuguucuuuuuuuuauaauccuuacuaucuauguguaauuuaacuuuucuaaaauuguuuuuuaaaaguagaaccacaaaauguacaccucaagauggucagagugaauuuaguggcaacccuguuuuccaggaagagaugagggguuggcaguacugguggcagaacagcaauggcggugaaaguggagagaaaggagcucagcugaaaucuagagccguccuccaggagggggcuccccaaaguccugaacuccaaaauggccuuaucguccagaaauucauggaggcuuugccucauuacuacccuugacccuuucuuccucuuucugcagguucacccaaaaucugucuguauucagaagagauguggcagaggcguugcgcagugauggcaacacugaaccaugcagucucgacaugaugagcugacccgacuuuucugaccaugugcggagcagccuuuaucaagagacuccugaaggucugggucucaggacagugauguuggcuagcccaggggaauguauuuuucaaaacauacaagcaacagcaaaagcccuaacuucuuauacgucuagccuaauuauaagaauuucuaacaguaccaguguaaauucagucuuuucucugaaaagcaaaggauguguuuucagucuuucuaucaaauauuaucuuuguucuccuaaugcucugaaaggauguagaaacaauauuuaaccaaagaacguaauaaaccagguuugcaccuaaguguguacuaguuuaugguucugcagucaagguugucaauuuguuggagaugcagccuucaccauggauccuggauugagacgaaugccauuggaaccuguuaaaugaguaguuuguuaugugucuggaagaagcagcguuagggacuuugggcugugagcauuuagaacgagccuggaagcacuacagagcaucccacaggaccacacgcaggccucccugccucagcugcaucugauaaaguugagagacaguaacacaauuaaaugacuuagaaacaauguuugcuuuucacuggcauaaaucugaagugguucagucuagaagaauuaagcugugcaauuacugccugcagagauauuucuucaggaggagucauguagccccagucagaaguucuggguggugccagcacccaguccucugccuccauuuaauuuuuaagagaaggugaagguaacuauuagaauauaauauuugaagcagcucugccuucuuagggcuacccaaaacaguucuaggugcuaaaauucagauuuucagaggaugagaaauagcugguuuccaacucuccacaaaaacucuuauuacuguugggacuugggauucugacucaccccaaacccagaacaugaagaagaccuuuacaguuugugcucuacuguuacuaggcuauuaauuugagaucguccacugucaaguguuuuacuaucucacugcuguuuuuaugauucaggcuuauaacaaauauuguauccuuuauuucugauaagac

SEQ ID NO: 16531 - RNA, 645 nt, Homo sapiens
caugggcaaaggagauccuaagaagccgagaggcaaaaugucaucauaugcauuuuuugugcaaacuugucgggaggagcauaagaagaagcacccagaugcuucagucaacuucucagaguuuucuaagaagugcucagagagguggaagaccaugucugcuaaagagaaaggaaaauuugaagauauggcaaaggcggacaaggcccguuaugaaagagaaaugaaaaccuauaucccucccaaaggggagacaaaaaagaaguucaaggaucccaaugcacccaagaggcuuccuucggccuucuuccucuucugcucugaguaucgcccaaaaaucaaaggagaacauccuggccuguccauuggugauguugcgaagaaacugggagagauguggaauaacacugcugcagaugacaagcagccuuaugaaaagaaggcugcgaagcugaaggaaaaauacgaaaaggauauugcugcauaucgagcuaaaggaaagccugaugcagcaaaaaagggaguugucaaggcugaaaaaagcaagaaaaagaaggaagaggaggaagaugaggaagaugaagaggaugaggaggaggaggaagaugaagaagaugaagaagaagaugaugaugaugaauaagu

SEQ ID NO: 16532 - RNA, 1445 nt, Homo sapiens
uauccccagaacuuuccacaaugcuugagacacaguggggagauaauaaauguuugcugaauaacugaacggggaugucagagcagcccgaggauauacaagcacgcgucccaucuucguagccucugcgauccucgcguccgcgcccgcgcccgcgcccggcccggguuuccuccuccgaagaggcggccgcguagcccucccucgcaacuccccccagacgcagccccugucuccucuggccaauuaaaguccaaccgcugccgccgcuccuucgguggaucccaagcccccgcuccggcuggggcucaacuguguggagggaggcugacgauagagccgcgccggcgacgcggcgggaaggcgggaaggcugcuccaccgcucggcagccgcgcgaggcgcgccaaagccggcccagcugggacucccaccugcccuggcaacacuaaagccgcggucagcgagcgugcugccggcguccgcaccuuccccgggacgagcccugggccugucccccgcccccuccacccgccgccuccaacccaggcucggccgccccuuucucgggcuccggcccgggccuggggugugcagcccagaccagugucccgguccccggcuaggggcagaggcaggggcugggacuccggggacaccggcccacggcccugcggccuccgccgcuguccucggcccucggucuccagacgcgucccgccggguucccagcguggcggagcgcgggcccgcggcgcagagcacacugaccuggaagugcagcgccaucuucccaggaggcggcgccggccagccggccggucggcacccagcgcccgaggggagggagcagaggcgggcgccgcggaagccccagacgcccgcggggucccugcgccgcucguccuucgcagccucagccaggcuucgcguccgcauucgaagcgcuggaggggcggggcugggagggacggggcggggcugggagggacggggcggggcgacggaggcggugcacggggcggggccgauaggggcguguccuccgggaaucucaaccgucccuugcgcucaaguuucaaccggcguguguuggugggucaugaccuccaaccucugcccuuugacacaacuaccacgacccacccgucagccguggacccugacucauaagucuuccaaaggcucucuugaccccugacccucaaaauacaacuaucgcccauggcucccgacaccugcaucuccacagauuuucuugucuccuaacagccaggaaccacagacacacacagccauaaccuuugacucccacaugccagcuguugcccuugaccccugacucccagggcccaaauuccauuguugcuuaacaauguuuuuaacuugauuuugguuaaaauuaaaccgcccaugucuacaugcuguuaaguuguaaaauucaag

SEQ ID NO: 16533 - RNA, 2626 nt, Homo sapiens
caaaugcauuuuuaaaacaaucaccaguggagugcugagaggaaucaugagcugagaucuuucaccuuuguagagaugaaauaggauguucuuguuaacuguguucuuggagcagugagccaggcugcuccaauaugcacugugggcaagaugccagcuuuugugaucuccuuugcaggaacuuuuagauggaagaggugaaaagcaggguccucuaggcuaacaaaugacuuuaagucuuuucuggggaagaaugaucugauuugcuaguaaagauuccagagaugccccugccucaaauuucugguggguggguuaggguguggaacaguucuggcagauugagagagaucaucaagacacaggccacagauaaugccauucaaucuuuaugaggucgcggcuugcuguuguucuauagauguuguaaucuugcagcccugcuucugcauaggcugagcaugaagcugagugcacagaauccuuugaggaggucaugggauuggugaaaagaugcuaggccuagaagacauggcuucuagucuuggcugugcccuguuugauuuuggacgcauccugugucgucucccacccuaguuucuacuaacaugacauauaagcuggcugcacuucaucaagucccagcuacugauuuucugggaguauguaauauguguauaaccauguaucagauugauuaggacccauuugugugacugauaucacauguccaaaauaguuucacauuuauaaucuuaauuuuuaaccauacuacaaaccugugagauagaaagggugaauauauuuguucccuuugacguauuagaaaacuuaggcaaauagagauucaguuaauaguagaguccaggucucuugacucucauucuuggguucccacacuaaauuaaacuggauuagucuuuugggauaagucugaaauggaaugcaacuagauucuuuguggaaaaaauaacuuaauaaauucuauucaauuccuaaaugaguagauaaaaaacaaaguuguauuucccuuguugagaauuugccuuugaaucccucugugaaaugaauuagaauguuuucuuaggauguaagaaauauacaaacucagaaaaagcacaucucacauauuuuuuaauggauaauuucuccugggacuucuuuacauucugaaaauucacuuuauuauugcauucuaaaguuuguggcuuuaaaugccauggcaucugagucuaacuuuuauuggugauauuugugguuaucaguuuccacugucacccugucccauuuccuuuguuuuguuccauagauaugauuugguuuaugaaugagggcuuuucgauccuucaagauauguuuuugugaauugguucaauaauuuguuauugaaaagcaaaauccaucagagacauguuugccuacuuccuuuaaaaagaaauauuuucauagagaccaacugucuauucaucauucaugccucuucuuuguauguuuuaaggacauagccacaauucuuguucguuaaauguguccaugaauguauucaaccugaaaucccagcuucaaaacuucuaaaauuuggaaauuacacaagugucuuaguccaaaaagaaacugcaggccucugccuugggugcagacacagaguaaguuggcaggccagacucaaagaggcccugagaaggagaaggaagucugacucucauucuuggguucccacacuaaauuaaacuggauuagucuuuugagauaagucugaaauggaaugcaacuagauucuuuguggaaaaaauuuggaguugccuuuuuaugucacaacucugaugaucgcauauuucucagcugagugcucccuccuuucauuacucugaguucuuagugaagcuuuugacucagaccccugaccuugagggcuaccuaugaggcaucauucaagccagcugcccccuccuacccauuacagaaagcagguucuuugauugcagguagucuaacuuuuugcauuccugugaauguuuuuaauugauuuacauaaacucaaauuaacuuuaacuaagguuaagguuuagugucucaaaaacugggaguugcaacaaagaacugcuguaucccuguaugccugcaucauucuucaaccacaaauuuaucauuggaugcuuuuuugucauguuauggccacaucagaaauagauguuguauuaguuuauucuugcuuugcuauaaagaacuaccugagacugguaauuuauaaagaaaagagguuuaacuggcucaugguuccacaggcuauacaggaagcauggcuggggaggccucaggaaacuuucagucauggcagaaggugaaggggaagcaggcucgucuuacauggcuggagcagaaggaagagagaaaagggggaggugcuacacacuuuuaaacaaccagaucucgugagaacucaucaucacgagaauugcaagggggaaguccucccccaugauccaaucaccucccaccagucccgucuuccaacauuggagauuacaauuugaugugagauuuggguggagacacaaauccaaaccaugucagauguccuguuccuucuuggcacuaacauaggagauucaaugaaacagaagga

SEQ ID NO: 16534 - RNA, 30335 nt, Homo sapiens
uaugguauauuuauuucacaguuucacaucuuuaucauuguuuuuauauaaaaacaaugcuuaagugggguuucagaacagauauuuccuuuuaaacuuuuuuuaaaaaaucacaaauaugauuggcucauacaaccacauuucaccucuuuucaccagcacucccacccauucccguuagaaauauuuuguuaaaaaaaucaggugaucaaacucauagaaacugaauugugagaaguauaaugggaaaaggaaugagaaccuguggcucuagggaguuacagaagggaaaucaucuuuuagagccuugguuuauuucugacaggaaagguaaagccgugcauuuauuagaacaggaagcuaagaaauuaaagauggcgagauugucuaaaauaacugaggcugaacuggaagccuuuacccuggcacacucaaaaaucacuuuugguacuguuggcugagacuggccgaggaaugugcaucucuggcuggauuuggagagggcagcucacccgcaaccugaacauagguucuguaacguaucucauuguuacucagaaaguucaguacucagggccagcacgcuccugcucaugcgggauaagccacucauagcagaccagcuggaaggaucagggaucugagcaaagccaaguuuacuuaagcuaagccacuuguuccugggucaagcaguuuguuuucuaauaagcaucauuccugaucauuagagcaaagggaugaaugcuccucuuggaaugauacaggggaucugccacugggagaguguugcucaguguuagaguagcagcaaugacagaaugacagcgacucucugagucaacccaguacuuuuaguaccccaucacuaugugaauaaaggcagcuagaaaauggacucaauucugcaagccuucauggcaacagcccauauuaagacuucuagaacaaguuaaaaaaaaaucuuccauuuccauccaugcaugggaaaagggcuuuaguauaguuuaggauggauguguguauaauaauaaaaugauaagauaugcauagugggggaauaaagccucagaguccuuccaguauggggaauccauuguaucuuagaaccgagggauuuguuuagauuguugaucuacuaauuuuuucuucacuuauauuugaauuuucaaugauaggacuuauuggaaauuggggauaauucuguugugguauuaaauaauauucauuauuuaaaaacucaucuugguauugaguuagugcauugacuuccaaugaauugacauaagcccauauuucauuuuaaccagaaacaaaaacuagaaaauguuacucccuaaauaggcaacaauguauuuuauaagcacugcagagauuuaguaaaaaacauguauaguuacuuuagaaacaacuucugacacuugaggguuacccaauggucuccuucccauucuuuauaugagguaaaugcaaaccagggagccaccgaauaaacagcccugaguacauuuguaaucuugggcuccaugggaauguccuugauuaagaugaaagaggaauggacugauguuucuauuacaagauccuauaaugcuaggacuucuacacagcuuagaacaaugguuggagcuucauucuuugagcagaaagacucaaauauuauuucagucacuuguagcaccauuggaugugggugcacacuuggccuaaaauaccauuuacaucauuaucuuguccuguugaagaccuauggcaugcaagaaauuuaacauugacucaaaaauacauguaguaugcccaguaaaauacauuggcuagcauaaaaaucaaaggaaacaguaguuuggaauagugaucaacauuacugggguuuugaauugugaaauaaucaacaauccugcccaucuuuucucggaagacaaacuugaacuugucgcugguuuucauugucaagucacuguagucaacguugucgcuggaaauuucaaugcuggcaaagcugaucuuccguuuaaagcuggagauggagcuguugaugauauuaguaauacugacuucuucuacuuccuuuguuguccccuaguucauagacaaugcaguuagcuuaaaagacuugacucagcaaaauaaauaaguagguaaugagcuaauaaaaaguuuagaggccuaaguguugaauaauuaggcuuaauagagaguggcauugagugcuucagaaauuggccaauaagccaggcuugggcuccuguugcccuguuuggagacaccuauuuguaggucaccagcauauauaacaggaggaguaaacauggccuacuguggauauccugagcagugugccagaugcgaaaugcucaggcuuugaaguuaguggaccuggguucaaauuccauucggccucucacuauugugaaacuuuagucaccucaaucccuccaagacuuuauuuccucgccugccaaauggugauugguauugccaucuugagacugaugggaagauuaaaugguaaaaaauggaaagcaucugguagguguuugaugacuucaauucuguuccagggagaaaggaguaacugauuacgagagauaauagaaaucagcugugucuuaaaggcuuugccaccaaagcagaaauagugaugcucccugccauugcaaggaguugccauucuccaacauggcuggggucaacucccaggaaugugggaguguagugaagucagagagagugugguuugguuccuugaccaggccgcuugcuagguguggggucuuaugggaguuaccauaucacuguacaggacaaugaaaugaguaccauuauuaucccaauuuuacccuugagaaaugugccacaucaauuaguggcacauuucucaagaguaaaauugggauaauaaugguacucauuucauuguguuguuggaugaacuaaaggagauguugacggauguuuaggacacagugaguacuccauagugcagugauuaucauauacacagcagaauaagagcuuucuggugucuuuagaggaggcugucaguauuucaccaauguccauuuugccaaucuaguaaauccagauucuugggcggggggaugaggagguaacucaacuuccuuccucccucauaaggaagccuaagggagcaaaauaaauaaaagccauguuccucuuuggcuggcacacguggucauuugccuuuggugcuuggaugacaugacuaugaaacauuacucacuguagccaaacccaagggaaaaagcaacuggaucuuugggucauuuugauuccucauucuacacuauuagauccuccgugguccuagcacuuugcucaaggugggcaccucuucugaacuggaucccuaucauuuucuugcuucuuagcaugaacuuuagaaugccauuaucuaucaaauuuggcuuccaaauaacacuagggguccaugaaccuguaaagggugauaguuaagagcauggucuaaugcucucugcaagugggaauagcggauaagugucaggcuuuggaaccaaguagguuuagguuggaaucccagcucuaccucuuaguaucuauauccccugcgguaagucucuuucccuucuuguuaucagauuucauaaauuuaaaaaaggagacaaccuuauuggguuguuaugagcauuuaaaauaauauaguauuugcaaaaggcuuguuacugugucuggcacauguaaaugcuugauaaauaaugacuauuauuauuauuuagagagcuggacuauaguguuccauugcuaaaccaaauaaugacaguuuuucucaauuagcagaaaaauaugcucaccaagaaauuugucacaaucuaauauuuccauacauuuuucaguaaagcauuacuuguauaauuuaaggacaaaauaaugcaacaaaagaauuaaauaguaaauauauauuaauauaaaacuugcaagcagcugaucauguuuuuuucauauuggauucuucauggaugcuugcuccugugguugugauuuuaugcugcauacagauaacauauuuucugcuggaaaauuaaacauauuaauaucucauuguauuuggugaaaagaauggucuuuuucaaggggcaccaugacuuccagcugcucccaccugaacaaggauaagacucacuggagcacagggaaucacugcgggugggguggggauagaagccagguccagcccaugucuacagaucagcacacggcaccagugauggaucauacacagggcccucaagacucuuacccuaucuuuggcugccaucugcuguaaggaacuguagugagcaacugcauauucuagcaaggccccaaacacaaagcuaaagcagauccccagguacacaucgauggccuugaugaagcaguugguguugggaagagaagugcgggacccgaucaucaguguggucauugauaacacggucgucacuccugggaaaacaggcaggggauguuccuacaaagugacugguuaguccuccaccauagccuggcagaguguccccauuugagaauuggcagggugagggcaagacccagaaauggaaugcaucucauuuugaaaagucugcgaccuucuagaauaggguugauuuguccauuuuguacagauaugagggauguguuuuuuuuuaauguuucacguucugucuucuccugggagggggugauaaauaugcaaaagaacugacaauagaccaucuaagcacaaugaucccuuacuugucacuguaaaacuuaaguuuaaaaaugcaccacuccuggcagggcauaguggcucacaccuguaaucccagcacuuugggaggccaaggugggcagaucacuugaggucaggaguucaggaccagccugggcaacguggugaaaccccaucucuacuaaaaauacaaaaauaaguugggcaucauggcacaugccuguagucccagcuaccugggaugauaaggcaggagagucacuugaaccuggaaggcagagguugcagugagccgagaucacgccaguccacuccaaccugggcaacaagagugaaauucugucuccaaaaaaaaaacaacaacaaaaaacccagaauccuaaaguagucucuuucugucucucucuuucuuucucuguaaaagaaucucccaagaaaacaacucuuggaacugccuuaggaauaucaaugaagacaaugguaaaaggaaaaaaaguaaguaaccugauaagccaguucuuagaaaucuccuguuggagcugcuuaccaaugcagguucuugcagggacugaaucgagagagauccaaaaugaaacccaggacaacaccaccaggaaaguggaaggaacguagguuuccaaaaugaaauacagaacauuccuccgaagcucaaacuguaagaccaaucuaguguaauuuccugaaaggguaaacaacagauaggaaauugugucuguucguguagcaagugguuucucuaugggaugcuuaacuauauguacauuaagcccucugucauugaucuaaaucugguuauguaugaacugucauuaugauuuccacaggagacacugcuguugcauugaaugggauuuauaggggcgcuguccugccuuauguccaaccugggcuuuucugaaucacaguauuccuacagcagugcaaucaauacugguuuucuugacgucugccucacuagacagugaguuccuugggggcaaacacugaaucuuucaguucugcacucacaaaguaguuguucaauaaauaccuguuuaaugaagauuaccugugaccaucuguuucucaaggaauacuauggaauagaccuaauggaccuauuaaauauaagugaauuuuugaugauuucagaggcaccccagauuuuauacuacuucagggccauccuuagggaaucuagcaguguauucuagaugugggaaaggcauguguuagagagcuaucaguaacagaauucucugugguaaauaggcuacuguagcacaaaacauauauguccauggguuagagucccaagcucugcuccugcugugcuucuauuauggggaggugagcaguaguggccagcacugguguggaugcaugaaugaagagguuauccucugggaacaggaaaagucuggcuuagauuguuguuggggaaaaacaggauggugaaugggagcugcuccaacccucugucacccccaaauuaaagccugaaaugagaaauuauaccauuaaaaaaacaacagacauaugccuggauaaauauaguauagaauaaaaauauguacuuuucgagcuuggugagacccuagagauuacuuauuauuuuacuuuauugauggguaaauugagacacaggaaguuuuagugauuugaaaaggaccuggaguugauguuagaagaaagaauaaaaaccaggucuuuugcccguugguccagggauguuuuaucagucuacacugccugcuuuauuuucuugauuuugaaagucaauguuuuaaaaacaaacaagcaaaccuuagaaucaacauuugacuaaauaacgacccucuuuuguaccuaaagagggugguuaugugcuacaugagauuacauaauuuugaaaacugaagccauuuuuuauaugaacccaacuugggaauccagauuugguaaacuaugacugcauagcccuaauuuacaaaguugucuuuaaaaauaaaguguauuuauuugcccauuauaaaaauaauucaugauaauuacuuaaauuuuggaaaauaaagccaggcuugguggcucaugucuguaaucccagcauuuugggaggccaaggcaggugguuugcuggagcucaggaguucgagaccagcugggaaacaugauguaaccucaucucuacaauaauacaaaacauuacccaggcaugauggcacacaccuauagucccagcuaccagugagacugaggugggaggaucacccaagcccaggaggugaauuuugccgugagcugagauugcgccacugcacuccagccuaggugacacuagagugagacacugucucaaauaaauaaaauaaaauaaaguaaaauaauaaguaaauagauaaaagaaaaaagaaaagaaaaauuuggaaaauaagaaaaguagagagaaaaaaucaucuuuccuucuauuccagucuuuucucuauacauacccuuuaguuucuaauuuucauguaaccaugaucuuggugugacauaugauuuuuaaugucaccuaggcucaacuaaaauacacaguaggccgggcgcgguggcucaugccuguaauuccagcacuuugggaggccaaggcggguggaucacuugaggucaggaguucgagaccagccuggccaacauggcgaaaccccucucuaccaaaaauacaaaaauuagccgggcaugcuggaggaugccuguaaucccggcuacucaggaggcugaggcacaagagucgcuugaaccugggaggcgaagguugcagugagcugagaucgugccacugcacuccagccugugcgaaagacuuugucucaauuaaauaaaauaaaauauguaguaauuuuuuagggugcaaauauugaugagaauaagcguucuuaauauuaucauaaggaagugagaggaaaaugccagcugcuuuuauauaacaucacaucuuuccaaacaugucuauguaaaaucgccaaagaccaagagaugcauuucugguaaaugaaaugaauaaguaauacuuccugccauguuugcaauaauuagaguguucaugcucuuguugggcauugcugcugucuucuucaucuuugagcuguauucuuauuuuuauucuucagugucagagaacuaguguuccagugagaaauaugaauaaauuuuaugcaugauggaggcacggaauuugagcacucauuagcaaguaucuggagguacauggugcaaggcuucagagcugguccagaggucuguuccucaguggaccauuuuaauacuggguguggaggagguggaauugcucagcacaaacccuacugucccgcuccacugcaucccaaggagguaaagugagaagacgauauuucugacucagagagcaacccuacaccucaguucacuuauuuuuauuucauacaguuugucacaugaguuaccugucuccugcugcgaucuggugacuaaggugaaauaccgcucuaugguguacugagcaagccgcagguguuccaguccacgcacagagucguucccucucagccaggugaacuccacaucauuuccaucauagcccccuggcaaauaaaauggagcccuggucagugcaaggguguuccagauugaacuggucuggucuggaaaaugcuauaauauggagacagcaugaguucuuucuucauagugauaaguccaaggacaaucccaugcagaacuuagcaagauuucccaagugcaauugcaaugucugcucugaaugaagugaccugccaggacgauuugccgucaauugagagcuggucuuguguuagguacugcguagaucugguggaugauaagucauuagaaguggccucccucauuauuuaaauuacauuuauuaagcacauaucugugaacacgcaaagauacugccuuucaagauuguauaauagcucugaugauauuuucagggacuuaagaacugaucuguucauauuucuauauuggcauaaaugcaaaaacaaaaacaaaaaaccugcuuuauuaaagccuguaaaaaugcacguuagauaagucucaaagcaguuuaauuaauauacuugauaauaguaacaauaguuaccuuuugaacauuuauaaguacuuuauacauuaugucacuaauguucuuguaaacuugcaagguagccauuucuauauuuccucaauucuaagauggacauuucuuuacauuuucugaaauugaacuggaucuuguaguugauuuauaucuauauaauauauaaauauuauaauauauauaauauauauaauauauaauauaauauaauauauaauauauaaacguauauauguauuuuaauauacaguaaagcuuauauuuuuuccugaaauguuauuauucaauaaaugcuguuccauagaacucagucacuauaaugauuuucccacauuauucuugaaaacucucagauucagagggguugcauaacuuucucaggauaacaaggcaagcaagaaacaaaguuaccuuaggaaaguuuaaucccaaagucuaugagugacgaugauaauaauaccuaucauuuaauaagcaauugcauuuccaagugcuuuacaacauuaucaucucauuuaacccucaauguaucucuuugagaagauacaugaaugguucauaagcaaacaaaaagauacucaacaucacuagucauuagggaaaugcaaaucaaaaccacaauaaaaugccucacacccauuagauggcuguaauaaaaaagauagacaguaacgaaggccagcacaugcagaagcuggaacauuagcuagugggaaugugaaaugguacaaccacuuugggaaacaguaacaaaguagcaauuucuuuaaaacuuaaauauauauuuaccauuugacccagcauuccacuccuagguaucuguccaagagaaaugaaauccuguccacagaaagacucacacaccaguguucauagcagcacuacucauaauagccaaaagguggaaaccaaauguucaucaacugaugaaucaauaaauaaaauuugauauauauaucuaucucaucuaucucacaugaauauauauauauauauauauauauaugcauacaaagaaauacuacucaguaauaaaaaggaauaaaguacugaugcaagccauaacaugugugaaccucaaaaacaugcuaagugaaagaaaccagaugcaaaagaccacauagggcugggcaugguggcucaugccuguaaucccagcacuuugggaggcugaggcagguggaucaccuguggucgggaguuugagaccagccuggccaacauggugaaacccugucucuacuaaaaauacaaaaauuagccagguguggcagcgcaugccagcuacuugggaggcugagauaggagaaucacuugcaccugggaggcggaguuugcagugagccuagauugcgccauugcacuccagccuggacaaccagagcaaaacucugucucaaaaccaaccaaccaaccaaccaaccaaccaaccaaccaaccaaccaaccacauagugcaugauuccauuuauaagaaauauccagaaaaggcaaauucauacagacagcgaguagguuagucaucgccugggagcuggugaugggaaagaggcgugacugcagauggguacaggagucucuuuggggugauggaaauauucuaacaaugacauguggugaugguugcacuacucggaaauguacuaaaaaucuuugaacuguacaauuaaaaugggugaauuuuaucguauauaaguuauaccucaauaaagcuguuaaaaaacaacucugagucagacacuauuauucuucccacuucacugauaggaaacugagguccagagacauuaguuacucacccagagucacagagcuagugauggcaaaacucagugauuucgguaccugugaucuuauacauaaagguauauugccuuuguuuucaaagacuacugggaaaugugaugccgguguuggaacuaacauuuuguuaagucucacaguaugguauccauugucuagcaaggguuaucucgcccuccccagggaagagaaauauagccaugaacucuuaggggauuuccagguaaaaacugucuguggacuuucccuuggaagcauccaaacauguacuaaagccagcugucuaaauacggcuaccaucccacauuaaaaaaaaaaucuaugaaaguggguaguacaaguuucuaccuggacacucugacuuuacaacuaguaaaugcucacaaucauuacauuauggucucucugucccugggugaauaaggaaaacugugggaugguaucaguucuuuucuagagaugguacuuagaaaaaaacccauagugagguuucuguacccaaacacugcuaauaaacauucagagaaagcucccuccgcucacuggggaugguauaugugaaacagaggcugaacagagaaagcucccuccgcucacuggggaugguauaugugaaacagaggcugaacagagaaagcucccuccgcucacuggggaugguauaugugaaacagaggcugaacagagaaaacucccuccgcucacuggggaugguauuugugaaacagaggcugagguuuccaggagaaucugucuccugggauuugagaugagcccagccacgauacacggaagguaauagcuuuuuccaugugggacugaaaaugaguucucuuuuugauaaccucaaguuuuauucugccaccaaacagcuguauugcuucaagaaguuucugcaugcauuuaaucaauaagauaauuaaucuguuuuucugggucuuuaauuaaaugucugcuucugaaaaauggcuucugcuucauaauggcugugcuucucagauguugcccacuugugaccuuacguaaggagugcccacugcucuccagaguuugacuauauuucucccuccacacacaagccccaccuugaugccuuaauaaaucauaucugcaauguuguuugccuaucacaggugccccaguuuggugggcauuucggagcgguuuacuaaggaacaauggagauuacuuaacaaugcuagggaguucauucaucacacaucaaccuagaguuaaauccucauucuucaucacaggcaaauccccagguuacaguuuagaugcccauuuacuggcaugacugugugagcuuuauaucuaucaagcaauuuuuuuuaaaaguuggaagcacgagugauaaaugucaaggauggcuuugcauauuugccaucccuucugcuuuguuccuucuuguacauaauccucaucuuagcagauucugagucccacuccuugucucuugguccauuccagcugaugcccuaugucucauuccaagugacacuuucccuaggaaaacucugaccccccccccauuacuuuucauuguuguaacucauucuguuauaauuauuuaaaguccugcacccucuauuagacuguagaguucucgaagacugcagcauuacuuuuaucuguguauugcaaacaucuaccacaguaccucacauagaaucgucauuuaaugguugaauggaugaauugaauguauuuaaaugaggauagacagauggaacccaaccagccauccagacuggcuggagacuuuagugggacaauauauaaaacuaaaguauuagaaugagaaaaaagacuuuccuuagcagacacaggaaaggacaaacacuggucuugguccuagguaaugcaagggaacuggcacagggauaugucugggacuacugugugguaaucagguugcaauucaguugaacauucuggcaggauuuggggaauccaacaaaagcgucacaugguuacucaauuuggggaacaaugaugauaauaaauggacacuggagaaauugggaaggagguauuaaaagauuuucauuaucuccauauuacuguuuaaaagcacuuuaugguauacucaggaaaaauaagcagcucagaucacaaacaagccacuggaacaaacucccuaugugacucuccagcccaguggaagggcuauuagaguucagggaacuugggaccuuggggccauuccaccuggguugaaguccccgugcggcuacuucacuuucccuugggaaaauugccaaauccuaaugaaccucaauuucucuaucugcaagaugggaaaaacaauauacauaucucucaggauuguuugcaaggugucuaguauagugacagacauggauuaaguaauuguuaaauggaugcuacaguauuuauugggaaaagaauauuuauuacuacauauauuuuuuuguuugagauggugucuuguucuuguugcccaggcuggagugcaauggcacaaucuuugcucacugcaaccuccaccuccuggguucaagcgauucuccugccucagccucccaaguagcugggauuacagucacccaccaucacaccuggcuaauuuuuguauuuuuaguagagaugggguuucaccaucuuggccaggcuggucuugaacuccaggccucaaguaaucuguccaccuuggccucccaaagugcugggauuauaggcgugagccacugugccuugcccauuuauuacuauuauuauuacuauuauuguuaacaaaaaaguuguucagucaaggagauuggggcaacagcagauugaggccauaaaacacauuuuguuaccuccuccaagaagucuuuccucacuagccucucuacuuccuuugcaauggggagugagguuuuucuuauuaucacagugcuuugcacagaaaaaaaaaauaaaauaguguuuuagacaugaaguccuugcccaugccuauguucugaaugguauugcuuagguuuucuucuaggguuuuuaugguuuuaggucuaacauuuaagucuuuaauccaucuugaauuaauuuucauauaagguguaaggaagggauccaguuucagcuuucuacauauggcuagccaguuuucccagcaccauuuguuaaguagggaauccuuuccccauuucuuguuuuugccagguuugucaaagaucagauaguuguagaugugugguauuauuucugagggcucucuuugguuccauuggucuauauuucuguuuugguaccaguaccaugcuguuuugguuacuguagccuuguaguauuguuugaagucagguagcaugaugccuccagcuuuguucuuuuggcuuaggauugacuuggcaaugugggcucuuuuuugguuccauaugaacuuuaaaguaguuuuucccaauucugugaagaaagucauugguagcuugauggggauggcauugaaucuauaaauuuccuuggguaguauggccauuuucacgauauugauucuuccuauccacgagcauggacuguucuuccauuuguuuguguccucuuuuauuucauugagcaguggcaacaaaagccaaaauugacaaaugggaucuaauuaaacuaaagagcuucugcacagcaaaagaaacuacaaucagagugaacaggcaaccuacagaaugggggaaaauuuuugcaauguacucaucugacaaagggcuaauauccagaaucuacaaagaacuugaacaaauuuacgagaaaaaaacaaacaaccccaucaaaaagugggcgaaggauaugaacagacacuucucaaaagaagacauuugugcagccaaaagacacaugaaaaaaugcucaucaucacuggccaucagagaaaugcaaaucaaaaccacaaggagauaucaucucauagcaguuagaauggcaaucauuaaaaagucaggaaacugcaggugcuggagaggauguggagaaauaggaacacuuuuacacuguuggugggacuguaaacugguucaaccacuguggaagacaguguggcgauuccucagggaucuagaacuagaaauaccauuugacccagccaucccauuacuggguauauacacaaaggaauauaaaucaugcugcuauaaagacacaugcacauguauauuuauugcggcauuauucacaauagcaaaggcuuggaaccaagccaaauguccaacaaugauagacuggauuaagaaaauguggcacauacacaccauggaauacuaugcagccauaaaaaaugaugaguucauguccuuuguagagacauggaugaagcuggaaaccaucauucucagcaaacuaucacaaggacaaaaaaccaaacaccgcauguucucacucauaggugggaauugaacagugagaacacuuggacacaggaaggggaacacaggaaggguguggggaggggggagggauagcauuaggagauauaccuaauguaaaugacgaguuaaugggugcagcacaccaacacggcacauguauacauauguaacaaaccugcauguugugcacauguacccuagaacuuaaaguauaauaaaaauauauauauaaaacaaaaaaaaugaaaaaagaaauaaaauaaagucuuugugauuuuuuagaccuaaaaauguagcccuggacauauuugcugacaaaugaugaguacauugaugaaaaguccaugaccuuuuucauaucuucuacugggaccuguggcugauaugaucuugggagaguaaggguggguggguggcaaagaacauggucauagaacucaucuggaaccacagacccuuugagaguuaguaaucagauagauggcauaaauuaaauauuaaaaguuuaggucucaggggcuagucuauauuuguugucaccgaaauguuuuuuaugaaaugauugucccacaaaacgcuuaugaaagaagauuccaugguuuaaaacguuugggaagugcuaccacuccuucuuggaauuucacguggaaguaacuuauuagagcccguuaaaaacucugcagcaggccaggcacgguggcucacgccuguaaucucagcacuuugggagacugaggcaggcagaucaugaggucaggagaucgagaccauccuggcuaacauggugaaacccugucucuacuaaaaauacaaaaaauuagccgggcgugguggcgggcgccuguggucccggcuacuugggaggcugaggcaggagaauggcgugaaccugggaggcagagcuugcagugagccgagaucgcgccaccacaguccagcuugggcgacagagcgagacuccgucucaaaacagaacaaaacaaaacgaaacucugcagcaaagaagaauguuaauacuuaaggcuuuaugagucaucuggucucuaucacaaauacucaacucugccacugcaguacagaaguagccacagacgguguguaaguacaugggcacgacugugugucaguaaaacuuccuuagcagaaacaggugauggggcuggauugggcacaccagccguuguuugcugaccccuggccuagaccaccaacuacauuaaagcauuuccuuugguuuucuuguccacucauagguggagauaucugguacuaaugcauaaugguucuccccaaaagauauuaggcauaucuuugagaagucucuaaaucugucuggaaguacagucagaagggcugaauccacgaugaaucaacauuaagaaaagaaaggucacuguguaugagauacuuuucaugaauacacacaccuaagucacccaggaaaaucaucucaggagccuguaggauguauacuuacagcuuuccagcugcaacuugcaugucuguguguccaugggguauuuagacagauccauguuacaugcaacaguugucgugauucuaagagggaaaaacagguucaaaaacaguauugugaggaaguuauagaaaguucacauuccuucgaaggcccacucaaagaagacuuucacuggaacucuuaaaugaacauguagcuuggagucugcauguaaagcauccuugaggcucugggugcuaaagaaugugugcaugaggcuugguuaaaccuggguccagaguggaggaaguuggaaugcuggccauucaaggggcaaaacuucuggcaguaucacagaacagacagaugcauuggcucgagaugcuuuagcauccaguuuuuaaauuuuaucuuccugacagaccugggugggccuagaacaguguucaccaucacuaucgucaccacuugacagcaggcauagggacuugcauaggcucauguggcucugaguggcagaacugaggcugcagccuaggucuccuggcugugcucuucucaugaggcccugccuccucaugggaaccaggaugcagaggcagugggggccccaggcacuguggcuuugggggcuuaaccccagagauauucaauuaaaggucaguuaugcccucacaguggagauugcauucaccaggccucuaucuuccuuuuucuucagugucauacauuuuuauucagcauccuuauuuauuaagcacugugcuagguacuugggggaaauggaggugauuacagaauggugcucaccuccaggaugcucacucacacucccuuuagggagacagagacuaacaauagcuaugguuuacugagugcuuacugugagcuagucccugggcugagugcuuugcaugcauuaccccuuugaacaguucuacuagguaggaaauauuuuaauucucauuuuacugcugaugaaacugaggcucugagagucaaguaacuugccuaaggucacagagcugcugagggacagagcagggacuuguaccaaaaucuuuaugauucuagagccaggcuauuaaaacaucacucauuauuuguaauccuuacacaauauugauuguguugugugccauaauacagacagacacacauguacacacaaaugcaugcacacacucacacauccacauucacacauugcugugggaacauggggaaggggaacauuaacgaugauuggaauugaggucaaaagagaagucuaauuauguuucaugagacaagaauugggcuuugagauggucuuugcaaaacucaguacaguugaggcauguccagaaauucaguuuaucgguuagcucaacccuuguuuuauaacuuuagacucuuacuuaagauuaaacaucagccccaugaauauuuggcuccuggccuccuccccaaggccucugggagcuuuagguuugcacaguccuugcacaggcagggaugaguccuguuccauccaacccggcuccauuaacaauugggugaaaggaacuugagcuucaggaauuuggggagauggcaaaggggagcccauggcugcagguggcagagacuuuggggcacugcaccuugguuuucucuacaaacaugacucagacaaguagagugguguucuggagcugcugcaguuccacugggccccaagaaaggaaaguuccuugcaugcaccucucugucgucucugccauugcccuuauuucuucccuugcuaacuuccuuuuacccuuuaagacauagcucagaauccugugaaagcauccuguaacaucacccccaaaccacucaccuacucccuaacuugggccccagcaccagggaccuccuuuguuuccauguccgugucuugaggacaggucaaugccuuacucagcucuauccuguggccagcauggggcuuggcacagagcaggcauuugguagaugaugaacugagagagggaccuucuauuaugggggcaaggaucuaagaagccaugggaccucacaguggcuauuugaguucuggucacaacuacccaagacacaucugcauguuuucucccagcugccguccuccaccccugaggucacagguguccgcguaccugagggcauacaggaccgugccauuggagaagaggcggaugagccuguuucccacagugacuucauggaggaaggacuucuuggacuccacaauguaaguaucuggcacccagaggaacuccacgaggcgggcauccagagugaagcucuuguugccuucaaacaccagccgcugguccauccagcgcugucggagguauaugguggcuguguaguccugggagggggaggcaggguauggaaauggauggggguagugggugagaaaaccccaccaaauggaggaaaguggucaaaguuuacuccccuccccaccuccacuuagagcaagaauacacagacuuuggugaauaaaguuaccauucuaauugcaauaugccacuaccccaagacugggguaacugauaagucacuccaguuaccccagucuuggguuaguggcauauugcaauaagagaacaaaucgccuuauuuauucuagauaauagcuccuauugccaaaagggaacgccauguucaagacuuuaacuuacuuggugugacagcucacauugcacugaucacuaaggccccaccaaauuguugaauuuuuuggugggcuaagugcuuagguuguccacgauuuaucuggaaugcacagcauacccucuuggcaaacugccuuuaguuugcccuugucucgaauauguucucuuaagggagacagucguugucagcaucagcugucaguuuuccucggguugucucccccauuauaaaagaccauguaauggccaggcuugccuacuacacuuucauuccuuuccccaaauuuuauccaucaccaaguguacccacuucauugccugguuucucuccuucuggcucuugaaccgauuuucuuccugcuacucaggaaaucugcucuacaagaaucuuccauugucuuacucagaaaaucugcucuacaagaaucucccacugucuugaguuuggagauagcacuccagcuucugccauuccaaauggaggagggccaugagccauucuuuuuuuuuuuuuuuuuuuuugagcggcuagaaagcauauccccuuuaaacacacagagagggacuacuuggguagaguacaaaggaacagcgcuuaccauguuacucucugaaaugcuagagauacuugcaauguccagagucagcgcuaucuguacggguucuccuaagauaaaaaaaaacaagaaagaauggaaacacaaccaugagcugucuuaauacuauauuagugcauucuaaaaaagauuaaaauuacaaaaguugugcuugguuguuagaaaaauuuaaauauucuauaaauauaaaaagaaaaauuuucuuauccccucucaagaguaaccauuguguauggugugccucucuuuuguaugaaaaauaugcacacauacauagguaucuuaauauguaagagagacuaccugcauaauuaaugcuuuuuaauuauuauuauuauuauuuuugagacagaguuucacucuucuugcccaggcuggagugcaauaauagcacgaucucggcucgccacaaacuccgccucccagguucaagcgauucuccugccucagccucccaaguaacugggauuacaggcaugugccaccaagcccggcuaauuuguauuuuuuucuccauguuggucacgcugaauuaacgcauaaggaacauagugcuaagacauuugccacuucuuacauggaggguuuuuccuauggcauuuguaaggaacuaauuguuuagaaagguaacagauuugguaaucugauugcgcacagauguuguuuuaucccccacuuggcuaaguaaauuuaccacaagaggcauucaagacucauggcugagcuuuugcugaccuccugauacuuugcuucucuuccuuuacucuccuggaacccuaaacaauuuagaauuucagaaccuccacacuugguccagugugcagacuguugggccucaauccuggagucucagcagacagauugaacuucagagagagagaguucuaucucuagagacugaggugucagagccaccuucaagaagccaggccaggucagggaaguuuacuucucuuuauauggagauguggaauaauggaccuagaucccagcucugucaccucccaguucuuuauuugggaaaaguuauuaaaucuuucagagcugcaguucucuuaccugcaaguggagaucauacugacaucacagggucaugggaagggcuaaaugagauuagacgugugacauugucuuuguggaguggcggcaauggggaguguaagagaagugccugccuagccggacauccugaagguguucaucauugguuaucuguacaaagcucccagcgucauguccaucagucacguaauaauaggcgcucaauaauggcauuucccuucccuucccccucucuuccguaauccuagcuaauuuuggaaaagggacaacuuuauucaccaggcuaauagaugcaauagcauucacuugcaauaaauaacccccggggguaccucaggggacugugauaaugcauuaaccaggaagaggccaggcggauuucaaaagaagcuuaaaaacaucucaucgguaggaauacggcaaggcaaacuacuuauuaaucuaaggagacuaagccauaggauauagguaggaauuugaaaaugaaguguuagagccaaugcaauugaacaauaauugaauguuaauaucuggugggaaagggcgagaucuuugagggcacacccuggaaggugcuggagugaccuggugcuaaguggcuuucugccccucugggcagcaaggugcagcucugagacgagaagccuggagucagagacagguguuugaauuccacucaggccaccuaacagcuuugugaucuucagcaaauuucaaguuucucugugcugcaguuucucuucuuuuucugucuuucuuucuuucuuuuuuuuuuugagauggagucucccucuugucgcccaggcuggaggugcaguggugcaauauggcucacugcaaccucugccuccuggauucaagugauucuccugcuucggccuucagaauagcugggauuacagcacccaccaccaugcccagcuaauguuuguauuuuuaguaaagaugggguuucaccauguugaccaggcuggucucuaacuccugaccucaggugaucugcccaccucagccucccaaagugcugggauuauaggcaugagccacugcgcuuggccuaugcuacaguuucacaccuguaaaacagagcuacuagagccacugugguuugaauguuuguccccuccaaaacucuuguugacauuuaauugccauuguaagaguguuaagagguaggacccuuaagaggugauuaagccucaugguggaacuggugccaugauaaaagggcaaguucagcccucuccuguccucucucucacccucucaccuuccaccaucugaugacacagcaagaaggcccuugccaaauuccagcaccuugauauuggacuccucagccucuaaaacugugagccaauaaacuucugcucauuauaaauacucagccucagguauuuuguuauagaagcacaaaacagacugagacaagugccaaccauugagaguuggguuggcacgguuacggcaucuacuuuaagugccauagauccguguuaguugcccucccugaagaaugcagagaauggaaaagacacgagagcuccacugugcuuucuguccaguuuauauucuacaccgucuaaucuaggcuuugccucaauuggcuuuucuacuggaccagagcuugcucuuucuuccccuugaguuauaaaagcaagcugugccaccagagggcagcuuucucccaggaacgaggucaaagccagcuccuggguaguguucacuagugccugcuuacaaaccuuugcuuuguccagcucaaucccuaagaaauccuaugaaggucuugucucuuuuggacuugggguccugaaaacugggugcacagacauuacagagagcaauggcccuccgugggccuccagccugccaugcaaguauagggauuuucaggagugaagugccaagaggcacaaaacaagggguaugggguugugcuuuucccuuuuuuaaacugaagacuccaugccccauuuucaccccaggugggaugaggcaucacaucccuuuaggccuaccccaggcucccuguucucagaaugagcuccuugcccaaggacccugcaccuuguuggccagugaguaggcaaacaagaaggaguguauucugacuuaauuguuugggguuugggaggcaagagaaauuguugaguggcacuaaccaaggcgugcagacucacgugcuugucauacguguucaguagggccugggaaaaccaggggauauuggagccucuuuagguucuuuaaugucaggaucucacaucuuaauugugucucaaaucugaaugaaaaugcaucucucccaucuccaacugagcaggugugauugacugagggccucggcugcugugcuuuggaaucuaccaccacacuugcuccgaggccacacuucucaugggccacagccaaccacagacugaacacaguggggauaucaaaguggccuguuccugggaggcacagagaugggagacuccucugaaugcaccuguagcucaaggacucccugguggucauuccaaacacugaggacugcccuuccaucuaagaugcuuccacccaaccucccuuccuucccucucuccuucccugaggccagaccugcaggucugacagcucuccuagcuugccucucccgcugccucauucucccuucuagacauagucccccuaaauagcuugaagaagucaucagcucuuggcaucugcugcccggaggaucuggacuaccacaugaaucuuagaucagaccagaggguuuuauuaucugaggggaggagcaaggaggagaagggaugaaaauaacccacacucuguugauggggcaggcacugugccucaggcuuacacacuucauucagucuucccugugagauagauggauguccccauuuuacagaaagggacagugaggcacagaaggcuaaaccacuugccaagcaggagagcuaggagccaaacucagguuuguuaaaugccaaggcucuuucuguuguuuucugcuaugaagagcugugcaguuggccucacucccucccuccuugcuuuauucuuucaacagauauuaaucagcaauuuguuauaugucacgcacugagcuucuaugggggauagugagggaaaugaagucagacuccuucuagggcugcagccuggagccgggacagacaugaaaucaguuauagcauaaugggaacggcuaugauuuugaggcauguucacaaggaagugugaagaaaggggauggggccuggaggaaucaggggaggcuucucagagaaggcagcguuugcucugagacaugauggaaaauugauauuuucuagggagucaaguuuaaagaagcaauuccaggaagaaagccucuguaaaggcauagaggcaggagaggccagggaugucagggagcauucugaguacacuggggagcauuguaggaggggaaggagcggggacuuggguggaugagaauggcagacagauaaaggcugggcugggaagggccuagugugccuggacucuacgcgagcaugcugggacacauacagguguuccaacagggcaaugacccaggaggcauccagauggcaguuuggggagucagcugaaagggcucaggcuggagggggaagaccagaugggguagccugguggcgcauggugaauucauugaauaaugacccuggaagugggggcaggaggacgacagugugugaguguuaggaggcucuugcagccuccacagugagaaggagcauuccuuuaucuugcagguggagaggcugggugccuuuuuccaggcagugugaaaaaucauugguagccauccucauccaucauugccaauccuuaacaggcugcagaucagaaaauggagucaacuaaaaccucccgaaacccuccacugcuuauugucucuguuuucgucccuuugaaugauguccuggacacagaggaugaccuaccaccaaaauugggccugagaaauuuguuauauccugcugugagguucucaaagccaggcagggaaagcuugucacuucugccgaccucgacguugaacugacuccccuggaugcacauccuggaaaagaaaugggcuuuguuguguuugcuuguuuaugugugaaucaacacguguacacacccuugagcuuguguuugcccacguguguguggguguaugugccuugcccauguaccagcagugacauuccuacagaaaaaucucuuaguuuucagcuauugaguuaguaucuccauuuuuuacccauuugccauagaucaaaauaucaugguaauuuggaaacccuccaagucucuucuuuaaaaacauaaggguucauucaucuaugaccauauuggaagcuuguguucuguaaauagaguaaauggcaggaaguuucauuguucggugcuccagggaagugaguggaccggguuuugccuugcugugggugaauaggaggagcugcccccucccaccacaugcccgaaugcaaagcaacgcagauggaggccauucuggggguagcaaagcucaccucucagugaagagacucagacacacgaaggccaaguggaggcuguaguucauguugagaagcugcucacaccaaggggcugaaguaggaaucaccugggaaacagggggcaagguaaguggaaggccgugcaacaggcucaccugcuccuggccagccucucucucugguggguggucgguacagcauuuucucagcaugcauaggaagcagccucuuuccauaccuuucgguuacagcuccuucucccuguguucccuccaggaaugacuucauuuuggaggauuauguuuuuuuuuuuuuuaauuuuuuauuuuuuuuaaacagggccucacucugucauccaggcugaagugcagggacaugaucucgguucacugcagcucaacuucccaggcuccagcgaugcucccaaccuuagccuccugaguagcugggacuacaggcauguaccaccacaccuggguaauuuuuuuguauuuuugguagagaugggguuucaucauguugcccaggcuggucucgaaccagcucaagcgauccaucugccuuggccucccaaagugcugggauuacaggcaugggccacuaugccuggaccaggauuauguuuuaaaucuaucccaaauuaagacugggaccuuguuuggagagugguucaucagcaccagaaaugcagccaguuuauccucugggccauaucugcugggagccaaggcuauccuugcccuguccuugucccagcuuuaccaggaaggacacucucaacucuacacucaccuugaccaagccagacauucuuuuauuuauccccaggucuaggcuuguggggucagucauguagacaggaaacaaaaaccugagagccuccagugucaggaggucaugaguuaggugcugucccacagagcucacuccauccucacaguggccuuguguggugggcggguuaaucccuauauuauuacgacaaggaaacaggugcaugggaaggacaccaugcuagugagugccaggggagacuuugaauccagggcuggcugccucccccccgguacucucuuccuucagagcaggcuggggccugggccuuaguugacccgaggauccuugcugcugucgugaccuccuagaccuugucccuguguuuccugaagccuuccagcugguguguaugugaggaccauccguggggcauggcccaggggcccggccuccucagcuucaggagcugcugucaggcgucccucugagggagcaggggguagccaggcaggccagccugugaccugucaugcuggugacagcagaaugggggugcucaggcucaggccccauucucaggcagcccuggguugauuaccuucucuguggcaacuucugugaaacaagccacuuucuagaaucuggccauucuggagcuuagggcaugauucagccacucauuaauguuauuuuacuuucaaaaccaauacucgcucacuguugaaauggcaacaagucagaaguuaaaaguauaagucccaaugaugugucaauauggauucaucaaugaaaacaaaugugucccucugaugcgggauguugacaguaaagaagguuuuauguguagggaaggcucaauuuugcuaugacccaaaauugcucuaaaaaagaagucuauuuaaaaaaacauaacaaaaacaaaaaaguccccccccauuucuucucuuuugucucauacuucagaaauaacuaccgauaacaguuguuuuauccacagauacacauauauauuuacauacauauauaucucuauaucaaaaaaauuaaaaagcaaaauuggggcaauagcaugcuuuuugcggcuuacuuuuuuaacuuaauuauagcaaacauuuauugaacacuuaaugcaugcuuacaacugugccacgcauaucuagaauccucacaacucuuugaaguagggacuaccauucuccccauuuuacaggugagaauacugaggauuagagaggauaaggaauauuuccaaggcuaaguaguacaugaggggcagaaaaguacaucuaagcaagcugacccaacuccucuuaaugagugcaccaugaaacaugcuguuuugcaguaucagugacaccuuccaugucaguuccuauaauccgccuuauucucucuaauggcugcaaggugucucauggucugaauguaccaacauuucuagaacacaucuucuacugugaaugcuguuauuuccaaaguuuuuacguuacaaaaucagugaagaacaguuuugcacacagguaaauucuuaucauucugcucucuguuauguuagcuuuuuuguucucacucauugaaaauaccaguuauaaaaucaacauuauaaaucuaccaacgaucauauucacauucucuuccuuuaguccaucuccccaaucccuguccuuucccuguccaagcauugaguuuaaggggguccauggagcagcucccaugcccuccauugccucauucaauuuuccacagguuuauugagcuucuccugugaaccaggcaugugaaaagcaccaccagagcacccacccaucuagugaggaagagacaugugugacuggugaaugaacauucccuacagcauccucuaauaggagcagaggacaggggauauuugguaugcaaaagagcagggaggauggggcaaugucaaaagggaagucacagaaaaggucauuugauucuugaagagugaguugcauuugccagguggacaaaggagagugggggcccuccaaauguuggacagagaugugcaggcuugcccacggccucucucccacaugcuuaucagccucuucccaccagcccuuggcugucugugucuuucuccuggucuggccugaaggaacaugguuccacuuuggcauauuccucauuuccuccuccuccuauaggaaauggcccucgaucaagugauuuggggaaccauccagucuucaguuccaagacuccucuugaauagugcuuucccaguggccaaacuucuguuaggaagauguaacauuuggcccugggccucucagccuccucuaaggagucucaugaucugagaagcuucacccaggcuagagccagaaauguaaucccauccuaccguguuugcuugguuaaguugcuaaacacgucucauuuuauaagggaagaaaagagaagaaaaaggcuucuaaaugcccaugaauuguuagaagccaugucuggugcuuaauuucauuuaauucucauggcugcuggcccagaagguguuaauuuuuagagucaaaucuuagauuugcaaggggauuuggcugaggucacacaguuaaguggcaugauuuaaaucuguuuuccaagucccuuuucuuugcccugcauuuaggaggagggccuucagcacccccaagcugaacuggauuccacuugaaucuuguccuuuuuauaccaaacccaucugggggauggaguguugcauccgcagcacaucccaagugacaagugcagcugaugccaucacucccugugguagacgagccaaucguuaaguggcuauuuaugugucggccagccucaauggaggcucaggccaccaguucugguacaggugcugggggauggaauuuaguggagagguacugagccaccagagagcaguguccuaaggguuguccccaaagcugcaacacagauguugacuggaaccaccuagccuucugcaucugcagggacauggugcucaggaggcccuaggaggcuccugaguaggggcagccuaugcauuauccugccccgagggcaucucuggccaagcuccuaccuccacuuguagaggagaccuugagcucuggauccugauacacccgagucauuuaaccucucagagucucaguuuucccaucugacaaaugggaauagaaagcauucaauaaacauuaguuuucauucuccucugccuuccgugucuuccaugggaauucagugauuccacuaugacuaauagaacccaaaucucaagcucuuucuauuucuauauacaccccaggugccacucagagugugagcuaacuggcaccaccucaggaaguacagggucaggcacagggcauuaaggucacauagggagcugauggcaccuuuuucuaaaccagaaauccagccuaaugucucccagucucccccgccucuuccuggcuuggccuacugggcuucuauacuccgugcucuuggccucuaugucucuuuugaaaacuucccaggcuggaagcagaaauaauuccaauaugugcaaguuucuacuaccguuucuacucuauucccagaauuucuaccauguaaauacagugacccccaaccccaacuugucaccuccagcuuccuuccuaugcaggcacaguuuuccuauccuuaucacuucagcauagacagaaucauuuguuggaaagcaggaguagagcccgaauuagguuaaggugaggaaaggcauuauugccaugggucccgcuuaagaaaaucccagaagauaaaguggugcggcgcgugcccugugucugcuggucuuggccagcugcugcacaggggugaaugacuguggcuguagugaggacagcaggggcucuaaucuuggcucugcugcucguccugcaguggcgcucccugaugcucauuagguguucagcagaguccaggccugcccccucccucggucccagcagggcuuguauuuggaucucccucccuccccucucuccagacaccuggaggggccagcaguuuccuuaccagguaguuguugaggcucuguuagggcaaguccuucaggccuacaggcaggacuuccaggcaaggcacggucuucuggguccccaggguucuccucauccucagcccuguccccucguauguggacacgcagccacccucagauggaguggcucucuggggaagaauggagcugcua

SEQ ID NO: 16535 - RNA, 1683 nt, Homo sapiens
uugaaggagggugcagauaggauugaggagaguauagaaaggaugguggaagggaguguacacagggcuggaggagggggcaggagugaacgcacaggccaguugggagcggugcagagauccgugagacaugaugguaaagcugcugggccaugguaggugggaaggagaggagagagauuucggugcagacucucagagggcaggauaaacaggauuugauugauuagggguguaggggaggaaaugucaagggugacucccaggccucugguuuggggaccaggauguggguggagcaguucccugaguggggaacacuggggcaggacagauuguaagaugaccuaagggugaauuuaguuauauuucucaggcuaggggcauuugaugagaaauccagaacauuuucuuucuguucuucuaauucuggcagugcccaaacuccuugucuucuguaggagaaacccuggauucgggcuaaaaucccccucagcuggccuggugcagcugcugggggagaggcaccuggguggagacgaagcccaggcacccuccuuucucuuacugaaacauggcaugcaccagcuucagcacggugggagaguagccucugucuaugggacuccggcaaguccaaguuggaauaagcaagugugggaugauuuaaaggcugggacuuuaaagucaaauaccccagaguuucacucuggcucagauguuuagcaacugugugaccauggacaagucauuccgagacucggguuucagucugcaaaauggagcugacauauucccuugggagucguugagaggaucagaaccaacaccugaggcaggaugaucugaaguaccacucagagcuuuuccccagugucuucuuccccaucccccaugccugguucaagaaguggugagguggccucuccuagguguccucaggguggcuuuuaggcaaaugccaagaaaaagagaagagcaccuaugagcccaguuuuugaguuuuaaggaagacuuugcaacucagauucuuggcuuuccaaaguccaguccuugaaaugcuuaagcaauaaguuggaugccuuaaccaauagaucuugaagaauaugugagggugugugggauagguuuuucuccagggaguggaggaagauucucugggccagagggaaaggaggauagacagaggaggagaaagagacucaaaugcugagaguguuucugaccccacucucucuagaaccaggcgagggcuugugcccaugaucuugugacaacagaaccuaagcucuuaaguaggcuuugagauucaggacaagugggcuuggugccucuuccuggauguagccuggggagguggcaaggcuucuggcucuccuccacuccaggccuguuugguggcaggaaggcaggaaaggccccaguccucagauuggagaggagauucuccgagagauuagcaucuccuggagaaggaugagcggagaccugggcagucuuggaaaggccuugugguuaaaccuggaagaaauggaugcuuugguggacucagggcuggagacagaggaaaugugauuccagcacagccuucagugacggagggucauuccucccccggguagcuccucccucaacagugccagggcaccuuauaaauucucuagugggaagagaagggaaaga

SEQ ID NO: 16536 - RNA, 21053 nt, Homo sapiens
cgugagacgugggacuucucgcgggaacugcauucaaauaucccaggcgcuuacucgagagcuagcugagcgaaugggccggcgacuguggaguuagcguccucaauguggacgcccugagcucccauuaggagccgcuggcugcggcagcaggggacuagcgugagagguaggggcaaggggccuggugggagguggguguggagagcggcaguggggagagucgaacaggcccuaaagaaagcuaggggccggggucucggccgaggccuuuagcugaaacaucuccuuccccggaacccuggggucuuauacacuggguuccgagccggucuuaucuuccgcuggaccaccucgccgcccucagggauucuggacaaauauggaacguugggucgguugccggguccucaaaauuauaaccgccacuggaucugcgcugugcgguacgguagccucuagcccgaacuaagaaauggugcagaugggagauacauauuggguuucagagauagcgcauaaggaguaauaucucauuaauaauuuuuauaaugauuacauguugaaaugauguuuugaguguauuuguuuaaauauguaaauuaauuuuucaucuuuguuuacuuuuuaaaucaugauggcuccuagaacauuuaaaaucacguacaugacucgcguuauauuucugcuggacagcacugccccagccgugugucagauucuacccuaauugcuuuucauucguuaucucauuuaauccuuucaguaaccgauuagguggguguuauugugcuuguuuuuauagaugauuaaaccagaaauuaaauaacuuguccaaguucaugcagccagugaguaguggaggcgggguaagaacucaggcaguuugauucccagaguuuccugugucccaaaugcuuugugugugcuauauuuuugagaagcaggacaggaaaaaugguugcagcaccaugguuucuagguagauucuaguucccaucacacuucgcgucuuaacuugcggguaacccuaagcaaguuacuuaaaacuuucuaugccucagcuugcauguguaaaaugagggaaauaccuucaaccucuugaaguuguugagaagauugaauaagaauguguauaaagcggccgggugcgguggcucacgccuguaaucccagcuacucgggaggcugaggcaggagaauggcgugaacccgggaagcggagcuugcagugagccgagauugcgccacugcaguccgcagucuggccugggcgacagagcgagacuccgucucaaaaaaaaaaaaaagaauguguauaaagcaccaagcacaaugucugucacacauuaguaguuuuuaaucaaccacggcuaucucucuuuguagauugauagguuaacucuuucucauccauuagaccucugcugaaaaguuacuuccucaggaaaauuuuuuuguccauguucccuucuacgcgcugccccccagauuaggacagcucccccuuguuacaggcucagguagcauacaucugucucucuugcacuuaucauacuuguaacuugauaguucaauuacuugauuuaaugucuuuuacuaauagacuaggauucaagaagacaggaauauuguuuuagguugccauuguguugucaacacuagcacaaugucucacacaauaagaauuccagcaaauuuuuugaauaaacuaaagcaaauuuuuuuuggcuucucuggauaugccuggcuggaaugucuugagguuaacccuauuuuuauuuugguaguugagaugacaguauuuacuuaacucaagcucaucaagauaauuagaugagauaauauauuugaagcaguuagcauggcaaaugguaaauccucaacgaauguaaguuauugugaacaguacaacauuuaguuggcuggccguaucauguacaggcuuugaaaaggucuugcauuuuagagcagugacugccaagcugggauuaccuagaacaccuuuuuuucucucuuaaacccuguaucucuucccuugucuucauucucaguuaaagaccuugcuuccuaauucauugauaaauugaagcaguuaaaagguuacuuacacagacuuccaccacuguaccugcuuaucagcaucuaaacucauauacuuugcuuaaaugaaauauccaugcuucuauuaaaaccagucucuacauuaaacuucauccuguuuauucagggacaucacuagcaauucuccagugucuucuagaucaucaguuuuucuucucuccuggauuuaucccaugaccuacaaacacuguuauuuuuuuccaucuuaaaaauaaaaaaacuugucccuacuuccucuccaacugcugcuccguuuauccguuauccuuugcagcaaaccugugcuugcuaucuuuaucuccuaccauucucucuugaaggcauucuaguuaggcuuucacccccaccuggauaucaaaacuguucuugucaccagagaccuccaggaauucaaguucaauggccaguucucugcucucaccuuaauugccuuagcagcagcaucuggcaugauugauuacucccaccuccuuaauacacuguuuauugccuuccaggacaacacauacuccugguuuuccuucuaccucacuggucacuccugauucuccgcugucuucuucccuaccucauaacaggguucagucguugguccauuucucuuuaaauacuuuuauccucuauagacugauaauucucaaauuugcauauccagccaagauuccucuucucauauauccaauugccuacuugacauaguucauguucaaaacucaaauuccugauuuuauuuccaaaacauuauuuacaucagugcuucagcugauggcaauuccauuuuacuaggugcucaggccagaagacuuggaggcauuuuuuacuuuucccuuuuucacacaucccaaauuauaucuuucagaaaaucauauugaccuuaccuucaaaaccuucaaaaucuggccauuucucacagccuccuaugcugccacccuagucugagccauuucacauggucucugcuuccagccuuguuccccuucuaaacuagucaacauagcagccaaaaugauucuuuuaaauuauaucagauccucuacuccagacuuuggaaugacuucccaugucacccaaaguaggagccaaaguccuuauaauggccugauuugcccacucucuacuaucucuuagccaaauuucacucccugggcuucuuccugccuuaaggauuccccucuugcuggaacauucuucuucuaaauagcugccuggcugauucucucaucuucugccuccugguuacaucaccugucccuucuucccagauucuuauucuguucuauuuuuucucaucuccccuuucuaauuuauuaauauucuguuacuuacuguuuaucuuccccuccuggaauguaaguuucaugagggaggagcuuuuuuuucguccauuuuguucccuaaugaaucugaacugcccagaauggaaccuaguauauaaggcauucaagaaauacucguucagugaaugacuacauugacuugagacaugggggaacaucuugcaaugaccuggugcccuuugaaggcaaaggugaguuugagucucgcuuaggaggcugggaccaaauaguaaaggauaauuaguaagguugauuaaaguggaauguuucuauauauaauguuuaagucuuuguuuauaaaucuagaaugaaagcaacauccuuuaauucuuauggauaugguuucuauuuuugcauacuuuuaugaauaacuagaaaaauacuagugaaucucuuuccaggaaagcagauuuaauauauucaggaaguuaacacuguugugaaaaauuacagacaugauauuucuuacuuuaccuuaugagccuuauucacagcugccuuuuuauauuuuauguguuuauaguacccagaccuuccuuuucuggugguauuauuguuauuaucauuauuauuucucaagacagugucuugcucugucagugccaugaucauaacucacugaagccucuaacuccaucaauuuuccuuccuuagccucccaaguagcuaggacuacgggggcuugccaccauccccaccuuauuucuauugauugauugauugagauggagucuugcuauguuguucaggcuggucucgaauuccuggccucaaguaauccuccccaguugcugggauuacaagcaugagccaccauaccugcuacuaugagguuucuugauuacuuuuuuguuauucccuuaauuuugauuauauggauagugguccaauuaugagaccaaacuuaccuuaacauauuggaagcuuagcauacaacaacugaacaguuuucugauggugaacuguuuagaagcaaaauuaaauguauucuauuccacucuuuaauuuuugaucccaaaucaguaacagaauugucagaacaguucuugcucuuggaacaagaaugcaaauuugacuacuuauuagucaggaagaaaauuuuaauguuuuuauacgacaguaguauugaguagauauguuucuucuguuauugauauuauugcauggaguuuuuuguauaagcuuaaguaguuuuauuuccucuauuuacaguuggcuaaaaaaaagaaaagaacauggaggcagauauaaucacaaaucuucgaugcaggcucaaagaggcugaagaagagcgacuaaaagcugcacaguaugguuuacaacuaguagagagucaaaaugaauuacagaaucaauuggauaaaugucguaaugaaaugaugaccaugacugagguaggacucuggacuccucugucugcaagagugugcuuagcuauugaagauuuguccuguuuagcaauuaauaguaguaguaguuuauucuuuucugaagauuuuagaucuaguucccgcccugccccgucccuguuaaaaaagaaugaacuaaaugaauuccuguuauucuuuccacccuaguguauucagaguuugaaagaucaaguuaucauuacucucuuugccacauuuacuaccagauuuugcuuugucugcacacuuccuagaagaccucacuuguuuuagaccucuaaacaucuaagugccccaugacacuacaccaagcccuuaguucccccaugaaaucuagguuuguguucaacugcccacuaauagacuucucaaacuuaacacagacagaagaguggauucccuguccguuaaccaaauauucuuuuacgauuuuuuuuagcuuauuuaguaaauauaauagcauucaguuucuugaacaccaaaaaucuuuauauaccaaagauuuuugguauauuuuugguuucuuuauauaccaaaaaucuagaacuuuuagucaauaucuucccuuuauuucucacauuucacucauuaauaaguucuaagaacuagacuacaaagcauguaucuuugcuacuggcacuguaguccagaucaccaucaucacuccuagacaaguauuguagccuucuggccggguugccugcuuccauuguugccauucaugccauucauucuucacucagcgucuaaguggucguggaauaacacaccaaaggucaugccacagcccugcuaaaaaccauacaacagcuucugauuuuauuuacaacaaaaucugagcuccauccuuggguuuguagaucccuaugugaccugaccccugccaagcuucugaccucaccucaaacugcuuugccuuguucuugacuauacugguccucccuuaugggcuuuacaccagcuauugccuuuuuuuuuuuuuugaguuguuuaccccucacugcucuuggguugaguccucagauuucagcuuucauuuaaaugucacuucagcggagaggucagcccuuacuauguaauguaaaguugcccugauucacuuuuuuuuucuuuuuucuuuuuuuuuuuugaaacagggucucacucugucgcccaggcuggagugcaguggcgcaaucuuggcucacugcauccuccaccuccuggguucaagagauucuccuaccucagccuuccgaguagcucgggguuacagaugugugccaccacauccggcuaauuuuuguguuuuuaguagagaugggguuucaccauguugaccaggcuggucuugaacuccuggcuucacguaaucugccugccgaagugcugggauuacaggcaugagccguugugcccggcccugauuccacucuuaauuaucugcauugcuaauuaucucuagauuauaaacuccaugagagagggaauuuuguaugccuuguucacuauccugaaugccugccacacgauuauuucuuaaaagaaugaaugaauaaaucuggguaauuuagcaaaugcucaguaacauauuuaaacuugaaucucaacauuguaaauauggcagguaaaaaauaucuguagcagguaaaaauaacuagugauggcaaccuuuguguuucuacauaguacuguuguaaaccaagaacugagugcaaagucauaaaggcaaaguaaagauuacaaauaucacuaauagaaaauaaaacuguuauacuuaaucauuuugagucauaacuugucaaauuucaguguuuaacaguuaauacucuuugucuuccuuuaaaauaaaaugguuuuugaggggaauauuuuaucauuuuuuaaagccucuugaaggaguucguacuuguaacauuuuuaaugucuaaacuucccugugaguaagcaaaagcccuuuuaauuacuccuuuugucucagcucugcauucauucugauagaccuuuugugacauuucucagaugacuacauucugaaaguaaaggcuaauucaguauuucuuuuuuuucaacuauuauuacuacuacauuguguucagagcuacaaguagagcaucucauuaucaaacuaauaauucucaugaggaaagcuuaagugcuguuaaaucuuuuuuuguuguuagcagagauuacuugacuugacguguugacauaccauggagcacauuuuacuuccuugacaaggcacagaagcaguaagguaucccuugcauggguuuaacauaguuucgaaauacaccucagggguuuauuaagacugauuaacuacaaaguuauuccagguuuaacaugucuucguuauuuggaaagcagcaaaugcuugaaauaagaaugaaacaauugaaguugaaaacugauuguauguaauggcuuuaggcuauuuuuauguaauugaauuguaauugaaucuguuuucagaguuaugaacaagaaaaauauacccuucaaagagaaguugaacucaagagucgaauguuagaaaguuugagcugcgaaugugaagcuauuaaacaacaacaaaaaaugcaccuggagaaauuggaagaacaacuaagcagaagccauggacaggaagugaaugaacuaaaaacuaagguugggauaucugcguauuucagcacaaaauauuccauauuuaugcagccaucuguaaacuuuagaugauaaagauuuucuuaagugucagcuuugcaaaauagccaagaucuaagucuucauuaucuuaauauugggggugggaacacugagauacaagaguuugucuaagggacuuguauaaauuauauccuauuaauuaaauacaauuauuuaauuuugguugcuggauauuugugaagguuuaguuuagugacuagcauggccuccuugcugauaguggguacagcagccccuugcagaaagccucgucuccuagccuucccugcagucagugguaugcuuuguaauucuguaaaacagaccaguaguuucuuacuaguuaaugugcauuacaaaugacacuuuauaguuuguuuacugaggauaaacuaauacaugugcuccaguucuuacaauaauauuguggaaagguaccauuaucauuuccauauaccagaugaaagagccaguguuuagacagacugaguaaauuggacacaauucaagaacuagaaauucuccaucuagguuugaacugaggcugucugacuccaaaggcuguguuacugaaucacuacauagucuaacagcauguuacacuggcuccauuucaaacauaaacgcaagauaaaugauuggucagugguuuucccuuuucccagcuagccagugcuuucagguugcuucugaggaauccagaacuuuuuaucauggaucugcuuuguguauagucuauacucugacuuuuccagacacugucuaccaaaacuugccugacuuuuguccuccuuucucagaagucuguuacccaauuuucagcuucuuguauagcagccucuaagauuuuucuuuuucuguauaccaccuauacuauuacuuaauuucucauugacucucuuuuaauguuuacugauuuuaagaaacaucaaugaaaguauuuuuuuuuccuuuuuuuuuuuuuuuuuuuugaggcagagucucacacugucgcccaggcuggagugcaguggcaugaucucggcucaccugcaaccucugccucccggguucaaacgauucuccugccucaggcuccuaaguggcugggauuacaggugugcgccaccacgcccagcuaauuuuuguauuuuaauagagacaggguuucaccauguuggucaggcuggucucuaacuccugaccucgugauccgcccacuucagccucgcaaagugcugggauuacaggccugagccacugcgccuggccaaaauuacauauuuaagcuugcuuauuuuuucccaguauacacuaaaacaaacauagcuaucuaaauauaccuucauguaauauauaaucaucuugcauaccacucugacagauaauaucauccagcuugucugaaacuagucggauuugaggcccuaaugacugauaaugaugugcuuucuucccccucugguuguuauuuuuauuuuugcaauaguuuucaucaccuaaacaaaaaagaguaauaaagggaguauucaggacugagguaaggcuaauuauagagauggcuuuuuuuuuuuuuuuuuuuuuugguggagcaaagaguacauuagugaaauauuuuguuuuacugauuuucucaaaucacuuaugccaaaauuuggauuuuuuuaauaccuuuucuucucuuauuuuucacauuuaauucaucaaguucuaagaacuugaccuacaaaacaucuaugacgcuacugccacuccaauccagaccuucaucaucucuuuccuggacuacugcuguagccuucugaccagguugcuugcuuccauuguuucucuucaugccagucauucuucacacaguagccaagugguccgcaucauagugccuccagauugcuucugaggcauccagacccaccccgauuacucauggauuauuucuauguuuauuaaacaaggugugucacuagcuguuaaaagaugccuaaccuugggcaaauaggaaacuccaauaguaucaucauucaguaaguuugguucaaucaguucaaucagugauuguuuuuagaaagaaaauaacuuucaauuuaugacuuuuuuuuuuuuggcuuuagauagaaaaacugaaaguggaauuagaugaagccaggcuuagugaaaagcagcugaagcaccaaguagaucaucagaaggaacuccucucuuguaaaucagaggaacugcgcguaaugucugaacgugugcaggaaagcaugucuucagagaugcuggcucuucaaauugagcugacagaaauggagaguaugaagguaauuuuuauggcauguguuucucaggguuuucucuuuuuuuuucuggcauauuuuuacauguuuugguaauaauucuuaagagcuaguuugaaggcugaaacauuuuuugaccuaacuugcaucuaacuaauuaaaaaauggguuuuuuuuagguggaugacuucauucauaauauagcuuuagacuauaugauuauguaaggcagccuuucucuuagauuaaugaaacgucuggaagaauuuagaggcauauacucugaucccagauuuuaucguaagagcccaguguaaaacguuggcucaguggaaguugaaaugcaugugaacuugguuuuuucauugaaagcuaagguuaauuaaaaauuaaagccugaaauugauagaggaaaaagggcagucucuaaagccauuuguuuccuuguugaaaaauuuaacaguaauaguaauuucuauuauuuuagaauguaccugacaacuuuugacugguucuuuaguuuuaauuuuggaugugaaccacaacugagauaaacugagcagcugccaaaugaaagauuauucaagagaauuuccuccuuuucaauuccuguuaaauagaccacccucaaagaagaagugaaugaacuacaauacagacaagaacagcuagaacuucuuauuacuaaccuaaugcgccagguagaccggcuuaaagaggaaaaagaggagcgagagaaagaagcaguuucuuacuauaaugcccuagagguacuaugauuacaguaacaucauguuuuccaauuuaucauaacuuauuuucuugcuaauguaaucucuguugccuaaauuguuuucuuuugaauuuagaaagcucguguagcaaaucaagaucuucagguacaguuggaccaggcacuccagcaagccuuggaucccaauaguaaaggcaacucuuuguuugcagagguacuuauaaguauccuaacuacuaaauugguauuuucauuuacuaccagaacaauuaagcauguuaauauuuuguagguggaagaucgaagggcagcaauggaacgucagcucaucaguaugaaagucaaguaucagucacuaaagaagcaaaauguauuuaacagagaacagaugcagagaaugaagguauagaacuuucacuaucaaagguuuauuaaacaaauuuugugucagcauuacauguaugaauacaucaaagaaacuagcuuuuucugcaaggaguguacuuauauaguuguuucuagaacugcaugauuucaaaaaaucaauuuugaaauuaaaagauucauuuauaguuuaaaaaucuuggaauaaauauuuaguaauaguauauuuagcaaugauuauuguuuguuuuaaugguuacucacuagcuuugacuuaaaucuuucuuuguggaguagaagaaagaaaaguauuuauuucuuauucuuggccugaugucuuuccaagcauagcccuaggguuccuacuucagcugaaacucgcugccucaccauuccucugcucuuucaccaaggcuuauuauggagugaaauuuggauuauucaggguucccuuuccuuguagcuccucaagucaagcacauagacccuuuuaauuuuacggguuuuguugguugucauucuagccaaauaagagguagcagaaaaacaugugggaauuagaaagauuucaguauuguaacaguccuuagaauccugaucccucauccauugugccucacucuacugagguaguaauuggaaucuggaaaggcuuccuuccuuuuauucagaaucaugggcuuugccaaagaaaugggaaagguuaaugauuaaauuugggaguuagguggauuuggguuugaaucauaguuuugucacuugcuagcucugugaccuuggacaaguauuuuaacuuugaaagcaacaguaccucaucuauuaagugaagaugauagaacccccucuuagaauuguccuacaguuaaaugaaaguguaguaaaauacuuaaccugcuacuuggcaaaugaguguuuaaugaacaacagcugugaauuuuauuucuaaggguuuccagacugugcugccucauuuccugagacucuccccugucugggaaguauuucuuuauaaauuuucucacguuuacuuuaguuuucuuacaguauuuguugggguuacuuuuaaucuaccaauguugcauaugucccaaacuaucuuuagagacuagaagcauucugagucuuaggcuaagugggccuagccuccaaucugaaacaggaacaaaaaggauauccuuuaaaauguuaaaagucaucugcaaccucauaucauugauuguuuuacucaaaacuauauuuaaacuaauaggcacucuuuucaacuccagaaauuuccaaaggcagaaagaaaugcuagauuuagagucuacuuaauuucccucugguagcuucacaacuccagauuuggggugggggagguauaaugagguaaguugagugcugcucuaaaaaaauuaaaacaugguauauugaagauuaccccaguauacuaagauagccuuuuaucuuugcuuuuaacgucauuugugaaucuaacauuuguggcugucaguagcuuaguuuuccucacuuaauuaaaguuaauuaaaaauuuugagaaacccaucagaaccuuaauaagagcgagugcuuaugauaagcagucugcagcguuuggccaggcuuacuuaccaguucaguggugugcuuucagaccacagccaugcaagucaguuuuauguuucacaaaaguacaaauaauuacauuacagacuucaguuaucauucauaaguagucaaaauaaguauucaaauguuaugucuacaaaaaaauuuauuauuagauuagaaauagcuaauuuaguuuccaaaaugaguucaaaguaauauaguacaaauuaugaauuguaucaaaaaaguaguuaucagaaucuuucucucacuuaauuuuauuagaggggguaauuuuauuuuucuaguuacaaauugccacguugcuacagaugaaagggucucaaacugaauuugagcagcaggaacgguugcuugccauguuggagcagaagaauggugaaauaaaacaucuuuuaggugaaauuagaaaucuggagaaauuuaagguauguauaacaguuaaaaaaacacacauccaaauuuugauuugaauaucuuaaaauuugguuuguuuuuuaaguuuaaauuauuaauaaauaucuugugggagauacuuugagacuaaguaaauggcuguuucuccuuauacuuaaacauccauuggugauucuugccugaaacauaauucugugaugauugcuaaauggguaauuccaucacuucuucuauauuuauuaguuggaauuuuaguaaagggacagaaaagaaaaaucuuuuuccucacuuacucauucauuuauaucaguauagccucauggauucuuauuuuauccuaugaguuauaauccauugcuugcuuuauuuacucugauacucaaauugucccagauuugauagucgaagugcucuuacuugaauauuuccuuacucuauggcacaacaaggguuuccuagcucaccuggcccacuucugggauuagcauuucuucaaggaacauugguuuauuuuaguugagaaugguauuuguguaagcauuuguguguguguguguguguguguguguguguguguaagaauucacccauguuuucuaaauaaguaggcaguugucccagagucauuuguuaaaaaaucaaucuugaucccagugauuugaguugacaccuuuaucauacaucaaguuuccauauauacuugagucuguuucuaaauuuucugucuacgccauuggucugcuucucugugugucuguaccacacuguuuuauuaauuauaaaggcuuuuaaguauguuuaucugguaggacuauuuccucacuauacuuuuuauuuuucaguauuuuccugucuauuuuugaauguuagcuuucauuuacaaacaucuugucuagcaccaaaaaaagcuuguuggcuuucuauuaaaauugcaugcaauuuaagauuuuauaaauugacuuagggaacauugauaucuucauuaaccuccuaaugaacuaaaguucuaaaugacaaauuuuuguaaauguuaauaaccucuuaggcauucuaaauuguagccauuaguaugucauaaaaucuuaauuaaguuuacauaacuuuauuucugugucuuauaaaaacuguugaaagaacuacaaauuugguuaaguuggcagccuuauguuuccaucagugggcucagaacuauacucugaaaauuauggccuuaaaucaggggaauuuuauuuauaaccugaaauuguuucaaguuuuuaagcagauuuaccuuuucuaucccacuagagaaauguauaguuuccaucagucucagaagagcuugcacuacauucuugccugggguggggggaagaaucucagaagagggggacaccagauauaaauguaaggcucucaucuuccuuucauauuuuuccaguuuaugguuuuguuacaaaggccagaauuuaauccagcaggcauuuguuuuucuauuuucaaagccaggagagagaaggcagagcauguagguaaggcuagaagccuaggccuuguagucagauuuggguucagguucucucuucuugguuuacuuucaucuguauucggagccuguuuccuuaucuguaagagaggaauguuaauuauuuaccuacuucagaaggcagauaaauuaaauggguaguucuuagcguaguacgccaagggauauaaauucaggaagugauggugcuauuauuaauaaacauacacuaaccuuauuuguuauuuauuuuaaguaauacaaacuuuugcuuuuuuaagaauuuauaugacaguauggaaucuaagccuucagucgacucugguacucuggaagauaacaccuauuauacagauuuacuucagaugaagcuggauaacuuaaaguaagugucuggguugguggauggaaagaugaacaugucacuugcuuacuaugguagugucagugacuacaaaguuuuuuugaaauugccaaaggaaauuuuccgaaaagaaagguaacaaaaauaucuuugugcagauauucaugugugaauacauuugaaagacuauuuccuccuuuguccauuuccuuucaagaaugcaugaguauuuuuuaaauuuaacacuacuauuguuaaggauuauuuaaauuguuuauuguuucuuuguuacuaaaaaccccagaaaaauguauuuuuaacuaagaauucaaauaugcgaugaaauauuuauaccacuacacuuauuauaugcugucuuaauacucguugguucuccuuuuuuauuaucauagcaaagaaauugaaagcacuaaaggugaauuguccauacagcgaaugaaagcauuauuugagagccagcgggcucuagauauugagcgaaaacuuuuugcaaaugaaagaugccuccagcuuucagaaagugaaaauaugaaacugagagcuaaacuagaugaauugaaacuaaaauaugaaccugaagguauauaugucucauauauuuuugucuuuuaaauuaugaguaaccugaaauuauaucaaauuauuuucuuacuguaguuuuaugcaacucuauuacaaacucauuuguaguuauauaccuauaguuaauaaagcaaauuuauuguguaaaauagguaggaaaauucagggagaacuggauacugggugugccugaauauaacauguauccuuuuuggauaucuaauuucaucauacuguauaguagaaacuugagauuugagacuuucccauuuuaagauuacaguauuuuaugucauaccuaauaguuuaauuauguugaagcagcugauguuuggaagcuauacgagguaggacuguuuauagaaaaucuaaaguaauggagacuuuaaaaaggugggucuuuaucucugccucugauggaagucuggaggaggccuuccaggacugggaaagcacuccacgguaucaagauucaggcuucuuguguuuguuggucugcugccauccuguggagcagaauuuagucaugcagccucaccugcugacaggaagggcugagaaaugcagucuugauucucaggggccauguuccuaacuaaauauugggaauucuuuuauuaaggaagaacagugagccaggcgugguggcucgugccuguaaucccagcucuuggggaggcagagggaggaggauagcugugcccaggaauuugagauuugcuugggcaauauagcaagaccccauucuccaccaaaaugggggggaaaggaaagaacaaugaaacauauuagggaauaucuagcaagucuaaugacugagcuggaaaguagccuaaccauacagucucugcaucuuauauacuacagagagugaaguuuacuguauguaaauucaaaaacaaaaggccaagugugaaggagucuaagaaugugaugguucuacaacaccccuucccuaaaagaguguuacauguuuuagguuaaggauucucaacaaguuuuuguccccgcacucugcacaugccucagucucucuucguauugucucagugaacugcuaugauucucaacaauaguggggagguugccaaaaauaggaagguuuuuacacaauuuuaaaaggcuucucuugcucuuaacucuuuuuguuucuuccaugauucuaauaggcuccccugauuaagaauuauccauuaugaauuucaaacaucuguugaacugaacacagcaaauagacaggaggcaggguagugaauccugauaauguggguuucaaaggagcagugccagaaaaaggggaaaucauggucuaaaagcaacaauguagagcaaaaacagcaaccccuugugcuaccaguguuccucagacuccacuaacauuuugauuuugaaaaugaaacacaucgauaaugggcauagggaaaagauauuagagcaguuaauucaguggcuguguuuaugaccuguuuagauagaaugauauuaggccaugaggauagaaggcauugcaguagucuuugaugagacaugauaggauuggacuagggaaguauccaucauaaaaguagucugauucugcuuauauuuuguagguagagcuaacaggcauauauuaccaauauucagaaaguuuggccuauucuugucauuuaauccuucuaauacacaauaccaagugaagugggugcuuuuaauccccauuuuacagauaaaaugaagcucagagagguuaaauaauuccccaaagacauggcugucacauacgaggauuaggauucgaaccuggacucugccgcugucucuucaucuccacacugagaucuuaugaaccaccuuuuucaaaacaccaagagagaacagugaagcauucaugccuaaagucaaaauauugaauucccaaggaaaaauauauagccaaauaaacuuuaaaauauauaguuuauauagauuccaugauaaagaauaaaagguagaaacaaaggaugcauuucagugaggagaugguugcauuuuaaaagaauggaaaaagguauacauauaacuaguucuggcuucuuguguugauugugucuuuguuuucuuagauuuuuucuuuuccccacucguuuuuauucucagagacaguugaagugccuguacugaaaaagaggcgugaggugcucccuguggauauaaccaccgcuaaagaugcaugugucaacaacagugcucucgggggagaaguuuaucgauuaccgccucagaaagaggagacacaguccugcccuaacaguuuagaagauaacaacuugcaauuagaaaaaucaguuucuauauacacaccaguagucagucucucuccucacaaaaaucugcccguggauaugcagcugaagaaggaaaagaaaugugugaaacucauaggaguucccgcugacgcugaggccuuaagugaaagaaguggaaacaccccuaacucucccaggucaguguccucuuuuccuccaggcagccagcagaccucuccaucucuccucucucgcugcaugaacugugcugucuguuucuuuaucuacuuucuuacaauugcaugcaguauaauuccucaguuucaucuaccuaccuucaacuuuuccagaacuuuaagaaagacuaaacugauugcaaagggaaaggacucuugaauaaggcaaucacauuaaaaaguuacacguuucuguuucaugaaagggaauaucacaguuuaacacaucucugaauguuuuaucaguuugaauacauguacuguuauuuuucuccugguucaagcauggccaugaaagaaaaauuaacuuacuuucucaaagggcuuuccaguagucuaagaaauuucagccuucuaggaaacuuaggugaauuuuuuaugucuuuugaauugcuuauccuaggcauucaaaaaugggcuucaauacuuauuuugacauuuuuacauaucaaagcuaacucauuuucauuguuuccaaaacuugaaagccucuaguuucugcauaauugaguuugugacuaaaagaaauagcgucagauaugugugucugaaggaauuaaugucccaagggcuuugucuuaauaaaaauaauugaggucagaagguaagagaaagugaauggaagggaaagguaaguagcaguggcugaggcucgaguucuggaugugcgcagcaggagaagugaaugaggaaauugaagaaaguaaaagaaagaugaaggaugucugcaugcaaugggauuguuagaggcauuuaaaacaaauaucuagacauucaaaaagaugugccaauaacuagccuagauuaucuccuaugaaaugagauguugaaggugcuacuagggcuaccuuagucuuagagaguggagacagauuaauaagacauuuuacuaaugugcauuugaguagagagaguaagacagcccuguuuaaaagggcuuauauguuuuaucugauuucucuccaagucuucagugcuacuaaauguaauauucaacaguaaaagcacuuuaacaauguuagcugcuauuauuauaaggcauaguaauuuuauuacucccuccuuggauuuuuauagaauguuauaaccucugagucacauaaaauaaaagcuuaccauucuuaaggaaaaaguaacuucaaaugaguaucugccacauacccaugguuucaaagaguucugaaaugaauccagcagauuaugccuguuuauaugugaugcauuguauaaacauccuugaccaguguauauuucuggagguggauuuccagaauugauaagugccagccuugcuaucuguauugucuucauuccuuuuucugccuuuuuuugcuugauaaaaaaucacuuaagcaaauguauguggcuaauugacucaaguagcacguuggaaacuuuuugucuuguucguuaaacaaaaaauaaaauaccacaaaacauuugugugugugugugugugugugaguccaucugcuaacuuaaaauguuuccgacucuuuguuuucugccuguuuaacuuagauacacaauccuaagauaauuuuggaacaauaaauauggcuuuuauugggaacuucacuauugcaugcuuuacaaaacuaauugguguucuuguuaccgagaaucuuuacaggccuuuaagaaucucucuacuguuuaucuuuucuuuauucuacuaguugaaacucaauuuuuuaauaugaaacaaauagacaucuauucaugcagcccaagauuccauguuauuuuugucuugccuuuuguaugucauguuaacauuaaaauauugcuguaacauuucaguuuuuguguuaggugugcuuaucaugauaggugcccugucauauuuucuuuaauuuagggcuugccaugacuuuuuaaagauauucuuuagacuuaaaaaauaauuggcccagcguggugccucacaccuguaaucccggcacuuugggaggcugaggcagguggaucacgaggucaagagaucaagaccauccugaccaacguggugaaacccugucucuacuaaaaauacgaaaauuagcugcaugugggggugcgcaccuauagucccagcuacuccgguggcugaggcaggagaaucgcuugaacccgggaggcggagguugcagugagccgagaucaugccacugcgcuccagccuggugacagagugagacucugucucaaaaaguaauaauaacaauaauugagccuauugauauaaaaagacuuuuagacagccagugacuuaauauucuuacaguauuagagucaacuauauuuuuuuuccuugaauaccaugccuuauuggaggcccauuauacuggggguuuguuucuucaauccuucauaaccacauuugaauucagaguggaugcuuuaaugccuguagguuagcugcugaaucaaagcuucaaacagaaguuaaagaaggaaaagaaacuucaagcaaauuggaaaaagaaacuuguaagaaauuacacccuauucuauaugugucuucuaaaucuacuccagagacccagugcccucaacaguaaagacuugucuuuaauaagaguacggugccacuugccucaaaaguuacuauggugcuuaagauugucuugaucugacauauaucaccuucuggguuauuuacucauugugccaggaccuggcauuuucaugugccuuugaccaaguguucagaauuugcuugacucuaaccuggagagcuucuuaagugaugccccuucauggagcuucuaugacagugaauaaacuauuaauugaaggaaaauguuauaauuaauguaucuauuugcugcauuguauauggauuaaaugauaaaaaacaaguaaucuacccucagagccauguauuugagaaugcuucaaucauauuuuccuauguacuuuuuuuuauaaacuuaguuuuagacuauguuguaaaaaugggaagguuguaaacuauguuguaaaaauaggaaauguggcuuaaaauauauacauuauauuguuucaggauuuugucaguguuuaaagaaccaauguucaucuuuguauuuauauacaugauuuaaauuuugucuaaaauuuuaaauaaaacugcagugauuuaucc

SEQ ID NO: 16537 - RNA, 1339 nt, Homo sapiens
gcgcagcagccauggccagccaccuugugcucaacaauggcaccaagaugcccauccuggggcugggcaccuggaaguccccuccaggccgggugacugaggccgugaauguggccaucaaugucggguacugccacauugacugugcccacguguacuagcaugagaaugagguggggguggccauucaggagaagcucagggagcaggugguaaagcgugaggagcucuucaucguuaguaagcuguggugcacauaccaugggaagggccuggugaagggagccugccagaagacccucagcagccugaagcuggacuaccuggaccucuaccuuauucauuggccgacuggcuuuaagccugggagggaauuuuuccauugaaugaguuggguaaugugguucccagugacaccaacauucuggacacaugggcagccauggaagagcugguggaugaauggcugaugaaagcuauuggcaucuccaacuucaaccaccuccaaguggagaggcucuuaaacaaaccuggcuuaaaguauaagccugugguuaaccagauugagugccacccuuaccucacucaggagaaguuaauccaguacugccaguccaaaggcaucguggugaccgccuauagccccguuggcacucccagcaggcccugggucaaccccgaggacccuucccuccugagggaucccaggaucaaggcgauugcagccaagcacaauaaaacuacagcccagguccugauccgguuccccaugcagaggaauuugggugugauccccaagucugugacaccagaacucauugcugacaacuuuaagguuuuugacuuugaacugaacagccaggauaugaccgccuuacucagcuacaacaggaauuggagagucugugccuuggugagcugugccucccacaaggauuaccccuuccaugaagaguuuugaagcuguggaugccugcucaucccuaagugaccuauaccuguguuuccugucucauuuuuuuccuugcaaauguagcauggccugugucacucagcagugggacagcaaccuguagaguggccagcaagggcaugucuagcuugauguuggaucugaagagcccugucaauagaguagaagucucuuccaguuugcuuugcccuccuuuuugccccacuggggaaaguacaaccugaauacccuuuucugaccaaagagaagcaacaucuaccaggucaaaauagugccacuaacaguugaguuuuggcugcuuggaacuguaaucccuucagcaagacuucucuuugccucaaauaaaaaguguuuuuguggagaaaa

SEQ ID NO: 16538 - RNA, 16238 nt, Homo sapiens
cauuacaugccagcaguacauauuuauuauuauucaugaauggugaaaagacuuacaaggcccauuauuaugaguauaaccacacauaugaaauaucacuuagcggcaacaugggaugaaaaggacaguuauauauuuauauuaaaaaaauacacguuugcauucaauguuugccuagaaaaaaaauacauguacacacgcucuuucaagugcuccccauaaacugcuauaaaagcaggaggcaucaagcuguagaaguuccaauauacauaacauguugaaauaucucaagcauaaaaacuguacguaacuugcaaaaauaaaguuccuuucuucaaacauuuugaucugagcucaggcaaagcaaauaaugaacaccaaugauuuuuauacuauuucacacaauuuaaaauaaucaacaugaaaaggucaacagcuucaaaaauccugaaaauauggagguuacgagaaugaacaauuucaucugaaaagucuacagcagaucugcuucauccugacucucaaauauuuaaggaucauaauuuacuauacucaaacuccaaguuuagccaggacaaacaaaaugauaaaaagaaaaauuacugcaaacagggcaugacugcccuuuaguuucuuuagacaauuucacuagugcaagagcaucauuuaccugaaagauccuaagagucacaauuaaaguacucauacaaaacuauuuccuuuguucuuuaaaaagugccacauacuauacuuuucauuuaaaaaaaaaaaagaacccaacacaaauaaacuaaugaaagaccguuugucuccaucucuugucaaugaggaaaggccaaagugauucuuugauuccaauucgaaaugguguucguuggccaaugcccaaggucuccaauuuggagcagucaagcugagcauuucucggacguugugcuccuaggacagggcugucaguaaucuuuaaagaaagauaaacacaaaaaaaucaaaaguaagugaaaggcuauauuuugagggcuuuguucccccugaccuuuuuuuaaauauguauauauuuuuaaacagagaugagaucucccuccauugcccaggcuagucucaaauuccugggcucaagggauccuccugcgucagccucccaaaguguugggauuacaggcaugagccauugugccuggccauuuugagguuuuauauuugcuacuuauuuuugcucuuaguguaagaaaucugauuugaucaucccuggaaaaauaaaccaaaugccugucaugaucaagacaauaauacauuuucuacaaacuucaauacucaugaucuucucuacagaugauaauuuagagaaaaguagcacuaugaacagccagcauacaagcaaaguucacuuugauuaguacugagaaaugaaguuacccaacacagcaauaauauauaccauagcaauggaucuaaagguuuuuacagccauguacuuacaggucuuaagugacugcuggggagguugaaggcaucugcaauugcacaugccauuucauacuuagucaucuguucauugccagaccagugaaagguucccuuaauugauggauccuaagaacgaugacacaauaaauucaauaguuucaacuuuuugagcugaguagaauagguuugaccaaaaagcuuacuuaaaauaagguccaggaacuaaaaggcaacccucuuuuucuggaaaggucuccacaagauaucuaaaaucaaauuccuacuaauacucuuagcaaaacacuuaaaagagcaauuucuagaauuuaaaccuuaagaauuuuuaaaaucaaaaaaaggcuccaauuuuacuuaauuagugggaauauaaaaaagcauuacaaauuuuuaugaaaacaguacaauuuaaugaguauuuuuaauuaucccaagcuacaacaaaaacuuaauagaaccauuuuucaaguugagcuaaacuuucuuaaauauugucauguuauauauuacaaaauauaauucucauauauuaaaaaacuguggucauccuauuaauauucuaaacuaaaucagucucaucuuucuuuguauggauauuauauuuaauaccaacuuuuucaaaugugcugggauuacaggugugagccaucacgcccagcccccaaagaguaucuucuuaaaagaccuuagaugauuauuuugaaguuuccuaacacuuugcaauaaaagaaaugaugggaucuauaguacauaagaaauaaauucaaacagaagagcauaauauuuuuauucuucaugaauacaguguauauguaaacuacuuuuguuuggucuccuaguuuuaaaaaagcacuuuuggcuuucacucaguaacacuccaaguacagcugugaaaguucaagcauggaaaagacaaagcggaccuucgcuaagacaggacucaggaauccuucuuaccagcauucucuucucugcuagcugccggcacacaguggccacaucuuugacauguguggggaaccucugcugccagugauccauguuugcugacuuguugcugaacugcacuuuaucaaacauaacagucacagcacuuucuucgagcuuuucaacuuccccauacagaauaggaauccucaaaacagcagcuccuagagaagaauaaaagcaaauaauuuaaagcugacugauucuuaaauuuugauguaagauacaaggguguggauuuaaauaauaucaaaguagaaaccuugccuuuuaauuaaaauauaccaaaaugacacagcucacuugugacaacgcaauguaaaaauauucaaggccaggcacagugacucaugccuauaaugcuagcacuuugggaggccaaggcagaaggaucacuugaagccaggaguucaagaucagcccgggcaucauagcaaaacuccgucucuacaaaaaauuaaaaugaaaauuagcugggcaugguggcacaugccuguagucccagcuacuugggaggcugaguaaggcaaaaggaucucuugagccugaaguucaagguugcaaugagcuaugacugcaccacuguacuccagccugggcaacagagugagacccugccucaaaaauaaaauuaaaaacagucaaaggcugagugcgguggggcucaugacuguaauuccagcacuugggaguccaaggcaggaggacuacuugagcccaggaguucgagaccagcguggacaacacagugagaccucgucucuacaaaauguaaaaaaauuagccguucguggugggaggauugcuuaagccaaggaggucaaggcuauagugagcuguguucacccuacugcacuccagcccaggcgacugagacccugucucaaaaaaaaaaaaaaaaaaaaaaaaaagaaaaaggcaaaaccacauuuguuaaguaucuucugucauuuggacuaguuuuuuuuauauauauaaauccuacauuaauaugaucauuaaaaauaaaacuuaucaugacaacugaaugcaaugaauagucuuugacuggaugcuagauuaaaaaauaaaagcaauaaaggacauuuuuggcauaaaugagaaaauuccuaaauagauuuguauuugauuacaguaccauauuaauguuaaguuuccaaauguaugauaacugcacuguaauuaugugaagaacauucuucuuguuagaagauaaaagaaagguaaaguauuuggagaugaaauucaacuaauuaucaaugggucuggcaaaagcaaacauauaaaacaaaugugacaaaacaucaacaauuugugaaucuaugugaaggguauaugaguguucacauuaguuuuacaaccacucauuaauauuuagauuuuauaauggucccugcugaugguauacaauaguuaacacuuuaacugcaaaucaaacauuuucuuuuaaauuacaugacaagagaacuuagauacugcuaugguuugaauguuuuuguccucuccaaaaauucauguugaaacuuaauccacgaagcaacagugcugggagguggggcauuuugggagguguuuagguggucaucagcacucugcucuuaugaauggauuaaugccauuauaaaaggacuugaaggaagaagcacaucccuuucugcucuucugccgugagaacacagcauuccuccccuccagaggaccagaaagacccucaccuugaucuuggacuucucagccucuagaacugugugaaauaaauuucuguucuuuauaaauuacugaguuguugguauucuguuauagcagcacgaaauaaacuaagacaaauguauucaaggaugauuucaacagaauaauuuauaauacaagaaaacuuuuuaaaaaacuaaauguccauuaguaagguauucuacacuagggcugcuucucaaggccauaguacagucuaaggcaguaguuuuagugcaggggaccauuaaauuaaguacuacgcagccacugauaggaguaagauaucccagaguagguuccauguguacuaaaaugcaaagauguugagggaaaaaaaacagguugugaaacaacaugcauacauuuuuugaaaauauauaaaaaugcuuccacacuuaaccauauuugguguuuaucucccugaggcagcauuuaugagaacuuuuguucuuaguaauuuuacauuuuuucuaaggaguguauacuuuuuauauauggagauguguguuauacacaaacucacauacaggaaaaaagaaacaccauaauagaauguuaauacauacaacauacauauaacagaauacauaaaaacaaaauacauacacauauaacacaguaacauacauauaacagaauacauaaacagaauaucucacucuaagagaaauuauacugcccuguuuuuugaaaaugaguuacaaaagcuuguauuaccugacuuguuuucuauguguaaagaugaauauguaaacacugauaguggaaacugucuugaaggauucacaaaguaguuaucucuuagaauuuuuuauuuucuuuauuaacuauauucuaauuuuucucuaaugauucauauucauugacuuuuuaaauuuaaaacauauauauguguauguauaaaugauuuuuaaagucuucaaaaacaaucaggggcuaaauagauuaggucuuaccuagauuguucuccaggacagccuuuucuccaucuaauuuuguuuugccauacaaauuuaggggagcugguaugucuuccucucuguaagguggauuuguuccaucaaauacauaaucugagcuaauguagaugagaaaugcuccaacagcagcuacaaaaaaagaagacaaaucuauuaaauguuuacaugacauuacucuuucauggaauuuagaaugguuuuucaugauauauaaaaacaaauaaccaucuacaaaaccuuaauuucuaaaaacucagcaaucacuuaauauuuuaugaaaauuuuauaaagucaucauuaccugcuuccuuugcuaaauucccagaagcauccacauuaaguugagaggcagcaucuggcugauuuucuacaacaucuggucuucucucugcugcacaauguacuauaacauggggcuagaaguuaagcauugacguauuuuuaacucaaaauaaaaugaaagagguauuacagccuucuuaaaguuaauucagagaaaaaugugcaguaagucaacauucuuucaacuaagaauaaaucauuguaauuucuaauguaguuuugucaugcugcuucuuuuccccgcaagguucaaacuuaaaauauuuauaggcacugaaaagaguauuucauaauaugcagacacaaaccaggaaaaaaacugucaacaacuguauuucuacucuggugugacgguucaugcauguaaucccaacacuuugggaggcugaggugagacaaugcuugaggccaggaguucaagauaagacuaggcaacauagugguugguacucaaucucuacaaaaaaauuuaaaaaucagccagucgugguggcaugagccuguaguucuaacuguuguggaggccgaggcagaaggaucacuugagccaaggaauucaaggcuacagugggcugugaucgaucuaccguacuucacccugggcuacagagugagacccugucugaaaauaaaacaaccauguuucuaggcugggcgcgguggcucaaaucuguaaucccagcacuuuggaaggcugagguggguggaucacgugaggucaggaguucaagaccagccuggccaacauggugaaaccccaucucuacuagaaauacaacaauuagccaggugugguugcgcaugccuguagucucagguacucaggaagcuuaggcaggagaauugcuugaacccugggaggcggaggcugcagugagcucaacugcaccacugcacuccagccugggcaacaaaccaagauuacgucacaaaaacaagaacaaaacagaagucuuucuaaaucaaaacaaguuuuaucccccaauuuggacaaaaggaaagagcuaucauuuaugcaauuaacaugauuuaaauaucuaauaaauccaugucaaagggagaauaguaucaaugauaccgaaaaccucucugagccugcucccucagcccuaaaaugaaaauaacuauuuugcaguguugugagguuuacaguaacauuugaaaaccauuugcagagaaaguauuacuuagaaggcacucuauaaacauaagcauuuuauaaaaugucucauauuugucuuugucagcgugucaaaauuuaacuuuaagguuuacauauaccaugucaugcuaaaugaaaaaaaugcuacugcauaauacaacuuuagagcuuucaaacauaguaauuuccuugagagcaaggauaguuucuguaucauccagacaacucuuaauauuguucauguauaucuuaaaauaaccuaaaucauaccugaaaaucaugaaugaugugaugaacugcauuagaauccaacagauuaaccuguucaaauuuuggucuugcucuucugaaaccacagccaacugcaugccaauuauucugcugaaauucuuuguguacagcucugccaagaagcccaguggcaccaguaaccagaacccuccuauuagggauguuaacuuccuccuaaaaggugaaggcggauagaaagaguuacuaacuuugaaaacaguucucucaaauauauuaggcaccaucguuguucccuaaaugucuuaauucuacguauuuugacucaugucccauaucugcaagccaauucuaaaguuaaguuagggucgggcaucaggcucaugccuguaauuccaacacuuugggaaugcgaggcaggcagcuccgcugagcccaggaacuugagaccagccuggguaacauaaugagacccaucucaauacaaaaaaacaguaaaaauauacuuuguauuuauaaaaauaaauuuuuaaaauaaaaaaagcagaaaacacaacuuaaaaauguaauaaauaaaguuagaacaaugauuaaucaaaccauauaaaaaacuguaucacuuaagaaaaagcuuuugccaggcaugguggcccaugccuuuaaucccagcacuuugcgaggccaaggcagguggaucacuugagcccaggaguucgagaccagccuaggcaacauggugaaaacccguccuuccaaaaaaaaaaaaaaaaaaaaaaaagcaaaaauuagcugagcuacagguggugcaugccuguaguccuagcuacuugggaggcuggggugggaggaucacgagccugggaggccaaggcuguaauaagcagagaucaugacaugcacuccagucugggggacagagugagacccuguuucaaaaaaaaaauuuuuuuaauuaaaaaaguuauaauaaucuuacccaaggaaaggaacacaagaugauaugcaaggaauuauguagauuuauauuuccuauguuaacagaaaauccuauuuuuaugauugauaauacccaaaugaguuaguaaacagcaacuuuuuuuauacuuuugcuccaaguaccuaaauaguaaauaacaacauuacauucuucaguuuauaagacuuuacaauuugucuugcuucuauagauacgacugaaggugcucuuugagucucuagagagaaacguguuuuaaguuuaccuauuuuaaggccugauuaguauuugcgucaaaucugccaauauauuuacaagcugacauuucuggucuucagauuuuaaucccaaauguucuuucaagucucaauaauuuaucauauuuugauggacccaagguagagaauuaaucaacauuucaaaggaauauacgaggaggaaaaaaaacuugguccuuacaacacuuaaaugcuuucuaaguuuaaccaaauugguaaauguuccuuaguuaacccaaaauuuaccuacauagaagaguuaaaauuggccaggugcagugguucaugccuguaaucgcagcacuuugggaggccaagcugggcagaucaccugaggucaggaguucaagaccagccuggccaacauggugaaaccccaucucuucuaaaaauacaaaaaaauuagccaggcgugguugcaggugccuguaaucccagcuacucgggaggcgaggcgggagaauugcuugaacccaggaggcggagguugcaaugagccaagauggcaccacugcacuccagccuggguaacaagagcaagacuacaucucaaaaaaaaaaaaaaaaaagcuaaaacuaauaaacgcaaaggauaagaaaaaauauuuuaagcucaucuguguugcuacugugaaacaaauaaauuauuacacacagaaaugaaaaagaaccacuauuuaggaaaaaauuuaaauucuauguuuccaagcauaguuccaaaaaugucccuucuucccaagauggguaacaccaaguuuccaaccaggaucuugaauaaagucaacuuuuacuauuaaaaacaaaccaguuauuuuaacucaagaguuguuauaaucaccuaauucugggcugucaaaaucuuuaaauacauauacaauaaccaaagaccuuuuaaagcccuuagcucaauuaaauuacuuagccgaauacauacauuuuuuuuuaaaagacaccaaaaucaaguauuucuagcaaucaaaaacguaaaaugaaaagacuaacagggaaagauaguauaaagguaaauucuuaggauuauuuuuccuuaguucaaccaauuucaagacauuuuaaaaguugaaagcaauuucauucaggcuguguugcaaaacuuggcucuaaaccaacugaucuaugaaaacaaggauuucagccaacaaaauauuuucuuugaaauuuggcaagaaaacagcucuacaaagauugaacuguaaagaggagaaaacaugccaagucuaguacagauacagucagagaaaacaauuuacacaggauaaauacgguaaagauuccugaaaaaauacucuaaaagagagauaauuugguuucuucugaguuccucacuuuuuacuucacucuacggaagcaaaggaacagguaacaguuccuaaggucagugguucucgugcuucaguguggaucagaaucaccuggagggcuuuuagaucacaaaggucugggguggggcuugauaauuugcauucccaacaaguuccaacaagugaugcugaucaucgugauuuggagaccgcacuuagaggaccaguguacucucgaacuccaggaaaguucaaagcuuucauaacaauccguuucucuuacacaaggaaaacaaaaagugccaucuaccuuucucaaaaugacaacaguaucuuucccccuuaaaaaagaaaacuugaaauagaagccaaagcauuauacaauccacaaaaguuacuaaacaaugaauuaagaucuguguacuucacugacucugugaaguacaguuucauuuuaacaucuguuaaaugaauuuaaaaaaaaucuuaugaaucgucacaguuuugcaguaguuuuugcuaacuuaaugcaacuuaagagcccagaugaucuucuuuuaauuaagagcuucuuggaguugaugcaguauuaaguauagagaagaacaaggcucuuuagggaauauaauaccuuaacguaaaaaaggaaguggaguuguaugagaaaaugcaacuuuauauccuuauaccccuggguuacuauguaaggccuccaguacgcccggccuauaacauguuaauuuucaaauaaaauguugugcaguaucauuuccauuucaguaaaugcuugcacuucagaucgucacucuuaauaaaaaucuugagcacugacaccugacugcuggguacuguacacuguuucauauuuuuuucuagguaauuuuagguaaucuaagcuacucgggaggcugaggcaggagaaucgcucgaacccaggaggcggaggucguagugagccgagaucgcacaacugcacuccagccugggggacacgagcuagacuucaucucaaaaaaacaaacaaacaaaaaaaccaaaaaaaagaaaacuaacguguuauauaaguauacaaucauagcuguuuuuguuuuuuuaauagcaguuugaggccgggugccagggcucacgccuguaaucccagcacuuugggaggccaagguggaccaaccacuugaggucagggguucaaaaccagccuggccaacauggugaaacgcugucucuaccaaaaauagaaaaacuagucgggcaugguggugggcgccuauaaucucagcuacuugggaggcugaggcaggagaaucgcuugaacccuggaggcagagguugcagugagcagagauugagccacugcacuucagacggggugaaagagcaagaggaaaaaaaagaaaacaaaaaaacccagcagcuuguuagaagagauauuauuuccaaagagaguaacaagaaguccaguguuaaauguuuugucuauaguaaaagagaaaaagcuggaaccagaaccugagucuugcuucucuggucaagucaaauacacugcauuuugucucaauccugugaacuaauauuugguuucaugaaugauuaaaguuuuaucuguucugccacaaauugguguuuagaaguuauucuaucucuauugaucuaauuccucauugguaaauggggaaggcauuuagacaaaaugacuaaggcucuuucagcuuuaaaguucuauauuucuaacauuuuccauauuaucccuaccacgaggaguccgaauaguuucguuuacuuaaauaagguaacuuuuccucugaauaugcauuacuccgaaauuuaaaauaugccaaacaaauaucucuguuuuugagcuucuauauaagcaauacucugccuuuuacacuguuuuguugaggcuuuuugguucguucuuuagaaaaagaaauaucccucuaaaaacuacuuuggaccugcacuccauaaauuauuuuaguugugcacaaggaagaaaugucuaaacacuuuaagaaagucagaaugaaagaauaaaaugcuaucuaguucacucaaggcacaauaaagaguugauaauacuuugccugaagucuacuuuuucucaauuuuuauuauaugggggaaaguagaucuaauaucaguuuaaguuacucuaaacguaucugccucuuauugucuaaacucugaaguacggaauucaaucacuccaagggaccagauuuauggacaccaaaaaaacauuucuugaaaaauuaaguacauauaaauaaauauucuuauuaucguaucuaaucgaaugauaccaaauuguauagguaaugggagauacauggcuccuuccaaaugguccaacacaguacucugggacagugauuucuacuuuagcacaccugcauuaaugucuacuaaaaauguucuagaaaaguaaagaauggaauacuauuaguaugugguuuucccaaauuucagugguaaauaccuugucguuuuuggaaacuuuaaaacuuggcacaguuccauguuuaauuuuuuaauuccccagaaacagacccuuaagguaaacauuacugggcuuuacuuuuuaagauucucugacuacuuaggugggauuggucuaacuucuacugcgacgcuacugugcuccacagacaguauuacuaacaacaaccacuccaggaugcuucucuaacguuaacuaugagacaguucucguucucaugagucaguaagcuuuaauucuacagguuuugagagcaguaagucugugccaagcucuucguuguuucauuuuuaaugaaggaaaacacgaaaagcuauuuucauuuuuauacugaacuucuuuuugugaaaguagauuaagcuuuauaugcacacguacacauacaaaugcauacauauaaauguaaacguauguaacaugcacucagcacggucuggaggaccuaggaacauagagguuuaauagaccauuuauccuaacuuuacccucaaagaaccaaagugauuugaaaacccuaaguaaauuuggaagcaugaaaacuuugcaauaacagaaacagccaucuccuauauucucuacucucuccaaaagacauggucugggcauuaguaguguucuuauccccaggguuggauauguucuguggacagauuaaugcuggaggcccuuaaguggaauggagcaggaugggacgggggcgaggggggcaccagagauggaucuuccaaucaucaccauaaucuuccuucagggaaacuccguagugguucaaagcccaagacagucacacaaaccuguaucugaauuccaggcuccaaccuuacggaaugaaccugggccaaugucucacccucuaugcccguuuucucgucuacaaaaugaggcaauaacaaguaucucacaguggaggauuaaaguaaugcccgucaagugcauaacauagugcugagaacuuaagaguucaauaaguugucaucuccagcacuguuauuugugagaagucaccuuuuccuguucuuucucaaaccuacgaacuuguaagaucgagaaauacgaaccaaagaugaauaaacggggaaaaccaaaaucaaaacaaacaauucugaaaaaccucuucguccucaggagcagagacagaacucgaaaguaaaaccuccaccuacuugcuuccugccgcaguggcuggaagaaaaaaacacugacccgugugcgcugagauaaacaaacucgguggcgccccccucggauccggggcugggaggguggcggugagaccacucccggccggaggcucugacccgggcggaauacgccugcaaagccgcccgagccccgguggcucgucccccucggcgcccccgcucccaccggagacgcccaggccgacucccucaccuccaccagccgacagcucccgggaacaaaguguauagagagcucuuucucccgccccaccaugcccgccgucuucacgccgcagccucagcggccgccaccuccuccaacccaggaucgacgcgggccucagcucagacgcccucggcccgccuccccuaggcccagaacgaccccgcucgccgcuuccggcuuccgcugccauagccgcgcccguugauuggccacgcuccgccgacgccccagaaagagggcggguacgcgcggucugcccccagcccacgcgccgaugcuuaaagcgacacacaaaagaaaggcccugaccuuaggcagugaauucagguuuuguuucggagauuuuauuugagugcuuuuuauucuacuuuuuuuccuuuuuuucuugacucgggaaaagauugaaguggaucgccuugaguuucaaguuugcagacugcgcagugcaugaggaucgacugagcaauauaaaaaguggaauaaaaagcauuuuaaagucaugggggcgggggcggagguggguagagcauaauggacacaucucuagagcucuagguggggguuuugaaagauuuagaaaaagacaaggaauaaaaauaaaaggguuggcgucugagccauuugucuuccugggaugcuuaaaaaaagaaaaaaccugugugugagauaucaaaaauguaaaacuauuuuuaacuaauuaaaaauaaaaaguuguagggggaaggaagaugaacuacuuagguaccucuucaaaacgcagauccuuggacuuuacccauaauuacagaacaagaaacgagcccgggguccgacuucuuaauggguuuaaccagaaucaagcccacucuuuaagaaacaccgccucggggauugcaggauugggccacacgagcccagccuuggugagcaccgagaauuuaagcagcagcguguaaggcugggcguucuaccaccuuuuaaaaguuaagcagcccuaagugcugaugccgacuuauuucccuuccaguuaaaaaccgcaaaaaauccucagccaggcuggacgccugugaaauugaugcagaaaguaaacccuggcacaggccguguaggauuugccaacuuugcaccgaacaguccaaggguucuugugugcccaggauagcaagcucuaaacgucguccacaaacgugaccacugucuggauuuuccuagggccuuuccccgacuccuaaaccuuuuugguuuauuuucaaacuaaagacuaagcagccuuuuaaagaaguuuuccacgucagaacaccaugacuuuccuuccuccucaacccccaacaaaaacucauuuccuuauucguguaaacauaaaguuucucuagaacaguaaucgaagacagccugagguuucuuauguuccgauuuuuuuuuuuuuuaaacacaggcuauuacuguucauuaguuuggcuuuauuuagggaauccuugaggacugccccagcgcuaaacaagcauaaucaggggacaacaaagaagagggcgggaagagggccgggggagcagccaagaucaucuuacuacuuuuucucuuaacugggaauucgguuuaaaguuucuagucgcaacacgugauguaaucuuaccuuucuaugggagaaaagaaaauuaauucuucauucuucaacgugaagcagguuuaagggcaagcauaugcaauuagcauucugauucucagagcagccuagucuugaggaacagaaagaauuuaacuuggcugcuuuugaaaaucugacuugauacuuuccccguaaaaguuggguacaguucuaggggcauauguuuggauaugguuuuuaaucauuuucuuuaaugaugguagggucuaugcgaaucaaacgccauucuuaacauagacaauauacaacuucgugugguggcuaagucuauacauuuaaagagagcagccugaaacuaaaaguuauguuagcagauucaauucauacaaagacaaagaacaucuggaaaggaacacacuacagauaaaauccuuauuuauguagaaacuuuauauacauaauugcauuuaaaaugguaaaugaaagugcaauucuguauugucagcuagugagacuuagcugagcccuucauaaccugguucuccgggucaguaacuaaaguuggcuuauucuuccaugucccgagguuauguuuuaaggaaaugaaugacacccguuucuauuuucuuuacacaacaauucugguuuuagcaggcguucacuggaaugcuuuuaaagcaucucuuacucuagaaugcuucauuucuugaauugcuaguucuuaccugcuccauguccucuggcauuucaggcaugacuccagaauuauuucaggagagcagauacgggaugggucuuagccucugccuucucuugcugggucuuuguucgcuucugccugcagagagcgcaggcacgccaaaacgugaggagcagcuucacuugaccuuuuaaauuagcauuuugauuccaaucccggaaucucgugcaguucuccacauggcaguaagcugguagcugauuccccguaguagucucgaaaauacccaaugagaaguuucauguuuaauugccagucaagccugggucuauuugcaaaacuauuugguagaacuaacuacuuaacaaaaacaaaaacaaaaacccaacaacuuccugucaagauuccuuguaguuuucuuuugcaaaagaagagugagccacacuuuuggaaagcacacagaucaugcaguugauuccuguucuaaaaggcacaguuuucuaucauuuuauuuaguuacaccuuauugcaaca

SEQ ID NO: 16539 - RNA, 16238 nt, Homo sapiens
uguugcaauaagguguaacuaaauaaaaugauagaaaacugugccuuuuagaacaggaaucaacugcaugaucugugugcuuuccaaaaguguggcucacucuucuuuugcaaaagaaaacuacaaggaaucuugacaggaaguuguuggguuuuuguuuuuguuuuuguuaaguaguuaguucuaccaaauaguuuugcaaauagacccaggcuugacuggcaauuaaacaugaaacuucucauuggguauuuucgagacuacuacggggaaucagcuaccagcuuacugccauguggagaacugcacgagauuccgggauuggaaucaaaaugcuaauuuaaaaggucaagugaagcugcuccucacguuuuggcgugccugcgcucucugcaggcagaagcgaacaaagacccagcaagagaaggcagaggcuaagacccaucccguaucugcucuccugaaauaauucuggagucaugccugaaaugccagaggacauggagcagguaagaacuagcaauucaagaaaugaagcauucuagaguaagagaugcuuuaaaagcauuccagugaacgccugcuaaaaccagaauuguuguguaaagaaaauagaaacgggugucauucauuuccuuaaaacauaaccucgggacauggaagaauaagccaacuuuaguuacugacccggagaaccagguuaugaagggcucagcuaagucucacuagcugacaauacagaauugcacuuucauuuaccauuuuaaaugcaauuauguauauaaaguuucuacauaaauaaggauuuuaucuguaguguguuccuuuccagauguucuuugucuuuguaugaauugaaucugcuaacauaacuuuuaguuucaggcugcucucuuuaaauguauagacuuagccaccacacgaaguuguauauugucuauguuaagaauggcguuugauucgcauagacccuaccaucauuaaagaaaaugauuaaaaaccauauccaaacauaugccccuagaacuguacccaacuuuuacggggaaaguaucaagucagauuuucaaaagcagccaaguuaaauucuuucuguuccucaagacuaggcugcucugagaaucagaaugcuaauugcauaugcuugcccuuaaaccugcuucacguugaagaaugaagaauuaauuuucuuuucucccauagaaagguaagauuacaucacguguugcgacuagaaacuuuaaaccgaauucccaguuaagagaaaaaguaguaagaugaucuuggcugcucccccggcccucuucccgcccucuucuuuguuguccccugauuaugcuuguuuagcgcuggggcaguccucaaggauucccuaaauaaagccaaacuaaugaacaguaauagccuguguuuaaaaaaaaaaaaaaucggaacauaagaaaccucaggcugucuucgauuacuguucuagagaaacuuuauguuuacacgaauaaggaaaugaguuuuuguuggggguugaggaggaaggaaagucaugguguucugacguggaaaacuucuuuaaaaggcugcuuagucuuuaguuugaaaauaaaccaaaaagguuuaggagucggggaaaggcccuaggaaaauccagacaguggucacguuuguggacgacguuuagagcuugcuauccugggcacacaagaacccuuggacuguucggugcaaaguuggcaaauccuacacggccugugccaggguuuacuuucugcaucaauuucacaggcguccagccuggcugaggauuuuuugcgguuuuuaacuggaagggaaauaagucggcaucagcacuuagggcugcuuaacuuuuaaaaggugguagaacgcccagccuuacacgcugcugcuuaaauucucggugcucaccaaggcugggcucguguggcccaauccugcaauccccgaggcgguguuucuuaaagagugggcuugauucugguuaaacccauuaagaagucggaccccgggcucguuucuuguucuguaauuauggguaaaguccaaggaucugcguuuugaagagguaccuaaguaguucaucuuccuucccccuacaacuuuuuauuuuuaauuaguuaaaaauaguuuuacauuuuugauaucucacacacagguuuuuucuuuuuuuaagcaucccaggaagacaaauggcucagacgccaacccuuuuauuuuuauuccuugucuuuuucuaaaucuuucaaaacccccaccuagagcucuagagauguguccauuaugcucuacccaccuccgcccccgcccccaugacuuuaaaaugcuuuuuauuccacuuuuuauauugcucagucgauccucaugcacugcgcagucugcaaacuugaaacucaaggcgauccacuucaaucuuuucccgagucaagaaaaaaaggaaaaaaaguagaauaaaaagcacucaaauaaaaucuccgaaacaaaaccugaauucacugccuaaggucagggccuuucuuuugugugucgcuuuaagcaucggcgcgugggcugggggcagaccgcgcguacccgcccucuuucuggggcgucggcggagcguggccaaucaacgggcgcggcuauggcagcggaagccggaagcggcgagcggggucguucugggccuaggggaggcgggccgagggcgucugagcugaggcccgcgucgauccuggguuggaggagguggcggccgcugaggcugcggcgugaagacggcgggcaugguggggcgggagaaagagcucucuauacacuuuguucccgggagcugucggcugguggaggugagggagucggccugggcgucuccggugggagcgggggcgccgagggggacgagccaccggggcucgggcggcuuugcaggcguauuccgcccgggucagagccuccggccgggaguggucucaccgccacccucccagccccggauccgaggggggcgccaccgaguuuguuuaucucagcgcacacgggucaguguuuuuuucuuccagccacugcggcaggaagcaaguagguggagguuuuacuuucgaguucugucucugcuccugaggacgaagagguuuuucagaauuguuuguuuugauuuugguuuuccccguuuauucaucuuugguucguauuucucgaucuuacaaguucguagguuugagaaagaacaggaaaaggugacuucucacaaauaacagugcuggagaugacaacuuauugaacucuuaaguucucagcacuauguuaugcacuugacgggcauuacuuuaauccuccacugugagauacuuguuauugccucauuuuguagacgagaaaacgggcauagagggugagacauuggcccagguucauuccguaagguuggagccuggaauucagauacagguuugugugacugucuugggcuuugaaccacuacggaguuucccugaaggaagauuauggugaugauuggaagauccaucucuggugccccccucgcccccgucccauccugcuccauuccacuuaagggccuccagcauuaaucuguccacagaacauauccaacccuggggauaagaacacuacuaaugcccagaccaugucuuuuggagagaguagagaauauaggagauggcuguuucuguuauugcaaaguuuucaugcuuccaaauuuacuuaggguuuucaaaucacuuugguucuuugaggguaaaguuaggauaaauggucuauuaaaccucuauguuccuagguccuccagaccgugcugagugcauguuacauacguuuacauuuauauguaugcauuuguauguguacgugugcauauaaagcuuaaucuacuuucacaaaaagaaguucaguauaaaaaugaaaauagcuuuucguguuuuccuucauuaaaaaugaaacaacgaagagcuuggcacagacuuacugcucucaaaaccuguagaauuaaagcuuacugacucaugagaacgagaacugucucauaguuaacguuagagaagcauccuggagugguuguuguuaguaauacugucuguggagcacaguagcgucgcaguagaaguuagaccaaucccaccuaaguagucagagaaucuuaaaaaguaaagcccaguaauguuuaccuuaagggucuguuucuggggaauuaaaaaauuaaacauggaacugugccaaguuuuaaaguuuccaaaaacgacaagguauuuaccacugaaauuugggaaaaccacauacuaauaguauuccauucuuuacuuuucuagaacauuuuuaguagacauuaaugcaggugugcuaaaguagaaaucacugucccagaguacuguguuggaccauuuggaaggagccauguaucucccauuaccuauacaauuugguaucauucgauuagauacgauaauaagaauauuuauuuauauguacuuaauuuuucaagaaauguuuuuuugguguccauaaaucuggucccuuggagugauugaauuccguacuucagaguuuagacaauaagaggcagauacguuuagaguaacuuaaacugauauuagaucuacuuucccccauauaauaaaaauugagaaaaaguagacuucaggcaaaguauuaucaacucuuuauugugccuugagugaacuagauagcauuuuauucuuucauucugacuuucuuaaaguguuuagacauuucuuccuugugcacaacuaaaauaauuuauggagugcagguccaaaguaguuuuuagagggauauuucuuuuucuaaagaacgaaccaaaaagccucaacaaaacaguguaaaaggcagaguauugcuuauauagaagcucaaaaacagagauauuuguuuggcauauuuuaaauuucggaguaaugcauauucagaggaaaaguuaccuuauuuaaguaaacgaaacuauucggacuccucgugguagggauaauauggaaaauguuagaaauauagaacuuuaaagcugaaagagccuuagucauuuugucuaaaugccuuccccauuuaccaaugaggaauuagaucaauagagauagaauaacuucuaaacaccaauuuguggcagaacagauaaaacuuuaaucauucaugaaaccaaauauuaguucacaggauugagacaaaaugcaguguauuugacuugaccagagaagcaagacucagguucugguuccagcuuuuucucuuuuacuauagacaaaacauuuaacacuggacuucuuguuacucucuuuggaaauaauaucucuucuaacaagcugcuggguuuuuuuguuuucuuuuuuuuccucuugcucuuucaccccgucugaagugcaguggcucaaucucugcucacugcaaccucugccuccaggguucaagcgauucuccugccucagccucccaaguagcugagauuauaggcgcccaccaccaugcccgacuaguuuuucuauuuuugguagagacagcguuucaccauguuggccaggcugguuuugaaccccugaccucaagugguugguccaccuuggccucccaaagugcugggauuacaggcgugagcccuggcacccggccucaaacugcuauuaaaaaaacaaaaacagcuaugauuguauacuuauauaacacguuaguuuucuuuuuuuugguuuuuuuguuuguuuguuuuuuugagaugaagucuagcucgugucccccaggcuggagugcaguugugcgaucucggcucacuacgaccuccgccuccuggguucgagcgauucuccugccucagccucccgaguagcuuagauuaccuaaaauuaccuagaaaaaaauaugaaacaguguacaguacccagcagucaggugucagugcucaagauuuuuauuaagagugacgaucugaagugcaagcauuuacugaaauggaaaugauacugcacaacauuuuauuugaaaauuaacauguuauaggccgggcguacuggaggccuuacauaguaacccagggguauaaggauauaaaguugcauuuucucauacaacuccacuuccuuuuuuacguuaagguauuauauucccuaaagagccuuguucuucucuauacuuaauacugcaucaacuccaagaagcucuuaauuaaaagaagaucaucugggcucuuaaguugcauuaaguuagcaaaaacuacugcaaaacugugacgauucauaagauuuuuuuuaaauucauuuaacagauguuaaaaugaaacuguacuucacagagucagugaaguacacagaucuuaauucauuguuuaguaacuuuuguggauuguauaaugcuuuggcuucuauuucaaguuuucuuuuuuaagggggaaagauacuguugucauuuugagaaagguagauggcacuuuuuguuuuccuuguguaagagaaacggauuguuaugaaagcuuugaacuuuccuggaguucgagaguacacugguccucuaagugcggucuccaaaucacgaugaucagcaucacuuguuggaacuuguugggaaugcaaauuaucaagccccaccccagaccuuugugaucuaaaagcccuccaggugauucugauccacacugaagcacgagaaccacugaccuuaggaacuguuaccuguuccuuugcuuccguagagugaaguaaaaagugaggaacucagaagaaaccaaauuaucucucuuuuagaguauuuuuucaggaaucuuuaccguauuuauccuguguaaauuguuuucucugacuguaucuguacuagacuuggcauguuuucuccucuuuacaguucaaucuuuguagagcuguuuucuugccaaauuucaaagaaaauauuuuguuggcugaaauccuuguuuucauagaucaguugguuuagagccaaguuuugcaacacagccugaaugaaauugcuuucaacuuuuaaaaugucuugaaauugguugaacuaaggaaaaauaauccuaagaauuuaccuuuauacuaucuuucccuguuagucuuuucauuuuacguuuuugauugcuagaaauacuugauuuuggugucuuuuaaaaaaaaauguauguauucggcuaaguaauuuaauugagcuaagggcuuuaaaaggucuuugguuauuguauauguauuuaaagauuuugacagcccagaauuaggugauuauaacaacucuugaguuaaaauaacugguuuguuuuuaauaguaaaaguugacuuuauucaagauccugguuggaaacuugguguuacccaucuugggaagaagggacauuuuuggaacuaugcuuggaaacauagaauuuaaauuuuuuccuaaauagugguucuuuuucauuucuguguguaauaauuuauuuguuucacaguagcaacacagaugagcuuaaaauauuuuuucuuauccuuugcguuuauuaguuuuagcuuuuuuuuuuuuuuuuuugagauguagucuugcucuuguuacccaggcuggagugcaguggugccaucuuggcucauugcaaccuccgccuccuggguucaagcaauucucccgccucgccucccgaguagcugggauuacaggcaccugcaaccacgccuggcuaauuuuuuuguauuuuuagaagagaugggguuucaccauguuggccaggcuggucuugaacuccugaccucaggugaucugcccagcuuggccucccaaagugcugcgauuacaggcaugaaccacugcaccuggccaauuuuaacucuucuauguagguaaauuuuggguuaacuaaggaacauuuaccaauuugguuaaacuuagaaagcauuuaaguguuguaaggaccaaguuuuuuuuccuccucguauauuccuuugaaauguugauuaauucucuaccuuggguccaucaaaauaugauaaauuauugagacuugaaagaacauuugggauuaaaaucugaagaccagaaaugucagcuuguaaauauauuggcagauuugacgcaaauacuaaucaggccuuaaaauagguaaacuuaaaacacguuucucucuagagacucaaagagcaccuucagucguaucuauagaagcaagacaaauuguaaagucuuauaaacugaagaauguaauguuguuauuuacuauuuagguacuuggagcaaaaguauaaaaaaaguugcuguuuacuaacucauuuggguauuaucaaucauaaaaauaggauuuucuguuaacauaggaaauauaaaucuacauaauuccuugcauaucaucuuguguuccuuuccuuggguaagauuauuauaacuuuuuuaauuaaaaaaauuuuuuuuuugaaacagggucucacucugucccccagacuggagugcaugucaugaucucugcuuauuacagccuuggccucccaggcucgugauccucccaccccagccucccaaguagcuaggacuacaggcaugcaccaccuguagcucagcuaauuuuugcuuuuuuuuuuuuuuuuuuuuuuuuggaaggacggguuuucaccauguugccuaggcuggucucgaacuccugggcucaagugauccaccugccuuggccucgcaaagugcugggauuaaaggcaugggccaccaugccuggcaaaagcuuuuucuuaagugauacaguuuuuuauaugguuugauuaaucauuguucuaacuuuauuuauuacauuuuuaaguuguguuuucugcuuuuuuuauuuuaaaaauuuauuuuuauaaauacaaaguauauuuuuacuguuuuuuuguauugagaugggucucauuauguuacccaggcuggucucaaguuccugggcucagcggagcugccugccucgcauucccaaaguguuggaauuacaggcaugagccugaugcccgacccuaacuuaacuuuagaauuggcuugcagauaugggacaugagucaaaauacguagaauuaagacauuuagggaacaacgauggugccuaauauauuugagagaacuguuuucaaaguuaguaacucuuucuauccgccuucaccuuuuaggaggaaguuaacaucccuaauaggaggguucugguuacuggugccacugggcuucuuggcagagcuguacacaaagaauuucagcagaauaauuggcaugcaguuggcugugguuucagaagagcaagaccaaaauuugaacagguuaaucuguuggauucuaaugcaguucaucacaucauucaugauuuucagguaugauuuagguuauuuuaagauauacaugaacaauauuaagaguugucuggaugauacagaaacuauccuugcucucaaggaaauuacuauguuugaaagcucuaaaguuguauuaugcaguagcauuuuuuucauuuagcaugacaugguauauguaaaccuuaaaguuaaauuuugacacgcugacaaagacaaauaugagacauuuuauaaaaugcuuauguuuauagagugccuucuaaguaauacuuucucugcaaaugguuuucaaauguuacuguaaaccucacaacacugcaaaauaguuauuuucauuuuagggcugagggagcaggcucagagagguuuucgguaucauugauacuauucucccuuugacauggauuuauuagauauuuaaaucauguuaauugcauaaaugauagcucuuuccuuuuguccaaauugggggauaaaacuuguuuugauuuagaaagacuucuguuuuguucuuguuuuugugacguaaucuugguuuguugcccaggcuggagugcaguggugcaguugagcucacugcagccuccgccucccaggguucaagcaauucuccugccuaagcuuccugaguaccugagacuacaggcaugcgcaaccacaccuggcuaauuguuguauuucuaguagagaugggguuucaccauguuggccaggcuggucuugaacuccugaccucacgugauccacccaccucagccuuccaaagugcugggauuacagauuugagccaccgcgcccagccuagaaacaugguuguuuuauuuucagacagggucucacucuguagcccagggugaaguacgguagaucgaucacagcccacuguagccuugaauuccuuggcucaagugauccuucugccucggccuccacaacaguuagaacuacaggcucaugccaccacgacuggcugauuuuuaaauuuuuuuguagagauugaguaccaaccacuauguugccuagucuuaucuugaacuccuggccucaagcauugucucaccucagccucccaaaguguugggauuacaugcaugaaccgucacaccagaguagaaauacaguuguugacaguuuuuuuccugguuugugucugcauauuaugaaauacucuuuucagugccuauaaauauuuuaaguuugaaccuugcggggaaaagaagcagcaugacaaaacuacauuagaaauuacaaugauuuauucuuaguugaaagaauguugacuuacugcacauuuuucucugaauuaacuuuaagaaggcuguaauaccucuuucauuuuauuuugaguuaaaaauacgucaaugcuuaacuucuagccccauguuauaguacauugugcagcagagagaagaccagauguuguagaaaaucagccagaugcugccucucaacuuaauguggaugcuucugggaauuuagcaaaggaagcagguaaugaugacuuuauaaaauuuucauaaaauauuaagugauugcugaguuuuuagaaauuaagguuuuguagaugguuauuuguuuuuauauaucaugaaaaaccauucuaaauuccaugaaagaguaaugucauguaaacauuuaauagauuugucuucuuuuuuuguagcugcuguuggagcauuucucaucuacauuagcucagauuauguauuugauggaacaaauccaccuuacagagaggaagacauaccagcuccccuaaauuuguauggcaaaacaaaauuagauggagaaaaggcuguccuggagaacaaucuagguaagaccuaaucuauuuagccccugauuguuuuugaagacuuuaaaaaucauuuauacauacacauauauauguuuuaaauuuaaaaagucaaugaauaugaaucauuagagaaaaauuagaauauaguuaauaaagaaaauaaaaaauucuaagagauaacuacuuugugaauccuucaagacaguuuccacuaucaguguuuacauauucaucuuuacacauagaaaacaagucagguaauacaagcuuuuguaacucauuuucaaaaaacagggcaguauaauuucucuuagagugagauauucuguuuauguauucuguuauauguauguuacuguguuauauguguauguauuuuguuuuuauguauucuguuauauguauguuguauguauuaacauucuauuaugguguuucuuuuuuccuguaugugaguuuguguauaacacacaucuccauauauaaaaaguauacacuccuuagaaaaaauguaaaauuacuaagaacaaaaguucucauaaaugcugccucagggagauaaacaccaaauaugguuaaguguggaagcauuuuuauauauuuucaaaaaauguaugcauguuguuucacaaccuguuuuuuuucccucaacaucuuugcauuuuaguacacauggaaccuacucugggauaucuuacuccuaucaguggcugcguaguacuuaauuuaaugguccccugcacuaaaacuacugccuuagacuguacuauggccuugagaagcagcccuaguguagaauaccuuacuaauggacauuuaguuuuuuaaaaaguuuucuuguauuauaaauuauucuguugaaaucauccuugaauacauuugucuuaguuuauuucgugcugcuauaacagaauaccaacaacucaguaauuuauaaagaacagaaauuuauuucacacaguucuagaggcugagaaguccaagaucaaggugagggucuuucugguccucuggaggggaggaaugcuguguucucacggcagaagagcagaaagggaugugcuucuuccuucaaguccuuuuauaauggcauuaauccauucauaagagcagagugcugaugaccaccuaaacaccucccaaaaugccccaccucccagcacuguugcuucguggauuaaguuucaacaugaauuuuuggagaggacaaaaacauucaaaccauagcaguaucuaaguucucuugucauguaauuuaaaagaaaauguuugauuugcaguuaaaguguuaacuauuguauaccaucagcagggaccauuauaaaaucuaaauauuaaugagugguuguaaaacuaaugugaacacucauauacccuucacauagauucacaaauuguugauguuuugucacauuuguuuuauauguuugcuuuugccagacccauugauaauuaguugaauuucaucuccaaauacuuuaccuuucuuuuaucuucuaacaagaagaauguucuucacauaauuacagugcaguuaucauacauuuggaaacuuaacauuaauaugguacuguaaucaaauacaaaucuauuuaggaauuuucucauuuaugccaaaaauguccuuuauugcuuuuauuuuuuaaucuagcauccagucaaagacuauucauugcauucaguugucaugauaaguuuuauuuuuaaugaucauauuaauguaggauuuauauauauaaaaaaaacuaguccaaaugacagaagauacuuaacaaaugugguuuugccuuuuucuuuuuuuuuuuuuuuuuuuuuuuuuugagacagggucucagucgccugggcuggagugcaguagggugaacacagcucacuauagccuugaccuccuuggcuuaagcaauccucccaccacgaacggcuaauuuuuuuacauuuuguagagacgaggucucacuguguuguccacgcuggucucgaacuccugggcucaaguaguccuccugccuuggacucccaagugcuggaauuacagucaugagccccaccgcacucagccuuugacuguuuuuaauuuuauuuuugaggcagggucucacucuguugcccaggcuggaguacaguggugcagucauagcucauugcaaccuugaacuucaggcucaagagauccuuuugccuuacucagccucccaaguagcugggacuacaggcaugugccaccaugcccagcuaauuuucauuuuaauuuuuuguagagacggaguuuugcuaugaugcccgggcugaucuugaacuccuggcuucaagugauccuucugccuuggccucccaaagugcuagcauuauaggcaugagucacugugccuggccuugaauauuuuuacauugcguugucacaagugagcugugucauuuugguauauuuuaauuaaaaggcaagguuucuacuuugauauuauuuaaauccacacccuuguaucuuacaucaaaauuuaagaaucagucagcuuuaaauuauuugcuuuuauucuucucuaggagcugcuguuuugaggauuccuauucuguauggggaaguugaaaagcucgaagaaagugcugugacuguuauguuugauaaagugcaguucagcaacaagucagcaaacauggaucacuggcagcagagguuccccacacaugucaaagauguggccacugugugccggcagcuagcagagaagagaaugcugguaagaaggauuccugaguccugucuuagcgaagguccgcuuugucuuuuccaugcuugaacuuucacagcuguacuuggaguguuacugagugaaagccaaaagugcuuuuuuaaaacuaggagaccaaacaaaaguaguuuacauauacacuguauucaugaagaauaaaaauauuaugcucuucuguuugaauuuauuucuuauguacuauagaucccaucauuucuuuuauugcaaaguguuaggaaacuucaaaauaaucaucuaaggucuuuuaagaagauacucuuugggggcugggcgugauggcucacaccuguaaucccagcacauuugaaaaaguugguauuaaauauaauauccauacaaagaaagaugagacugauuuaguuuagaauauuaauaggaugaccacaguuuuuuaauauaugagaauuauauuuuguaauauauaacaugacaauauuuaagaaaguuuagcucaacuugaaaaaugguucuauuaaguuuuuguuguagcuugggauaauuaaaaauacucauuaaauuguacuguuuucauaaaaauuuguaaugcuuuuuuauauucccacuaauuaaguaaaauuggagccuuuuuuugauuuuaaaaauucuuaagguuuaaauucuagaaauugcucuuuuaaguguuuugcuaagaguauuaguaggaauuugauuuuagauaucuuguggagaccuuuccagaaaaagaggguugccuuuuaguuccuggaccuuauuuuaaguaagcuuuuuggucaaaccuauucuacucagcucaaaaaguugaaacuauugaauuuauugugucaucguucuuaggauccaucaauuaagggaaccuuucacuggucuggcaaugaacagaugacuaaguaugaaauggcaugugcaauugcagaugccuucaaccuccccagcagucacuuaagaccuguaaguacauggcuguaaaaaccuuuagauccauugcuaugguauauauuauugcuguguuggguaacuucauuucucaguacuaaucaaagugaacuuugcuuguaugcuggcuguucauagugcuacuuuucucuaaauuaucaucuguagagaagaucaugaguauugaaguuuguagaaaauguauuauugucuugaucaugacaggcauuugguuuauuuuuccagggaugaucaaaucagauuucuuacacuaagagcaaaaauaaguagcaaauauaaaaccucaaaauggccaggcacaauggcucaugccuguaaucccaacacuuugggaggcugacgcaggaggaucccuugagcccaggaauuugagacuagccugggcaauggagggagaucucaucucuguuuaaaaauauauacauauuuaaaaaaaggucagggggaacaaagcccucaaaauauagccuuucacuuacuuuugauuuuuuuguguuuaucuuucuuuaaagauuacugacagcccuguccuaggagcacaacguccgagaaaugcucagcuugacugcuccaaauuggagaccuugggcauuggccaacgaacaccauuucgaauuggaaucaaagaaucacuuuggccuuuccucauugacaagagauggagacaaacggucuuucauuaguuuauuuguguuggguucuuuuuuuuuuuuaaaugaaaaguauaguauguggcacuuuuuaaagaacaaaggaaauaguuuuguaugaguacuuuaauugugacucuuaggaucuuucagguaaaugaugcucuugcacuagugaaauugucuaaagaaacuaaagggcagucaugcccuguuugcaguaauuuuucuuuuuaucauuuuguuuguccuggcuaaacuuggaguuugaguauaguaaauuaugauccuuaaauauuugagagucaggaugaagcagaucugcuguagacuuuucagaugaaauuguucauucucguaaccuccauauuuucaggauuuuugaagcuguugaccuuuucauguugauuauuuuaaauugugugaaauaguauaaaaaucauugguguucauuauuugcuuugccugagcucagaucaaaauguuugaagaaaggaacuuuauuuuugcaaguuacguacaguuuuuaugcuugagauauuucaacauguuauguauauuggaacuucuacagcuugaugccuccugcuuuuauagcaguuuauggggagcacuugaaagagcguguguacauguauuuuuuuucuaggcaaacauugaaugcaaacguguauuuuuuuaauauaaauauauaacuguccuuuucaucccauguugccgcuaagugauauuucauaugugugguuauacucauaauaaugggccuuguaagucuuuucaccauucaugaauaauaauaaauauguacugcuggcauguaaug

SEQ ID NO: 16540 - RNA, 7314 nt, Homo sapiens
ugaggaaucaugucuucaacuaaaucacaaaugguucagaaagaaaaaaauuaucuguaacuuuucuaugcaugagauuuaaaauuuuuucaagaguuaaaaagggcaaaaaauaaaaaggacauaaauaggauauugaauaaaaugucuauagacaauuccuaccuauaugccuaaaucacuuacaaucaaaaugaugccacugauauacaauuagugaccuuacuuugcuuucugccacaaaggacucaccuaauuaccaugaucacacuucucuuuuguguuaauccacuucuauuguuaggguuuuaacuauuuuuaaacuucuugacauaaaguaaucccucaaguaauaauauucuaauuaagaaauuuacauuaacucuuaauuuacuuaaaauacauuuauggacuuuuuccuuuauuaaaauuguuuucagcacuauaauuuugugugaauuguuauacuuagacaaagggguacacaauuccuauuuagaaaauuuuauugaauaucauacuuaucaaaagaaaaaguuaauuuuccccaaaggcacccuucauuucacaugaucuauacucuaauguucuuuuguauuaaaaauaugguuaaauauggaauuaguaaaaugcagcauauaaaacuucaugcugagcaaaaacaaguccaaaacaacuuuaccauauauccauagaauaguucccacaguacauuuccuauguaaauuauguuugaaugcaauuuuuagaaccauuuuaagauacauuuugcaaucuguuaacuguaggcauccgcauuuuucuuccauuacauaaucuguuuaucugauuaaguuggcaauaucugcuaggauccacagaaugcaggaaaaaaagcaguuauuucucaagguuugagaaaucugguccaccuuuaguguaguuuccugagauuucugcuccacugaagucaaaaccaggauucuaaaagauacaaacauauauauaaugaaauaaaacuuauaaggaaaaauacaaguacaaacuggcaauugauaaaaaaggauauauaaaugaccaauaaauacaugaaaauauaacagacuucacuguuaccaccaaaguaauauuuaaaauuaugaggcauuuuucaacucucccaguuacaaauauuuagacaucauauguacacuacaauguuggcaaguguauggggaaacauauacuucaauaaaagucuguaguuauauuuaauagcuagcauuuuuauuuuauuuauuauuauuuuuuuugagacggaguuucgcucuuguugcccaggcgggagugcaauggugcgaccucagcucaccauaaucucugccucccagguucaagcgauucuccugccuaagccucccgaguagcugcgauuacaggcauguaccaccaugccuggcuaauuuuguauuuuuaguagacacgggguuucuccauguuggucaggcuugucuugaacucccaaccuccggugauccgccugccucagccucccaaagugcugggauuacaggcgugagccauggcgcccagccuauagcuagcauuuuuugagagcuuucuauaugccacacaaauuucuaagagcuauacauauauaagauauuuaacccucacaacaguccugugaaguacuaugucaggccuuagucuuuuuggugggcuauuucguuuauccaacaaacauuuguugagcuccuacuguuugggagaccauuagagguauguagaauucaagagugaaaaaaaacaaaaaucccugcucuaguggaacuuaacauucuagcaggaggagacaaaccauaaaucaaccaguacaggggcuggcagacuuuuuaaaaacuagguaguaaauauguuaggcuuugcaguccacauagucucugucacaaauacucaacugucugaaagacaauauacaaacaaaugagcauauacguauccuagaaaagcuauaaaacagguagugggccaaauuuggcccaagggcuguaguuugccaaccgcugaugucguguuaaaaguugguaagugacacagaaaaaaaaaaaaaacaggauaagggaaauaaaauuauauuuaaaugggaugaucaaaguaugcuucauugagcaaugauaugaaaacauaaaaguuagccaaacugugggagaagagcauugcagucaggauagcaaagggaugggcugacauguucuuuaaggaacagcaaacaggccaguauggcaaaagcagaaucacuaagagggauagcuguaagggaggagguaaucagggagaugauggaauaacugaucagaaagggccgagaaaugacuugcagaguucugagaaguggcaugaugugacuuggauuuuaaaagaacugcucuaacuggcugggcgcggugguucacgccuguaaucccggcacuuugggaggccaaggcgggcggaucacgaggucaagagauugagaccauccuggccaacacggugaaaccccaccucuacuaaaaauacaaaaaaauuagccgugcgugguggcgggagccuacagucccagcuacucgggaggcugaggcaggagacuggcgggaauccgggaggcggagcuugcagucagcagagaucgcaccacuccaucucagaaaaaaaaaaaaaaaaagaacugcucuaacugcuauuuugagaagacuauggcaagaguaaaagugagaagaccaauuagaacguuauuagaguaaucaggcaagacauuagaggugguccagaucagaauggugguagaguugguggugaaaaguggccaaauucuaaauauauuucgaagguagcaucaguaagauuuccuaauacauuggauaggguaugagaaagauguaagaaucaaagaugagucccaauuuuuuuugaccugaacuacuaguuuucaucaacugagaugaaaaggcuacagguaaaaacaaauauggaaggauguuaggguguucaacuuggacauguugagcuuaauauacauuagauagccagguggagauguugaauaggcaaccggguaugcagguccuaaauucagaaaaaaagucuaggcuagagauauacaucuggaaaucauuaucauaaagacguacauuaucaagugcugcaaucuagcaauuccucuccuagauauuuaucuuaaagauaucuuagaacacuugaguaguuucacagagaugaaagcacagcuuucuuuaaaauagagaaaaaugaagaaaucuaaaucauaucaaaggcaaacagccaaauaaugaugacacauccaaacuacagaauccucugaagcaguuaaaaagaaugaguuuuauaccuauguauuaguagggaaagagacccacagcauauuauuaaauaaaaaagcaacaagaagaacaauacacacagugugauccuccauuuaugcuaaaaaacaaaacaaaacaagcaauagccaacauaugagaugaaaaugagauagaugcauggaauggggagaaugguggugaaggggccuuucacuuuuuacacuagguaagucuauauugauucaacuauaguaagaguuuauucaugcauuacugauguacauaaaaguaagcuuaaacucacaaaucacagcaauacaaauaaauuccucucaagaaaaucuuccgaaaaaucaaauccauacaagaaaggccauuuuucuaacaauucacuuuaaaaauucuucuagaaaauguuuguaacuuuucauaaugacauuugaguuuuaauuucaaauauuuauuugaugauuuuuauauauuuaauuacacauacucauacacuucaucugacuuacuucuuuuuggaaucucucuaauguaagcuuucucugcauuuggucuugcacccaaggauccgcugcauauucagauucuaguagagaaguccaacaauuugcugcaucucucuuugucuuuguaagaacaauacgaaccauuuuucuguccucuaaaaaaaaaacacacacacacacacgcacaaauaaauuagaguucuucaucaaguuguuuuuuuuuuuuuugagacaguaucacucucacccaggcuggagugcagcggcuugaucucggcucacugaaaccuccgccccccggguucaagugauucuccugccucagccucccgacuagcugggaauacaggcaugcgccaccaugcccggcuaacuuuuguauuuuuaguauaaacgggguuuugccauguuggccaggguggucucaagaaguucuucauuaaauuuuauauuuccaaaaacaacuaacuaauuuuuucuccccccacuagguaacuuugacauacaacgguuuucaacacauuucuauugcuuuaucuuucaaagcugcaaagacaaaaaagaccuaauacaaaagaggaaaagauaucaagacaaaauuauuuuaauuugaugaauuauaguaauuacccuuacccaaaguccauguucccucaucagcuauuguagaaucaaagaguuugcccugaaaaauaaacauauaaggugcuaaaaauacagaauuuaauuuuuauaaaguuuucaugauuaagauuuaccuacuuuccuaccuaauccacaucuuauaccaccacuucaccaugacauuuauaggugcacaacccuaaauuuucucccagcagguaaaauggaaacuaguuuacacugcaagggauauuuacuauggcaaagaacacagagcucucuaaagaaagaucagggcuccuuaauuuuuagaagauacaguaauacugaccacuggccaaaugugaaauuaauaucugaaaugcuuuaauucuaccaauuuaaauuaaccacaagaagggaucuccugcuaaaacuaaaaaauguugucuuuuuuuuuuuuuuuuuuuuuuuuuuugagacagaguuucgcucugucgcccaggcugcaguggcacgaucuggcucacugcaaccuccaccuccaggguucaagcgauucuccugccucaaccucccaaguagcuaggacuacaggcgcccgccaccacgcccggcuaauuuuuguauuuuuaguagagaugggguuuccccguguuagccaggcuggucucgaacuccugaccuugugauccgcccgccuaggccuuccaaagugccaggauuacaggcaugagcuaccgcacccggcaaaauguuguuuuuaaaguaaacuuuuaaaaacguuuuaaucuuuuuguugggcaaucggcauuaaaaaaacuuuacguauuccagauuugauagauuaguugugacuaacuguucacaaacucauguuuuuuaaaaaaauaaacaaaauauaaauuuaaaagagacugcaccaggcccaguagcucaggccuguaaucccaggacuuuggaggccaacguggauugcuugaccccauggguuugaggcugcugugagcuacaaucucaccccugcaccccagcaugggagacagggacccugucucaauaaauauauauuuuuuuuuaaagagagaaugccuaaacucaaauccauuuuaauuuguugccaaauuuaaguuauagaaagugaaauuaaaugucacuaggaaaagcccacauuuuaaaauaugucaaaauuagugagaaaaaaaucccacuggucuauacguacaucagaaaucccaaauucagcagcuacugcuaaauuccgaaaguuacuggauuuacuaauuuauaaucguaaucuaaaaccauuguugaggaaacuaugaauuguacaauucagaaaaguaacugagauccaagcugacauaaugucuuucacacgaaucuugaggcacucaaagcaccuccauauacuguaauauauauaauagcuaauagcuaacauauaguaugaacuuauuacauaccagugaauacuccaagcucuucauacacgugaauaccauguuaagcucaaaacaaucccaugagaaggguacuauaacuaccuuaucuuguggauaaggaagauauagagacacugaacaaucucucgcccaaguuuacaaaacuaggaaacaaguagucucccuucaccauauuacacugccaucaaacaucuugggcaucuaaccugagaacuaaaucuaauuucaaccuguuaguuuaauuauacacuuaacaaagaaaaagcggguccagauccaaagagcauuggugaaaagaaauaaaaggaguacuacuuauuuuaugcacacaccucuucaccaccugcuugaccacuccacaaacaugcaggauuuucaagcuuuuagaugagaaaacuaaucaccugacaucaucucuaaauucucugcccguuauucuaucccuauuuucuuuguuguccuuuccuauauuuaucuauuuaugaauuacgcuuccguacaggagcuuaaccucuccacugcagguacguuaucuguugucuuccugccugucuucagugcacggaagaaauauuuguuccuuuagcaaccuaguuaaucuguucccagcugaagcccgucagagaagcagaagcagcagucuuaguuugaaaacuaaacacgaaaauaggcuccucaaauuuccacaacucagcaccugcccugaagaggcgggggcucugaccagacccaaaccuggucaguguuauccucuuucucuuucugccagccacaggagccgucgggacacccaacagucguucagggaaacggggcugggggcgucugggaagaggaaacugaacacaagccccgagcugccgcuaccuugaggaucucgcggccgcccaccgacagcgccacaugccggcucuggaggccgcacuggauauccugggcgcgcgugccuggcggcaccugaacuucaaugaacaccuccuccaaggucugguaccacuggccccacggggucccgcacgguaccaccccacuccgcuccucaaacggggccgacauaauccagucccucccggccgcggccgcaccaggcggagccgagcgcacgcgcggaaucccacgcuuaggcuacgccucggccucuccgcucgggucacugcgcaugcgcaggaacgcaagcuagcgcuuuggugugcguguucguuuuucccuuugaauggccguuuacggcaccggcaggccccggaugaaagaacugaaauccagaaaaguucacaugcaacgaacaaugggacagaauuggaaccagugaagccggaacucacuacaccguccccuaagugacgccaaaaugcacuuucuaacgucuccggagggaagugcgcuugcgcaaaugcuagguuacacuug

SEQ ID NO: 16541 - RNA, 7528 nt, Homo sapiens
auugaauuucauuaacuuuauugaaagguauaucccuuaguacuaaaacauaaugguaguugguuaguuuaccucugccaacucaaaauuaacaaugauguauucaaaauauugaaauuuaucagccuuuugggaaaacuaaaaaguuacccauaaaacaugguuuacaaaaguuaagaauaagauauacugugguucuuugguuuuucauuguguacugauccauaacgugaugucaaauuggauauagccaucauggauagacucaggcuauacauugcacugaguaacuguuuacaacacuuuaacacuguacuucuuacauucacuaacugccauggaggauccuaaacacuacuucagcagcuucauucauaguuaugaaggugucuacuugcuuuucuuaagauuuuuguuuuggcacaguaagggcaucaguggaaguauauucucuauuuauaaaauugccaucacuucuaacuuaaaaacagucuguaguaaaaaauucuggaguguucaaucuagucugaacuuaccuuagugugggaaagcaaguuuucgaagugauaauuuauuuugaguuacuaauacaauagaaacuaguuuucuugaugggauucaguuugaggcaguagguucuguauaaaaauuuuuaucguagauacaaaugucaccuguuuucuagaaaaaaauauuaaaagauaacuuaaugaauaugccaaacuuuauaggucuguauuuuucuuuauauaaaaugcccucaaauuuaaauguaauucccauauagcaauaaaguccacaucucuagauuaccuauuacuugcauuaugggguguguuuauacugccuagaauguuaacccuuauuaugccuuaaaaguacauuugugaaauguugcuuuugacauaaaccucauaacuuaaaauuuaaguaggaguaggauuagaauaaugacagugauugaagcugugggaagacugauaguugauaguauuagugugacuccuccaauagcauuuucaauaccaccuaaauauauugauccaauaucuaaaguuagaucaaugauagaaaugaagauucacaguuuaccuucucaggcuugucauuagcauuucacauuuaggcuuuuagcuuugauuugaaugcuucacagaugaauucaaaucuaaacauaauuccacuacagcauaauauuaggcaguuuucccaagucugagaccaucaugcuuaucucgugauguuuugaggcuucauagcuuaaauccauuguaacauuauggaauccauagaacaagguuguggagaaaggcuucagagaaguuuuuuggugcuguaauaauccuauuuaaauaaagaaaacaaacaaaauccaacuuaacagaagccagucugccuaaauacuacuaagaaaauugaaauguucauaucuaauauucauaaucacauguagauguauuaaauguuaacauuuaguuuugaguagaauaaaucaucacugaguuaggaaauuuauauggcaagaauguauaucacauaugcagaaagcaaguuuacauuuuuuaugcauauaacuacuuugcaguaguccagcugcuauagcaaugauagguuaguauaguguugacacacucuggcaguuuccagauacccaauguagagaccaucuaucauauccuacuuuuuuucuuuuuuuuuuuuuuuuuguggcggagucuugcucugucgcccaggcuggaguguaguggcgcgaucucagcucacugcaaacuccgccucccggguucccgccauucuccugccucagccucccgaguagcugggacuacaggcgcccgccaccgcgacuggcuaaauuuuuuuguauuuuuuagcagagacgggguuucaccauguuggccaggauggucucgaucuccugaccucgugauccgcccgccuuggccucccaaagugcugggauuacaggcgugagccacugcauccggccuacuuuuuuuucuuuuaaguacaauauccaaguucauauugauuuugcuuauaagcuaacagucucaaauuaguucauacuugguucagacuuuuggugcuguuguccugcucagcuuauguaauuuuaaaucagucagauacauacagcaagaucaugugcaauuaaaaaaaagcaugauuuuagugcuacaaggaggaugcuguucucuaagcugaaaauuuaaugaaauggcuaacguauguaucagagguuggauaauuccuuacuccuaagauguuguaccuuguauauaguaaaggccuucaaauauuagcugacuagaucagugaugucaucucccccuuuacuauuccaacuccauuuuguuuauuuugaagauaauuacucuucuuuaguugaaaauuauggcauuggaaaauguucucuaucuggagaauaauaacggaccaaauuuaccaguuaagggaccauuucaggaauuguuggaaggugaguuauucuguaguagcuaugcuucaauugccgugcaguacgcccagaaacaauccauuucaacuucugaacauuugguuuggaacacuuauuugaugaauauucaguuaaacauuuggauacaagcucuugccagaaggucagaucucugccauuuaucuguacauacauaaauuuuaaaaaauuauuacuccaaguaagucccaccuuauuuaacuacauuaauaaaugcaauccuaugaacaugugucuuugcucauuaaaaacauuugaggauagcuacuuaaguuucaaauaaacauaugacaucucauuuuacuucaggagauagaagggguuuaguuucuuuuacagcuguuaauaggauuuaggcuauguccuucacauaccuuggaauguuucugaagacauucuauuccuucuguuaacucuacacacuucugugcuuggaucucuaaugcaaugauagacaaugccaacacagaaggcuaaaagagauaaauuuaaaguaaaugccaaauauaaaaacagaucauaucaauaggcauaaucuuuauaaaauauuuaccuuugcuuuagaaaauaugauccugcaaugacaugccuucaguugagcuucuagucuuucaaaauuaaugcuauuucuccuuuaaaaagaaaaugguauuacuuuuauuagguaauacuacaucuagucaaaagauguuuuuagaaaaacauugaagucaauuuuuaaaguaaagcuuaugcacacuuaacauagcaaaugaacuauugaaaggaauuccccuuccaucagagauacuaacuucuaaaggcaccauaugggaguuuuagaugauuugggccaaaaaauuaaaaugaauaguacuaugccacaaauacaagauuuauuuucuuuuaguuuuaauaaauauuucaacauccacugaagguccuuuuuuuccauaaauuuguguuagaugcuuuccuacuagguucuauaaagucaaaauguacuuuaaucccaagaauuagcuuuaacgaagcuauugacaauggaacauuuucucacuuaugauggacauuaaaguucaaggagccacagcugucauuuuacuuauuuuuauuagaauucuaugaggauacugauuuuaugcaauauccauacaauaccauucugauuuccaaaugucucuuguucaaaacaaaggucacuuaccuuucaaguggcaaguucucuugaaggagugaauaauacaguugcagaaauugaaaggcaguaguagcuuugacuuuccaacacaccuucuccaauacaaucuuuuccauucucaucaagucugaaaccguaaaccuauauugacuuauucggaucaagucaguugccaaugggacauuccuuuccucuucuauugauuuuacagccaaauaaaagcagcucaguccaacacacccaaggugcuugggcuguaccuaaaaaaucaaaaacaaaaccaguaagcccaugacucuaccuuauuucaauuaaaacauaaaggauaaucuagaacuccgacccaacauuuugaaaauguauauuugagguuuauuucucagcugugauggacuuaacacaauccacucauaccuaaacuauagccugucaacacuauggaccccacuuagaaccaauuuuugaguaacuggacugaguuucaguauaauguuuggcucagcauagaaaaaguguguuuuuauuaaucacuguagaacuauaaguaaacauuguucuaguuugaucaaauaaguuaacuagucaaagauauaugaggacugaaauacuuuauggcuuauuuacaaaauaagccauuucuuugcaggauguuguauuuuuuccaggcucuugucuuugugggaacacauauaaaacaguuuuaaaauacuauggcauauacuguuuacucugccucuaagaguucuauccacuacuaaucuuuaucauuuaauuuucugaaugucugccguaugagacacagucaaaacuuuauccaguuuacuuccagcucacaugaaacuaagcuuuuaccaguauuaauaucucugugcucucucucuucuuguaaacucuucagcaguacacuuaugccucuuuaaaggcauaauguaguuauuuuucuuauuaugacuuguacauaagagcaacgaucuuauucucacauaagacugaauuauaccugaggaauagcuguauauuauucauuugugcaacauuuacagauucaaagguaaugacuacaugugaaaugucuaaagagcuuaauuagucuguugaagcaaauuucuugaaucuucaacaaauauugaaguccuuuuuuaugaugcacuguguuagauaccgaggacuaaaauaugaguuuccuuccaauugucacaucaucuuauuuuccuccagugaccauggguguacaggaaaggcagaugcauuuguaacaguuaagcucugaaagugacagucuuguuuaucuaguauaggaaaauaguugcuccuccuucagacacacucuccucccuacugcauguacacugaagcuggaaaugccaagcauaagcaagucuugacuaggucuaaggcuaaaacauuuacaauuuuauauauggguagugauuaacaaauauaucuuaauucuuagccacaauguagccucuaauaaauuucugccacuaauaaauuuguuuauaucuaaaaauaguaaauaaauggacaaauccaaccuaucaagaaggguuuuuuaaaaacagccaauuuucuuacuaggaaacugcaauuuguuacuugauauuagacuauuuuucauuucagaauuuaagucuaauaccugauguacuacucuugauuaugauaagaaauauuaaugcuguaguagacaaaauuaauguuuuggcuacgugcugaaaaaaaaaaggucaaguuuaugaauaccagccaaaagguaacaauuccaucuccaaaacacacugagcaaaauuacaaaaauguagcuucaaacauaccuucauuuuagacaggaaucuguccaguaaauucacagcuagagaaaaugucucugugucaaagccaaagaacugaguuagacuaagaagaucuuuuacuucaaagucccuuagucuugcagucauucugaggccauuaucgugugcagacucaauuagucucaaaccacagaccuuuggcugacaucuagacuccuguuccaacagggcauucagcugguguagcaguuucugagagucaguuguugucaguaccucuaucaucuauauauagaaaaaaagaccagcaaggaguguaagaguaguccuuccugcuuuccuuggccaucuuugcacugggccaagaaaugauuuauaagccucccaucccccaaugcggcuagugcaucuaagucauugcaaagugccaucuguuauuuauuucccuucuacaaguuggucacauccuaaauugaguuccuagagggaaggaaccaugcuuuuuuuuuuuuuuuuugagaaggagucucgcucuguugccaggcuggaguacaguggcacgaucuuggcucacugcaaccuccgacucccugguucaagcgauucuccugccucagccucccgaggagcugggauuacaggcaugcgccaccgcgcccagcuaauuuuuauauuuuuaguagagacgggguuucaccauguuggccaggauggucucggucuccuggccuugugaucugcccgccucggccuuccaaagugccgggauuacaggcgugagccaccgcgcccggucggaaccaugcuuuuuagaaaaauaaaaugcaaaucuucaagaaauacuuguucaaguuauucacugucaauagauaaccacgaauaaacaccguaagacaggauaccgaaagugaaaagcagaugguaguuaaguauucugccacauauuaacaaaaugaacuguucaaguuacuuaauuguacuuaguuccacauugauaaaguagggauaagguuuaugaccuaccucacagauuugugaguuaaaaugaaaucacguaaagagcuuagcacauacaguagacgcuuaaaaaacacugaacaauaauaaugagcuugagcuucuuucuagauuuauaaaaugaggguaacaauaucugucgcugaaugugaagacugaacaagaugauucaccacuuaaagaguauagcacagugcuuggcacacaauacucaauauuacuuaacuuuuauuguuguuaggaaaggaaacuuaaaaggugacauuaggagcacguauuggggcgggggggugcgguggguuguugcuaaccuagucugaaagaugaaccugggaauuccauugauuuaagugugcauaacacaaccaugucccgggcacaagcuaagcccuggauacauggaaggucccucccacaccaacuaaagacaggaaggcaggaggucuucagagcuagucaugugaggaaccucuaacugcagggguuccauucuuccuccccaggcuagucccugggacugggucggcagacacgaaaggcaccucaggaggccggauccggcuccgccccuccagccucggacuagccugggcuugugcucacaacagcgguagaguuuaguguggaaaagggcgcgggccagaccuacuccucgccccgcgcccccaacccagcuccccacccgcaccuggcggucaacucccgcgcagucccacucaccuugacagagacugcagcuccucagcgguaaccacccuccccgggccugcucaccucaccccacgauaucagauccgagaggccuacgaggagaggggacucguaggcaagaggagagaggcccggggagggggacuguccuggguggaggccucggcagcgccgccgagacaacucggcccugaucagggucagcucggagccgaaggggccgcgccugcccuaacgaggaauauauuggagggcggggcuuucucgcgagaagggggcauuuucgccgcugauugguguaauucuuuugauggauggccuccg

SEQ ID NO: 16542 - RNA, 2250 nt, Homo sapiens
uuuuuuuuaacuaaacaaauuuuuauuacacaaagguugucacauaauuggauauuucucuacuuuguacacaacuauucucacucuccacagaaaggcugcuuaacuucucaucuggugguggcaaguacuaaaauccugauuuuaacagaauaguaguaaaaaugccucagugauuuagguugaaagcaguacauugguacauggcucuuguacccaguaucaggaauguacaaauguuuuuuauucaaaaauacaaaauaaauuaucuguaggcauggacaaugacagcaguaaaccauuauauauuuugucaacugaaaccaguaacugaugguuauagugauuuucagccagccuuuuuuucauuuucuccaacugacuucucugaaguuauuggugaggaacacugccuugggcuuccugucacaguucauuaauaaagguaaagcacuagucuaggaguuagaacaugccaccucccauaccaccucccauuccacccauugcacccauuccaggguccuucucuucuuuaggaauuucugugacuacaacuucugcuguaguuaacagagaggccacaccagcagcauccaauaaagcaguucucacaagcuuuguugggucaauaauuccuuuuucuaccauauucauaaaaucuccaaccauagcaucauaaccaacuucugaggaauuuugcauaauuuucucaacuaucaaagauccuucaacaccugcauucguagcaguggucauugcuggaauuuugaguguucuuuuaauaauuuccauaccaauuuuuugaucuucauuagcuggagucaaugaguccaaggcuggaaugcaucgaaggagggcaaaacccccucccaaaacaaugccuccuucaacagcagcucuuguagcauuaagggcaucuguaacucugucuuucuuuucauucacuucaacaucacuugucccaccaaacuucagcacaacuacuccaucugaaaguuuugccagccauucauucaguuuuuccuuuucauauucacuaguugugacaucuaacugcccaaugauuucuugaauacguuuuucaaguugagccuugucaccuuuuccuuuuaagagcauggcaucgucuuuggucacaaugaccucuccaacuuuuccuaagucaugaggcugaacaucuucaagauucagggucaaccccucuucuccaaacacugcaccaccaguagcaauagccauaucuuuaaguugguucuuucuauugucaccaaacccuggagccuugacugccacaaccugaagaccaaccuuuagccuauucaagaugaguguacuuagagcuucuccaucaacaucuucagcgauuaucaccaaaggcuuauggugagcauuggcaauuucaagagcagguacaauggacuggacacuagaaauuuucuuuucacucaacagaacauaggcauccuggaauucacauuucugaccuuuugauguauuaauaaaguauggagaaauauacccucaaucaaacuucaugccuucaauaauuucuaauucaucauucaguguuuuuccauccuuuacugugaugacacccuuucuuccaaccuuuuucauugcaucagagaugauauugccaauuucuuugucuccauuugcagaaaucauagcaaccugugcaauuucuucagggguggucacagguuuagacugcuuuuuaaguucagcaauuacagcaucaacagcuaacaucacaccucuccugauuuccacuggauuagcaccuuugcuaaucuucuggaagccuuccuuggcuauagagccugccaguacaguagcagugguagugccauccccagauucuucauuuguguuauuggcaacaucuugaacaaguuuagcuccaauguuuuuauauuuauccuucaagucaauugacuuugcaacagucacaccaucuuuuguuacguugggacuuccccagcucugcucaauaaucacuguucuucccuuuggcuccauuguaacggccacagcaucggcuaaaaggucuaccuacaccuugaagcauuaaggcucgggcaucugcaccaaauuuuacaucuuuggcauaagcucgagugagaugaggagccaguacccuggacacuggucucaucuggcgaaagacuguggguaaccgaagcauuucuguggggcggcugcagggcaugcgcgcggcgagacagguugucggcggcgagugag

SEQ ID NO: 16543 - RNA, 17466 nt, Homo sapiens
uaaguauugucauuuauguaucuuuaacaaaagauaaaauacaaaacggacacaacaucagccuuuauguugaaccacccuguuuagguaggaaaaugaacauuguuuuucauucuuaaaguaaauaggaauuaaaucuauuugcauugcuguuuaauuucauaccaaucuaaagcucgacacuauguauauccaaaguacuugacaauuugacucaguuacucacaccacuguuucugagaugcugacuuaaugcaguauccuacaggugguuuuugguaguuuagaaaagccagugagugggcuguuaaaaguugauauacugaugucagagguuuuguuaggcuguuuucacugauucuacugucaguauuaucuucacaguguucugagaagaggcuucaggaucauggcaaucuauuacuaauaucccuagaagcuauccuuauaauucuuucaauaaaccaacuucagguuuuguuuuuuugcaaauuuuacaaacaaaguaacagcugcuggcuauaaauauuaggauauucuacaauuuaaaaaaucuaauauucaugauuguuacauaggggcaaucacaaugaaaacaaacgguaauguaaaccauauccucuaugauaaaggaaaggauuucuacaccuagacuuauguccagaaugguaaaagaccuacuacugaucagucaauauugacccaaugaugagaaaauaguuguuuuccauucaaagacuaacacauuuagucuacuccagaggccaaggaagagagaaucgcuugagcccaagacugcagggcauuaugacuuugucugugaaaagccacugcucucuagccugggcaacauagcaagauccugucucuaaaaaaaauaaaaauaaauguagucacagaguugcuaguaauuauuuaaaaaaacaaagcccuguuuuuuucucaaaaccaaggugugcuaauacuaaauauagggccacaaaaaucgaagcaauaaaguuugaagcuuaauaaauacagagaaagagacauucuuaauagguagagagccaaggcuuuuuuacaugacucacauaaaacuggaaauaggccaggcgcgguggcucacgccuguaaucucagcacuuugggaggcugaggcggguggaucacaaggucaggagaucgagaccauccuggcuaacacgaugaaaccgucucuacuaaaaauacaaaaaauuagcugagcaugguggcgggcgccuguagucccaacuacuagggaggcugaggcaggagaauggcgugaaccugggagguggagcuugcagugagccgagaucgcgccaccgcacuucagccugggcgacagagcaagacuccgucucaaaaaaaaaaauaaauaaauaaaaaaaacuggaaauaaaaucuuaauccaauuuuaaauucuauucccaaaagcacacuucaugugccucuucuucuuuucuuguuuccucaguauggaaaggagugaacuuacugugaggcaucugaaauauuuauuaaagccaggcagcaagaagaauaaacaaggauuuuucuaucuacaaucaucaauaagaagcugaaaagaauguaucagcugcaucuaucuuggauggucuucugacuaguugcuacuguccaaggaaagaggccauggggucaucuggccucugacguuucauucuauaugccuccauuuccucuucaguagguucucgaguuucauacaugcuauuguaaggccgcuuccucucaucaaucugcauggucuccuugacaugaagaaggcgggccuccucugcguucagugccuauagugagaggaauaaaauguguaucacagcucuacaucagaugucuuuucuucaaaaguggcagaguaccaacacaccccacugaauaugaacugcucuaucaaaaacgcagauugccugaaagagcuuuggagucagcccuucuacugucaagcuacaacuaaucacuauuuggcuuauaugauauuuuuauacagcacaaaacauucuauaacauuuuaaaucaauguugaagaaauuuuauuuaauaacaaaaauuaaaugagguucacuuuacuuauacaagcucacaaaugaugcuucugguagagacuacaauucugacuuuucucaaggacuugccaaaacuuacaaacuacggagcuagaaggcaauucuuuccggucaacaugccaauaacucuaaaaugcuuuagaaugcacauuucuucuguccauuagucauaauuacuaaauacuccaagaagaaggcaauaccuacaccucacaauaucuccauuaauauaacuugagcaaaucacucagacucuaggcuuguuucaucauuguaaaaaugcauuuggagacaggacuagaucacaggccauuacaaauaaaggccuugacaaauaauacuggcaagaacgguggcucaugccugcaaucccagcacuuugggaggaugaggugggcaguucaccugagcucagaaguuugagaccagacugggcaacauggugaaauccuggcucuauaaaaaaauacagaaauuagcugcacaugggggcaugugccuguaauaccggcuacuugggacacugaggcagaagaauugcuugagccuaugagguggagcuugcagugagcugcggucgugccacugcacuccagccuggacaacagagcaagacccugucucaaaaaaauaaaaacaacccaaaaaacaaagaauacugcuacuugucacuuuuacuauuuagacuucacaaauuaccuuuuucaauuuuucaugcuucuuuucuucaucaucacuaucugaacugcucuuucgaugcuucuucuuuuucuuuuucuucuucuucuuuuccucuuucaguuuuucuugaugcagcugaaagggaggauugaaaugcaguguuauuaaugugaaaacaaagcucaggugcacuacuugggcggcugaggcacaagaaucacuugaacccaggaggcggaaguugcagugggcccagaccgugcacugcgcucgagccugggcgacagaaugagauucuguuucaaaagaaaaaaaaaaacucaggugcagguuuuaaagcccucccuccaggacuuaaaaauucaggacaaaugauuaucaacuuaccuccaugaggguuugagguuuuuucacagauucuuccccaguuaucucauuuauaauacacuccucagaguucugugggaaauacauguaauuugaguugagugucauaguuacuaaucaucuaagaacaaguuaaaauuugaaacaugagacagcauguuuuaguuugacuuaggagcuucgguuguuuuauaccuuuaagaaccaaagacaauuacuuacaacaaucuccuucccagcuucuccaguacaauaggaauacuugaaaaaagagugacagcauuuguauccccaucggccuucuuuccaguacgauccccagauaugcugcagagagagaaauuaaaaagcuuaaaaaggaagcugaaauuagaaacuucuguauacuguugauaagaguauaaaauaauacagcccauuaaagguaauuugggagaaaaauuauggggauucaaggcuggcuaacagggagaagguagucugaccugaagugugagaagcaggaccuguaguuacaaaacucuuaaauucuauucccaaaagccuauuaaaaaauuuaggguaucugacuucucuugaaaaacguaggagugggaaauucugggccuauauaaccacuuggcaauaaucagcuguugcugaacaguggaugccccauuagauagggcuuguguucuccaguuuguacaauuugccuggcucacuucacucauguaugaucacuggucuggcuccuauagggaguuagguuuuugacccucaacuaagagagacaauuguaguuugguuacuucaagagaacagcaaaggacaauauaugcuuuaugauguuuacaaugcaauaugaauauacuacauuacuuauuaaauauucuugucaaaauauuuaacuuauauccaaucaagccguuagaccuaaauuccuauuuauaaaacauacagggauagagaaacaaguuauauaacacuacuaggaaccagucaauacagaauaugagacaauuuacaaacuaauuggccuaaucuguuaaauggucaccgucaugaaaaugaagagauacacucuagaaaagagacauaauaaccgcauaacgaucaaaagaaauuugaaacgaauucugacuaaaacaaaaaauagguguuaaaggcauuuuucuguauauuuuggaaaaugugauuaaugacuagauauuaggugauauaauguuaauuuucugaagugcaauaaugucgaugugguuauauagaagaaaauccucauuuuaaggagauaugugauacagcguuuauggauaaaaugucaugauauacauaauuuccaaauguuucagucaaauaaauauauacauaaacuauauguguguauauauguguauuuuacauauauauguaaaacugugcauaugcacacauacaacuagacaaagcauauaaggcaauauguuaaaaauuucagaauuuagaugauggguauauagaugaacauaguauuccuucaaaauuuuucuauuuuugaaaaaauuccaugaaacaguuaaaauuuuuuuuuuuuuuuaaagcauagagaauacaaaugguuagcuaauaaaguuguaguggaaaaaugcaauacagagcaaaaccaacaaggacacaaaauuguuccaguuuagcacauacugugugauuguggaucuucacauccuccucauacuuagagcaggcaacagcccgcuccuguccuuugaugacugucccaugucuugaguacuccacauagucuucagucugggcuaaaagcaauucagcuggaggggcauccaaauguucuuggccaccauacuaaaaggacauuggacauuauucaauacauuuuacaaccugauuugcauuuaaauuuccagaaaacauuuauuucuaaucagaaagaaagggaacauucuuuacuggguuuuguuauagaaagcacaguaggaaaaaaaaagccacaaauuuuuucugaggcaaauagaagaugucucaguugcuauucaucuguugaguacaguaaguuacaagauggccauaaauuccucuuaucuuucuauacaugcccuuuugccacagggcuuugcuuuucuucccaucaagagacgaagucuuucucugucccuugaaucugggccugaccauguuauuugcuuugaccaaugaaaguuggcaaaugugaugcaagcaaaggcacuuauguaccacagcacacuuuuugcugccacucucuagaacucugagaaugccauuuuaaaaagcugugcuacccuacuagaggaugaaagaccacaugggguggagaugagcugucccagaagagguccccuuaggacaauuagccuguuaacugcuaaacacaagagugaggccaucuuaguucaucaucuaaccucagcugagcaagcccagaccaggagacuuggccaacugugagaaacaauaaauguuuauuuuaagcuauuaagauuugagguagcuuguuuugcugcaaaagcucauacaaaauuaccaucugacuaagagaaaggaagaaaaggacuauucuucauggauuaagagggcucucuuugcauuauuuuccaaauguaaaacuaacgcuuauuaacuaguaacuucucuuuaacagaaguucuucuuuagcauuuuggucaaaauuaccuuuuccaggaugcuuucuuucugcuguucuuugaaaucuucuuuuuugacuuugaaggacuuauacaacagcucuagcuuuguaggaucugccuguagaugcacuucagaucccuugucauaggcuucccaugcaaacacuagaguaauucaaaacaucuuagugaguuggcagcugcauuacuguaugcuucuugaaaacaagcuuuaaacaaucccaaacgucuuaugagcugauauaaaauggcuugacauagaggaaacacuuacacugugucugagccauugaaaugguaucuccuguguaccuaacaaaguuaucuccagcauaacucacucuguaaauacaaauaaagaaaauguuucagagauugauuuaaggaaaauuaauucguaaaacugaaucugaauuaaaaugaacaccaucuauggucaggucagaaaacaauuaacuuucucucaucuuaaaaucuguacauuuaacuugauacuuacucaucuggauucuuuccugcauuggcauaaggauucucucucauugcucuaguuuuuggaucauaguaggcagaauuuggaucuaaauuccucaaauacuagaagaaaaaaauauuuaaagaauuaauguuuacucacagcaaaaagauuucagcagacuaguuggaggaguugaacaugaucaauuaaauaaauguguguauacauuucugggguucaggugaagagaaaaaacagaaugaaaccuuaucuuagaaugacucugacuauauuauccauaugcuacccagagucgauaaaauuuaugcugggaagacaaguauuuuucaaauauguauguuaagcugacaagacuuacuuuugcaauaucuucucgaauccugagauuccggacaguaauucgucucuuggagucaaaauucuguccaggcaugucaauaucaucugcauauuuaucuucauccucaucuucacuauuaugaucuuuuuccuaaaagagggagaggaaggaaaaguaagaagaaaagaaagcagcauguaguucuuuuuuuuccccuuucccuuuaaccaaacccuuauuuacuuguguucuuuaaaagcuauuauuaguguuauuuauuauuagccaucagaaauuuaaaaauuuaacauauacucagagacagcaaauauguauuaccaucugagaauuugguuccucuucuccccacugguguuuuggagaauucugcaucaugaaagaagaaaaaucauucauaaucucauuccacuuaauccaauuaacuuuauuauuaagauaauaaaguauuauuaucuuauuauaaauaauauauuuauauaauaaaauauauuuuauuauauauuauauuuauauuauauauaauaaauauuuauuauauaauauauaauauguaacuuauaaauaaguauuaagauaauaaaacuuaauucuaacugaacaaacucucacacuucucaguuauaaugagcgcaaaaauucugaauacaagagugccauuguaaauaauuuuauuacacugucuauaaagccagcaaauuucaagagaauuuuaauuaagauuauaaccacaaaaugguaacagaaagauuaagauguccaaaguacccaauaaauauuaauuucuaaauguguuagucuucagacauacuguauucauuaaacguuacuaguuuccuaguaaguccaaaaagaaaauauuacuggguucaugucuucacagccaaagugaaguuugggcaaugaaaaaaaucuacaagugacacaguauuguaauuuaaggagaggccaaacuccuugucacaaggauacacuuuucuucgcuagcaauuggucagaauacuuucuaacuccacagaaugccuacacuaacgugguauuucaucaugucccuucauaaaggcuucaaagauuaaaaauacuuaaaaaaaaagagaauacauuauagcauuagugaggagaugcagaaacacguguauguauauauacuauauagauggaagcauaaaucugcauggcuuuucugaaugauggcuaagugauaugucauaaaaauuuuagaaauacaaacucacugaaauacacuucuagaagguuauccuaguaucaugucaauuauauaaagauguauaagaaugugaugugcaguguuguauaugugcaauguuuuuucaaaacacugggaaaaaaucaaauuaauagaucacugguuauauaauguauugcacuccauggaacacugaacggccauuaaaagugauucuauccaaggggcagaaaaguauguaucguuuccuaacuuuuuugauuaaaaaaaggggaggggagagacagauaggauaaggguauauauuuguauuuguauuuauucaagacagucugaaaggagccacacacauacacaaaagaguuggggcgaggggaaguuuaguguuaggguggauagaaacagggguggagagacuucgcugugcaucuucuuaaauuguuuuaauuuuugagccaugugaauucauacaaaaauaaaugaugcuauaggucuauaaauauagacagaaaacacguucccacuguacucuauguuguuaaauuaaaaaagaagguaauaaaugaauauauaaagauggauucauguaagaaacauuuuguauucuagcacacaugaacagguauauguggacaagagagaccuggaaaggccuacuucaaaauguucacaauuaacacagggauauuuucuuuuuuauauuauguucuaauuuuuuuccacuuaauauguguuacuuucaaaauuagaaauauaaauauuuuguaaaaaauaauuuuuuugaguucccacuauuugcuaguucaccaaagacauuuacauacauuucuauagugacagcuaagucucuaaaucuacuguaugugguucaucuuaauauccaagcauccugggagcggggagagauagcauuaggagauauaccuaaugcuaaaugacgaguucaugggugcagcacaccaacauggcacauguauacauacguaacaaaccugcacguugugcacauguacccuaaaacuuaaaguauauaaaaaaaaaauaauccaagcauccaagugggcaaaaaucauuagccccuuacauacauuaaguauccuuacuggggaaauaaauuacauuacguuuacaacaaacaacagagaauacauuagaacaaaagaaacaggcccuuuuucuuuucccaaaguuaguaauaaauaaaaauaaucacaacaauaauagcuacuaauuacccaguguuuacuaugugauauguauauaagcuuccuggggguagguguuaucauuucuauuucagacauacuaaacugcagcucagagaggcaaauucacuuuuuuuuuuuuuugagacggagucucacucugucgcccaggcuggagugcagcggcaugaucuuggcucacugcaagcucugccuccuggguucacccauucuccugccucagccucccgaguagcugggacuacaggcgcccgccaccgcgacuggcuaauuuuuuguauuuuuuaguagagacgggguuucaccguguuagccaggauggucucgaucuccugaccuugggauccacccgccuuggccucccaaagugcucggauuauaggcgucagccaccgcgcccggccggcaaauucacuuuucuaagagcauguaugucucauggagcagagauggauuuuguuauugauugacugauugacugauugauugagauagagucucgcucugucauccaagcuagagcacagugacgugaucucggcucacugcaaccucugccuccuggguucaagcgauucucccgaguagcugggacuacaggugcucgccaccacacccagcuaauuuuuguauuuuuaguaaagaugagguuucaccauguuagccaggcuagucucgaacuccugaccucagaugauccaccugccucggccucccaaagugcugggauuacaggugugagccauugugcucggccagagauggauuuuaaacaccuaucugguaacuuacaauguuaacuugccugguagguuaccuuaguaacucgguaacugcuuacuugguaauuauuucaaguucuguuugcuuuguuacuuauacaugguuuagagucccuuuuagaaauuuaaacuaaaaaacuauaaauguuuacuauuuauuugugccuagauuuguuaaaaagaaacuugacaacucuaauaugcauaauauauuuacucuauugacaaggauuuuuaaaaaagaaaaaaaaacuggcugcaauagaccuuucauucauauaaaaaauguuuugcccaguuauauaacuaauacauauucauugugggaaaugcagaaaauacuaaagaaauagaaagaaaaauucauaaauucuacauuaaauaaaaacuaguguucuggucuuuuuuucugugugauaauauuauacuaucuuuucauguauuauucaaauacaaguguuaaccaguguuguuaaugaagucuugagaaaugccauuuuaagaacuacacagcauuacaccaugcagaugcacuuaaccaauucccuguuccuggacauuuaagcuauuccaauuucuuuacuauugugaaaaaugcuguacuaucuuuaugcaucaugauuuuucuaaacucuagaaaauucuuuaggauggauagcuuuaauaauuuaacuugaaaaaguaaauguuugugugugucuaaauauaaauaguggcaauauuguucccaaacugacugcaucaauuuauauuacuaugaacuguauacaaaguaucaguuuuauuuuucccccaauagcauuucucucuuccuaacugaagagcuauaaaaugaauucuuguuucaauuuucauuucuuuguuuaaaagaaauaaaaccuuuuuauugaucauuuucauuacuuacagccuguuccacuaauuuuccugaggcuaauuccucuuggaguuucugggcuuucaauguucguuuugccuuuaaaaaaaaaaaaaagaaagaaagaaagaaaaaguaaacauuuaaauuuuacuuacaacauucaagucaccaccuaaauuuuuauauauuuaaaaugaauaacuuuaaauuaauuuauuucagaaaaggucacugaacaaaccuaucucuuugggauuccuuguagcccuagaccuauuacucuauaaagagcaggaguuacacaguguuugaaccaggcauuaauguaaacugagccaaauggcaucaguaguaaauugcagggagcaagcccugacaaaaacaagcaguugccacagaacucuagaugacugacucuuaccaggcaggcgugggguuaccauauauuacaauauucaagaaaagaugaaauccagauuuuuauaugaaaucuuauaauuuuaaaaugauaccucuaauuaaaaaaaaaaggcagugugacuaugacuucaaaggaauaagggugaauaggucaaaucauaacaguaaaaacugaaguuggguuaaaauaaaauaaaauuuucugaaacaaauuauccauucccuuucuacuacucccaaaugcuaugggaggcaacuauaaaauagguucaugggcaagcuauagcuuggggccauacauuucuaaccucacaaaaccaaaagcuuuggacacuaaucugucuucaugcuuccaauaucuuuugcuaccuaagucagggaguaaaggaccaauauaagaaucaaauaagaagaaacugcuggcaaguauggcuagcacacuauuuccuuuacucaauauuacaauuauaaagguagccuauacaguaguacuacuauuauaaaaaugcuaccauuuuuaaagugcuucaagauuugaaaaguagagcugcuagagauacagcaaaaggacgauucuuuaaaaaccccaggaaagcagggaauuuugcucaccaaaucaacuuuggcauacucuucaacaauuuucauguguucuucuggauuguagccauuccaccgaucccucuucccaucauagucaaacaucaguugaggcuggacauguucaucuggagcuauauuaguaccuguaaauuuggcuccaacucgccuaggucucuaaaaacagaguaagauuuaaucuuuuccuaaguuuuuauggcccaaaggaaaacuucauacaacuuuuacagagugggcacuuuacgaucuauucaauuuacaguuagucuuacaguagaaaauuuuguugguguugaaccaauuccacugaaacuaauuuuuauuuaacuuguaccuaaauauaggugauuucagaaaaagagaaguuagcucucugacaaagaaaaaagaaagacucugacaacgguuuucaaaauuuucaaaggugaacuuaccucaaagcagucuuucuuuuugugugucauggccccacaauuuucacaugcuccuuugcgguacuuaguaauuauggaauucuauaaauauauauaaagaaaaacaaaaaugucuuaaccacguaaguuagaaauaacuuugacucucauuacuauuuugucuagggaaaugauuucuuuguuaaaaggaaaauaaguuagagucuccacacauuuauaaaugugaaacuuuaaagaguucaggaguguaaaauuuauauaagaaacacaaagauaaaauaguaaugcacugugaauuucaauaccagauaaaggguuuuauuaucuguuucuacuuuaaauaguauugcauuaaaaauucuuacauuaaguucuuaaacucuccauauccaugaagauguauacagguugccuacauaccucuuuuacaccccucuuguaccauucuccagaugagcugaacugcuuuuguuuuucugguuguggucucugguguuuuaaaguaggucuuuuugaaggaucaauauaccauggcacugaagaaauauacugaggaauauggggguugaugucucuguaauuaaaguaaaaaaaaaaaaaauuuaaggauaaaauuggaaaauaaucaguauuacaauuacaaagguagcuuauacaaaaucuaagaacagaaauauugcagugguagggggaagagaacaagguugcuaucucuauacuauaauaaagaauaauuaaaaauaaagaaguaauuuauuuuagagugaaaauauuuccaacuaagaaacuaagaauagugauauaacugaagggggacaagagaggaaggaaaauagagauguguguuaguaaucuaaaucuucuaucacaagaaguuuugguucaaauaaugucuauagucaauuaauuaaaauaauuguguagguauuauuaucuagagaugugacgguaacaaccagaaaaacucaaaauagaaagauuucauagcagucacuucuguagagcaggccaggggugggaacgguaaaaaaggacuguugcuauucauuauaagcccuucaacauaauuucauuauuaaaccauaugcauaugaguuugauaaaauaaaaaacaaaaaugacauaaaugaagagagguuccucucaaaggaugaaaaauuaauaaacuaaguagacaugaauuugaauucugaaugaauggaucauacaaaaaauuaaguacuuacuuuccuucuucaucaacuucugcaggagcauugcccaauuuucgcuguucuucuagcuccuucuucuuucuccaguccucucuggucaucuucuuugguucuuccaaacucauuucuuuggaccccgauaggggugcagcauuaacugcaucuacaacuguggcugacaugguuaucuggccuccucuaggaaaagaagugaaacuuacaguaaaaaguaggccuucaugaauucacucaaacuaccaaaaauacauccuaauaauauauacuguuucauauguuuuuuuuucuccuauauuauguguaaggaagggucucuucccccuccucaaggucucuacauacuguuagcacuguuucucucucaacuccaauuuacaaauggagagagacacacacguguauuuaaaauuucacaggacucuuuucucauauccauccuuaaucccucuuucuguguaugucucaaacuuuucuaacacaguaacucuuaaugagagaaaagaggguccuaucucuguaccccuucaagaaugaauaucucaagaguuaucuauauucacugccuccauuuccucaccuucuauuuucauccucacucacucuaacuuagcccuccauucccuaccauucuaaagaaaagaguuacaucauuaagucaucaaggaccauugugcuaaauccaauggacauuuuucagcucuguuccuucccuuuuuauauauuaugucuugacuucccugacacuacauucucuugguuuuucuuuuucuuuuuuuuuuagagacagagucucgcucuguugcccaggcuggagugcaguggcaugaucucagcucacugcaaccuccgccucccagguucaagcgauucuccugccucagucucccgaguagcucgauuacaggugcccgccaccaugcccggcuaauuuuuucguauuuuuuguagugacaggauuucaccacacuggccaggcugcucucaaacuccugaccccaggccaucugcccaccuuggccucccaaagugcugggauuacaggcgugagccacugugccuggcccucuugguuuuucuuguaccucucuugucaucaaauuuugcccaguuauuuaauguuggauuccucaaggcucagucagcaccuuuuaagccacucuaaacucccacuaauggauaagcucauuuacuuccaaggcuucaauggucacaauacaacacugcuggcucuccaacuuauuuuucuauaaaauaaaaaauaauaaaggaacaacguauuuuucuauucaagacuuuuuaucugagcuucagauacauauauccaauugcuuacuugacaucuccacuuagaggccagaggcauuuaaacucaauacgucuuaauucaaucucaugaucuucccucugaaaucuaaucuccuacucuucccuaucuuaaugaaagacaacaccauccgucccuuuacauuaagugcuucagcuuaucccuacaucuaucucaucacuaagaacaguuauuuucaccuuuugaguaucauucaaaugcaucuacuucuuuccauucuuacugcuaccacccuaguguaaguuauuacuuuuuccuacuuacuggacucuucugauucccuccaaucaauucuccacauugcaguguuaauuuuucaaaacacaaaucugaucauaucaugucugacaugguuuggcucuguguccccagccaaaucucaucuugaauuguacuccuguaauucccaaguguugugggagagaccgggugagagaucacugaaucauggcggcaguuucucccauacuguucuccugguaaugaauaaguuucacgagaucucaugguuugauaaagggaaacccguuuugcuuggcucucauucucuauuguugccgccaugugagagguaccuuucaccauguuugugaggccuccccagccacguggaacuguuaaguccaacaaacuuacuucuuuaguaaauuggcaggucugggcuaugucuucauuggcaaugugaaaacagauuaauacaauguccuacugcccaagcuuaaaauccuccaaugcaguaccguccaaaaauucaauacagcaccaucuaagagaaauacaaugcuagucccacauguaauuuuauguuuuccaguagucacauuaaaaaaguaaaaauaaacagguaaaauuacuuuuacaagauuuuauuuaauguaauauauccaacauauuauaauugcaaauuugaauuagaaaaaaaacaacucugucuuuaaaaguugauauggguuuuacacuuauuuaaacuaaucacauuuccagucucaauaaccacaaguggcuaauaacuaucauaacgaauagugacaccugggugcgaugguucacaccuguaaucccagcacuuugggaggccgaggcgggcggaucaccugagguaaggaguuugagaccagccuggccaaccuggcgaaaccccgucgcuacuaagcauauacaaaaaaaucagccaggcgugguggcgugcaccuguaauccuagcuacucgggaggcugagacaggagaaucaccugaacccaggaggccgauauugcagugagcugauauugcgucacugcacuccagccugggcgacagagcuagacuacgucucaaaaaaaaaaaaaaaaaaaugacgcuccaaaggauuuuaucauucguacucuaaaaacugacaucuuuuuaacacaccuacacgguccaccauggucuggcaccugccuaccuuccagccucaccauuacaacuauccccgcuuccuucucuacuaacuacauagaccuucuuguaguuccucuaguuccucuaacaaaccgugcucccuguagacacugggccuuuacacaagcucuuucccaguggaaagugcucaaugccugggggucuacgaugcuucucaaagguguucucuucuaugucugaccuauagaaaaccuccacauauauuuguguaacauauaaacugauggccuaaauauacugcgaagagaagcacaacaacgguaaauuuaaucuuuauuaaaacagcuaccauuucucgagccuaccguguaucaccucaucuaaucuucacaauaagcccaguagauaggucugaugaacaccauuuuacagugaagaaacagguucugagagguaagauccucagccaagaacacauuguaguaagaaauaaggacuucaaacacaacucugacuccaaagucaguucucuaaaccaguauguuauacuuguccacagaacauuggcuucugggccuaaaauauuaaaaacuaaaacugaauaaaguauuauagucaccaaguuguacgcacuaguuuccgucgcuguggagggaccuauuuucuccaacuaaaaacaguaauagcucccacuuacugagggcuuacguaagacacuguuuagcgcuuuacuuacauagauguuuucauuuauacccgcaugauaccccacugaagucggaucaucucgacuuaacaggaaaaacugaagcucaaguaaauuuuucuggcgaggaaauacagucugucaauuuggguacuggaagcagcuuucccugcucgcaguccggggauugcucaaggucuucgaggcaccgccacaaaggcgacacucucauaguuaucccgacuguuucccugaagacgcaggccuggccuggcagggcacgagugccaugaaugggucucaggacaguggcuuuucggucccccguccucgcucccucaacaccugagggcucaucacccccgugaagauauauccaauaauuaggagccuucgacucauuuucucagguuccccaacuccccgucgcccgcaaguucuaacaauauuuucuuacccagccccgccgcagcuagccccaaguccauccgacagaauccaagccaaucucguaauguuuacuuccggcuuuucgccuaauuccggcg

SEQ ID NO: 16544 - RNA, 1238 nt, Homo sapiens
uaccugucuuggauuccuuagccccuugccaguccuggagacuguggcaggggccgccaggaaggcagcugucugcugcugagucagaucggaagguggugaaucuuuccagagcagcugaaaaucucagcauggagacaguaagaaaagagacgggguguggauaagacucugccaccgugucacacuagcauaggaggcugcacguucauuuguuguuguuuuuuuuuccuuugccaaccuccguucuauuuaugugcaagcaguuuggauucaaguucuuguaucugucuguucugggaccuggggauugugaggguucccucacagccagcacgacccccagaaagaggcgucccacaauaaacacgucaccugcucuugaucucucaccucuuguccuaggcauccccucuugggccggccccuccuucccucucucaaaucagcccuggugagcaucucccuaugguagaggguggaauauugggggcagcagcaagaccucgggagcugaguccugcccucugaguaggagcugggccucccugggcacacagaggccagcggagggguguauaaggcuugacaccccagcuccaucaccgucucaggguuuuuccaaagaaaccaguaggauauauauggagagagauuuauuuuaaggaauuggcucaugugauugcagaggcuguggucuaaaauuuguggggcaugucagcaggcuggaaauucagguaagagcugauguugcaguagaguucaaaaucuguagggcaggcccacaggcuggaaacucaggcaugauuucuguguuagcagucgugaggcaaaauuuauucuccaggaaaccucaaucuuugcucuuacgaccuuuuaccaguuggaugaggcccacccacauuauggaggcuuuucuuaaagucaacugauuguaaauguuaaucacaucuaaaaauaccuugacagcaacaucuagacuaguaccuagccacacaacaggcacuguagccuagccaagcugccacauaaacuuaaugaucacaccacuuaccagcuguuggaaggcaguugacccaaccucucucugagccuccaucuugucaccuguuaaaaugggagugauaacaccuugccucauaggguucuuaagaggauuaaauaacauaauguacaucaaggccaguaccuccaaaaaaggagauaauuauuauauuucuucaagcauaagaucagcu

SEQ ID NO: 16545 - RNA, 741 nt, Homo sapiens
auuuuuuuuuuucucagacgaugaacucgcacuuagaagaucaaggcgggcuggaaagcaaauuuuuaaaaaauguaaaccucugcucaaaacugagcgauaacccgaaaaaaagaagaaagggaaaauccaacgaaaagaccaaaauaauaaaauuagagauguaugcuuggcuguuggggguuguuugguugguugauuuuugguuugggugcuuuuuuuuuuuuuuugcuuuuuuuuuuuuuuuuuuguaaugaucacaggccgguggaggacaggaggggcuggaguuuccuuuuguagagguacccuucacuugaagaagcaggaagaaaaaaaaaaaaaaaaaaaaaaaaaaaaaaaaaaaacccugauggcaauuuaagaaacaauagacucaacucgcgcugccggcuuugcuacuucaagugucauuuuccacaaccaggcaaguuuuuuccucucucucucuuuuuuuuuccuccuucucucccaaccaaagauguuucuuuccuuugcguguagaugaggaggacgcugguugccguagacagauacaccagagaggguggggggaaggggagagagggagagaggaaagggggggagggaaagagagauagagaggagagggagaaagagagagggguggacccugcuggauggagauucuguuuucuccuugcuaaaauagaagugauuugcaggcuuucccuauggaauccaguuugacuuucccca

SEQ ID NO: 16546 - RNA, 891 nt, Homo sapiens
cuuuguuaggacaggucuuuaagaaaacaccccucuucccuuuuucacagcgaccacccgcgacaguucugagccccgcccucggacccuucuccacaugcuuuuuggugguggggggauguggcuucccaaggccgggcacucgcaguuggccagagcuugagggguuccuggaggguggcugcugcggcgagacgccgagcauguuuuccauccauucccaccugcccugcuagcugagacgugagauucgaggggugccggaauauaacuguggguucuacuccgcgaagguggguucacuucauccaccgccacuuuucuuccuccccacgcagugcgugucagguaggaguaaaugcuuauagaguuucaucucgcgcgcaaaacccaaacaaaacuuucacaccucuucagcgaguucugaggacgcacccguccuuggcggagaggacgaggacaugaggggacaugugugucccguugucagcugggucuaugucgccugaaggggcgugaagagcgcccacuggauguuuugggggaagaggagguggguguuugaggguucgaguguguguacagggugacaaggggcgcgggucggcguccgguuuagccaucuaacucugcgucuuuggccgcagcggggugggucuggcccgggcucacuuugagaagcagccgccuuccaaucugcggaaauccaacuucuuccacuucguccuggcccucuacgacagacagggccagcccguggagaucgagaggacagcguuugugggguucguggagaaggaaaaaguaagugggcgcagcgcugucgccccucguccccggcucggcucgggagcaggcccgggagccuugggcagcgcgcccuuccuugag

SEQ ID NO: 16547 - RNA, 99875 nt, Homo sapiens
cagcagcuggagacuaacggagucccaaacgacauuaauggccagaaccacuuauuugauuucccucaugggugcccaugaguaggguuugauagaccuaccuacccaucaucuucaggagugccucgcccucuccaacacuuagcacuucucuagucaaccuggguuugacuaaagaggcucagaaaaaggaacagauggacgagguuugaggcugggauucuacaacgaggcuuugcuaaaacuugcugagggaucuuaggcaagucauuucucucucauuaucaguuucuccaccuggaaaauaagguguguugcaucaggcucuggaguuauacggauguggguuugaaucuaggcacugacauuagcuguguaaucuugggcaagugguuuagccucucagguuugauuuccucauuucuaaaacagggauaguacuaguaccuaccccaugggauuacugggcuaaugaaaagagauaauguaugcagagucccuggcucauaaaaguuauuuucuccgauuaauuaaauaagugaauauguguaaagugcugaagacagcguuugacacuuagcguuuuaucagucuuagcuaucaugauuuucuuauucuaguacauagaaaguccucaauaaguaacaguaguuauuauuauuuuuggucacaugucccuguguuucccuccaaaacccuaaccauccccaauucugguuuucuccccgcaugcagcccaaggguuuucacgucccagugcgauugucugggcuguuuccuccgccugauguuccauuucuccuccucccgaucucagauggcuucuccucugggauuccucuggucuucaucacucccuccucccaggcagaaggaauggcuccuggauuuguguccugcuuaaaaaaaaaaaaaaaaaaaaaaaaaaaaaaaaaaaaagaaguccauauagcacuuaguucuuugugccuggcgguuggguuaacucuuucugagccugucuccgagaguggcggcccccgggggacggcgcugggugaaucaccucugagugucacccaaggcgucuggcacagugcgggacaguaaacgggccgcugugcggagagggguccaguuuaacuccuagaagcccgaguccccgacccucuacaggccgcguccaccacaaaucccuccuccuggggggcucggauucucccuuccccgcggucucccucaccugagccagccccgcucccccgagucucgccagcuccuccccggccccucccuccagcccccuccgggcuggagccuccccuccuccauccccuggcggaggcccgcggggcuggaggcggagcgucucggcagagggcugggagccggguggggaggcgcggggcgagccgggggguuccagacgcgccuccaccgccgggcagugggcagguauggcugagggcgugugagcgccgagcgcuaagggccgccgccaccaugccagggggcgcaggcgccgcccggcucugcuugcuggcguuugcccugcagccccuccggccgcgggcggcgcgggagccuggauggacaaguaaguggccaggcgcggggggauggaggcuggguggcccggagaccugggaguagccuugcggguccggagcgcugggaccgcgaccccugcgccucccgcaacuccgcggggccugcgcccccgccguccccagccugggagcccgggcuuuguucccacguucugcgcccugggagguggcagaggucggggaaacccggcgcagccagaaaacagccgguccgcucacuggcuagccuucccuucucgccuucuccuuccucuguuuuucugcuuuuggcuucucuuuccgccguucucggggcuuauccuccuccguuuucucacggucccucguguccgcuccgccucucucucugucuuucucucuaccgcccgcugcacucgccaacgccgagcaucccgagcgcccugcccguguggccugggagcggcuuccugggaccaggcucggugccugccacacuggugggguaggacauaaaaugcccgcggcagacugugguagccuuggcuaggggauggcucgcuggguaucugcagccacacacuucggauccccgagcuggcaggagcccuacugaaggccaagucaaacgcacccauuucacagauggggaaaccgaggcccacaaaagggaaaggacuugcccaaggccacgccacggguugagguccgcgguggcacuggaaaccagggcucucuuuccacgccaacccgacggccgccuucuuugguccucaguuuccccuucugugaagcgaaggggucugacucgauguuuccagcuaagaugccgggugauguccguguuucucaggacuaguuucccagacaccaauccccuccccggcuccaucccucgggggcuauaagcagauuucgcggaaggcuuggucccggggggcggugcccggguucucucauuaugaccggagaaggcuuagcccuggcuccaccgcugcagacgggcugggcugacuccagacugcugcuugggggaccaacagucagcguuuucaaauagagcgagcaccggcggagcgagggugggcuggcuggacccccgggccgccucaaacccagaggcugagagcucuuccgacaguucggaacuuccaggggccgaggucgggcgguccucccaaagggcucaaaggaaccgcccuuugagcuguuguuccgaaggggaaacugaggcacagaggagguucuaggguagcaccaggccugugucagugcuuagugcaggagaaaagcaugaagaaagacaaggaaagcuaguuacugcuccuagcacaggcgccuucucugaguuuugaguccuuggagaacacuugcuguagaauaucugggaaauaacgaaaaguguaaaagaaaaugaucugcaacccccaaauccacaguugcuguugauauuuuguuuuuuuuccccuccacauucuuuguguguuccuauggauauauauugauaaaauuggaaccauacccauaaguacaguuucgugucuugcguuuuucacuucacaccaugagcguuuuccacaucaucaaauucucuguaaaacaugauuuuaaugacucuauacaaaguuuucaaaaguuaaaaacacgacucauacaaauguggccaagauuuauucaacucauuaaugagguagcaaacaggagaguaaagcugauucagggagcauuagaaaggggugauacaagcauuggagaaagaauguugaaaucauguggcccagggcagaugcagaaaugguggaugccccaugaagcaaaccauaauucuugguuaucuuucuuuuuuaauuuccuuccuucauuccuucuuuucuuucuuuuuuuuuuuuucagagucucuaucuguugcccaggcuggcaugcaguggcacgaucugggcucacugcagucucugcuuccuggguucaagcuauucuccugccucagccuccugaguagcugggcuuauuggcaugugccaccacacccggcuaguuuuuguauuuuuaguagagacgggguuucaccauguuggccaggcuagucucaaauuccugaccucaggugauccgcccgccucggccuccuaaagugcuaggauuacaggcgugagccauugugccuggccagguuaucuuuuuacuaugcugaaaucacuuacaucucugucagacagaauucuauagauauauauagauuauauaacuucacagaguguagcuuuuaaucaaugguaaauaaaaagucaaugguacauuccccuagauaaugcaguaauccaugggugagucuguuaaacaaugcucugauacaacauugagaagacaucuugcuugcucuugccuuauuuccaaguuuuggagaccuuuucuuaacauguacuauguuccucuuuuggugagauuuuagauugcuuucacuauuuuuuuacaaucguagauaucauuuaauuccauuaaaugcuccauuaaauauuauagaauuccuuuuuguuuaaaauaauauagacuuaucagagccaccagggcaagagcgaugcuugucuuuuuuuuauuucugagauggagucuugcucugucacucaggcuggagugcacuggcgcaaucuuggccucccagauucaagggauucucgugccucagccuccugaguagcugggauuacaggcaugcgccaccacacccagcuaauuuucauauuuuuaguagagacaggguuucaccuuguuggccaggcuagucucaaacuccugacuucaggugauccgcccaccucggaccuccaaagugcugagauuacagguugugagccaccguuccuguccugcaguaugcuugucuuguuccuccaugaauauuaagcaccuauucauagcauaguacuuggcacauaguuaaguacucagaaaauauuugauaaauauaugaaugcauuguuucuaauauuugccugucugaugaauugguguugguccaauaagauuauuuuuaaaaucuauguugacugcaagugcauuauaucgguauucugaagagaauguuaauaauuacucauaaucaccacucuaacagaacaacuauggccaucuuuuuaucauucauauucuguaugauugauguaguuaguuuagacagaauagauuuuggaguccucagccccauucccaggaacacuacggagaccagucuguuuaggugucgggaaauuaccauuuuguuaagauagucugccgccaguauuugaguucugcagcgcccugaacaaaucucuccuauaguuuaaauucucuuucuugcaaaacaggacuccucccagucucuaguaaaaauacaaaaaaauuagccgggugugguggcgggugccuguagucccagcuacucgggaggcugaggcaggagaauggcaugaacccggaaggcggagcuugcagugagccgagaucacaccacugcacuccagccugggcgacaaagcgagacuccgucucaaaagaaaaaaaaaacaggacuccuacuuccuacuucccaggguugccuugagcaugaaggagaacugguuugggagagugauuugggaaguagaaaguggaauacaaauguaaacuugccauuaggaagcuccaauuaauguaacuugaugcagugaugcucugcggaguaggaggcaauuucauauugacucuucacaauaaagcugugagaugggcagguagcaucuuugucuucauuuuacaggcaagaaaacuaaagcuccaugggagcaguauucaugggcuugaccuccagaauaugcccagaaucccaccgcuucauuccucuccacugaugucauucuaaucugagccaccaucaucucucaccagggcuccagcauaucucuagccuggccuuccugcuucugcucucacucucgccgcucugccucaccccacccccauucuccaccacgcaggcagagugaucuuuuuuaaacuuaacacagaucauauugcucuguauuuaaaacacccagugccuuccaagucuauuuauaagaaaauccagacacucuccguggucucugcauuaucagacccauggcugucuugcugaccacaucucauaccaacuuccucuuucauuuacuagcuaccccuaccuuaugcuuguuccuucaacaggccaaguucacuucugcucaggcagggccauugcacuugcuguuuccucuaccuggggcacucuucccccacguuuuugcauggcugccuucuggcuccucaggacucaaaugccaucuaugcugaucauccuguuucaaauaggcaccuccugauagaugucucuuuacuccaugaccccaacuuauuuuauucaggguacuuagcaccaugugagaacauuuguucauugucugucucccaccuuuacaaguacagagaccuuauauguccuauuuaccacaauaucaccgacaccuagagugccuaguuccuaggaagugccaagagccugaaauccagcaagucuucuaaugacccagugcaggggcagcucacagaaagugcauguguggcuuagcugggguauagaggucugggauuccaaugguuuugcaucuuguauuggcaggaggaagugaggaaggcagccccaagcugcagcaugaacuuaucauaccucaguggaagacuucagaaagccccgugagagaaaagguaagacucaaaagaccucauuuacacuggcaggaguugacaacugagguuugggcuaccuacucaacuuucuuagaaucccagucaucaccauuaguucuguuucuggcccacucuguccucugggugcccauuuuggagaucacagaugggacuuuccuuccuuguaugacaaacuucuagaacacuucccaaugcuauuaguugaggaaaugaaaauucacauuaaugcugacacaagcuaagugcagauguguuggugucacagaaaucacuuagucuugauuggaauucauuaaauauugucauuguuauuuuugcucugcauaauacauacuucauuuucuugaaggaauaauguacuuggagagaaaaaagauaauaauauaaacuauaaacuauuuuaauaagacgcagcguagagaccuaguacuggggaauguaucuuaaaauccaguaggcuccccuggccagaacaccaggaaaacacauaggcuuuaucaaagagauugggaagaaaacaaaaaacacuguccuguucuugcagagaggaccugagcauuuaggauauucuuugugguucugguuuuuguuuuuuguuuuuuuguuuuuguuuuuuuguuuguuuguuuguuuugacagagucucacucugucgcacaggcuggagugcagugacaugaucucggcucacugugagcuccgccuggcagguucaagcgauucucaugccuuagcuuccggaguagcugagauuacaugugugugcugcgaagccaggcuaauuuuuguauuuuuaguagagauggguuuucaccauguuguccaggguggucucgaacuccugaccucaagugauccgcccacguaguccucucaaaguguugggauuacaggcgucagccacuguggcccacugugguuuugguuuuuccagcaagugagacgugaaagagcaagaaaggaagaugcgguuguugugugccaguaaccagcuaugugaccugccacuugcgaagugguagauuuucuucauuuauaaaauagugcuuagagagaauaaggagaaaagaaagcuggggagagggguuuuuucuaagaucucuuuggguuaaaaugauuugugauuuauugggcaacauauaggagcaagauuauagcaggaaagagaugugucaggaaagacuucagacauuguggcuguugaaucuggaaagauaaauggaaaggagcaauguccaggauccuugaaacucuggccaggauaauacagacauguccaaaaaggcuccaacuuggauuuaccaagggaaccuaacaguguaaauuuuaggacagaccaagugcgauggcucaagccuguaaucccagcacuuugggaggcugaggcaggaggaucauuugaggccaggaauuuaagaccagccuggggcaccauacugagauccuaucucuacaaaaaaaaaaaaaaaaaaaaaagaaaauuagcuagaccuaggggugugugucuguagucccagcuacucugaaggcugaggugggacgaucgccugagcccaggaguuugagguuauaguaagauauagucgcaucagcaucacuguccuccagucugagugacaaugcaagaccuugucucaaaaaaaaaaaaaaaaaaaaaaucaggacaaauaaaagcaaguaacauuuuguccuaaaggcaguaaacgcauggaauucauuucaucaaaaaguaggagaggcugaaaauagcuucaggaaaagucucgacaaauuaauggauggucauccuagagcagauuacuuuuaacaauuaagaucuuggguauugcaaccuauucauacccccugaggaauggaccugcuacuuuuuauagaggcuucuuuguucucuccagauguggaugccgggcauccucaggaagggccugagaacaaagcagaggaccagauccugucuuuguucccaaccauugucugcccagcauaugggucauuguauucuguaggaauagucagcauagugccuggcaccguaacuauuuguucaaugaacaaaugaaugaauguugaagagagagagacuagaggcuggauuucacuugggccucucauucucauuuauauaauuaauucacucauuaaacauuuuuuucuucucuuuuucucaucacugacuuaaagcucacauucauuaaacauuaacugaauacuuauacuguauacuaaauauuauacuagaucuuagggggaaugcaaauauaggacagauuuccaauacccuauggagcuaaagaucuauuuaaucuagacugaaggggaaagaauuuuuaacccaucccuaggagagguauaaauagugggucagcuuacuguacuucauaggagaggagagcugauggugccucuucuuaauacagaguggaguuucaucagaaaagcucaucaguagagccggacagaaaagcuucauagauccuuaaaaugcaguuucauuguuuugcuugaaaugccccauagaaaaagggaacauccuuuuuuaaauaucagugccugagcaccuuccagaauagagagaauuauuuuuggaucacccacauaaaaauaaagauuacuacuccuggcggggcaugguggcucacgcccuguaaucccagcaccuugagaggccgagauggguggaucaccugaggucaggaguucaagaccagccuggccaacauggagaaacccugucuacuaaaauuacaaagauuagccaggcgcaguggugcacaccuguaaucccagcuacuugggaggcugagcaugagaauggcuugaacccuggagauggaguuugcagugagccaagauugggucacugcacugcagccugggugacagagcgagacucuguuuaaaaaaaaaaaaaagauuacuauuccugcugcagcuugugucucuuugggggaggggaagauagugcuuugauuuggggcaguauucauuuucugugggggcagucacaugguuaccuaccucuuggaugagggaauugcuguagcucuguugcugugucgucuuucuuucuuucuuuuuuauuuuuuuuuuuuguuuagacggaguuucgcucuuguugccuaggcuggagugcaauggcgugaucucagcuuaccgcaaccucugccuccuggguucaagcgauucuucugccucagccucccaaguagcugggauuacaggcaugcgccaccaugccuggcuaauuuuguauuuuuaguagagaugggguuucuccauguuggucaggcuggucuggaacuccugaucuccagggauccgcccaccuuggccucccaaaguguugggauuacaggcgugagccaccgugcccggucuguguggucuuucuuaaaugcccacuuggagcuggggucccugaugcucagugugauugggcagggcacugccucaaaaacuccauaaaguggcaaaggaucugcaaccagaauagguguuggcagagcugaaucagggcaugacaaacagagaagugaaucucuuagugaaaguuauuggucaaacaucuccccagcuuccuacuucgguggguuugaaauguuccuucuugagaugaaguaauacgauuaauuaggcaauggccagcguugcccaagagccuuugaucggaauguugagaucucaucagagcccuuggugaccucaaagucucagaaaugcccaaauccuaaugcagagugggguuugcagcgaggaaggggaaugugcuuagacgagguaggcuucuaaccagagguggcagaacaggugaccuacuuucucagacaugcaagaaguaagcuuugaggucaaccuuagaagggcuagaagcucuacucuagcaaugauuuuguggauugaaagggacuucaagaauuuaucugcuggaugagguggcucacauuuguaauaccaacacuuugggaggcugaguugggaggaucacaugagcccaggaguucaagaucagcuuuggaaacaugguaauaccccaguaucuacaaaaaauuuaaaaauacuagcccagugugguggcaugcaccuguggucccagcuacucaguaugcuugagccugggagguugaggcugcagugagccgugauugugccacugcacuccagccugcacaacaaagcaagaccccgucucaaaaaaaguugucaguuccuuagucccaaaauagagagcuuauguuuaaaacacuccaaagaaucuguucuguuuuaaauauguaaauauccuuuuuuaaaaaaauaauuuauuucuucgaaaaaaguucaguagccuuaaguugaauuguugaagcguggagauuuauuaugacuugguuuuuaaauuucuuugaaauucuccacaauaauaaaguaaaaagagauuaauaaaaaguucuuuucuuaaacugugaaagcaauuguaaacauguggaaagaugugcaaaagaaaacaaaauuaacucaugaucccauuaacuaugguaaugguuaggcuuauuucucucuacauuuuucccuuugcgaaguguauuuaaauaaaauauucaguauuguauuuugagcuuuaugacuaaugauuauuguguacauuuugucaguaauuuaacaacuacuuaaaguugcugcuuuuaaugaucauucaguguucugucauaugaauggaucaucauuuauuuaaccauucucuaacagguuauauuuaggacaguuagguuacauuucauuauucauuacuuuuuuuuuuuuuuuuugagacagagucucgcucugucgcucaggcuggagugcaguggcaugcucucggcucacugcaaccuccgccucccagguucaagcgauucuccugccucagccuccugaauagcuagaacuauaggugugcaccaccacgcccagcuaauuuuuauauuuuuaguagagacgggguuucaccauguuggucaggcugguuuugaacuccugaccucaagugguccacccgucucggccucccaaagugcugggauuacaggcaugagccacugcgccuggcccauuauucauuauuauaaguaauaaauguccuuaugugcaaaccuuugccugugccuccauuuauuccuuucaaacagccucacauuccugagucuaaacauuuuuuuuuuuuuuugagagagagugucucgcucugucacccaggcuggagugcaguggcgcaaucucagcucacugcaaccuucgccucccagguucaagcaauucuccugccucagccucccgaguagcuaggaucacaggugcccaccaccaugccuggcuaauuuuuguauuuuugguagagacgggguuucaccguguuggccaggcuggucucaaacuccugaucugccugccucggccucccaaagugcugggauuacaggcgugagccacugugcccggccgagucuaaacauuuuuaaacucucagugcauacugucauguuaucuuucagagaguugccgucaguuuaaauucucagugguagggauugcgagugcccaguuuacagugggcauugugcauugugauuuagaguuuuagauaaccucuggcacuuugauuuuuuucaagguaucuuauuauuuuuaauuuguuuuucuggacguggggaggugguuuauuagcgaugucgaacauaguuuuugugcuuaucaaccacugguauauguuaagugauccguucuggauauguagcaccuguggccacuaccaaacugcuuauguguaaaauguaucuacuuuuuggccuauaaaaccuuaauuugaggaucucuuaguugcuuccucugagaugauugggguuuuccaaacggagagccaaaaugaaauaagaacccacuacgaagaggauccccuaguauuuuacaagauaauaggcaauauguaucauggcuugccgugugccaggcacugugauacauuauuuaugcucauuaucucacucaauccuuacaagauccccaucaaauugacuauuacuaucucuguaucauacaugaagaaacugagauguggggaggcucagcaacauguccgacuucacacagcugcaggugucagagccggugcuugaauccagaucugacucugcaggacauuuacugcuggagauuguguuuuccaguguuucccuucaccgcaccacauacauacacuuacaccacauugcagccuggaguuucuucucuaugccuuucaggagaaagcagaugggggaaggauuugggucauucugggauugaggucauuuuacaugugggcuggaaaugcaauugaccuuugcucauucacuuccuguggaucaauguuggagcgcugugcuagauccugugcccgacccagggagccuggugccggcuuuuaggaacugacauuguuuuguuguugcuuuuagcauccacucaaagcugagcucaggguaauggcugaggggcgagaacugauccuggaccuggagaagaaugaguaaguggacuccuccuuugucuaaaaugaaacaaauaacuucugugucaacgccggacgcaggugucgcuguucuggaaggaagcagucaauggagugaccccaagcucucaguccuugguuucuuucaggcagcaucuugcaaagccagagccuuuccacagccucuugacucgaugugagauugcuggacugcuaaauguguugcuaaaauuuccuuaggcaguauuucaggggccccuggaguucacugcgggcacacagaggucuguguaugugugagauuaagggaguggauggaccagaggucuuuggcagcugccuuacuagcgccagccuaguguguggcaggaaaugaaggagauuagaggaaaacagcagagaggagcgagcaaagcagggugugcuggggcuuggagccucagacucagauuguuccauguguucugguucagccgcaucugagauuuugucaacagggcaucgucaacagucuccuggcuacaucgggcccggcucuuccaucuucuuaaccucauucaucuugggugguagccuggcucagaggcacuugcacauugauuugccaucagaugcagucauaucuggauucauguaauggaggaggugaaugggcacgaugcauggcuaugucuguggcucauucuuuggccauuccccaucuacuuagccaugaagagcucuccuuacuuggccgggggacucugaaaacauuugguguuuccccacugaccgucccacuuuucguucugccacacagacgucgcagauaaggcugcguggcuuggagagcugccugucuccucuuggcagccuccagaacccccuggaagccaaugaguaaucaaaugcaucacugccaagaaaaggaugaagaaggaccuuccuguauacaaaaggaugggaauagcuuuuaggcuuggguggaaagggagaauauaauuuauuccaaauuugggcuuuuugggcacuugcaaaggaggaugagugcugucccgagugugguuaaaauacaacucacagcuugugcagugguggggcuucauccacauccuuccucugccuccaggacaugguggccucgggaagccagaaagauggggaucacagucauuuuuguuccucuccucuugagaguaaagccaguuuaggcuguguuucuucucuccugugucccuggaauagaccuggccagcugcgucccuagacagugcagcgucuauuggcccuggauuuuuccuugcauugucuuccuuugguccuacaagaaaaggcccuuagaggguuuguucuugaccgugucucucgggggccugccuuuguugcucacggcagcuuuguucccauuaacucuagucuaaguguucccuguuguugccugugucuaaucucuccuguucugcccccaguagagccuguggcccuucagcucccucuggucagcccaagugauaguguugguguugugggaaaaugcuuaggaguuggacuggccaagcaggagucccaggacucaagucucuauccuucccuccuauuuugaaacauuugcuacagaccauaggaagcuaaagcaggaagaugccuuagaaaacacugaauggaaugaucuuagaaaacucugaaauuauggaugcagaaguuuugauucagagagggauaggcauuugucugaggccacccagcaaguaaaugaaagagcugaaacuaggaucauguguauucuuggugugagucuggaguuacagaaugugacccagggcaaauggcugaaucuuuuggaacuucgguguccuuguuuauaaaaugaggguaauaaggccagccucgugggaugguugugaggauaaaugaggugaagugcaggaagugcuugcacagcgcauggugaguggccagccacuguugggauuuuuauugucccacacugaggcuccagaggagagcccggggcugugguucuagcaucugcuuuuccgagagcagcucucguuucccauugagccgcauggggcuggaugugguuccuggccuccuugaauuggcagaaggcagcagaguugguaaaaauggaagcagcagagccaagcaauaugaccucaccaggugucccugggggacggcuuccugcuauuuucauccaaauugggcuuuuuguuuugaacauguguuagugagcggaacuccaacugcacacgacuuccuaguguguuuauuucccaaagccuucucauucauggugcgugcgaguccggauucaaaacagcuuuggagcgggggagaugauuuucuaauuuuucaaaucacuguguugaaguuucuauaaucucaugacauuugggggaaacuaggcccugggccaagccauuucucagccucugguucuuaaccuccucgaucaacguauucauuuuuuuuuuuuuuuaaucuacgugccucugugacauuucaggcaccagugcagguacuggggauaaagcugugaauaaaacaguacagccuuuauggagcuucuauucuagugggaaacaguaagcagacaagugagugcaccguccgucaggugaugggugcugugcaggagacagaggagcauagggaguggggccaggggaguguggagguagaaugggagcugcuguuucugaauggcagucagggaaggccuuucaggugaacugauacuugagucaagaccugaaggaggugauggagugagccauauggguagcugagagaugacaauuccaaggagagggaacagccacguuccaaggcccuaauagaugaugaagguuuccacucucccucuguacauuuccccauacacuggauucucaggucucccaggagcggugagcaagggcuucugggacucuggggggagggagaggacauuuuaaauuucuuuuucaucauccugccgugucuggccuucucccaucaaaucaaagcccacguauuaaugcauggcccaaaauagcagugagcaagccuuuaauggaauucacacauggagagaucgccaagaauggugaggauggaaaggcauggggcaugggccaggagaggagggggaacacagcaaagugagcuucagcucaggcagcagacacacugagguguccuacaauagcgcggcagccggcagccugucucugcuuugaagcaacucagcaacucacggaugacauccgugagaagcacacauucuuuucucuauugagugcaggugaaaaacagugacccuuuagggauaaucugagcauugcuuuugugucgguuauuccuguguucagauccuggcucugccacuuacuaccuuguagccucuuuaagccucaguuugugcaucugggguguaauuauagucccaugucauagagccagagccacagggaggaugaaaugagaugguacaggugaaggacuuagcagagugccuuguuuguauuccaagcucaagguagcuaugauuauuucuugcucauuguuuuuaaauugcaaaagcaaagcaugcucauuguaaaacauguagcaauuccaaauaaacaaaagaaugaaaguuucccucccacgaggaaaauccacugcuguuuggugagcaaacccuggaccuuuucuaugcauacaagaacaugcacaugaauccucacagacacaaucacauacagacacagucacacagaagcugcuauuuuuguuggggagggaggagcagaaaugagauuaugucagacauauugcuccagcauuuccuuuuuugaacucaacuggaugucaugaagacagucuucugcucuaauaaaguauauauuacauuguuuaauauuuauacacacauguaaucacauaauuugcaaagauuggugcauagcugcuguuggagaaacuugugauugaggcagugugguacaguggacauagcauugaccucagagacagaugauaugaaauuggucaaaaagccagccagcuccccugagccucugcuuucucaucuguaaaaugcagauuuuggccccggauaggcucugaaggcucuuucugcacuaccucuuuuuuuuuuuuuuuuuuuuuuuuuuuugagacggagucucgcucugucgcccaggcuggagugcaguggcgggaucucggcucacugcaagcuccgccuuccggguucacgccauucuccugccucagccucccaaguagcugggacuacaggcgcccgccacuacgcccggcuaauuuuuuguauuuuuaguagagacgggguuucaccguuuuagccgggauggucucgaucuccugaccucgugauccgcccgccucggccucccaaagugcugggauuacaggcgugagccaccgcgcccggccugcacuaccucuuuaaaggaugcucugugaguagaaaaaugcaaaagaagucucugccucaggaaauuugcucuaccuguggagacauccugggaaauagugggcagugggauaaaggaaaaaggugccccaaaucacgggaccuugaaguuggggacgaacuucuaggucagaacccgcagguucaggcaacagaaaauacaagaagggaaacuacagagcagaaauuauagacugcuguuugcacaacccacagauuugagcauuaauccauauuuuuucucuauguucuuuuccccauguccugagacuaccucaccaacccaggaacccauauuugacaaaaacuuguuugcugaaaucaaauggaauccuccuuaguuagcugcaggcauccagggagaugaacaggguuaugugagccccagcgccauauccuguccuuucuuggcuuuuucccaaaaggagggcacacugaauugcucaaccagauuccuggaugcucacugggccgcauuacuagugagcaggaucacucuauuacaagaucaccuucaaaagcaaaugaauggcucaacuaguaggcacuuugcccagaggcucuuuggccauaugcuucugucuucuaguaucuuaaacacauucuaggacucucauuucuucaauacacuguccuuccucaaguccaaaugaugauggcuugagaaagggagagacguccuuuggucuaaccccauccauuugugcuccagcccaguuagcuaaagagagaucuuauuugcucaaguuuaguuaauaagaacgggcguuuguuuucuuuugugaguaugucuaccuccaaaccaccuggggaacagcaauugucaaggcagaauuugggcauuuagagguuuacugauuuuaauaccuaucauuacuuccaacuuuaaucuuucuuccuaucccuaacuucuuaucaguccuucagugauaucauagggaaggagaaggcuuucauuguccuggaaaucaagcuacaaucuggaaaauuaacauucagugcuaauggaguaaucuagcucccuaacauucucguuuuuccucaaguccauuauacaauuuggauugcauaauacugguggaauugaggaagggcagaauuagcaggcaggaaaggaauuuuucagcaacacacggggcagauuaguugccaucucuuauuccugcacuucuuuuucaaggauaccugguagaaauaguagcagacccaaagcaaaacuaugaauaccacuuaggcaguggagcucuccccaccuccacccucccagcuuccucccaggucaagaguagacuuuaacaucuuaccuaggauaaaggacagcucucuuugacccucucuugucaggagcuucauuuguuguuggcaaaauucaauuuccuggaucaaagagcagcuuagaaaggcuuagaugguaucccaaugcucuuaguaaaccaugcuucacugaguugcauuuaaaugagucauagacauauggauuacauugcacuuaaaauacacauggcucaagaaauuaaaggauaucauucuuuaaccaaguauuuggcagaucuaaaguauucaaaauguuuuuccaaacucuacucgcagcugggcuccccauuccccauggcuaagguuguauaacccggggagacaggugcugaggaaacaguuggaugaauggguggggacaccagaauuugaugagagcugccuguggugucugaaauuuucuucacauguucuuuggaaguaugaagaacugguuuaacccugcuguguugacgcugaaggcagugaaugcaugaguggauuuaaauuccaagugcuuugcuaggcacgucauuccagagagaccugguaguccuguuugagauguaguuucuaauuguagcuuuguagacugagaaugauuucauuugcauuucccauguugucccaaaugccuggaguugcagaacaaauggauugccagccagucugaugugauuuuuuauaagccaaacucucaaccccaccccagcauaagcagggucuccauuugcaauguacugaauguuuaugucucccuucaaauucuuauguugaaguccuaguccccaaggugaugguauuaggagguggggccuuuuggauaugauucguuuaugagggcucugcucucaugaauaggauuagugcccugauagaagagacccgagagaauuagcucaccuuuuccaccaggugaagacacagcuagcagcuaccaucuaugaaccggagagagggcccucacuagacacgaaaucugcugaucccuugaucuuggacuucucagacucuagaaccgugagaaguaaauuuguugcuuauuugcuacccagguuaugcuguuuuguuauagcagccagaauggacuaagaugccauuauuucuaaaauauuggacacaugauaucacuuucuuaggguccauugcuuaagcucagacucaguaauaagccuggugaucugaagggaugcagcuucaugauacgcuugucuaagguaucagagagcauccaaaauugaaauagccuagauguguugauucugaaagccuugugcacacaagccuuaaacauccuaauccauagaguagaacagauuuggacuuuggucccagagacccugauucaauuccagauacugacacuuccgguuggguggucuuugguaagucacuugccuucuaaguuuuacuucuucaucuguauucauaguaauacuacuuggccaggugcaguggcgcaugccuguaauccuagcacuuugggaggcugagccggguggaucacgcgagcccaggaguucgagaccagccugggcaauguggcaaaacccugucucuaccaaaaccaaccaaccaaacaaacaaaaaacccccacaaaaauuagccaggcaugguggcacaugccuguagucccagcuacucaggaagcuuuagugggaggaucuuuugagcccaggaggugaagguugcaaugagcugagaucauaccaccgcacucuagccugguugacagagccagaugcugucucaaauaauaguaauaauacucacugcuuugugagcauuugcugagaauggauacuucggaaaaggcacuucacacaaugucuuauugaauccucauggcaacccuuugaaugagauauuguugucugcauuuuauaaugaaacucaagcaugaggaguuuaaauaauuuacccaguauugggcauagccaggagucaaacucuggccugccugccucuuacuacauuauagcacuugcauagaaaauagagacauugauaccuucauugcaggguguggaaggcugaaaaaugcacccucuccccuccaaugauaaccacauucgaaucccuggaacauguggcagaaucuuugcagaugugauuaaguuaaagaucuugaggccgggcaugguggcucacgccuguaaucccagcacuuugggaggccaaggcaggugaaucaccugaggucaggaguucgagaccagccugacuaacauggugaaaccuggucucuacuaaaaauacaaaaauuagcugggcaugguggugcgccccuguagucccagcuacucgggagguugaggcagaagaauugcuugaacccgggaggcagagguugcagugagccgagauugugccacugcacuccagccugggcaauagagugagaccccaucucaaaaaaaaaaaaaaaaaaaaaaaaaaagaaaaagaaaaaaaaacagguuauaaaaaccuugcugauaaaacagguugcaguaaagaagagucacuugagccugggaggcagagguugcagugagcugaggucacaccacugcacuccagccucagcgacagagcgagacuccgucucaaacaacagcaacaacaacaacaacaaaaucaaagaucuugagaugagaagauuaucuuggauuaccuggaugggcccuaaauacaauggcaaauauauuuauaagagggaggcagaaggagauuugacuauagacagaacaggagacagugaugugaucacagaggcagagauuagaguggugcagccaugagccaaggagaagcuggaagaggcaaggaacagauucucccagagggcacgcagcccugcugaccccuugauuuuggcccaauaauaccgauuucauucuucugaccucucaagcugugugaaaacaacuuucuguuguuugaagccaccaauuuugugacaauuuauuacacacuagccccaggaaacacacacacaggguuugugagguuaggagauaauguaugacaaugcacuuaguacaacgucuggcacauagcaagcagguuuucaauacaugcuaauuuguacuaaugcaacguccagaacaaauguuuucagguguuuuggggaugcaagcugugacauguggcccuugcagcuuucuucaagcaugaaaaugacaagagaaaaaaacauauugagcaauaaucugugugguuauugcuuaucuacauuacccaaguuccgggucauguucucugaugcucugucugcccuuagggaacuucuggcugaggauaacuaggaaugauugucacauauuaacaaauggugauagcuaaaaaguaggagaugccuguauaacaggcaucguacugugguauuuauaugggucaucuacuucacuugucacaaccaaccaaugaagaguagauuccuauauuagcccuauuuggcagauggggacccugagguguggagcagugugacuugcuaaaagucaugugggugggaagagcagggccaggaugugaaacuagaucuguuugacucccaaguccaggcuuuuaacuggggcaguauauugccucucagaugcauaguccuggcucauuaugcuuugggcucuuuuuugguuagcacuggcauuucuucuucauuguucuacucucccccuucccuuuccuccuaccuuucccaggcccugguuagaauuugcaugucaguguaaugugauaguguaauccaggcaggugugcaucccaagcuuggcuccuugcacuaccuggagguguaagcuuuggcaagucgcucaaccuuugagagucucaguuuucucaucuacgugauggggauaauaaccucauaggauguguguggaauucaauaacguaaugcucuuaaaggauuuacagggugccuggugcacuaugagagcacaauaaauagacacuguuauuuguguuuugcagggucagaaaagcauuuaagaaugaagucagagggaauuccccugaguugguuuccaaauguaauuaagaagaguugaccuuaaaacccauugccccugggaggaaauuacuucugcucuccagcgaugcccaguuugaccuaauuguaucucgaaaacacugcuuugcaguguucuccagugggccaaacuguaccucuuuucugugccugcagaaucagaugaggcccugaacuguccaauaugagguugggauuuguucacugguuccggcucuccuuccagggauccgcagccagggcugccugugcagccaggaaggauguccacgguuuucuuuugucucaagcuuauuucuccuggcugcucuucagcaggagcacgggguaaaaugaaugggaggaagcugucaacugcccuguuggccuuagauggacccuuauccgaacuaagggaagcuguggacuuggaagaagucaggaugcuuggguuuggggaccccuuuaucaucaggcugcuuaccuucagauaacaacaauagcuggcauugagggagugagcauuuaccaugaacuuaauauuuuauguagauuuuaaaaaucccuauguauauuuauauacaaaugaggucauaguguauucuugguuuuguaaccuauuuuuuuucacuuggaaauauagcaugggcauuuaaaaacauuuaaaagauuuuacauggaacuuuuuggaauguuugacauuuuucauaauaaaacuucagagaaaaauuaaacaaguuauagaguuuuuaaaugcaugguaucguacuuuauauacuauuuuauaauuggcuuuuuuauuuuuugucuucagugucuuuccacaugagcacauuuauagaccuguuucauucuuuuuaauggugacauaggauuccacugaauggaugaaucaaaauuuauuaauuuccuuauuaacugacaguuagguuucugauuucuuguuauuacaaauaauccuagcaauaggauuguacauaaucuuuaagcacauuugcaaguauuucuguagcacugauaccuagauguagaguuacaggauccuauggaguacacaauuaaaacgcuuuuaaauuuugacaaguuguaccucucacuccacaaauaccuccccaaaggcugaauguaccauuuugcauuuauacaacaacagauaccuccccaaagguugaauguaccauuucacauuaugagcauauuauaaauaugucuccauguaccuuuaucauauuuaaaaaaauuaauuagaaguucuauuuuuacuuacuuuuuagcccaugaaacaaaucucaguaauuuuaucuuuuccuuuuuuaauuuuuaauuuuugugaguacauacauaguaaguguauauauuuacgggguacaagagauauuuugauacaaacaugcaaugugaaauaagcacaucaugaagaaaaggguauccauuccaucaggcauuuauccguugcauugcaaacaguccaauuauacucuuuauuuuaaaauguauaguuaaauuauuauagacuguagucaccuuguugugcuaucaaauaauaggucuuauucauuuuuucuauucuuuuuuguacccauuaacuaucugcaucuccccacuacacccuucccagccucugguaaccauccuucuacucuuucugcccaggaguucaauuauuuugauuuuuagauccuacaaauaagugagaacaugggauguugaucuuucugucuguaccugguuuauuucacuuaacauaaugaucuccaguuccauccauguuguugcaaaugacuggagcucauucuuuuuuauggcagaauaguacuccauuguguauauguaccacauuuucuuuauccauucaucccagauagagacuuagguugcuuccaaaucuuggcuauuguaaacucugcugcaacaaacacaggagcacagguaugucuucaguauacugauuuccuuuuuuuuuuuuuuuuuuuuuuuugaguagagucccgcucugucacccaggcuggaaugcaauggcacaaucucggcucacugcaaccuccaccucccagguucaagcaauucuccugucucagccucccgaguagcugggacuacaggcacacaccaccaugcccggcuaacuuuuuguauuuuuaguagagacgggguuucaccuuguugcccuggcuggucucaaacuccuguugcccaggcugggcuugaacuccuaagcucaggcaauccacccaccucagccucccaaagugcuaggauuacaggcaugagccaccgugccuggcccacugauuuccuuucuuuugggucuauacucagcagugggauugcuggaucauaugguagcaugacauagugguuguacuaauuuauguucccaccagcaacguacacaaggguucccuuuuccccacauccucaccagcauuuauuauugccuaucuuucaacugggugagaugauaucucauugcgguuuuuuuuguuuugcuuuguuuuguuuuuugagacagagucuugaucugucccccaggcuggagugcaguggugcgaucuuggcucacugcaaccuccgccuucuggguucaagcgauucuugagccucagucucuugaguaucugggacuacaggugcacgccaccacaccugguuaauuuuuuugcauuuuguauuuuuaguagagaugaaguuuugccauguugaccaggcuagucucaaacuccuggucucaagugauccaucccaaagugcugggauuacaggcaugagucaaggcacccagcuuguugugguauugauuugcauuucucugaagaucagugauguugagcaccuuuucauaugcuuguuugccauuuuuaugccuucuuuugagaaaugucuauucaaagcuuuugcccaacuuuugauuggauuauuaguuuuuuuuuuucuuauagaguuguuugagcuccuuauauagucuuguuauuaagcccuugucagauggguaguuuacaaauauuuucucccauuguuuggguugucucuucacuuuguugauuguauccuuugcuguucagaagcuuuuuaacuuguugugaucccauuuguccauuuuuucuuugguugccugugcuugugggguauugcucaagaaauuuugcccagaccaauguccuggagauuuuccccaauguuuucuuguugcaguuaaaugguuugaggucuuaguuuuuuuggucuuuuuuuuuuuuuuuuuuugggguuggggggacagaaucaugcucuguugcuuaggcuggagugcaauggcgcaaucucagcucauugcagccacugccuucuugguucaauugauucuccuguuucagccucccgaguagcugagauuacaggcgugcaccaccacgccagcuaauuauuuucuuuuuaguagagacaggauuucaccauguuggccaggcuggucugcaacuccugaccucaggugauucgccugccucggcuucccaaagugcugggauuacaggcaugaaccacugugccuggccugaggucuuagauuuaagucuuuaauccguuuugauuugauuuuuguauacaaugagagauaggggccuaguuuuauucuucugcauaugguuuucccaccauuuauugaagagacuaucauaucauuuucguggcugugugauauuauagucuauguguaugcaugauuaacucuuacagcuucuuauagugaaaaauuaucaaacgugcagaguagagagaaugaugguaugaaucacuguauacccaacugagucaaagcgaauuuacauguaacguggauauauaaaggcaaguugcccuuggcuccucugcaaguuuauaucucacugcccuuguugagagauccuguuuucccaaacacaccauugaguugauuauugagcuugggcagacucuuuaaacccaagcucucuugucuuuuuuuuuuuuuuuccaaacagcuuuacugagauacaacucacauaccauauaguucacucauuuaaaguauacaauuucaucuguuuuaguauauuuacaaagucaugcagccaucgccauaaucugauuuuagaacauuuucaccacuccaaaaggaaaaaacaucagcaguguuaugaguugaaugguguccccccaaacucauauguugaaguccuuauccccaguaccucaaagugaccuuauuuggaaauugaguuguggauguauuuaguuaagaugagaucauacuggaguauggcaggucucuaauccagcaugagugguguccuuuuagaagggggagguuuggaaacagacacacacucugggagaaugccaugugaagauuagaguuaugccaccacaggcgaaggaacucagaagccaggagagagccugggauaagcccuuuccuugcaccugcagagagaggaugauagcuugaucuuggacuuuuagccucaagaacugugugacauaaacuuccgauuuuuaagccacuugguuugugauacuuuguuacgguaguccuagaaaaggagcacagucauucuucauucucccccaccccacgucaguccuaugaagcuggcaaucugaugucuccagauuuacuuauucuggauguuucauguaaaugggauuauacaauauguggucuuuuugacuggcuacuuucacuucggguaaaguuuuugagguuuauucguguuguaguauguaucaguauucuuauugcuauaugguauuacauuauauagauauaccacauuuuguuaacccauucauuaguugauagaucugccuuuuaagcucgagcuaauuuuucuccauucuacaaguuugauuucaggggauacugauugagcaccucuauguagaauccugugcuaggugcuguagagacuaggcaugaaaacaggauauucuuaccuucuggcaguuuagacucugugggagagaaaacagcaugcaaacagcauaauccaaaacagauuacaaauuuacaugguagaauugaaaguaaagaacugcgaaggcaagaggaacgggaauuugugacuggggaagaggggagccuucccuaaugaggguuacuugaaauauugucuugcagaaugaugggaggcuuuugaugagggagggagaugagaugaauggagaaugagaaaggaauucagacugagaaaacaauguguaaauguuuggucuggaucaaagggaaccuaaaacuguagugcuacuaaucuuuuaggaauuuaguaucccuaacuagccaaauauuugaauucagaagagugauauguugagguuggggaacggguugcuuuuucuuccacuggugggcuaccagaggauuugaguggcauagagcucaauauuuuaauucucccauuuuugacuuugaguugcauucucuugccucaggcagacccauguggucagggaaguaggugagcuacuucuaggaaacauacuugaagugcacuuaaaagcuaggcuguauuucuacaccuuggaagagaaguagcuuuccucccaccccuccccacugaagaacaauuugggcugagccaagaggauggagguguacuugguggauggagcccauggauuggaaggggcugagcacaaggcauugauggcuucuucacaacuucuguagauggggaagccuccugagaugcaaggcuggugggcgggaugcagacggauuuauggauauacauuuggauuugggagaggcucuuucggccuucucuuuucucccagcuccgaggaugugauuaaacucuucaucuaggcucucuggaaauuggaggguguuuccuacucuuuacccuuugugguugggcaauggagcaugacuauccuggagaaaaaugagaggaggcugacaauguggccccuggacagauucuguccugaaaaugaaacuacauuuacauuucacccaggagauguuuuugauuuugagcaauuaagauuugcuuuuucuuuauuuagaacucagugacauacacagaccuuuggcugaccccuugaauaaacuaagugaauagucuucuggguacuauggggcaaguugcuaggucuugcacaaacucaacuggggcagguauugagucagagaaucccuggcuuuucuggcaagucucuucccaguguacugggcuugaguucuggacuacucauugagaauuccuaauuuauguuauuccuuucuucucuuccuucauuaaacaaauauugugagugccaacuauguggcaggcacugggauagguccugguuauucccgggagaaucaauggugaucagaauagucucugccaucauggggcuuagaacguaguagaggggacagauaauuaaacaguuacagaacaaugugggaccugcuaggagggaggaaguagaggguacuguaggaacauggggaaggggaacuuccucuggauugggggcacgggaagucugauaggaggaaguaaagaaaagggggagugugauggugguggagaguguggcagaguuggcucauacaauagggaguaugugccaggcagcacagaucacaggaucaaaggcccaaaggcaagaaugacauugaaaaugaaaaguucucuauaguuagaacagagagcaggaggaaggaaaugaugagagaagaaauuggugaggcaggcagaggugaguccuuaaagggccuuguaggcaccuuaaagaguuugggcuuuuaucucuagggcaaugggaagcggaugaagaauauuuuaaaagucacauagugacagcauccaaaacgcauuugagaaggacuaauuuagggaagagguagcugauauaaagagaagaggauagauuccagagauauuuauaggguggaaucauggaaacugggaaauggguugcaugugggcugagggagagggugguuucaagggacaguccaaaguuucuagcuugaauaaguagcaggauaguugucuuaauucauuuugcauuggcaaaacagaauccuagagacugggucacuuauaaagaaaagaaaucuguuucucacaguucugcuggcuggcaaguccaacaucaagguaucagcgucucaugagggccuucuugcuaugcuaccccauggugaaagggagaagggcaagauagcacaugaaaaaaagagcaagagagcaaacuugcagccucaagcccuuuuauaacagcauuaauccacucauuaugguggagcccucauggccuaaucacuccucaugaggccuaccuuccaacacuguugcauuggggauuaaguuuccaacacaggcuuuugcggggauacauucaaaccacagcaaugguggugucugucccuggaguuuuccuuagcuuguggugggaccuuggacaagccaccucuuuccuuggaucuuuagguuucucauuagauagguaauuagacucaauggacuaauuagacuagguaauaauuccuagucaccaccuuggcaggaucaucauggggaugcaauaauaaaaccugugugaaaagcaguguccuguacucuuuccauaacgcugacaggcccagcagaagcaaaaucugugccuccccugguuuucucuguuuucuccuccuuaucuaaaauucuaagcacuuggucucuuaggaacuggugagaccucugcccauuccagcagcugaggcuucauuggggaccucucuagggauucugaaaccggcuuuuguugaaaacaaugauaucauugaguagguggagcugggccggacuuuccucagccgguugaaggagaaauggggucuuuaugacuucuguacuuguggcucuuuuccagccucuuccauggcucccaugugucucacuuccccccuuuccuccuugcagaaaacuggcagucuccacguuuucuccucuugcaucagucuccccggggagagggccagaagggccaaggagcuauaauggcugcauuauaucaagcaugguuucuuuuuccaaggccccccuucuggagaagggaagggcaagucauggaaagggacuccuuuggagggagacuggagugcuggggaaaagagugaucuaaguguuggaaggaaugucaggcucuuuguauucuagaagcucuuuaucucuugacucacugaugcuagauuuggggcuuggguaagaaugcaaaggucaaacuggccucucagggauauggugauaggaauauggguuuggagaaggagggcagccauguugagugaguauccuuaauuccugaucccuagacuggccuugcucucugcucucaacacgcacacaugcaugcacacacgugugcgugcacauauacaucccuucuccauaacuguguagacagcuuuuuaggagaaacuagaaauugguuaccacacugguuugcagcuguuccaggaaggaagaugagcugugaaacagugccuucuggggaccagacagugacaccugcccucugcauggugucagcauuugccaagcacuugggagcugcaggugccaagccaggagaggggcaggaaaccuaggccugccucacuggcugcugaagccccauccccuagcauagugccugcacaucacggaccuccauacauguuuguggagggugcaaguggacuugcaggugcagggccugcaaggccugaugcucagaaaggugcugcgucuugaucaaggacccccagcaaauagugacgaaaucaagcugugagaaacucuggccuccugaugccagguggccugcaguuuguaccacauuacacugcuuaauaugcaguuauucaugagauugcaugaagagccuuucucucugccuacugggugugucuggauggcccaacucuuggcuugucuaccacugacauuuagcuuacucuaguuuauugaaaugauggguuuagaaacaaaaacugugugaugcugggcaaguugcuuuugcuuuuuuucagauucuucaucuguaaaaguggaggucaggguugggcagagagggugguauauaaauaauguuucauugcgguagacucuguaacuuacacacuaacccucgcuucuccuaaacaaucuuuuuggaaaggauauggggcaacgcauagaaugagggaaaaguugaaaaacuaagguuuggaaagguugagauccuagaaugaauagacggucccuucauguacuaucaucuugaaauucugagaugagaucugacuguccaggcauaucaugaagcauucauuuggccaggcaagggcagggaucuugaccaacuccaggugcccuagucagcaaugcaacgagaggggaguauuucuuuaaaugcaaguugggccacuguuuaucucaagaagguggcauggaugcugggcaggcucugacaauagguauccacuaugaucuaugagggcuuuccaaguucugacauccuugacuuaugcuuugggugcggucugugucuuaguaugcuaagaaacauugggcaaguuuaugaaaguuacugggauauuuaaucagagcuuaaaaagggcuaagcaccuacauuuagcaggcugguuugugguccucaccuaccuguuuuauguuuguuuguuaguuucagggagugguccgcuuauucccuuuuuucuaagcauauucucacagcuccagugaucucagaggguccuucucuucauuuccccugugucuuauccacaccguuuuucuuuaugauauggcaguuuccucauacccucuuacauucgucuuucccuucagguuuucugugguaucggcuaaucugaucaacacugugguuauuuaccaaaaacugguugcuagagaaguuguuccuacucaccauuuucgcuuuuagauuuuucucagaaauucuaaagguagcaccucauuuccccgaacuguucuuaucuaauuccaacaaauacacauaaugggcuauucgggacacuggaaaacaaauuugugaacucuucuugggugagccauuuugagggccccgcaggucccugccaguuaaguugucugaucucaagaagucagcucuauuugugcagagagguuacccaucuucacagaggcagccacgagggaggccugaagaggauuaaguaaagacccugcuggccaaaggagucaguggugcucauccaaacauccuuugguauauaauguaaaagcaaaacacaggaccagaaacuggucggaagggugccaggucuugugcggacugggagaagaugucgugggaagugguuggugaaagggaguguugacuuaacgcauuguuuggaaacuuccuuaauaggaaguuaaagaaaacauacugaguagcauuggccuuuugccaggcuucuggauggcgccauuuuugccuucggaguguugcuuccaaagcugguccucuggcaacgauggugcuuauucaagggagucccugggauaggaggaggucccaauuuuuuacucuaggagcaaccuccaaaguucccccuuccuucgccuuucuguucccucauaaaggaaugugucugcuugcagcccccuggacucaucagucccuuauuuggcuuuagggccaugccuuuggcacguugguuuguuuccauuccuuuggagucagagguggaaugaguacugauguagaaaucuugguucugaagcagcucuggcugucucuucccugcuuuucuuucagcaucuuagaaaacaaaacaauacucacugaauuuauuuugucccaaaucuagacuagugcaggccaugacauuagaauagcacucugcuuuucagagacacuuuccaguaccugucuguccugggcauugccauuucugcuugauagaaagggaaacugaggcugaguaguuugugacuugcaccguaucaccuagccaguuaaaaaauauugucaaaauuuacaaacccagaaggagagagacuaguauuauaaaccucagaugcccauuaccuagauuuaacaaugaucaagauuuugccacguguauauauagcuagugcuggagaaaaugauagcaauauuuguaaagcacaaauacuuucuacuuuacaaauaauucuuucacauuuguucauaugaucuuccuauaugccaggcacuauucuaacaucuuacaggggcacugugaaguagauuuugucauucuccucauuuuaugaugagaaaccauaggcacggagaaguuacugaccagucugaauucacacgacuuauaagagcuaggauuugaauguauuuucucauuugauccucagcaucgcugugauacugauggugauuauuagucuguucauuuugcagucuagaaaauggaggggguuuauguggcucacgugaaaacaauuuuuauacaaauacauagugagcacuucucgaaguuuuauuuaucuaauuaaugggcuaaccagcaagaugauaaaacugguuuaaaauuggauaagggaaacuaagacguauuuguguggcgguguguguguauuuaauagugaaaaaaggaaugcugagauaagauugcuaaauuagacacaaaacuaguuaauauccuaggggcuguaaaaucauaaccuuugggguuaucuuuucuacuagauggaaauauuugcauuucuguuguaucuuauuaaguuuuuacaaguuaacaucugauuuuacagaguggaacaagggcuguccuaauuaauuguaaauaguacaucuuucaaagccacacucuucccauaaaguccagagaaccguagacaggccucugagagucuaaggcuuggcugugcucccuuaguguuuuuuaauuuaauguuuugagacagaaucuggcucugucacucaggcuggagugcaguggugcaaugucagcuuacugcagcuuccgccucccgaguucaagcgauucuccugccucagccuccugaguagcugggauuacaggugcgcgccaccacaccuggcuauuuuuuuuuguagagacgggcuuucgcccuguuguccaggcuggucuggaacuccuggccucgugugauccaccugccucggccucccaaaguccugggauuagaggcgugagccauugcacccagcccuggcuguacgcuugugugacauugagaggaaccauagucaucuuuugcuucauuuccaggcuuuggaagggcaguugccuagugcagcugcugcuuaaaccaaagcauuccgacuuucccucuaugcuggguuagcaccaucuuuagacuuuuggaaggugauuaggaggcuagaaauaaaaaaaagaauuaaaaauguuaaaauugcucaaauggaguagaauaauucccagaacccgaaaacauaaaucaccugaaaaaaaaaaaacuauuaaaaauacagauuucuuaauccuucccuagaaaagggaggggauuguguauuuuugaacagucuuuccagguguugugcaguuguugggcuaagucgcauggugagaacauuauuacuaacauaggcaggaugaagacccuccaggugaaauaagagagaccagaaaaguggaccucccaaggcaucaucaggguauaaaugccuggagacucuuggaagaauuagauagagaaaggcccagagaaaggaggugucagcaaaacuugcuacugagaugagcagagugaugcucgccuaugcugagcucgucugcagaggguguuuuucaagguaaaugggaaauuguuaucacuuuaucuucacugguuugcuuaucugaagcaggaggaagaagguuugagcucccagaagauguuuugcaaauucauuuuagugucacugcuccuuccucucuagagggugguuuagccuagagaggcauuugaaauuugucugacgauaaauagaacuuaaaggaauuguccugaguuugaagcuucugagccuuaggaaagacgggucugagcuguuuucaggcugcaguguacuuucagggccuggcugcuuguacagguuccaguucuucuucccuagagagugaccuaauguuuuauguccgguauuuggggguagcuuauuuuccuaggugggagucugaagaugcagguuuugcucagggacuuuggaaucuaaaugacccagauuuugcucaacucuagugcuggcuauuauuaugauggugccgagacauggcagaguguccuacugauuucugccuguccgugggcuccugagcacagagcagacagagcagggggcagcaggguagaacagaaauugcuuuucuuuuaaagcuagaaaaaaggagugggcggaaugggaaaucuugcacaguccuuucucuuccuggaugcacaucacucacaagucguuuccugaaaauccuaaugcaauccaauggugagagacggcuuccugccggucugcugagccagccccucgucagggaggagaugagaacaagauguggucagagaauggggcagcugggcugggccgggcugcucagugaccaugugcccuccucucugugggacagcagcguccuuugguucugagagcagcaccuggacacaugggcguauguggaccuagcuugggggagcugcagaguuguucaaacagauggcuggcccuaacccuagaguuucugucugauucaugagucuggguggagccuggcaauuugcauuuuuaacuaguuucuagaugaugcugauauugcugcuucagaaagggugauuagguggaaaaugaaagcggauuguuuuauguagauucagaggccagaaugaaggccugugggugccagugacagagguguaguuuuuaauccggaguaaaacauuaaacuacuguauguggucagaaauggaguggguagucucaggaguagccucucccuggagguguccaguggugaauagccauuuggcagauuccuacacgagauaaaagguucauucauucguuugcgaguuuauucacucauucacagaaugcacauguacugccugcuugcuaggugcugggggccggggagaagacuucaaagacacaaggucccuguuuuuggggagcucacaguguaauugggguuugacuacaugauuucuaggguuccuuucagugcugagggucagagaggccugugaugaugggguaaugucacugggugaaugauuucuccccccuugcuaagucucagaagaggcugagaauauuuuuaccaggagugcauuuucugugggaaaauucacacuuccccacuggcaccuggaaugaacuauuaaacucugaacuccugaccagcuguacauggcgcagucugugaaagcaaacccaggaaaugggcugcaggaaugagcacauugcguuuuaccaccucucuuaagugauguacuggagaguucauggcuggggaaaguuagagagagaaacuuucuggguucuucugucauaaucccuguugaaagcaauaaugauuaucacuaacuuuuacccagcuccacuuugugccaggcauggcauuaagucugcuacauuuauuauguuguuugauccucaucacagcccuaucaaaugaguauaucauccucuuuuuuguguaagaggaaacaaagguucagagacauacauguacuuguucacggccguagaggcagugaaugucagagcuggaaucaaaacuucaguuuuccagucuccagaccaugcucuaagcugcuaguacacugaacuacucauccauccauucauucgguaacuaguuaagugguuuucucauugaacaaauguuaagcacugacauaaaccagugagcaaaacugcuuggccucugcccucaugaggcuuacagcuuuucucccucaggcaaaugggugacuccucccucaaaucuuggacuaguuagaugcuaaggagaaagagaaaggacugggagacagauucuggcagguuagccacugacccaaaguuuccaugugaaugagaauuucucuucacaaagcugggguuugugcuuugcuuuauuuuuacauuuuccuguugggcuucuuuucuucuuguccaaggcgagaaguugaaggccuugacauaguacaggagacaauucuuguggcauuugccuucugaccacacacuggggauggagggaaaucugagcgaucccagaacuuagagcuggaagugacucuagaggaauucuagagacccucugcgaugacccucucuugcugggaaaugucaccucuuucaaaaccuggguuaucccugcagauuccuuuggcuuucugugcuggccucagccuacauuuucuucuuuuuaagagcaguuuuaaauuaaaauuucaguuuucaaaacaccucucugacaguuaauuuaaaagucaaccaacuucagaaauaugcaacuuauauuguaaacaucuucugcaaccccugagauaaucaccaucaacaaagggcauuuguuucucucucucuuuuuuuuuuuuuuuuugagacagagucucgcucuugucaccuaggcuggagugcaaugacgugaucucggcucgcugcaaccuccaccccccagguucaagcaguucuccugccucagccucccagcuaggcaccugcuaccacaccuggcuaauuuuuguaauuuuaguagagaugggguuucaccauguuaaccaggcuggucuugaacuccugaccucaggugaucugcccaccucagucucccaaagugcugggauuacaggugugagccaccacaccuggcugaccuugacuuucuguagaucaauucugccuuuaauguggcugaacuauuaauaguugaaacauccauuugacucuuauauuuuucuuuuaauuuuuagagaaaauucuaagaacauuucuugaaguugccuggccuuuggugaggggauucuuaaccuguacuucaaggggucuguggugagagaaaccaauguccaaguuuagaaaagaaaaaaaggaauuuauuggaagaguaacauagaauuaccaggucucaggaaaucggaaccacuaaguguccgaaagggcaggcaacggaagcuuagggaacccuuguagcaggaacagaagaacagaugcauugcuuccaucuguucagaccuggcaguaucucuccacuggcuucgcuugaaauacaggucaccccuuggccagggccaaguaggacaccuugauugacaaucucaccaaaauaugcaucagggaagaguuauucccuuaaagaaaaauuggucugcugauacuaaaaauugguagauccagugcuggaaaaaucaaccacgguacacaacaggguucauaggccccgggaaauuuugcauguguuugcaugucuguuuucccaggacccagacaaauauuaagaucauugcuuuaguucugucaauuccaucuaguuggagugauguucccauagugaugauaaauuauauuuaauuuacauuaaauauaaaauuaauaacaaacuuaugguuuuccuuuuuguuccuuagccccuuguggcugccuaguuucuuuuguauggagaugcuugggauaguccugccugguucaguuaaaaucacucguuguugcuaggaggguggaguucauccacuuaugauauaaaugucucuuuuuauuuuuugcaggcaacuuuuugcuccuuccuacacagaaacccauuauacuucaagugguaacccucaaaccaccacacggaaauuggaggugaguucaggucaacaaaugucuauccagcagcuguccucucccagcccuacuccuaggaccucaggagaugccugauggaguuggucucuccucugaagggaguguuucccccaagcgaagaccaagggagcaaacgagaagcaaaacauguauuugauguucauaggugcuccuccuccuuugcugacuacaauggcuaaagaaacauagacuauuuuaggguaauugcaucuaauuacaauugaugcaaauuacugugaaauauacauguucuuugcuuuauguuaauuacccacauguuaacaaaaguuuuaguaaaaggagugacuuacucauaauccugucgucucauccaauuagauguuugauuaguccuuuuuaaauggauguauaacauuuacagaguuguaaucacugugcauauacauuuuguagucugcuauuuuaaugugauuuuuaaguuaugaauauuuuauuuugcuucuauauucauauuggacauuuuuucccucaaaguuguuuuugaguagggauguuuacgcaaugucaaagaucuuucauuuagaaaauggucuuucagaugguuacaugucaguuugcuuugccacacuccacugguagacauuuaaaguagugaaugauacacauuucaugguggcuagcucuucuuacagggaugccuauuggaauuuguaggcucagaacguugauucucaaccaggagaaccaauggcguugccccgaccccgagggacaccuggcaauguuugcaggcaauuuuuauugccgugacuggcagggaggaucuacuggcaucuacauucuauaaugcauaggacagacccaccacucccccacaacagaauuauccagcuccaaauauccauagugcccaaguugagaaacccuggauucgaaugaccauucucaaagucugggcuggugagaugggggugaagaagggaagacgcacacuggcaggagcagcaguggccuuugccuuuggggcaggacauaauggacuacugaggcacacagacugggaguugugguguggagaacagcaggagaggucccucugcaucaggacuccuucagcagcuucucauggaaccugaguguucuaccaggcccauucuuuaaaauaucccugcuggagugcaaguguccagcaagauaacacuggccacuaucagucauuaacagcucagauuaguucgccagauuaccccuggauggggaaagggacacaggacagguaauuuugugugugugugugugugugacagaguuucacucuguaaccuaggcuggagugcaguggugcgaucuuggcucacugcaaccuccgccucuuggguucaggcaauucuccugucucagccuccccaguaggugggauuacaggcaugcaucaccacacuuggcuaauuuuuguauuuuuaguagagacaggguuucaccauguuggccaagcuauucucgaacuccugaccucaggugaucugcccaccuuggccucccaaagugcugggauuauaggcaugauccacugcgcccggcuaauuuuguauuuuuaguagagaugggguuucaccauguuggccaagcuggucucgaacuucugaccuaaggugauccacccaccucagccucccaaagcgcugagauuacaggccacugugcccggccacaguuuuugauagauccaagagacguggcgcauaguaacuggguagcucaggggcuguguuuuguggcugaaugugaagaccagugcugccuucuuaaccaagacuuucuuggauggggaaggaguugguaguguggccggugccugcagcaaaguuggacugugucuucucauccccagggaggcuguccaguugugacuucauauucuucaaugccccuuggucaaaacuuuuccucucuucuugagaccucuguucucugccuccaggggcaggggugggaugggggaacaggcaugccuagaaagcuguuagccaugacagccuccuucaaacacucuccucugaguuuggauccugccacuucuguacccacagcucaagaaugggucucaguccacgaauuugccaugagcucacgcuuccugcuaugaaagcccccuugggguggccccaucaggcugagaagcugaggaaugcaaugacuucaugacugauccuugacuuguucuuugugcucucugcuugugcauuaggcagagauguuguaagggccuuucagaaagagaggauuggaaaagaacucccccucucccagaauccccuccuuccagaaggucuuguugacugaagcacauccuagcugaaccuugggauggacaacucauuguuugcuuacauccccugcuacuagacucuugcaaagcucccacccaggcccaugggguucucagucagacuucccauuugggagcugagagcucaaugaaaaaugggaauggaauaaacuacucagcugcccuugacccgaauguuggagacugcacucuacuaccaaacuuggccugggguagcuggaguucugggaaccuuaucaagacucaucagucaggccuuuaggcgacagccugcaucuaggucaggcgguugggggaaugggucugugaauguguuccaacagaaaggaugacaggguuugcaaucugcagccaggguuguuaucuuggcuuuaacuaguuauaugaccuuaaacaacccccuugaccacacuaguguugaguuuucucauuugcaaauugcauaugcugauaucugacucgcagggcuguggaaggguaagaugaaucacuaauuuuuaugggaauucauaagcaacucuuccaaccccacauuuuacagaugaggaaacugagaggagaaggggaaaaguaacuugcccaaguucaguuaaccaguaaguggcaaggcuuaggcuagaacuugucuccuuuguugcuagagaagguggggauaaaagagcucugacaagccaaguuccuccuuugcuacugcugggagaggcagaggauggagcuuggggccaggcugcugggguuccaguauccacuuugcugugucaccuugugaaugacuuaaaaccucucuuucaauuucccccuuuaaaacauggcaauaauaauaucugccucauaagauuguggucagaaucacaaggaaaaaucugcuaaguuguucagcaagcaguaagagcuggguagauguuagcucuuuuauuuuagacauagggccucgcucugucccccaggcuggagugcagugacaugaucauagcucacugcagccucaaacuccuagcuucaagugauccucuugccuuggccucccaaagcauugguauuauaggcaugagccgccaugccugguuagauguuagcucuuauuguuuuguuuguuuguuuguuuguuuugagacacagucucacucuguugcccacacuggagugcaguagcguaaucuugacucaaugcaaccucugccucccggauucaagcaguucucaugccucagccuuccgaguaucugggauuacaagugcccgccaucacgccuggcuaauuuuuguauuuuuaguagaaauggaguuucaccauguuggcuaagguggucucaaacuccuggccucaagugauuugccugccucggccucccaaagugcugggguuacaggugugagccaccccacccgaccucuuacuguuaauaauaguaaguuguaggugucaucaucacaagagauaguguaugugaaagcucuguaaauuauaaagcaugcuacagaagccaggugcucuauuuucgagagaacuagggcugugaacacucuuagcauccauucaaagauaggaagaggugcagggauucuucacagccaucccuggguuucaguucuuucuuuuuucuuuuuuuggagacagagucucgcucggucaccaggcuggagugcaguggugccaucucggcucacugcaaccuccgccuccuggguucaagcaauucuccucccucagucuccgaguagcugggacgacaggagugcaccaccaugcccagcuaauuuuuuguauauuuaguaaagacaggguuucaccguguuguuggccaggauggucuagaucucuugaccucaugauucgcccaccuugaccucccaaagugcugggauuacgggcaugagccaccgcgccuggccucaguucuuucuguuaaccagcguuuugaaacuguagcugauacacguuucugaacuccuugauucucugucauuccaacuucucugagccccauuuacuccacacaggcccggccccucuucuccccaugaguaauccugugcuacgggguuuguggcuccccuguugaguucuaaggaccagguucaggacuugagugcuucaugaggggccuccaaaucccagaucccacggguagguugagaagccacaugacaggcuggcauuugaaagcaguuggaauccuggccaggaggaggguuuugccugccacgccuucuuucauaaucacagcacacuggcuuuccuuugugcuccucucaaggguggcaucugacuuguuuaaaguccagaagaguuugaugcaaagacagggguuggcucugucccuccuccugacuaugagcuugaaugggcagaggagccacaucgcuggccgauggaucauaugcagaugaaagggcaccuguggucuggagaacgaggccguguugagugucagcuuggccuguauccuuugaucuggcugcauggcuggcuggauaugcuggagcauuggcacagcuagggcuuuggauucagccucuuggugggcuuccaggcgccuugaggccauauucuuugauaaaggagaauuucaugauuauuugguugccgauguuuaucgccugccacucucggccaaguacucuacuagcuccuuuauguacgauauucucaccaccacucugggguacagaggcuaaagacacugaaggucagagagaguuguggaacugcguaugcuuggauuuaaauaugccuggcuaugccaaaauguuugaauuuaauuauuugucuauacucaggauuagagcugggagggagguggagccagagaauacagacacacgggguagcugauuauugggucacaucccugucugguggggacaaagaagcaacugcaagcagcaugguccuagagaugggggaaaagagaaagcuuccaugucugcaacugugugguuugcauccaucccuuuugagaucuuuccagaacuuggcucuacccuguggguuuuaucuucucucuguucugaccagugcaucucucuugacuuauuugggaggaagccucuaggaaugugucucuuguuguuaccccugauucguuggacaccguccugauuucacccccuucugucugguuuagcacuuuagcaugcccaacagugcguauuugcuuccuaaauucuaugguuaccugacuuauaaaaugcucggccagcacuugaaaugguuauuucaagccccuucuuuugguuuguaauuauaucuguuuggauuucucauuaaugacugccucucacaagaccauaagccccacgaaggcugaagcugugacuccguuugcuggcuauggugucuccaggggcuggccccuggccuggcacagagcgguggucacagcuguuuguagugauggagaaauucugacagccaugagacacaguggcuggagagcagcagcagaccucacgggcacagguaccaaaucaaguacaauccagauguggagggauuugugugaaagagcaucuugagcuguggaagaguagggaguguuuguuuccuagggcuacuguaacaaagcaccauaaacuuaaagguuuaaaacaguagaauuuuacuuucucacaguccuggagucuagaaguccaaacucaagauguugucggggccauacucccuccaagccucuggagagaauccuuccaggcucuucuagcuucugguggcuucuggccauccuugguguuccuuggcuugcaacuucaucacuccagucucugcccccaucuucaaauggccuucuucucuuucugugugugugucuguguguccuucccucuuguuagaaggacacaaaucauuggauuuaggaccuucucuaauucagcaugacaccaucuuuuuuuuuuuuuuccuuuuccuugagacagaaucucacucugucgcccaggcuggagugcaauggugcgaucuuggcucaccgcagccuccaucuccuggacucaagcaauucuccugccucggccucccgaguagcugggauuauaggugugcaccaccacauccggcugauuuuuguauuuuuaguagagacaggguuucaccauguuggccagggcggucuggaacuccugaccucaagugauccaucugccucagccucccaaagugcugggauuacaggugugagccaccacgccuggcccagcaugacaucaccuuaauuuaacuacaucugcaagacccuauuuccaaauaaaucacauucugagguggacaugaauuuuagggggauucuauucaacucauugcaggggguugcaaagauaacauugguggggaggcaaguucuuuccauggcaugcuuuuggccacagaaaacacugauuccugaaagagcccugaacuaggaaaauucuggauuuuccaaucagcagggagaccuugggcaaaucucuuugcuccuuugagccucagcuuuucaucugcuucauggagauaaugacaucuucccugccccgucuccuaggauuauuaugggaaucagaugaaaugguggcuuggaaagcucuuugcagguuguaaggugcuauaagguuggguagguauauaauaagccaugagucauccaugaccauccugagauauuaacauugccaugcuuaucaguguucuuuagccugaccaccuccuuucuccuugcuaggaucacugcuuuuaccacggcacggugagggagacagaacuguccagcgucacgcucagcacuugccgaggaauuagguaagagacccugaggcugcagguggcaccgggcacucuccccaggaauggaaguuucaagauagacaaggcugaggcaaggaccuugggaaggaguccauugagaaugugugcaagccagcccagagaggggcugagccugggaggaugggcaagggaaagccuagguaauccagaaauccauugggauuuaacuuuccugaugaacuugauguuuuaaaauauagguuuuguuauuauuuagguaugguaaggccaaaaaaucaggagaugacugccauugaaaagauggucauacucacagaaaagggaggggcccggcugugccauggggggcggcacggggaggcacugggguuggucagcgggcagagggagucuggagaaaugucagcagacgcccuucuugugguuucugcgggaaggaaugggcgaggcagagaaagcagguuuaggauuggcuaguuugcaucauuucagcaggcucugggguuuaugggcucucuguccuuaguuguccuauaccugguucuggggugauuagggaagggggauaguggcccagagggugagagugcccauaaaauaaauggcuaggguauggacucuggauugguuggcuugcauuugaaaggcaagguagcugggaaauuguugaccaucucuaggaauuggcuaauccuggaaggggcagucccucuauggucaguaagacccagaugucaaagaaacagaagauaaaaaagaagacacaugguuaauaugcucgggauggaugaguuugggcauuugguuccacaccuccucaguucuucucugggagauguacuuggagguggugaaauaggaaauggacgguuaaugaacagagaguaggaagugaaaggaaaggcaaggauaauuuucaagacagaaaaucaacugaaaaguucugaccagaaugugcuuuugagagugacccuuccuucucugagugagacuaccuggcuuugagcugguagcaguuuaccagcugggugaccuugggucccaguggucucauuuguaaaauguggauaaaaagaauauaugccugcaguugugaggauucagcuugugaauagcuaucuuaccuaggaacuugcaguggcacacugucagcaugcagugaacuccuaggacuuugcuucucuagguguguuccauggaugggcagcaucaacuuuaccugggagcuuguucgaaaugcagcaucucagguuccacgcagaccuacuggauuuuaaucugcauuuuaccaagacucccaagugauuugugugcccauuacagucuguaccugagaauguguguuccuugagaauaugaaguauaucucaaauaucuauuucucuccaccagccugccuuaaugccuugcuugcaguaggaucuacacauguauguugacauaauaagucuuauuuauguagaccacuuucaaucucccuccucuuuuuuuuuuuuugaagaaggaugaugaucuaaaaaaccugguaucucauugcauauacuaauugccuggguuuugauugucuguacuauguggugccucugugcagugauagacagugagcuacaguuucccagaauacacaggcucagugugagacacuucagcccaguguaaacuggcucuaugacaaaaaggaaaaagcccugauuuguagcaucugccaauaugcugacaaagauaaucccaccaugaucaauuucaggcuaccgaugugauguuauugaaggcagaauugggaagauaugccuuugauuggcucuggugagcugauaggagguggcuccauuguguguucuuccucucuugacugauugcuucauucauucaaugauugcauuuuucauucacaaauagaaauugggugucuuccuaaugcccauacccuacacagguggagggaaaaccagcacuguaauuuuggagcccucaguuuccuugucaauaaagugaacaucaguauuaagcaugguagagauuauugcuguaauuauaguacuuuuaaacauaaggguuuuuccuccucuuacgucggugaaaccaugcuaagacuuaugcaggcuccuauacaaauggaagguuucucacacugcaggucccaagugucuguuuauaaauugggccaugacuuuguuugaaugcugcauggugaguuggcuggaggaaaucaggcaggaaaugggcuuuggaugggaagcaauaacagaguggccccaaauccccucugcuuaagugaccugauugagccaagcuaacuggccucgcagugguauuuacaagcccagccaccgccaccugcagucugcaaguaaacaaaguuugucccaagaaggaggaaaaagaacaugcaggugugaccugcuucugucugccucuuccuccauccccucagucuggagcagugggaacuuggcuuggcgucuuguaaaucauuccagcagcagugcugaaagggagggggauaccgggugagcuguccguguguuucuguuuugcaugcuuccgucuggugagguccaccugccuuacuuucccagccuucucacuacacacgccuuaagaaaccaaggcuguggguggacugauuuaagagcuggagacucaugccagaugguuccauuugaacccuggagaaggagcagcugcaacagcagcaacauucaaacccaugucgucaaaacacuaggcgccucccaaagcucauaaagcacugcugcagugaaaaaucuccauagugauuguucuucuuuccuggaaacaugcucccaugauuggagaaauagguaggauuucuaucaagugagaucuucaagcugaugauaccaagaggaauucagcugagcuucuaggugguugcuaggcccccucuucucuucaaagcaguucuuuagguuacuuuaauugaagaagucauguauuaucuuaguaaaaauaaauucaaaaaguacaaaagaguguacaaugaaagauaacaucucuuucucaccccagauuuccagauuuucccccuuccuagagacagccguuguuacuaguuucuuguauauccuuuuaggaauauuccuugugaaaaaagaacguagauauguaauugauaugguuuggcucuguguccccacccaaaucugaucucgaauugcaauccccauguuuugagggaggguccuggugggaggugauugaaucaugggagcagucuccccaugcuguucuggugauagugagggaguucuuacaagaucugaugguuuaaaagugucaguuucuggccgggugcgguggcuuacgccuguaaucccagcacuuugggaggccgaggcaggcagaucacaagaucaggagaucgagaccauccuggcuaacacggugaaaccccaucucuacuagaaauacaaaaaauuagucaggcgugguggugggcaccuguagucccagcuauucgggaggcugaggcaggagaauggcgugaacccgggaggcggagcuugcagugagcugaaaucgcaucacugcacuccagccugggugacagagugagagucugucucaaaaaacaaacaaacaaaaaaaagugucaguuucccuugugcucccucucuccugccaucuugugaagaaggugcuugcuuucccuuugccauccaccaugacuguaaguuuccugaggccucccagccaugcagaacugugagucaauuaaaccucuuuccuuuauaaauuacccagucucaaguaguucuuuauagcagugugaaaacggacuaauauaggaauauaaugucuguaaucuuauuugggccccuggacccuuugagaauugauuggaagcuauggguacuuauaaaugacaccaauaggccaggcgcgguggcucacgccuguaauuccagcacuuugggaggccgaggcaggcagaucacuugaggucaggaguucgagaccaaccuggccgacauggcaaaacuccauuuccacuaaaaauuuaaaaauuagccaugugugguguugcaugccuguagucccagcuauuugggaggcugaggcaggagaaccguuugaacccgggaggcagagguugcagugagcugagaucccaccacugcacuccagcuugggcgacaaagcaagaccccaucucaaaaaaaaaaaaaaugacaccaauaaaaagauguggcaucccaucucacuggggaugucaaguuucauucucccaagccugucucagauuaagacauucucuaaauaucuauacuggguuaaggugucucugacugagccuguguguucugggaaacucugugugugagucuguagcucacugucuaucagcaggaaguguaucugguugguaaguuguuuacuuuuuuaaaaauuuuuuuuuguuaaaaauuaucauuauauaacuauacagguuuaguguuaaauguucaaaucaugcaggaauguguaagcuuuaaaaagugaaaguuguuuaucuuguccuacccuuccaaccaaucccauucuccaucuguuauuacuguuggagguauccuuaauuacuguuggagguauccuuuauugaaauacauaauuguguguguguguguguguguguguguguauauauauauauauguauauaugaacauauuuaauccaaaugagaucacccuaugcauacaguuuuguauuuuuuuuccaacuuaagcauuauguuuuagguauacauagaucuaucucauucuuuuaaugguugcauaauaucguuuguacuaaugucuggcacguuucauuauauagaaagucuuucagagguaugcaauaaaucauccauaguggucuauuugauggaucacccuuauauuacagcagcccugccuucgaaaacauagggcucacucucacuguaauuacaccuuaaccguggucccuggacucagauucugugagagagggagagagggagaacaugagauugaaaaugaaugcaggagaauguguaggaaagugugcaugauggccuggaauaagcucaaaauguaaagucaagggauccacguuuaagaucuagcuacauacuuccuggcuguguggaucucuguguuuuccucuccccauuaaauuuuuuccuugucuuugcuguggccaggcuggucccuccacaggccccuacucuauccaaaagguggcuaaguccugggagugggguggguggucagugggggugaggucaggggcauaccccagagucaugaaccugaacauuaggagagcugggauuagccccggcucucacauuaacuggcuaggugagcuugggcaaguucuuuuuugggugggcuuuccucuuuucuguaaaacaagaguagaccagaccauuaaaagcuuccuucuguguuggaaguccugggaugcagagagguugggcagagucucagggaggugggagccuggggcagaaggagguggcucauauacacacagccagcccuggagaagaaguggcaaguccuuuccaccuuugaauuccuugccuuccuucugcagaauggaucauaaaugcuaccuccgugucaggcauugcacagauuaagcccucagaggacaguguuauuaaguugugaugaauuuagauucuggagccagacacuuccugguuuaaacccugccaagcuacuuaaguucucaagucucaguugucucauccauaaaaugggaauaacaauauugacaucacugguggauuuacaauaggugaggagugcaaacuccuugacagcagggacuuugcuuugaucaugcuauuucccgagcugagaacaguuccugucacacacuggguucucaguacagauguguagaauggcuaucgaauaaaacacuuugcgcuuugcuugauguauaauacacaaucaaugaccguuagcuguucuuuuaaaaugcugcuuugguuauuaguaaauauugccuauucaguccauuaucacagcaacucugugagaugggcaguguuauuacaucacuuaccacacagcuaggagacagcacagccagaguuugaauccaggugcuauaugggggcacccuguccuugagaaaguacaugaccuacaagccuucucuucucuuuuuugcaggcuuuggaguucccuguaacuccuuuuggauggauauaauuugcagagaaggggagaggaaagaaggguagcaggguaguuacuuuuuagggcaccucuggguauagggauguagaauguguccccuuugguuuagcucugaauggacaaguccccaggaagcaguuguuggccuaguuccuugaagaaugcauuuggugaauccuucaguuaugcagggguuaggcaugaauugcuuggugccugccuggccuggccugcccggguuuuccuauacaauuucauuuguauccaucucuuaacgaugagcaauaggauggagaacagaauggagaauggcaugugaggcuggccacccagccuccugggccccagcucaugccuucuggcugaguucugccuuugccagggcuaacauucagcaaauuagaucaaccaaggcuccuagaaggauaaacaacugguggugcuuggaagagggcagcuaaaggaauuaggguugagggcggggacagccccuggaaccacauucucagacauucccccagcaacaaagcugcaguccacugacagugcuggggcuugugccagccucuccuccauccccaggccgucugagaggauugcagucgugacaugggcaaauaaccaggaacagcaguuggaggaagggagggaaguggccacagaauccuauugcuggaacgaccuucaggguccuucugagccucuguuucucucaaauuguaaucugcccacucccugaaucagaauuacuaugggccuggugaaaagcaggugccugcuacagaggguggucuguaggccaaaguuccugaguguggcuaggcagggaauuacucaggccugcagcucugcguuuuuuagguugggcccuguauuaguccauuuguguugcuauaaaggaauacguaaggcuggguaauuuauaaagaaaagagguuuauuuuggcuuacaguucugcgagccauacaagaagcaugacaccagcaucugcuucuggugagggccucaggcugcuuccacucauggcagaaggugaaggggagccugugugugcagagaucaaguggugagagagaaagugagagagaaagggaggaggugccaggcucuuuuuaauaaccagcucuugaggaaacucucaugggaauuugcugaguaaaaacucucucauuaccaccaggaugcaccaagccauucaugagggauccaccccaugacccuaacaccuccuaccaggcccaccuccaacaaugggaccacauucuaccgugagacuugguggggacaaauaaaccauauccacagcagaccuggauaccuauguuuucaauacacuguagaauauucuaauagauaucccugagaccucugcuccuagagaucucugacacuuaggcuuggaacucacugauggaggcagaaagcacagaggcuaaggggaugggguccagagucuguggaccuuaaaucuuugacuucagauuaccuaguccccaugccuggagcccacacugcccuuaaccaugagagcuuguuauuuaaugucucugagccacaguuucuucaucuauaaagugggacucaugagggugccuccuuauaaugaugaugugggaaugaaauaagaauaacauuuguaaacacagugccuggcauccaguuagcucaaucaauggcaucugaaggugaaaaguaggcugcauaccuccuucaucuuuucucuuaggaaacugaggugaggccaaucaccccuaagaagagagcugcuggcaccaucacuggagccaucuguagacuggugguaucuuucuaauucacucuacaggguauuuuuuuuucuuuuggagauggagucuugcucugucgcccaggcuggagugcaguggugcgaucucagcucacugcaaccuccgccucccagguucaagcaauucuccugccucagccuccugaguagcugggauuacaggcacccgccaguacgccuggcuaauuuuuguauuuuuaguagagacaggauuuuaccauauugcccaggcuggucuccaacuccuaagcucaggaaauccacccgccuuggccucccaaagugcugggauuacaggugugagccacagcgcccagccucuacaggacuaucaugauugaggcaguggaaggucaggguaagguugugggacuuggaacuagaaugcuuccauucaaaucccgacuccuuuaauaccuaggugauaggcugaucugugcagcaaaucaccauggcacauguuuaccuguguaacaaaccugcccauccugcacauguacccuggaacuuaaaaguugaugaaacaaaaacaaaaaacaaaucccuacucuuacucuuacuguuugugugacuuuggguuaauuaaccuugcugagccuuuguuuucccauuuguacguuggggacaauauuuguaaggauccuaggaagguggugggaagaauaaaaugcucacuuagcacagugccaaguccauagcaaaggcucuauaaucugcagccacuaugaggauucuuauuuauugugcaccacacuauggcuuggucucuguccuguuuagcucacaggcuuguucaagugaugccagaucaguugcgccuugugaaccuccauuggaacuuucccugauuccucuauggaacuuuccacucacuggguguaaucuuggcaaccacaaccuggugcacacagaaccaucagcugguugguggucaagcccucuguguucccaaaguguguagccguuaggggaaacugaggugaugggagaggccuugguuggcugagaugaaaagauaacuugggaacaggaugcgugcagcagcucucuccucugcccuuuccuggcuggauuagggaguggaugcgacccuugcuccuugccacgcucccacccccagauguucagggaguaccuuagauguccgucagagggggugauuggguacugcugcgucagacugggugaggcaaccaggaagucaucaggcuuccuggaucuggaaugaggucagccagggaugggauccgggaaaggcugcugcccaucagagccuggcgcugauuuuccagagagcaucacaggcucuucccaaagggcaaaaucugggcaggaaucccaaguggcgguugugguggagguggaagcugagauaagcuaagagagagguccugccaauuuacaguggcaaagacuggguuggagaugcuguagguucugagcucucugcauggaugagagccugccugagguuuuagagcauacaaaaugcugcuagaguccauggggcuuacuccugggcuuccuccucccacuaagccuugauuacauaccuuuacaaucauguuuaucucauuguaucaagguuggcagauaucugcugccugggccuucacugaucauuagcaauagcaauugauaauaagucaugguccucuuucuugcugaggcuagaaaagcccucagaagccuuggugauguaacaguugaagcagcugccuccaguccaaggggugaugaaacuuuuugcucucucuguuauacauuagagugacuuauuccaauguuuacacucaacgcuucacaaggguaggcacuuggugugucuuguucgcuauuccguccucagcaacuggcaugauaccuggcccguagcaggagcccaguaaauguuugugacugucuuccagaggacugugaguuucucaaggacaaggauuaugucuagauuaugucuaggacacaugaguuuauucugaguucagugcuaguaucuauaaucaagggaggaaaaaaaguagucccucaugcuuggugguggaugucacuucaccaaauaacuaccgugcugacguggggcaggugggacaaguaggcgugucaucacugaugcaucuagcucugguuuccaagcacaaagacccuugucuuuccacuuaaucauccaguagucuugauaaguuaucauugccguguuagggaugaggaaacugacgcuuggagagauuuaagaugcuuguugaagagcaugugacaauugaauguuggagcuaaauccagaaccucggucaccucacuugcaggccacuguucuuucucuggccacuguacugcuuuuccugagucucuaaaguuuugacccaugauuugucauaugccauguuuugguuugggaggcuuuuuggaauccuggaccuaccauccuucauaaguuuuaagugucacagguacagccuucuuagaacuuuuugagauuucccaguccagagacuuuuaaccuggagucucacgaugagcuuggugguggugguugggugggguggggguugggguggagguccaagugcccugagcucaugcaccacuuuuuauguauaagugcauuccucuagagaggaagugugagcuugcaucagagucucacgaagggguacauggccccauaauuagguuaagaaccaaugaucaaaacccacuaugucauuuugcauauggagaaacuaagaccuacacaagggacuuuuucagaaccauaaucuuugaccagagauucuauuucuccucucaacagaggacugauuacggugagcagcaaccucagcuacgucaucgagccccucccugacagcaagggccaacaccuuauuuacagaucugaacaucucaagccgcccccgggaaacuguggguucgagcacuccaagcccaccaccagggacugggcucuucaguuuacacaacagaccaagaagcgaccucgcagggugaguuuugaggcucucagugcagaaaucaaccuggggacaggcuuguccccucugagguugcuuacuuugaauccaggaguauuucuaaauugaaggugaugccuaagaaaaaggaaauaguguuuuucuuuuauucugucauuguugagugugaaauacccucaucauagaauaacugcuuuugggggaaaacacuacuaccuuuaaaacacucagaugcugacuucagaaagcuuaaaaagugaaaagaaggcugggcgccauggcucaugccuauaaucccagcacuuugggaggcuaaagcaggcagauugcuugaggccaggaguuugaguccagccugggcaacauggcgaaaccccaucucuacuaaaaguacaaaaauuagcugggcaugauggcugggugccuguagucccaacuacuuugggaggcuggggcacgggaaucacuugaacccggaagccugggugacagagcgagacccugccucagaaaaauaaauaaaaauuaaaaaguggggaaaaaaaguaugcuuucccuauuggaguagacacuacaccauaugcacacaguccucauauugauucauacugaaaauggcaugguguuucgagguuucgagguucugugggaacguggugguuagcacacucccucucauaugcuggccucuguccugccugugcucaucagcucaucucaguauuuucugagaauaaaggacugaauccagggucccagagcagccuccagcaauaaccaaauggcaguggaagguguuauaugagugauggccaccacagccaagaacaucucuagugccgaaugacaaaaucauuacggagguagcugcugcuuauccagcagcucuguuucuuagcaguuuuuuaaaaaugaggccaaguccacuauuucuacagcgcugaucuguuucucuuucuuagaugaaaagggaagauuuaaacuccaugaaguauguggagcuuuaccucguggcugauuauuuagagguaagggggaggcaaugggucuugcagaaaaacugcucucuugauagcuuccauuccaggcuccagacugcuuuggggaaauguugcccauucaucuuucuccaguucaucuaugauuuugaccuuaaaucucaccaaaggcugggcgcggcggcucacgccuguaaucccagcacuuugggugggcaaggcggguggaucaccugaggucaggaguuugagaccagccuggccaacauggugaaaccccaucucuacuaaaaauacaaaauuagcugggcaugguggcacaugccuguaaucccagcuacuugggaggcuguggcaguagcauuuccugaaccugggaggcggagguugcagugagcugagaucaugccacugcacuccagccugagcaacaagagcgaaacuccgucucaaagaaaaaaaaucugaccaaaggcucauuuugccauuuuaaacauaguuggggggaacucccccaacuccccccgccccuuccucccccaccuccacacacagcuaagccucuccuggcuuguuacaucagucacauagaaaaucaagacaguugucugauuaacauuucuuguacugggucugaagaccuuuagauucugguguuuauucugaggaacccggaauugucuauggaaauucuaaaacuuuuuuuuuugcaaagaugauaaauauauucccagucauccgacugaaaacuguauucuugcccauguguggguccauuuuuauaaucauguugaugccaaaugaugaccuaaagccaugguccccaaaaugugguccccagagcaccagcaucagcagcacccuuguguaagaugcaaauucucgggcccugcccccgaccuccugaaucccagacugucagggugggguccagaaauccauguuuuaacaagaccucugggcgauuggguugcacagucaaguuugagaaccacugaccuaaaggcauagcaguucagccuuuaacuccauguuccucaaaucagacagguucuaagaauuugaggaacccucaccuggcucaucauguauuucauuuauucaucagugaucucuugauuuucuauuaugugccaagcaccuggauauauagaucucaagaagacagacccuccccaggcaucgcagaguuugcaguaacagcacacaaaccuguagguccaaagugugauaagcacuaagauggaccauuaggagggaugaaagugcagauaaugggggauucaacaugguuuugggaauuagggaaagcuucccugacauugaagcagacaccuaaagagugaguuuaggccccagagcccauauuugccuaaauuagccagcuguuaccuccaauucucacuuuguuuagugacuccaucauauaaguacuaagugcaucuucugugcauuggaugucauuaugagcugagcgcucgcuguguucgagcagggcagacacuggccuuggucucuccugaggauagagcccaucacaacuccagucugucuguaucccauccacauaguuuagcuaccaucuucccaaagagcucauucuaaggcagcuguaccuagucacauuuccaaagcauguguccuggcagcagggccuggugguggggagagcacuaggcugcaggccagaaggucuuugaguguuagucacuggauguuagcagcagaaggagguggcccuugaagcugucuuaaaagacaaggaggaguuaacugggcagaggaguggaggugaagggcauuccgggccgagggaacauugugcucugcuuugaaaagcguuuagauuuauuuuaacugauguugauauugguuuuuccaacagcuguuuguguguguguguguguguguguguguucuauguuuucuguuuccucuccaaagacuagugugucuauaggaugggggaauaguguggggagcaaaauccaaagcugguuuaaaagccagcugaggcuccauagucgugggaggagauaacugacucuggccugcccugccugacugcccguagugggaggacugguggaagaaaacugagcuccucugacucugggacauuuuuccacuuaaguucugcaucugugaucaucugauacaauggucuugagucauuuuuuucagcuacagaauccuuugguuacauggaaguuccugggaaccccaguaguuaagcauauagagcccagcugcucuguuuaaaggugggguguuucuccccuuuggccuugcauuguucucagaggaaucucugugcaggcuuucaaacccacugggugugaaucuccagcagcuggagaagugggaagcauggugggaggcagggauuaggcaucuucuaucuccugaccuccagagucacagcacaccuccagagaaaaaguguccacucaaggugccuccaggacucuggugucagcuagagccaucuuucucuuacaaaggagagugucucagcaacagcccuggguucccaacagggcugugauucaugcagcugugguggauaagggaacgugcucauuucucaguccuggacaccccuccgcugaaggcuuugaaugauucauuugagggacugggguggggguguguaacaggccaggcuggguucacaggcucacgaaucauccccucuccaccugucuccauccucugcagacagaaauauauucuugacaauuaauuaauuaaucugagaggaugggaaggcaggaaaggggagggcugcuuuaccaugauuuauaaccugcugcagagacagagccuuggggcucugaaugcagagcagaaaguggagacacagauagggagagcaagacccugcugcugccuagagagagaguugucagcaguaaaaaugagcaggcagcuccucgcucccugggccuaggugggagcuucuagggugguucucaguuuauucauuccccagguggaacggaauccagguggggauaaagaguaaggugggcuguuguaggaguagacaggauaacuguaaacacaggccuguaaaggacuuccaugaugcuggcacagugcagaguggcugggaaaggauggugcugcaugugguacucacugugucacccuagaaaauguaaguuugagacaguccuuucuuuacaucaggggucugcaaacuauaccccauggucacauccagccuauccuguguuuuugcaaacaaaauuuuacuggaacacagccaggcccauugguuucuguauuauccaggcuucuguauuauauauacaggugucuguauuauucugagccaccacugcacaguugaagaguuguagcagagacuauggggccgcaaagccuaauccggccuuugcagaaaagauuugcugacuccugcuucagaauacucuggacaacagaauucgcuccuuaaauuaugguggucucauugggcaguucuuugaagagaagauuaauauuuuuuugaaagacaaugaaaucuggcccugauguucuaauaaauauuacuaaaugaauggaaaugcugcaacgcugucugugccgagagaccaauuuagaaacaggaggccucuauaaugagaaacuccuggauuaacaccuuggaaaggucuaaguuacagugucacacugaaucuaacucuagaaagcagugguaacagauucucuucuggugaguggcaguuuuaaggaagccuaagaauguccacaagcuguggugaaagggaaaugguggauuucuucccuguaucagggcugguacacaccucuggccaaacaaauaccccagguuguuuuacuuggcuguucuuguucuuucuugcuuagauauucucaugggaugggguggaggaaggacgugaagauuuugaaucaaaauaacauguauaguggguaccuaagauaaauuagagaggacccagauucuguguaacaauggcaguguacaggacaugcccaucauuuuuaaauguaauuugcaguuguagcagguuuucucuuuacacugugaagcuuuccuucaucauugcagcucagagagaucuaucuuuuugaggcaggaaugguaaauaggagguauucauacuaaaauguccucuuucugguacccauggcagauauuucuaauggaacacagcuuucuuuccugugcuugguuagaaaugucugauuacggccaggcgcaguggcucacgccuguaaucccagcacuuugggaggccaaggcagauggaucacuugaggucaggaguuugagacaagccugaccaacauggugaaaccccaucauuacuaaaaauacaaaaauuagcuggccaugguggcgagcaccuguaaucccagcuacucaggaggcugaggcaggagaaucgcuugaacccgggaggcggagguuguaagccgagaucacgccacugcacuccagccugggcaacaagagcgagacucugucucaaaaaaaaaaaaaaaagaaagaaaugugauugaaucgaugcagucucauaauucuucucauucuucucacuguagaaggcacugccaguggaucugaguggugugcaagaugaagccuauuugccagugucuuaugguccuccucguuggcacucaugucauucacaugaccucccacugugguuauuucugugcacguuuucccggcagguuuucucaaccauuucaguucuauacuccuuaaguacagggucugucacucagcaucugccacaguuauuucuggcccucucuguuuuaauugaagcuccucuaggcuagaaccaagaucucacacuucuuuguguccuacauagugcuaagcacaaugccuugcccauagcaggcauucagcagcaauucgaugauuguugauugaccacauguagggaagccucgugagaucuguguaaugguggcuucauguuggggugaugaccacggugaggauuggaucaguccuccuaagccccagugggaguuugccagaggccauguaauucgaaggacaggagaauaagaugugcuucaaggguuagaggaaggcaauucuacuccgugcauaauuauugcaugccuacugugugugcugcgcugagcuaguagcuguggauaugaagauggauguugacagguccuacccuccaaagcucuuacugugguggggaagacaauugcauaaaaaugauggcucauagaagacagaagaaaauaagagcaaauucaaagacaaguaauggggcgcaggaagcauccugugagagguucugggaucucacaugguucugcuugucccauuuaguuucagaagaaucgacgagaccaggacgccaccaaacacaagcucauagagaucgccaacuauguugauaaggugagaccagguguguacuuugugggaaaggugccaggugccagcacuuccaagggcacuggagcugccuucugcuggauuggcugccccagccaucuucugaaagggaaugagcagugccauagaggcccagggcggucaugacagagcccugaacuacguacccuuaggcaaguaacucauuuucuuuguguugcauuuuuuuuucuuuuguucuguuuucagcuuauaaauagaaaggcugucguaaaucaaugugugguuuuuuuuuguuauuuuuauuuuccugguggaauuuuaaaaaaugaaaucuuaugccaauaucuacuauaaaaguuagaugaaaacagacugcucuaagugggagcuggggugaggacccagaacacuguccuucugaccccuuccucuuaccccugcaguggcucccgagcagcuuggggcauggaagagcccaguuuaagaauccuuuaagguucuuuaagguuccuuccagauacaaagcccagggauucucugacuuaggagggaauugagguaggucagggugggaaagacacacagccuuaaaaguugagaagugggcuguuugagaaguggguugcuugagaagcggauugucugagaaguggguugcuuggggcuaaucuauaaagucuccaucuguaaaguuauccuaaaauuaugucuugucucuuaggaaggaugugcagugguuaacuuuccuaggucaggaccuuuuacaagaugcucuucggaaauaccuacauuuuugaauuuuacuagaacgggcuggucugggacuuggaaguacauuguguauaugaaagaagauauuuguuauaguacaaaaugcagaauagguaaccuagaaugacaguagccucuugguaggcuaguaguauauaguuuuuaaaaguaguuuuucauguguuugggaucaaaagucucuuugagaaucugguaacguuuauugcacaauuuuagaauacucauaacauugaugaagcuuaacuuugggccugcuagggauucaugaauuccaggucuaaagggaaaaucauuuuuuccuaaacacuagagaauauaggagaucacuuaaaauauguuuuagggauuaauaggcaaauguauuaguucugaagucaucagauggcaguuuccaugcccaugguuuuuuucugcccuagauggcucuggaaacaaaggucaguggucagugacaggugaaagucaaacacuggcauuuccuggaaggacagacucuagggacacaguccaguccucccucuagcuccugacucacucaagaauaacauuuaaauaauccuacaacccaaacauuugacaucugggaaaacaagggaagcuuguuucccuggggagaauaugggaggcugacucugcuuucccccaugugacaucuauuguuuggagaccuggcagguucggacuuggcuggguauccccucugugggguaugugauggaaccaagggcgcuggugacaagugaagggagaagagaggcaccagcaagccccaguccuuacugaaagcccuaagccuggguggcccaugcauccugugcagccgucuuggcucucuccucgcggcugguguuagucacuccuggcggguaagggaagccacgcccacuucucuggagcuugcugaccuagcuacuugaacugaacuauuguugaacuaaaacuggaaugaauuggacucgugcugagucaugaacccaauccaaaauguuuuucuguaacugugaaaaaaagccaaguuuacuuccuucaaaagcucccuaguaaagcaaauucaaauuggaaucugaaccuuuuauuuucuguaacgauugaacuggcacaaaacagaaaaaucaaaauuucuguugaaauaaacugauauuucacugaaucuggagcccaucuugaccagcguuucuuggagcgaguggauuaucuggauguguagguacugcagcacugaaguaguaaagggucacaaauaggcucugagguuguaauuugggccuucauccuggcuccaccaucuucuugcugagacuuugggcaaguuccuuaacuucucuaagccucagugccuaguacguaaaaagugguggaaaaauguuggugcuaugauuauucuuuucagcuggggcaguaccuaccaauuuuggauaaagaugguaucuccugcucauuauguccucuccauacauggggcuuuuuauuaagucacuggcucaguauuuguaggguggacccaucaaagaacccguuguauccacaccuuccagugguuuagcuuuaaagaaaacccuccuccugcuuauauuuguaugaggugaaaaaugccagaucauaaagauuagauguagcucuagccucgaggaggucgagucagaucuuggguauagaauuucaggaucucugguuuggacaaaacccugaagauuaccaagaacgucuguagucuauugcuugcaaccugcuuauuccauccuugacaaaaccugagacuauccagggauggggaagaaaauuugaagaguaagcauaucugugcacuuuuaugucauuuauacucauuuacuuccaaaaugagugggagacauuuuauaauaaaauauccauguauuaauauaauuugguauauccauacgaaagaauauuauucagcaauaaagagaaaucauaaacgaauacacucuaacacauggauacaucucaaaaacauuaugguaagugagagaagccagacacacaaaaccacauauuguaaaacaaauguccagaaaaggcagaauagaaacaaaguagaugcacgguugccugggcugagggugagaaugggaaaugacuaucaauagacaugagggaucucaccgaugugaugaaaauauucuaacacuggaugauggcgauggcuuuauuuuauuuuuauuuuuuuuugagacggaguuucgcccguggcccaggcuggagugcaauggcacaaucuuggcucaccgcaaccccugccucccggguucaagugauucuccugccucagccuccugaguagcugggauuacaggcaugcgccaccacgcccagcuaauuuuguauuuuuaguagagaugggguuucuccauguuggucaggcuggucucgaacucccgaccucaugugauccauccaccuuagccucccagagugcugggauuacaggugugagccaccacgcuuggcuggugauggcuuuaaaacuugguaaauuuaccaaaaagcauugagcuguacacuuaaaauagauggguauuaugguaugcaaauuauaccucaaugaaguggcuuuaaaaaaucuauauacaagagaacuuuuuagauacccauaagaaagauaaggcucacauaaggaauugggagaaaaaaauuguaccagacagccuggccaagggcacugauuacagaagacagcaaagcucagcucugagcuaucucaugaccagcuuuguuugaaagccuucuuccuauuuuaaaaugaaauuuauguuccugucuguuuuaccuauugaccuaagcccuacuugaacaucaugcagaacaacuuuuuccacaugauagaccuauucauaucugaaagcaauuuuauguccuaucucagucaucucuaaacaaagucacugcaguucugccaccagaauguccugcucucucucaggaucucauuuucccuuucuaaaaaaugucaguaacaccaguugccuccuucuguuggagccaugggcagaagagaaaucugguaucugugcucugaguucuuaggcuaggaaggagcuuuuuuuuuaaauuuauuuuuauuuuuuaguuuuaguuuuuuucuuuuuaaucucaagcuccaccagaaugaaaggaaggggcuuuuaaaucccaggugguauugacagauacugugguuuuucuguguccuuucaguuuuaccgauccuugaacauccggauugcucucgugggcuuggaaguguggacccacgggaacaugugugaaguuucagagaauccauauucuacccucugguccuuucucaguuggaggcgcaagcugcuugcccagaaguaccaugacaacgcccaauuaaucacguaaauagccuuuuuccauauguuguguuguccuuggcugcaaagccucugcccacccagcacaugcucagaguuugccccauggcgaguguugguuguacaaggccauucugacucccugguccagagaaucaggcauuuccuaaacaugcgcucuguacccagcauaccccagaaaauguuuaaaagccugagucacauuauuccuaagaaauguuuacagucuaaugggaaaauuagacuuacacauauuccauugagcaucugaaauaauuguguauguauuugggaagggacugacuguuggucaggucuuagacuuucuaagagacucaucucaaucuuccuggcgcuuuguucuaauacaugagcugaucucccaacacaggcacaggagagcgggcuccuuguguuguccuucacuugguucccaaggggcacaaggcugagugcuugagagaguccaaguguuagacagugcaggaacugaggguuugguuggagggagacauugaggagggauugugcuagauuuucaucagccugggagagacagugaugggggucacaugugacagugccccagggugauuauuugguauuuauuaguguugacuucugaagguauuuugaggcaguuacaacaaaaggcauauagauaauaaaaccauuugucuucuuuucuuuuuuuuuuuucuuuuuugagacaguuuccgucugucaccuaggcuggagugcaguagcgugaucucggcucacugcaaccucugccuccugggcucaagcaauucuagugccucagccucccaaguagcaggcaugcaccaccaugcccggccaauuuuuguauuuuuaauagagacaggauuuugccauguuggccaagcuggucuugaacuccuggccucaagugauccgcccgccucggccucccaaaaugcugggauuauaggcgugagccacacaugccuggccuucaaaccauuuuucuucuguucccuaaauauagcugaguuaauaaucauuuaaacuuuggcuuauccuuuuaaagaaacugggaaaaauaacuguccccaaaaccugggcuguaaauaguuacuacauuugccuaggaagagucuuuggcuauuagaacuuuuggccugaacuuuggaacauguagaaaauaacuaguaggacuucauaucaauuugcauagauuuugcauauuucuuugcagauuguuucucugaagauaagucugccuguaauucagcaaacauuuauuguauacccacuaugugugagauucugugcuagguucuacgaucccaaaauaguuaagauagucuugcugucaaagauaucauggucuagaugagaagacaaacguggagauaaguaccacauaaugaauuuccauauagguucuuuaaauacauuacauguuuguggcaugcacagaaacacugguaguuuuuuuuuucuucuccucuacccuggauguauauaacugaaagagggauguauucaacuggggaaaaugaagcuugcugcuggcagauuaggaucccauugcaaaacaaaggcagaaacagcucauucuugcauccaacugcacuuugugaggcuccugauggggcacagcuguuuccuuggccccugaguaugugggaaugaagcaucaucggccccacagcugcugccccgaugcccccaccccuacccugugggacucacaccacagagccagggguaagguauuggaucccggcagcugguggaagugggcaugauucacuucagcaucagaaucugugccacccuuccaucaaccucuccuucugaccuuuuccugugcagcaggaaugcaaugcagcuuugcaaacccugcccauuuccuuccaaggaaucagcuauggguauauugugggagauaaacgaccuuucucucucucuuuguguuccucuggagucaugagggaguaggugagaggaagugagagguguggugagcuggaaguuguccaguuggccugguuacaagggccucuccccuugggaaugaccugggaaagucagcggguccagggaaccccgugauggccacuuacucccaggcacauuggaacagcccucuuagucucguccccggucaccgucucuccuugccuccugcaggggcauguccuuccacggcaccaccaucggccuggccccccucauggccaugugcucuguguaccagucuggaggagucaacauggugagucucagcccgugugugugcgcugcagaaggcgcugagcugccuuucaagaccagaggucaucuuuugaauaauaaguugauauuuauuauuguagcagaaaaagcuuugacaucaggaagggcaauuguuuaaaaugaagucauuaaguucuaagagauggagguacugaagggugaauuuucauuuauuauaguucauuccguaucuucaagcucaggaacccugaagagauuacaugcauacaucacuagaucucauauguuccaaaccaggggcuggaaaauaguaagagaguagagguuaaaaguauuuuuauuucaggucgugugcuguuauauaugucauuaagaaacaagaaccugucucaaagucaugguuaggaaauuacugccuucuuuugaaauucacucugacuucaugagacuauuuguuuugacucuucauuucuaaccugugaagugcauaucaaggaagacuugucuucaucuauuugucugucccucuauccauucuguauuuaucgacaaaguagcauaauggccaaaaccacaggcucuagggucugagccuguuggguucaaagaacagcugugugauuuugggugaguuaaugaguguucucagcuguaaaaaacgcauaguuuuacaguugauaaucauaggauaggaaugggaauuaaaugaaauaaugcaggaaacacacuuccauguuuaguaaaucucuuucugcugcuucuuuccugcuggguuuuuuuccucuugauuucuuuagcuuuugcaucaucagacaguacaccaagugcugugccuggaguguaucugucuugugugguuuucucaggaaacacuaagccaaguacacccuauguuugaaucaaggucguguuuucuauguugauuuccuuaugucuggagaaauauauauguucagaagaagaauggggaaaaaucuuccucuuuuauuuauucugaaagcauuuauuggucuggaaguucauccauaggucaguuguggucugcaaccuuugagaacucaggaaacauggacuuuuaaacauuugauuuccuccuagugacagcagauucagccuugcugucagaggcacauauggagagucuguaugcucagugacaguggaauugguggagaccugcaagacuuggcuaaggauaaggcagggauggggggcagaggcagaucuguccccuugaccuugaccucaacucugucuucugagcaggaccacuccgagaaugccauuggcguggcugccaccauggcccacgagaugggccacaacuuuggcaugacccaugauucugcagauugcugcucggccagugcggcugauggugggugcaucauggcagcugccacugggugagucaaacagcaagagggaggauggggaggagggcgggcacaccuggacagugugacccagggguuccucccagcuggccccacugagacucccuuaaacuucugauggggccaaaaaauguaguuuuuacaacaaagaaauugagagaagaccaaggcaaaugugcagcaagaacuuaacuuuccagcaggagguuuggugcugguguaacccuagauuuauuuaauuucuguuuuaagguguugaguuauaaaauuggcuuggccauaugugucuuuuuuauuucaugaauuuuuuaugaggacacauuuugaucauagccacagcccuuaauucuucuaucccaagagaguuggaucagugcuguuucaauuccaggcuucacugaaagcuccgauguaacagaacaaguugaagaagagggccauccacacaccccacagugacuucucagggaguuugcaggccacauuacccaugaggaacagggugaggcagcugcaucucccuguggucaugaggaaauuuuuuuuuuuuuuuuuuuuugagacagagucuugcucugucgcccaggcuggagugcaguggugugaucuccgcucacugcaagcucugccucccagguucacaccauucuucugccuuagccucccgaguagcugggaauacaggcgccugccaccaugcccggcuaauuuuuuguauuuuuaguagagacaggguuucaccauguuagccaggauggucucgaucuccugaccucgugauccacccgccucggccucccaaagugcugggauuacaggugugagccaccgcgcuggacaugagggauuuuuaaaaccagagucucugaagagaauuagggaguuucuucaaaggacuugucuucuagcaucugaacucaggcagcacaaagcauuggguucuuccaggcucuuuggaaggcaucacguugggaccuuguguuccuucaccccacaccauuagggccuguuuaugauucuuagagaaugguguuucaaugucuccaagaaacagugcagcuuucuuagagcucuggugucaauuuuuuaaaauuauuucucagcugugacauggaaaggaugauguuggcugggugcgguggcucacgacuguaauuccagcacuuugugaggcugaggugggcaguucaccugaggucaggaguucgagaccagccuggccaacauggugaaaccccgucucugcuaaaaauacaaaaauuagcugggcgugguggugcacgccuguggucccagcuacuagggaggcugaggcgggaaaaucacuugaacucgagaggcaaagguugcagugagccaagauugugccacugcacuccagccuucagccugggcaacggagcaagacuccgucucaaaaccacaacaacaaaaaaagaaugaggcaggauacagcuucacagucaugccuggaucccuauaagcucaugguuaagcucaccccuuucucucucaaucuaaaaagcguaucugaagacaaaugauugagaguuauauugauuacuacucucuuucauuuuuaaauuauucacaaauauggauaguuuaacaauuauuaguaacaaauuccuuggagcauaccuucccacugaaggaaaagcuccaguuucuuggaggguuuaaccuuuaauugguuuagagaauugggagcaggauaacucuccuuuuguagacccagauggcuguacuauuuguccuuuucaccaauggugggacccaggaccuuccauacuccugugauaaagagcaugcguuuaugaguuggcugguugaguuuggaaugcccucugcauccuuagaacagcaaugagaucacuggcccaaaaugaaauaaaacuuaugaucuuggccuuuuuuuggccugguccucugucacaagagaauauucaccugauaucagcuucaggaaaaguuuagguuggcugguguuuucuucagugcuaagucucaggagaccucuuguaacacacucacaacccuuuacuuaucgcagcccccucaugcaaugggcagaaauugcuacuccugauucucaaaugcuuucugcaugccgacuaagaaaaauagaauguuauggggugguuaauaucucaucacuaaggaugaaagaauucuuuuuuuuuuuuuuauacuuuaaguucuaggauacaugugcacaacgugcagguuuguuacauauguauacaugugccauguuggugugcugcacccauuaacucgucauuuacauuagguauaucuccuaaugcuaucccuccccgccucuugcuacccuacaacaggccccgguguguuauguuccccuuccuguguccaaguguucucauuguucaguucccaccuaugagugagaacauccgguguuugguuuucuguccuugcaauaguuugcugagaaugaugguuuccagcuucauccaugucccuacuaaggacacgaacucaagggaugaaaaaauucuaaauuaauguauugguaaauguucuaaggggccagaauguaugugugugagacaaugggggucugaacccagguggagucagccccacggguagcaggagugacagcacgagugacaccugccugacugcuagaugcucaaacuccccacuaauuccagccuuguccucugccaggcaccccuuucccaaaguguucaauggaugcaacaggagggagcuggacagguaucugcagucaggugguggaaugugucucuccaacaugccagacaccaggauguuguauggaggccggaggugugggaacggguaucuggaagauggggaagagugugacuguggagaagaagaggugaggggucacaauggugcuagugggaggggaagaauuugcauugguuucaaaacucaaggucaaagagaacacaauugaaaauuucuuagucacagguguuuccuacauauaacuguccaauaccccaugaaaaaucagauaugaagaagccuuccaguuggaguguuugugccgccucugcuaguuuguggccagcaucgcuaguguccaggaucaguucuucuuaugagugucuggucuaaccagaaaccacgaucacguggcauguugacucugucuuccucaguggagcugcacaugccugcuugcccuccagcugcacggaauuuauucuggaggccacacagccagauauaugggcuugaacaggggccuuaugaggaugcuuaaaauaacaagcucaugcuguuuaggcuggaggagagaugauggaaaggggauguaggaagugcugucaagucccaaaagggcugcuaggaggaacuguuuauguguaaacucucuccuuccuucugaucuucacagugaguguggaggguacacggcagagcccggucauuuuuaacaaaugcaugugguuucugcagaaagcagaacuggauuguuucgucucuauuuuuugaaggcugaaaauauguauguuuauacaugcauaacaauuugggguagauaacaaguaacaguaaauuaugggggugagacugagguucuguauaaauggaaaaaaaaaucugauuuuauggccuucucucucucacucuguugcccaggcuggagugcagugacaagaucuccacucacugcaaccuccaccuccaggguucaagcgauucuccugccucagccuccugaguagcugggaauacaggugugugccaccacaccugguuaauuuuuuuuuuuuuguacuuuuagcagagacagaguuuugcuacauugaccaggcuguucucaaacuccugaccucagaugauccacccaccucggccucccaaagcacuaggauugcaggcgugagccaccgcacccugccugugaccucugugaugugauuuuucuuuuuuuaaugccaguaugucacuuucagaauaaaacaagaacuagucaaggaugccacccccaccaccaugagcccagagagaucaacacagacccaucagaaaggagggagugguaugaacauggagggccacugggguugaggaauggccugagagugggcauggccaguuggcuuagguucugagcaguugcucauucaacaggcacacugagugugggcuacugugucugguccuaggguuaggaugaguggcaaaaaugacauaguuccuguccuuggggagcugauagucuagugggagaaacacauauugaaauaauugcaaaagaauauauguacaguccauggcaagugcuaggaagacaaaugacacagugcucugaacauauauaaugugagggggaaccuccuugcuugugugggaggugaccuggagcccauaucugaaggcugcauuaggaguuagugaggcacgcaggagggaaggcacauuucagguggaaggggagccugugccuucgugggaagaaauaugguacauuaggaaggcaggaauacaggucuuccuggagcccaacauggugggagaauaaugggaggaaaguguucuauuccuucucuuaggggagacagguggacaggugucuguggucaggggaugggauguggcucuccaauaugcuagagcccuggacaguuagggguauaagguugauaaacaugagguaggccucaggcagaccugacuugaauucagcaggugugucccucggccagcuacuggacuugccugagccacagcaucccugucuguggaauggggucaaggcugccucauaaggcugugguggagagaucuguggagccccguacacuuuucaucaauggcugauggauuggccuguuaauacuguaagagugugaugaggacgcucagggucacuggaacgccucauaaucuuuuaaaaaucucaggcugggggagagcaaggaacccauggagaucuucuguuccagaaagguccaggccaggaagggcuuaggaagagaagcagauggagaaaaaaaucuaaggaaacagacccaggaguugacauaaacuguuuggagagguuguuccagcagacucuugcaccggcagccccuuuucaugagauaagaaagccuaggaggguugggggcaggagggcacccaugaaagacagggugucuggauguucuacuggggauuagaaaaacaaaacauaaaauuuccauauacucugcuaaaaaguccauuuuagaagacuacaugguuacagggagaaauacgcauguuauauuaaguaaaaaaacacuguggauacuaugauuuuguaaaguaaguauaaauauauauguauguguguagaaaaugccuugaaaaauauucauacucaaaauguagcuguguccuagcggggcaugguggugugugccuguggucccagcuacuugggaggcuguggcaugagaauugcuugaaccuaggaggagaagguugcagacugucucaaaaaaagauguagcuguguccaagucauguuacuaaugauugugcauauauaugguucuugugacaaguacacauuagcuuagugacgaagcugucacaugauuuuugaggucaaaaguuuccaggccaggugcggugguucaugccuauaaucccagcacuuugggaggccgaggcagguggaucacuugaggucagaaguuugaaaccagccuggccaacaugacgaaacccaaucgcuauuaaaaauacaaaaauuagccaggugugguggggugugccuguggucugaguuacuucggaggcugaggcgggagaaucgcuugaaaccaggaagcagagguugcagugacccgagauauugcaucacugcacuccagccugggugacagaucgagacucccucucaaaaaaaaaaaaaaaaaaaaagagauaguugcuagagagcugggguuccaggggugugugggcaaggguggggaaaauguuggggguggugaaggcccucccccacucacacccaccccacugccuccccaggaauguaacaaccccugcugcaaugccucuaauuguacccugaggccgggggcggagugugcucacggcuccugcugccaccaguguaagguaaguggcccuuuucuccacgccuugggcccuggccugacagugggaccacaggacugcucugcugggguggauggcuggggauuugccuccauccuggggcugugauggcaacagaguuucagaaacacagagcggaaaaggugccuugaauaaaauuuacuauuccuauacugggccucacugaauucagaucaucccagaggaggguggcgcuucuuuggaaaugguacuuuuuuuuuucuuuuuuaaagaaguauccagagagagugggcuugauuuuauugagcucauaaacaauaauaauuaucaucauuuguauugacauuaauggaccucuuaguagaugccaggcacugugcugggaauuuuauguacguuaucucauucucuccucacaaaaaccccauaaaauauaugugacuauccuuauuuuaagauguggaaacuagagcuuauaggggauaagagguuuaucuggaaucaggcagucaggaagggacugaauccagcuuucccugacucuggugcccacauuccuaauauugaugugagagauaaauugucuguugcugcuaguguuaccguagaaccacaaucucucuuccacaauucugaaauuaagggaguucuaaaagcugaaaaaaaauguaaacacauuugguggcaaaacuugaccugaauugacaugagaugaauuauagucuuuuuaaaaaaaaaucacuccuaaagugaauauuuauauugcauuacagaaauauuaauauguuugaucagaagguguuauccccagccuugcugggggguuauguaauauacauauguaguuauauaugcggacauauguaauuauccauauccauauauauauauauauauauauacauacacacauguguaauuauauauguacacacauguacauauggaccuauguauuacaauaucugcuuucuaaaucugaaaagccugaaccccaucuggccccaucauuuuaggcaggaacugugggccugggcuucugccuagcacuugcugagugcucguuaggggccagauaccauucacauacuuaguucuaacucacguuuaaucacccauuaguggguuauuauccugaguugugggugagugagcacacacagguuacacagcaggugcccaaggccccgcugccgguuaaggagcugggaugugugcccaggcaggcuggcuguggggcagguccucuuugccuccaccugccucuggauggcagagguguguccugcagccuccuccugcauacaccacccaugcccacacuugcgacugggcauccacucucagcaagcugcucagcuggcccagucuuggccugagaguggccgguggagaagccugucugccuucuccuggaaggacccugugggugggaggaguggcccaggagcaggggagggggucuguucucagucacugguuuccuugccuggcucucggaaugugcacggcaucugguuuggcugugcgucccccugggaggcugugcugggucaaguucuuccagucuuggcccaaggccuaagcauaagcauggaguggaccccuucacuccacacaagaauuuccguuugagccucagaaaggauucccugguguccaagacugacuucaaacccugguugugugauuuggggcaaccuauuaacucucugagccuagguucuuuaucuguaaaauggaaagaguauuaguaacaccgacuacccagggaggcuguaagacucuucgcccuuugccccaggugugcuguugaucaacuuauugaucugcaaagugggacaaauagcaguaucuaucccauggaagcugugaggaucccacgagauacguguaugucacacacucagcccagugccuggccccauaguggggauauauuauugcugaggugcuuuguaaacucacagauguuaugugaaugcuaguuuuguguguguguguguguguguguguguguauuagugggccuggcuccucugccacuuacuaugagucuuuggaugcaucgucuaaccucuuuaagccuacagauuuuaucaucugcagaagggauaauuauaucacacaggacugucaugaaaacuaagugaagucauauuuguacuggacacuuaagugggagcugcauaaaaguagcugcuauuacuaaagcauguaggaaacuguaaauuguuguauagguauuauuucuugccucuuucuuaagacuucuaugaagagaaagugaguuagcauuugugaaaacagcuugaaauucugucaguauucacaugagaaggcugaaggugguuugggcuaaugaggucauguaaaaagugcugugaaaucaugguaauggaaaauucuguucuaugagagugauccuuaugagcccuugggcaacaggguugaggguggggaggagauugacuguguuuuccucucauuccuuggcucagcuguuggcuccugggacccugugccgcgagcaggccaggcagugugaccucccggaguucuguacgggcaagucuccccacugcccuaccaacuucuaccagauggaugguacccccugugagggcggccaggccuacugcuacaacggcaugugccucaccuaccaggagcagugccagcagcuguggggacccgguaaggcucuccuggggagcacggcucuccccagcccaccacuucccagccagccuccccuggcccucaggguaguuuggaaucuuggcuucaaauggcaccucuagauacuaccucuuucauccccuugacucaggguagauguucagggagaaccagaggacaguguuccuucccagucccuugaugcuuuuauuucucagaguggacaauugaauaagaguaauccaaaagaaaaaugagcagaggauggagacagagaagcaaaugcaaauggcccuuaagcuaugaaaagacguuuaaucucagucauauuaagggaaagcaaaguauaauuaugaugaggugagauuuuucauauaucagauugcaaagacugaaaguuaagauaauaauaauauaacaacaauaauaaugauauaguguuguggagggugugaagaaacagguagauauaaccacuauggaaagcaauuuggagauauacuuagaaaugcagcuaacacuugcacauguaugugaggauauauuuacuaugauguuuacugcaccauuguuagccauagcaacaacaaccuauguguccuucaguagggaccaauuaaauuaauucugguacauucauauaaugcaaugcuuuauggcuaaauaaggaggcagcccuauauuuacugaauaaaaucaucuuccacaaaaaauuaagugaaaaaugcaagguguagaacagcaaauaaaauaugcuuucaagccagauuugguggcuugcaccuguaauccuagcuacucagguggcugauaugguggcuugcaccuguaauccuagcuacucaggaggcugagguggggggauggcuugagcccaggaguuugaggcugcagugagccacuccacucuaggacuccagcccaagcgacagagggauguaccaucucaaaaaaaaaaaaaaaaaaaaaaaaaaagacugggcacaguggcucacgccuguaaucccaguacuuugggaggccaaggcagguggaucaccugaggucaggaguucaagaccagccuggccaacauggugaaacccuguaacugcuaaaaauacaaaaauuagccaggcguggugguggacgccuguaauuccagcuacucgagaggcuaagacaggagaaucucuugaaacugggaggcagagguugcagugagcugagauugugccacugcauuccagccugggugacagagcaagacucugucucaaaaaaaauaaaaaaagaauaugcuuccauucuuuauuagauagauuaucucuagaagauacacacagaauuauaccuaggagauacagaaauuagagauuuaaguaucuuuagaaaauauacuguuaauaagugcuauuccuccaggauguagagaaguaggaacuggaugacuacaagaaaaauuuuccaagacauacuuauaucuuuaaaauauuaugcauguaugaccuauuuuuuaaaaucuugaaucggaacauggcuucuucauuagagagcaggcuuagcaugcaacccuccccacacacaaauauaaauccucaauaagguaggaagaauuuacauaaaacaggccaggugugguggcucacgccuguaaucccagcacuuugggaggccgaggcggggggaucaugaggucaggacuucaagaccagccuggccaagauggugaaaccccauuucuacaaaaaaaauaaauaaauaaauacaaaaauuagccagucaugguggugggugcuugucaucccagcuacucgggaggcugagguagagaauugcuugaacccaagaggcggaggaugcaaugagccgugauugugccacuguauuacagcuugggugacagagcgagaauccaucugaaagaaaaaaaaaaggauuuauauaaaacauuauucucugaguagaucuuguugagaauauggggauggaguaaccuggagggaacaggaagaagaggcugaguauucccucccagaaaauauucuuaccuucaugacuuuaccaaagauaccuuugcccuugggggcuucugacagaugaguauacugauagauguugcuugcccacccaggagcccgaccugccccugaccucugcuucgagaaggugaauguggcaggagacaccuuuggaaacuguggaaaggacaugaauggugaacacaggaagugcaacaugaggugaugaccaaagggcaggccucaugaaaugaggaugaacaagcaguuucugcucuguccucacuguugcccaacucagcagugugacuggccccagagcugcaccuuuacgucaaucaguugaagucagucaucuauucucggcccccuguuugacaaugcacuuuucagcucugaggaagucagaggaggguguggguggcagugcuuccuagaaagcugaucgggcuuccuuuggggaccaucuuacaguagggcagggaaucagcccuuuugggucauuucugccaaauucuaaucaugcccuaauuugaauagcuccucauucauuaauucacucauucauucauuuauucaucauucauuccaaccaaccauccacucaucugucuacccauccauccauccauccauccauccaucuauccauccaucuaccacccacucacccacugauccauccaucuauccauccuccaccacccacucacccacucauccauccauccauccauccaucuguccguccaucuauccaucuacuaucuauugaagauuuacugucuaucuacuaucuauugaagauuuaccaugugcaagauauugugcugagugcauggaacuucuaauuaacaauauaguaugacaauggcaauguggagagagccauccaacccaucuuagugugucagagugguuucccaaaggaaguuauaccuacacugagaucuggagcaguuaccucggugaacaggguggaagguggugcuggugcauaggagaguaauccaggaagagagaugaauagagaaaaacuggugguugaaagaacugagaacaguuugauacaguuaaaguauaauguuggggugcaaaggagaaggucugcugagaaauuagccuggauaguuuagcauggaccagaucaugaaaagccucaaaugcauggcuaggggaguuuagauuuuagcuugagagcagugugaaaauuagacuccuaugaggcagacuggaggcagggaaaucaaucuucugcagaccagguaagggggguggggcagugugaauuaagguagauagauaauaagauagauaauuaaggagggaagauugauaggguuugaaaauggcuugagcccaggagugagggagaauggggaguuggagaugaccccagauuucuagcuggaacuccuggguggacagcgguauaaggggcaaaaagggaaagauugcucagcucagguggcuauucuuggaguuaaggacuuuucgaggccaguucucuggucuagauuugcucagggucaaggagccuguucucuucccuuggugucaguccacauggaaucucuccugguggguuccaaagcacaugacugcccuaaaccuuugccccaccccacgcaagccugcugucuugaucaagaaagacugaagcucucuggugccccagcucuuccucugccucugauuccgcuuccuucccucucugucucuugugcccagagaugcgaagugugggaagauccagugucagagcucugaggcccggccccuggaguccaacgcggugcccauugacaccacuaucaucaugaaugggaggcagauccagugccggggcacccacgucuaccgagguccugaggaggagggugacaugcuggacccagggcuggugaugacuggaaccaaguguggcuacaaccaugugaguccccuccccugcucaccuaggagccagcugcagagcagagugauugagaagugaggucugagggaaggaugccugggcucagaugccaccucgccaaccucugagccuugguggcucccuucaugaagcguguauagugacagcaggcacccaccccagagaacugucggaaggauuaaagaaaaucaucccaguaaagcacuuagguggccuagcuagugccacuuucauccucaucgcuaauuaucauaggaauuaaaaauggacuaggaguuagggaagccugagcaaaauaauagcacagacucuauccuccagagucgauucugauaaugaaacuauggaaaacaugaagcauuuagcauagcaccuggcacagaguacugucaccaucauuauuuuuaaauauaauguuaaaauugauacauauuaaugacaaguaauuaacauaaucaacauaauaguccuuuaaugugauaacacauaaauaauauuguauuguuaaauaugauacuuuaacaauauauuugucguuuucucccuaaucacaaaaguaauagcagaauuuaguuggcuguuguccuguccuuagcguugugggcuguuuuccauuuuucacuuugauaguaaccugaagugugcugccuauuugggcccucauacuuuuuuucuuuuaagauggagucuugcucugucacccaggcuggaaugcagugguacaaucucggcucacugcaaccucugucucccaggcucaagcaauucuccugccucagcuucccgaguagcugggauuacagacacaggccaccaggcccagcuaauuuuuguauuuuucguagagauggaguuucaccauguuggccaggcuggucuugaacuccugaccucuggugauccgcccaccucagccucccaaagugcugggauuacaggcgugagccaccaggccgggccauggguccucauauguuccaagugcaaaaucuugccuccuaacucccaaccagcaucccucccauugcacugaucguucuguuuucucuccgugcagauuugcuuugaggggcagugcaggaacaccuccuucuuugaaacugaaggcugugggaagaagugcaauggccauggggugcgugcuggguucuggcuucucugugucauggggacgucaugagggcaggcccuguggguggcugaugcucucuggggugcugaugccucugcccuuucuuugcuccaggucuguaacaacaaccagaacugccacugccugccgggcugggccccgcccuucugcaacacaccgggccacgggggcaguaucgacagugggccuaugcccccugagagugagugccagccugcuggggccacugcccgcuuuugugagaagagcgggcaucaggggcagguggcauguugcagagcauccacauugaaucagcuucauuguccugauuuuguagagaggaaaucaggauaaagacagaccaagagagaggagcgacugcucauagugugguguggggacacgguucagucucucuucucccauccuuucuacugaggagggggagcccgcuuaguagagugagaguaagagagacuguaggucauugaauguucccauucuuuuuaggggacacggugacuauuucucuuugggcacuuaaaaauaaucaugaaccugggacacauuauggugguuuagauuuccucugauggacacaaguuaaaauggagaaccagacacucagaaaauuuuauaguauuuuaguggaucucucaaggauucuagcacuaugauuucuaaaguuuuuuuuuuaaaaaaaauagcaaauaacuuuaaaaaaaaagcaccaaaaucuuucaaggaagaaaccccaauauguaaaacugauaaaaaguaguguuuuguuaguacaaauacguucucuauauuuacauuaaccacuugagagaauauugggguaguuuugaugaaaccaaauguuaaguuauggauuaugggugagaugucuagucuuaaaucugucugagucuuuucguuucuuuguuuuuuuuuuuuuuuugagacggagucuugcucugucacccaggcuggagugcaguggugugaucucgacuuacugcaaccuccgccucccggguucaagugauucuccugccucagccuccugaguagcugagacuacaggcaugugccaccacaccuagcuaauuuuuguguuuuuaguagagacgagguuucaccauguuggucaggauggucuugaucucuuuaccuugugaucugcugaccgcggccucccaaagugcugggauuacaggcaugagccacugugcccggcccauaauguguguuuuuaauuauaauuuguaaguuaaaauaaguaauacaaauuaaaugcaaaucaaaugccugaagaagaagcacgaauaccuauuuugaaaucugcuguagccgagacagcuucuaaaucucccacuuggguucuguuucuggaagguguggguccugugguagcuggaguguugguggccaucuuggugcuggcgguccucaugcugauguacuacugcugcagacagaacaacaaacuaggccaacucaagcccucagcucucccuuccaagcugaggcaacaguucagguaugacaggguucaauggaggacucagggucaauuuaugggucacaaaggucuccauaaaugguacuuagcaaaaguguuggugauagugggucuaauucagggaagacaagugcaagauacaugcugcccucuccccugcuaugacugugacaggcauuacuaguugaucuuauuguaaguacucuacugauucuggucaucacuccugaguucuucucagcagaauauccccaaccaaaucaaguugaaauauaaaauaaaaucuauuugccauccuuugucuaguugauuuauuccccauuuuauuuuauuuauuuuugagauggaguuucacucuuguugcccaggcuggaaugcaguggugcaaucuuggcucacugcagccuccgccuccugaguucaagcgauucuccugccucagcguccugaguagcuggggcuacaggugcaugccaccauacccagcuaauuuuuuguauuuuuaguagagacgggguuucaccauguugaccaggcuggucucgaacucuugaccucaggugaucugcccgcuuuggccucccaaaaugcugggauuacaagcaugagccaccaugcccagcccccucuuugucuuuuuaaccacuguugcuuuaaaguuuguuucaucugguauaagaauagcuacuccugcucgcuuuuggugucccauuugaaaagugauguauuauuuuggauauggaagauguacagucucugagucaccuauuaaauaacacuuguucuggaggggauuuuaagucccaggucuuucuggaucuaugccugauggggauugguugauggcucgugacacccuugugucuccucacaggggaagggucuuaaaagggugaagagaaggugcugagagagcucugcuuuguauaaggccaacucuguuuccuugagaguucuccauuggccacacguuuuucuacuuaggaagaugugguucgagaagaccaaucccacucccuccagagcagacuugggaaagauuuagcugcuugcuggccgugcuugggucaaagggaacucaggcacuguccccugcugaacaucguccccuuucuuuuccucccccauuucuuguuucuaguugucccuucaggguuucucagaacagcgggacuggucaugccaacccaacuuucaagcugcagacgccccagggcaagcgaaagguaagagcuuugcaccacugaacuuugcuacuuuuccuuuaucccucagggccaugcuguauuuuucuuuuugagauggagucuugcccugucgcccaggcuggaguacaguggcgccaucucagcucacugcaagcuccgccuccaggguucacgccauucuccugccucagccucccaauuagcugggacuacaggugcccaccaccaugccuggcuaauuuuuguauuuuuaauagagacgggguuucaccguguuagccaggauggucuccaucuccugaccucgugauccacccgccucggccucccaaaaugcugggauuacaggcaugagccaccaugcccggccgccaugcuguguuuuucuaagagccucugugggcccaugggauugguaauaaaagcccuuuuauuggcuggagagacauguuauuugguucugacauccccuaaugacuuuaaagguugcaucugacuucugggauccucagggguuuaauagauuggugugucuguucucccuuugggcucugguuuaucucaaagagacacacaaggccagcccugagugauuucuugucucagguguuccuugacuugugcguacaggugaucaacacuccggaaauccugcggaagcccucccagccuccuccccggcccccuccagauuaucugcgugguggguccccaccugcaccacugccagcucaccugagcagggcugcuaggaacuccccagggcccgggucucaaauagagaggacggagucguccaggaggccuccuccaagccggccaauuccccccgcaccaaauugcaucguuucccagguaaguggauaaucagcaaccuugggcugggaacauugcuuuuaaggccacuuucaauggguaauggcaaagguggggaaggugaaacuuguggggucaugagcugacugccuuuucugcaauucagucaauacgggggcgcacagcagguuagagcaacgaacguggggaaauagacucucuaagaagcuccuaaaccauguggcauuuucucccggguuggccuauuuuaugacaagccacuacccaccuuccaccccauauuaacuucugucaguucccccaugcucgucugccugcuaggucuuuguaaaugcugcuuguucugccugauacgcuccuucucuccuugguggggccaccuccugcucauccucagaucugcuccuagaugccgcuucucccaggaagucuauccugauuccucaauucugagguugaugggacuguacuucucucaucauaguacucuuccuaccaaauuguaccuauugguaccuucuacugauuggaaagucuuagggauguauccugaugccuugcccaucccaaggggcaggugccucugggaggugagaguggggucuagacucucccccaccagcccuggugcucuuggaggcauagccugcccagcagccuguucccacugcgugugugugcucugauggcucugaccacaccuucugcaggagaucccccagugcagacacagguguuuccuggguggcggccggguggggugccuucuggaacuggccuguguguuuugggugugaccccucaacugagacugcuuucucuggguguaauccagagggcuccauggaacccaagcugucucugacccuaaggacucugggguuggcugcaggcuuuggaggguccuugggauguguggcagugguacaguuugggaaggcugagggcauccauucuguuucucugcugugaaacugcugcucuccccuuccuuuuauguggggcagagguaggauggaaaaauccaugcagaaagagaggaaagauugacagggagagagaaggaaagaggaaaggaaaaaagcaagagaggggaggaguggagagagagagguggagaguguacucgugugcugagggugcuauagcagaguacugcacacuggguggcuucaaaacagacacuuauuuucucacaguucuagaggcuaagaguccaaggucaaggugcuggaaggguugauuucugaagccucucucuguggcuugcagguggccgcccucuugcuguguucucacgaggccuuuccuaugcacuucugccucccuggugucugccuguccaacucuccucuucuuaugaggacaccagauuggauuagguggccucauucuauccuaaucaccucuuuaaagaccuuaucucuaaauauggucacauucugagguacucaggguuagggcuucagcauaugauuuuuuuuuuuuaaaugaugagugcacaguucagucccuaacagagagaugaaagaaagggagaaagcaggcguguagagacuugggguuacaggagaacaggagugccagcagagggaggagggagugggucgggcgagcaguccacucagacuguuguucugaaaaacccacacuagaggcauguucagagaacacggggccagccucaccccugucaccccuaggugcugagccguaggucaggaagugucagggacagcggggacccagcugucuguuaagugguggaggcugugcauacccugcaccugcaccccugggacugcuggcaggagucccgggugcaggaagcugcccagccaguggcaggcaccccaaaacacagcccccaagcacagcuucuccugggccccgggucccaggugggugucucucuacaagcgaacagugggaggcagcugcucugagugggggcugcugugaugacauugggcugccaccugccuccucacagccauuccaagaagggaguugcugcagcccucauuucucuuggagguugccaggccucauaggauugaagggacuugcccgacauugcacaguugugaguggaggagcuaggacuugaacccaggucucauccagcugagugagacagccuccugcccuggggccacucacagucuccagucugccaucaaagauuccccaccuccuagcugggggacauggacccccuggagaagugauagaugaaaccucaucacuucuucaguucugcuauucuaaaccggcuuaugcaccugcacucugggccaggcaaugacgaggaaggcagauggcagcuuugccuccaggagcucacauucugcuggggcagugacucugggauaugugucacugcaacagugauaugugcugugaaggagaggcucagggugcucagaagagaguaacgaggauuugaccuaaucugggaaauccaggaagguuucccugagguggugacauuugagcugagacaugaaggaggaacaggacuuaaccaggcugugagggcaagugaugaaggagcuuuccuggucccaggacccacuaguagggaggcucugucaugggagagggcccuguggauugaaggaacuuaaagguuugugugcuugggucccaaggagcuaugagaugaggcuggaaagccaggaggagcccgucuaugcccaggccacauagccuuggucaggacuuuggucuguauuccauaggaagaggacaguggugacaugaugcaauuuucuguugacaaggauugaucacucuuugggauaucuuuaggcaggagagagguguaguuccugcaaggggcccauagaugcuucugaagcuguuaaucuacuguuugaccugcauggggauuacuuaguguauucacguugugauaauucaucuaguuguauauuuaugauuuguucgccuuuuucuguguguauuauauuugaauuuuuaaaauaguuuuaaaaaaugaaagucacucuagaagcaaauggguguccuaguuagaagauuuaaagguuguccugaagaaagaugguaaaagcuuggagcagggaguaggcagggcugaugaagugaagcugaugagaaaugugcagaagagaaaauagauaacgaguugaagauccauugcuuggcaggggaugacgccccgugucaggcuugugcaaucugauugaguaagaugccaucccuuguggaagggagcaugggccagaguagcugagggacuguuucugcucuagaaaaaggaaaacagugcugggcgagggcccugguagggcugaguuggaucaucgcagauguggccuguggcugguugcccugggaggcccagugcugacaugcugaugaggcuccugcccaaacuccagccccucaguggcucauuugcacagcucccuugggagcacagccuuucccaguugcaaccugacaucugcacccagcugucaccugccccagaaggucucuauccuggcuuccagcaaccauugcaacuuggcagcuauucugagcuggggaaggugguggugaagggggcggguuguauuguccuucuagauagagcugaagaacauggcuuuuuggccuuaagaauuugcuuuaguuucugauuccaugaagcuucuuggggaaaaucucggcucuuuguguuauuccugcccucucuaugugcuugccuuuuguccacuuuaauacgugguagugacccucucgagaagggaaggaagucaaggggagcaggcacuggaacucccuucuaugcaguuggcuuccccuuaaaccccaacagcuugggggccugcgggugggacagucauucuuugccccuuaaaaaacaauggaucaacuaauacguguugagcaccuacuguauacuaggcacuguucuggaagccaaagauguaucagugaaccaaacagauacggaccccacacugcuuccacucuagaggggaauggagagacacaaaguaaaaaucaacuggauaaguaaauaaauuauauauguuguaaggcaguaagugauaugaaaagaaaagaagagguauauuaggauaaaaaggucagggaaugucagggugggggcuguuguaauuuuaaauaagguagucagggcaaagccuuguggagauggugagaacaugaagguaauaguaacacaggaaggacagaauccaugaaaugugccacacacauggacaaccaacaugaacaaaauauagcugcugcuuuguuuaaauuuuguuuuaaucuuaacaggcaauacacguacaugcucuuguuaaaaaaaaaaaaaaaggaauguucaagggcugggcgugguggcucacacguguaaucccagcacuuugggaggccaaggcaggcagaucaccugaggucagaguucgagauuggccugaccaacauggcgaaaccccgucucuacuaaaaauacaaaaauuagcugggcaugguggugggugccuguaaucccaacuacucaggaggcugaggcaagagaaucguuugaacuccggaggcagagguugcaguaagccgagaucaugccauuacacuccagccugggggacagagcaagacuccaucucaaaaaaaaaaaaaauggaauguucaccuggaacacaccccuccccuuuugcaccccaucccaguguaaucucuuuggucuguauccuuccuuuuuucuguuacagacauuucuauuaggcggugagcgugcugacuuauuuuaugucaacuauccucuacagcuuguuuguuccaccuaacaacucuugaacaucuccccacgccagccccuaucaaccuacuucauucuuuuuaagugcuauaucaucugucacuuuauaauuuuaguuauuuuucugcugaugaaauuuugcuuauuuauaguuucuuugcuguuacaaacagugcugcaaggaacaaccuugcaguuucauuuuugugcacgugugcaaauaguucucuaacauaggucagaagaaguagaauuacuagaucagagaacaguuauuuguaauuuuuuuuauuauacuuuaaguucugggguacaugugcagaaugugcagauuuguuacauagguauacacaugccauggugguuuacugcacccaucaacccgucaucuacauuaggcauuucuccuaaugcuaucccuccccuagccccccaccacccaacaggccccaguauguaauguuccccucccuguguccauguguucucauuucauguucaucucccacuuaugagugagaacaugugguguuugguuuucuguucuuguguuauuuugcugagaaugauaguuuccagcgucauccaugucccugcaaaggacaugaacucauccuuuuuuauggcugcauaguauuccaugguguauaugugccacauuuucuugauucagucuaucauugaugggcauuuggguugguuccaagucuuugcuguugugaauagugccacaauaaacauacguguacaugugucuuuauaguagaaugauuuauaauccuuuggguauauauccaguagugggauugcugggucaaaugguauuucuaguucuagauccucccuauuuaauaauggugcugggaaaacugucuagccauaugcagaaagcugaaacuggaucccuuccuuacaccuuauacaaaaauuaacucaagauggauuaaagacuuaaacuaagaccuaaaaccauaaaaacccuagaagaaaaccuaggcaauaccauucaggacauaggcaugggcaaagacuucaugacuaaaacaccaaaagcaauggcaacaaaagccaaaauugacaaaugggaucugauugaacuaaagagcuucugcacagcaaaagaaacuaucaucagagugaacaggcaaccuacagaaugggagaagauuuuugcaaucuauccaucugacagagggcuaauauccccaaucuacaaagaacuuaaacagauuuacaagaaaaaaucaaacaacccuaucaaaaagugggugaaagauaugaacagacacuucucaaaagaagacauuuaugcagccaacaaacauaugaaaaaaagaucaucuucacugguuauuuguaauuuuaauagauacugccagcuugcucuccugacuuccucuugagaauauaaacacauuauacauacaguuucuuucuaaaugggaccauacaguauauaacuuuuaucuaucugauuuuaaccuguaagauaucagggauauuuucuuucaaacaggccucuggccuucaagugaggcuuauugcuuucucuccaggacuucuccaggccucggccgccccagaaggcacucccggcaaacccagugccaggccgcaggagccuccccaggccaggaggugcauccccacugcggcccccuggugcuggcccucagcagucccggccucuggcagcacuugccccaaaggugaguccacgggaagcccucaaggugaaagcugguaccagagggcuccaggggggcagguguagaguugagaaaacaaagcaauucaugcuucuuguggucuggacugaacuuccagaacaaaagccaagggcaaaacauucauguuucuuggugcccgcuugacuguggaguuuuggcuucaugugaaaggugauucuuagaauccugagcugugguggcuucaguccugccccugcaccugaccuggggagggacccugagcaagucccucuugagucuguuuccucauuuguacagaggcuaugaugagcaguaguaccagccccaucagguuguugugaagagcaaggaagugcauuaguagaagccaccuggccugcgggaggcuguguacacuuggccccuccucguacuucuucuguguggcugacagucucaguuugccagucuuggcagucaggucagaaagggaugaggugaagaagcuggcugaccaugcuguauucccacgaggcauugagaaaacuauggacugugcugcugccuuagcagggaagggaagagggagggguggcuggucagcuugagauaggggcaccuaccacaccccuuccugcagggcugauggucugggugaguggacacauggauggacuucacaagaagccuuuguucucagugggugguccauccuuccuucuaaaaucgggaggauggcugcccccuugaucccauugaucagcaucaagcugaugucucucucccucccuucuuuuucuucccaguuuccagaauacagaucacagagggcuggagggaugauuagcucgaaaaucuagaccuguccaaggggcuucucccuuuccuugagcucucuggacacugcagaggacccauggccauggaacccugaagaagcaugucuggccgccucugagcuccucccacccuccuccaggaaccuccacaucuccaaaaaucucccuguugacucagugccuccucggcuuccuuggaagcccagagggacuaugaucugauggccucuagguguuguuuugugcaauauacagccccagguagggaggggagaguaugaggagggugacuggcagcuucuccuccagacuccuagccccgaggugcugauggagaugcucaaggccagcaagccccucaggccagcacuucgcuugcagaagccauccauucacuccuggggugcagggcacgcaagagagcuucccauugcuucugcucuccucagaggucccgggcuggauggaggcugguacuuacccaccccuuuuagcuuuuagggauuaaggaagggucaagccagccacugcuguggcccugcccagggcuugguugagggaacggcuucuggcuguauggcugcaugugacaagccacguccccucccaccucuccccaaaccccugcaucccuguauucacacgggucacucugacucagacagguacuauucguaggcaguguagacagcaggaggagcaccgggcuugggcuuccucugagccgugaugccaaagguugcgacuccugacucuggauaauuuuuaguugcucuuuguuuucucugccgcacuuuccuggugccccacgcuuuucucucuuccuuccccucucauucucccucuaauguguggugcuuuggugagcaaacccucagcaguccugaccuucgggugaccaggugcuugugaccuacaagucagaguccucucucacagucggccacuggauuucccucacuggcucucaggagugugaccagaguagacuuggggcauggccauuggggucauauguuuauuuuucauuguguuuugugaccucagcagggugggggucuuccuccuuacucuaagcuaaaucuaggugagguuuccccuuagggagcccagcuauuuacaaaguacacacgagggagcaggcuggucauugacuucgggcuggaccguugcccucugagcagagaacagacccauuucugggagcugcccgagaucacuggagaaggcagccagcagcagcugcacuggaacagucagagcagggagccucuuccucaacccagcuuuuugucauucacuuccuuuuguucucucucuggucacugcccuuaccugacccucacagaaagagagcucugagcaggugagggggucugcgguggcuccugucuucccugcagcagggaaggagggccguguggugcuuugcuagauaggacgguuuuugcaaagcaccuggagauguuugcugggagauagacucccacuccacaaaggugcuggguggcucuccggacaggagcuggccugacucucacuccucugaggcuuuccuggggccuccucccauccugccaugagcaauuguuugcucuugaaaaccucacugcaaggcugaggcugagcuucugauucaccaccccagggccuccuuauaguucucugcacacaauaggugcuucuuggauguucuuggguuuggaaauaaguggaaaauacgggauguaccccugggggaaaagccuggguuggguuuagaaagaucucaggaaaaugaguuucucuucccucaggguggcugugauacagguuccccauguccuugccgugggucauccuugcugugggucauccuugcuguggagauccauuccccaccuuuccuguggcccaaccuuuuauuuaaaugugcuacccucugccucaaggcuugguuccuggaaaguaaaggugaaaacauccccuuucaccccucugcaaaacaaacaagcaacauccucaaaacccaaccccaugccucacagagcuuccuguggcuucuccagccuuucucccucacaucaggagguagauagcucugaaaugacagcgccacagccauagugacugcaugagccaucugaaccugcaguccacccucccuggaaccacaccagaaagagaccuggguugucguuuucuugcuuuuuguuuuguuuuguuuuauuauuuucauaucaccuccaucccauaaaguuguacugugaacuggaagaugguggaauguuuuggaauuugauagacuuucggcaaccaguucuacuaaugcuucacuccuggcucuguucagggaggcugcccaggaggaagacuggccauuaugcauccccuuuucuuuccagugcccaguaugcuguuuugaggugucaaauacaaauaaaucugggcuuagggaaggagagaccuuauuccaaagcacgauugcagaaggggaaagggaauauugcaaaagggagaggaaggggccuuaugggaauagugaaaaggcucagaccgaccgauggcaagaucugcaagcgucucaaagcccaggcagaaaaggacuuuucuuuuauuggaagaaguaaacauggcuagaaagaaccacguucagggaaugacguugugcccagccuuuuuuuuuuuuuuuuuuuuuuugucuccaggggaggggcuguuugcuggcucaggcugaggauggcccaaaguccagggucugguggggaggagggaagcuuaacucaaguuuggguuagugaguuagcaagcucuuugugcagauggggauguagguaaaucuuuuuaaaagugaaauuaaccuccugccaauuuuacaacccaagaauuuuuuuuuaagggccuuggagccaucucuaaaacaaaccucaagggauuuagugcccugucucccugucucuagaagccuuagccugggcaccuggcucaaucuuguaacugccugcuagccauagauuccuuucagccuugcugacuucucccuauaaaaguaaagccuuuuucugccccagcucugagacacuugcagaucuuaaggucugagacuugcugauuuucugguuggaguguuuuuuuguauugccauagucccuucccccugaagcaauagccccuccccaccuccugcaauacgccuuuccaaucuuuauuggaagucucucccugccuacuuccuaauuuauucuuauuugacagaggguauggaagacuugcaauuugaaaacuggggaccaguuccaaagucaguaauuguguuaaccacguguauaacagcucugcuggacacccaagaaagccaugggaacgccaacuggaaagguccccuuccccaggggagccugcgaaggagagguucuguagaauccaagcccacauuuccaaagucacccccaacgcguccucucacaccguccacugugcguuuguaugugucugggauccagggcaaugugaauuuucuuuuuauuugggagauuguucacggaaaacagaucuucuucucucuuguccaccuauuaauuguuuacaauauuuguacaucuaugcaaaauacuugaaugggccauggugccuuuuuuccuuguuaguauuuaauuaaaaaugaauuguuugucauuugcaauguua

SEQ ID NO: 16548 - RNA, 99875 nt, Homo sapiens
uaacauugcaaaugacaaacaauucauuuuuaauuaaauacuaacaaggaaaaaaggcaccauggcccauucaaguauuuugcauagauguacaaauauuguaaacaauuaauagguggacaagagagaagaagaucuguuuuccgugaacaaucucccaaauaaaaagaaaauucacauugcccuggaucccagacacauacaaacgcacaguggacggugugagaggacgcguugggggugacuuuggaaaugugggcuuggauucuacagaaccucuccuucgcaggcuccccuggggaaggggaccuuuccaguuggcguucccauggcuuucuuggguguccagcagagcuguuauacacgugguuaacacaauuacugacuuuggaacugguccccaguuuucaaauugcaagucuuccauacccucugucaaauaagaauaaauuaggaaguaggcagggagagacuuccaauaaagauuggaaaggcguauugcaggagguggggaggggcuauugcuucagggggaagggacuauggcaauacaaaaaaacacuccaaccagaaaaucagcaagucucagaccuuaagaucugcaagugucucagagcuggggcagaaaaaggcuuuacuuuuauagggagaagucagcaaggcugaaaggaaucuauggcuagcaggcaguuacaagauugagccaggugcccaggcuaaggcuucuagagacagggagacagggcacuaaaucccuugagguuuguuuuagagauggcuccaaggcccuuaaaaaaaaauucuuggguuguaaaauuggcaggagguuaauuucacuuuuaaaaagauuuaccuacauccccaucugcacaaagagcuugcuaacucacuaacccaaacuugaguuaagcuucccuccuccccaccagacccuggacuuugggccauccucagccugagccagcaaacagccccuccccuggagacaaaaaaaaaaaaaaaaaaaaaaaggcugggcacaacgucauucccugaacgugguucuuucuagccauguuuacuucuuccaauaaaagaaaaguccuuuucugccugggcuuugagacgcuugcagaucuugccaucggucggucugagccuuuucacuauucccauaaggccccuuccucucccuuuugcaauauucccuuuccccuucugcaaucgugcuuuggaauaaggucucuccuucccuaagcccagauuuauuuguauuugacaccucaaaacagcauacugggcacuggaaagaaaaggggaugcauaauggccagucuuccuccugggcagccucccugaacagagccaggagugaagcauuaguagaacugguugccgaaagucuaucaaauuccaaaacauuccaccaucuuccaguucacaguacaacuuuaugggauggaggugauaugaaaauaauaaaacaaaacaaaacaaaaagcaagaaaacgacaacccaggucucuuucuggugugguuccagggaggguggacugcagguucagauggcucaugcagucacuauggcuguggcgcugucauuucagagcuaucuaccuccugaugugagggagaaaggcuggagaagccacaggaagcucugugaggcaugggguuggguuuugaggauguugcuuguuuguuuugcagaggggugaaaggggauguuuucaccuuuacuuuccaggaaccaagccuugaggcagaggguagcacauuuaaauaaaagguugggccacaggaaagguggggaauggaucuccacagcaaggaugacccacagcaaggaugacccacggcaaggacauggggaaccuguaucacagccacccugagggaagagaaacucauuuuccugagaucuuucuaaacccaacccaggcuuuucccccagggguacaucccguauuuuccacuuauuuccaaacccaagaacauccaagaagcaccuauugugugcagagaacuauaaggaggcccugggguggugaaucagaagcucagccucagccuugcagugagguuuucaagagcaaacaauugcucauggcaggaugggaggaggccccaggaaagccucagaggagugagagucaggccagcuccuguccggagagccacccagcaccuuuguggagugggagucuaucucccagcaaacaucuccaggugcuuugcaaaaaccguccuaucuagcaaagcaccacacggcccuccuucccugcugcagggaagacaggagccaccgcagacccccucaccugcucagagcucucuuucugugagggucagguaagggcagugaccagagagagaacaaaaggaagugaaugacaaaaagcuggguugaggaagaggcucccugcucugacuguuccagugcagcugcugcuggcugccuucuccagugaucucgggcagcucccagaaaugggucuguucucugcucagagggcaacgguccagcccgaagucaaugaccagccugcucccucguguguacuuuguaaauagcugggcucccuaaggggaaaccucaccuagauuuagcuuagaguaaggaggaagacccccacccugcugaggucacaaaacacaaugaaaaauaaacauaugaccccaauggccaugccccaagucuacucuggucacacuccugagagccagugagggaaauccaguggccgacugugagagaggacucugacuuguaggucacaagcaccuggucacccgaaggucaggacugcugaggguuugcucaccaaagcaccacacauuagagggagaaugagaggggaaggaagagagaaaagcguggggcaccaggaaagugcggcagagaaaacaaagagcaacuaaaaauuauccagagucaggagucgcaaccuuuggcaucacggcucagaggaagcccaagcccggugcuccuccugcugucuacacugccuacgaauaguaccugucugagucagagugacccgugugaauacagggaugcagggguuuggggagaggugggaggggacguggcuugucacaugcagccauacagccagaagccguucccucaaccaagcccugggcagggccacagcaguggcuggcuugacccuuccuuaaucccuaaaagcuaaaagggguggguaaguaccagccuccauccagcccgggaccucugaggagagcagaagcaaugggaagcucucuugcgugcccugcaccccaggagugaauggauggcuucugcaagcgaagugcuggccugaggggcuugcuggccuugagcaucuccaucagcaccucggggcuaggagucuggaggagaagcugccagucacccuccucauacucuccccucccuaccuggggcuguauauugcacaaaacaacaccuagaggccaucagaucauagucccucugggcuuccaaggaagccgaggaggcacugagucaacagggagauuuuuggagauguggagguuccuggaggagggugggaggagcucagaggcggccagacaugcuucuucaggguuccauggccauggguccucugcaguguccagagagcucaaggaaagggagaagccccuuggacaggucuagauuuucgagcuaaucaucccuccagcccucugugaucuguauucuggaaacugggaagaaaaagaagggagggagagagacaucagcuugaugcugaucaaugggaucaagggggcagccauccucccgauuuuagaaggaaggauggaccacccacugagaacaaaggcuucuugugaaguccauccauguguccacucacccagaccaucagcccugcaggaaggggugugguaggugccccuaucucaagcugaccagccaccccucccucuucccuucccugcuaaggcagcagcacaguccauaguuuucucaaugccucgugggaauacagcauggucagccagcuucuucaccucaucccuuucugaccugacugccaagacuggcaaacugagacugucagccacacagaagaaguacgaggaggggccaaguguacacagccucccgcaggccagguggcuucuacuaaugcacuuccuugcucuucacaacaaccugauggggcugguacuacugcucaucauagccucuguacaaaugaggaaacagacucaagagggacuugcucagggucccuccccaggucaggugcaggggcaggacugaagccaccacagcucaggauucuaagaaucaccuuucacaugaagccaaaacuccacagucaagcgggcaccaagaaacaugaauguuuugcccuuggcuuuuguucuggaaguucaguccagaccacaagaagcaugaauugcuuuguuuucucaacucuacaccugccccccuggagcccucugguaccagcuuucaccuugagggcuucccguggacucaccuuuggggcaagugcugccagaggccgggacugcugagggccagcaccagggggccgcaguggggaugcaccuccuggccuggggaggcuccugcggccuggcacuggguuugccgggagugccuucuggggcggccgaggccuggagaaguccuggagagaaagcaauaagccucacuugaaggccagaggccuguuugaaagaaaauaucccugauaucuuacagguuaaaaucagauagauaaaaguuauauacuguauggucccauuuagaaagaaacuguauguauaauguguuuauauucucaagaggaagucaggagagcaagcuggcaguaucuauuaaaauuacaaauaaccagugaagaugaucuuuuuuucauauguuuguuggcugcauaaaugucuucuuuugagaagugucuguucauaucuuucacccacuuuuugauaggguuguuugauuuuuucuuguaaaucuguuuaaguucuuuguagauuggggauauuagcccucugucagauggauagauugcaaaaaucuucucccauucuguagguugccuguucacucugaugauaguuucuuuugcugugcagaagcucuuuaguucaaucagaucccauuugucaauuuuggcuuuuguugccauugcuuuugguguuuuagucaugaagucuuugcccaugccuauguccugaaugguauugccuagguuuucuucuaggguuuuuaugguuuuaggucuuaguuuaagucuuuaauccaucuugaguuaauuuuuguauaagguguaaggaagggauccaguuucagcuuucugcauauggcuagacaguuuucccagcaccauuauuaaauagggaggaucuagaacuagaaauaccauuugacccagcaaucccacuacuggauauauacccaaaggauuauaaaucauucuacuauaaagacacauguacacguauguuuauuguggcacuauucacaacagcaaagacuuggaaccaacccaaaugcccaucaaugauagacugaaucaagaaaauguggcacauauacaccauggaauacuaugcagccauaaaaaaggaugaguucauguccuuugcagggacauggaugacgcuggaaacuaucauucucagcaaaauaacacaagaacagaaaaccaaacaccacauguucucacucauaagugggagaugaacaugaaaugagaacacauggacacagggaggggaacauuacauacuggggccuguugggugguggggggcuaggggagggauagcauuaggagaaaugccuaauguagaugacggguugaugggugcaguaaaccaccauggcauguguauaccuauguaacaaaucugcacauucugcacauguaccccagaacuuaaaguauaauaaaaaaaauuacaaauaacuguucucugaucuaguaauucuacuucuucugaccuauguuagagaacuauuugcacacgugcacaaaaaugaaacugcaagguuguuccuugcagcacuguuuguaacagcaaagaaacuauaaauaagcaaaauuucaucagcagaaaaauaacuaaaauuauaaagugacagaugauauagcacuuaaaaagaaugaaguagguugauaggggcuggcguggggagauguucaagaguuguuagguggaacaaacaagcuguagaggauaguugacauaaaauaagucagcacgcucaccgccuaauagaaaugucuguaacagaaaaaaggaaggauacagaccaaagagauuacacugggauggggugcaaaaggggagggguguguuccaggugaacauuccauuuuuuuuuuuuuugagauggagucuugcucugucccccaggcuggaguguaauggcaugaucucggcuuacugcaaccucugccuccggaguucaaacgauucucuugccucagccuccugaguaguugggauuacaggcacccaccaccaugcccagcuaauuuuuguauuuuuaguagagacgggguuucgccauguuggucaggccaaucucgaacucugaccucaggugaucugccugccuuggccucccaaagugcugggauuacacgugugagccaccacgcccagcccuugaacauuccuuuuuuuuuuuuuuuaacaagagcauguacguguauugccuguuaagauuaaaacaaaauuuaaacaaagcagcagcuauauuuuguucauguugguuguccauguguguggcacauuucauggauucuguccuuccuguguuacuauuaccuucauguucucaccaucuccacaaggcuuugcccugacuaccuuauuuaaaauuacaacagcccccacccugacauucccugaccuuuuuauccuaauauaccucuucuuuucuuuucauaucacuuacugccuuacaacauauauaauuuauuuacuuauccaguugauuuuuacuuugugucucuccauuccccucuagaguggaagcagugugggguccguaucuguuugguucacugauacaucuuuggcuuccagaacagugccuaguauacaguaggugcucaacacguauuaguugauccauuguuuuuuaaggggcaaagaaugacugucccacccgcaggcccccaagcuguugggguuuaaggggaagccaacugcauagaagggaguuccagugccugcuccccuugacuuccuucccuucucgagagggucacuaccacguauuaaaguggacaaaaggcaagcacauagagagggcaggaauaacacaaagagccgagauuuuccccaagaagcuucauggaaucagaaacuaaagcaaauucuuaaggccaaaaagccauguucuucagcucuaucuagaaggacaauacaacccgcccccuucaccaccaccuuccccagcucagaauagcugccaaguugcaaugguugcuggaagccaggauagagaccuucuggggcaggugacagcugggugcagaugucagguugcaacugggaaaggcugugcucccaagggagcugugcaaaugagccacugaggggcuggaguuugggcaggagccucaucagcaugucagcacugggccucccagggcaaccagccacaggccacaucugcgaugauccaacucagcccuaccagggcccucgcccagcacuguuuuccuuuuucuagagcagaaacagucccucagcuacucuggcccaugcucccuuccacaagggauggcaucuuacucaaucagauugcacaagccugacacggggcgucauccccugccaagcaauggaucuucaacucguuaucuauuuucucuucugcacauuucucaucagcuucacuucaucagcccugccuacucccugcuccaagcuuuuaccaucuuucuucaggacaaccuuuaaaucuucuaacuaggacacccauuugcuucuagagugacuuucauuuuuuaaaacuauuuuaaaaauucaaauauaauacacacagaaaaaggcgaacaaaucauaaauauacaacuagaugaauuaucacaacgugaauacacuaaguaauccccaugcaggucaaacaguagauuaacagcuucagaagcaucuaugggccccuugcaggaacuacaccucucuccugccuaaagauaucccaaagagugaucaauccuugucaacagaaaauugcaucaugucaccacuguccucuuccuauggaauacagaccaaaguccugaccaaggcuauguggccugggcauagacgggcuccuccuggcuuuccagccucaucucauagcuccuugggacccaagcacacaaaccuuuaaguuccuucaauccacagggcccucucccaugacagagccucccuacuaguggguccugggaccaggaaagcuccuucaucacuugcccucacagccugguuaaguccuguuccuccuucaugucucagcucaaaugucaccaccucagggaaaccuuccuggauuucccagauuaggucaaauccucguuacucucuucugagcacccugagccucuccuucacagcacauaucacuguugcagugacacauaucccagagucacugccccagcagaaugugagcuccuggaggcaaagcugccaucugccuuccucgucauugccuggcccagagugcaggugcauaagccgguuuagaauagcagaacugaagaagugaugagguuucaucuaucacuucuccaggggguccaugucccccagcuaggagguggggaaucuuugauggcagacuggagacugugaguggccccagggcaggaggcugucucacucagcuggaugagaccuggguucaaguccuagcuccuccacucacaacugugcaaugucgggcaagucccuucaauccuaugaggccuggcaaccuccaagagaaaugagggcugcagcaacucccuucuuggaauggcugugaggaggcagguggcagcccaaugucaucacagcagcccccacucagagcagcugccucccacuguucgcuuguagagagacacccaccugggacccggggcccaggagaagcugugcuugggggcuguguuuuggggugccugccacuggcugggcagcuuccugcacccgggacuccugccagcagucccaggggugcaggugcaggguaugcacagccuccaccacuuaacagacagcuggguccccgcugucccugacacuuccugaccuacggcucagcaccuaggggugacaggggugaggcuggccccguguucucugaacaugccucuaguguggguuuuucagaacaacagucugaguggacugcucgcccgacccacucccuccucccucugcuggcacuccuguucuccuguaaccccaagucucuacacgccugcuuucucccuuucuuucaucucucuguuagggacugaacugugcacucaucauuuaaaaaaaaaaaaucauaugcugaagcccuaacccugaguaccucagaaugugaccauauuuagagauaaggucuuuaaagaggugauuaggauagaaugaggccaccuaauccaaucugguguccucauaagaagaggagaguuggacaggcagacaccagggaggcagaagugcauaggaaaggccucgugagaacacagcaagagggcggccaccugcaagccacagagagaggcuucagaaaucaacccuuccagcaccuugaccuuggacucuuagccucuagaacugugagaaaauaagugucuguuuugaagccacccagugugcaguacucugcuauagcacccucagcacacgaguacacucuccaccucucucucuccacuccuccccucucuugcuuuuuuccuuuccucuuuccuucucucucccugucaaucuuuccucucuuucugcauggauuuuuccauccuaccucugccccacauaaaaggaaggggagagcagcaguuucacagcagagaaacagaauggaugcccucagccuucccaaacuguaccacugccacacaucccaaggacccuccaaagccugcagccaaccccagaguccuuagggucagagacagcuuggguuccauggagcccucuggauuacacccagagaaagcagucucaguugaggggucacacccaaaacacacaggccaguuccagaaggcaccccacccggccgccacccaggaaacaccugugucugcacugggggaucuccugcagaagguguggucagagccaucagagcacacacacgcagugggaacaggcugcugggcaggcuaugccuccaagagcaccagggcuggugggggagagucuagaccccacucucaccucccagaggcaccugccccuugggaugggcaaggcaucaggauacaucccuaagacuuuccaaucaguagaagguaccaauagguacaauuugguaggaagaguacuaugaugagagaaguacagucccaucaaccucagaauugaggaaucaggauagacuuccugggagaagcggcaucuaggagcagaucugaggaugagcaggagguggccccaccaaggagagaaggagcguaucaggcagaacaagcagcauuuacaaagaccuagcaggcagacgagcaugggggaacugacagaaguuaauaugggguggaagguggguaguggcuugucauaaaauaggccaacccgggagaaaaugccacaugguuuaggagcuucuuagagagucuauuuccccacguucguugcucuaaccugcugugcgcccccguauugacugaauugcagaaaaggcagucagcucaugaccccacaaguuucaccuuccccaccuuugccauuacccauugaaaguggccuuaaaagcaauguucccagcccaagguugcugauuauccacuuaccugggaaacgaugcaauuuggugcggggggaauuggccggcuuggaggaggccuccuggacgacuccguccucucuauuugagacccgggcccuggggaguuccuagcagcccugcucaggugagcuggcaguggugcagguggggacccaccacgcagauaaucuggagggggccggggaggaggcugggagggcuuccgcaggauuuccggaguguugaucaccuguacgcacaagucaaggaacaccugagacaagaaaucacucagggcuggccuugugugucucuuugagauaaaccagagcccaaagggagaacagacacaccaaucuauuaaaccccugaggaucccagaagucagaugcaaccuuuaaagucauuaggggaugucagaaccaaauaacaugucucuccagccaauaaaagggcuuuuauuaccaaucccaugggcccacagaggcucuuagaaaaacacagcauggcggccgggcaugguggcucaugccuguaaucccagcauuuugggaggccgaggcggguggaucacgaggucaggagauggagaccauccuggcuaacacggugaaaccccgucucuauuaaaaauacaaaaauuagccaggcaugguggugggcaccuguagucccagcuaauugggaggcugaggcaggagaauggcgugaacccuggaggcggagcuugcagugagcugagauggcgccacuguacuccagccugggcgacagggcaagacuccaucucaaaaagaaaaauacagcauggcccugagggauaaaggaaaaguagcaaaguucaguggugcaaagcucuuaccuuucgcuugcccuggggcgucugcagcuugaaaguuggguuggcaugaccagucccgcuguucugagaaacccugaagggacaacuagaaacaagaaaugggggaggaaaagaaaggggacgauguucagcaggggacagugccugaguucccuuugacccaagcacggccagcaagcagcuaaaucuuucccaagucugcucuggagggagugggauuggucuucucgaaccacaucuuccuaaguagaaaaacguguggccaauggagaacucucaaggaaacagaguuggccuuauacaaagcagagcucucucagcaccuucucuucacccuuuuaagacccuuccccugugaggagacacaagggugucacgagccaucaaccaauccccaucaggcauagauccagaaagaccugggacuuaaaauccccuccagaacaaguguuauuuaauaggugacucagagacuguacaucuuccauauccaaaauaauacaucacuuuucaaaugggacaccaaaagcgagcaggaguagcuauucuuauaccagaugaaacaaacuuuaaagcaacagugguuaaaaagacaaagagggggcugggcaugguggcucaugcuuguaaucccagcauuuugggaggccaaagcgggcagaucaccugaggucaagaguucgagaccagccuggucaacauggugaaaccccgucucuacuaaaaauacaaaaaauuagcuggguaugguggcaugcaccuguagccccagcuacucaggacgcugaggcaggagaaucgcuugaacucaggaggcggaggcugcagugagccaagauugcaccacugcauuccagccugggcaacaagagugaaacuccaucucaaaaauaaauaaaauaaaauggggaauaaaucaacuagacaaaggauggcaaauagauuuuauuuuauauuucaacuugauuugguuggggauauucugcugagaagaacucaggagugaugaccagaaucaguagaguacuuacaauaagaucaacuaguaaugccugucacagucauagcaggggagagggcagcauguaucuugcacuugucuucccugaauuagacccacuaucaccaacacuuuugcuaaguaccauuuauggagaccuuugugacccauaaauugacccugaguccuccauugaacccugucauaccugaacuguugccucagcuuggaagggagagcugagggcuugaguuggccuaguuuguuguucugucugcagcaguaguacaucagcaugaggaccgccagcaccaagauggccaccaacacuccagcuaccacaggacccacaccuuccagaaacagaacccaagugggagauuuagaagcugucucggcuacagcagauuucaaaauagguauucgugcuucuucuucaggcauuugauuugcauuuaauuuguauuacuuauuuuaacuuacaaauuauaauuaaaaacacacauuaugggccgggcacaguggcucaugccuguaaucccagcacuuugggaggccgcggucagcagaucacaagguaaagagaucaagaccauccugaccaacauggugaaaccucgucucuacuaaaaacacaaaaauuagcuaggugugguggcacaugccuguagucucagcuacucaggaggcugaggcaggagaaucacuugaacccgggaggcggagguugcaguaagucgagaucacaccacugcacuccagccugggugacagagcaagacuccgucucaaaaaaaaaaaaaaaacaaagaaacgaaaagacucagacagauuuaagacuagacaucucacccauaauccauaacuuaacauuugguuucaucaaaacuaccccaauauucucucaagugguuaauguaaauauagagaacguauuuguacuaacaaaacacuacuuuuuaucaguuuuacauauugggguuucuuccuugaaagauuuuggugcuuuuuuuuuaaaguuauuugcuauuuuuuuuaaaaaaaaaacuuuagaaaucauagugcuagaauccuugagagauccacuaaaauacuauaaaauuuucugagugucugguucuccauuuuaacuuguguccaucagaggaaaucuaaaccaccauaaugugucccagguucaugauuauuuuuaagugcccaaagagaaauagucaccguguccccuaaaaagaaugggaacauucaaugaccuacagucucucuuacucucacucuacuaagcgggcucccccuccucaguagaaaggaugggagaagagagacugaaccguguccccacaccacacuaugagcagucgcuccucucucuuggucugucuuuauccugauuuccucucuacaaaaucaggacaaugaagcugauucaauguggaugcucugcaacaugccaccugccccugaugcccgcucuucucacaaaagcgggcaguggccccagcaggcuggcacucacucucagggggcauaggcccacugucgauacugcccccguggcccgguguguugcagaagggcggggcccagcccggcaggcaguggcaguucugguuguuguuacagaccuggagcaaagaaagggcagaggcaucagcaccccagagagcaucagccacccacagggccugcccucaugacguccccaugacacagagaagccagaacccagcacgcaccccauggccauugcacuucuucccacagccuucaguuucaaagaaggagguguuccugcacugccccucaaagcaaaucugcacggagagaaaacagaacgaucagugcaaugggagggaugcugguugggaguuaggaggcaagauuuugcacuuggaacauaugaggacccauggcccggccugguggcucacgccuguaaucccagcacuuugggaggcugaggugggcggaucaccagaggucaggaguucaagaccagccuggccaacauggugaaacuccaucucuacgaaaaauacaaaaauuagcugggccugguggccugugucuguaaucccagcuacucgggaagcugaggcaggagaauugcuugagccugggagacagagguugcagugagccgagauuguaccacugcauuccagccugggugacagagcaagacuccaucuuaaaagaaaaaaaguaugagggcccaaauaggcagcacacuucagguuacuaucaaagugaaaaauggaaaacagcccacaacgcuaaggacaggacaacagccaacuaaauucugcuauuacuuuugugauuagggagaaaacgacaaauauauuguuaaaguaucauauuuaacaauacaauauuauuuauguguuaucacauuaaaggacuauuauguugauuauguuaauuacuugucauuaauauguaucaauuuuaacauuauauuuaaaaauaaugauggugacaguacucugugccaggugcuaugcuaaaugcuucauguuuuccauaguuucauuaucagaaucgacucuggaggauagagucugugcuauuauuuugcucaggcuucccuaacuccuaguccauuuuuaauuccuaugauaauuagcgaugaggaugaaaguggcacuagcuaggccaccuaagugcuuuacugggaugauuuucuuuaauccuuccgacaguucucuggggugggugccugcugucacuauacacgcuucaugaagggagccaccaaggcucagagguuggcgagguggcaucugagcccaggcauccuucccucagaccucacuucucaaucacucugcucugcagcuggcuccuaggugagcaggggaggggacucacaugguuguagccacacuugguuccagucaucaccagcccuggguccagcaugucacccuccuccucaggaccucgguagacgugggugccccggcacuggaucugccucccauucaugaugauaguggugucaaugggcaccgcguuggacuccaggggccgggccucagagcucugacacuggaucuucccacacuucgcaucucugggcacaagagacagagagggaaggaagcggaaucagaggcagaggaagagcuggggcaccagagagcuucagucuuucuugaucaagacagcaggcuugcgugggguggggcaaagguuuagggcagucaugugcuuuggaacccaccaggagagauuccauguggacugacaccaagggaagagaacaggcuccuugacccugagcaaaucuagaccagagaacuggccucgaaaaguccuuaacuccaagaauagccaccugagcugagcaaucuuucccuuuuugccccuuauaccgcuguccacccaggaguuccagcuagaaaucuggggucaucuccaacuccccauucucccucacuccugggcucaagccauuuucaaacccuaucaaucuucccuccuuaauuaucuaucuuauuaucuaucuaccuuaauucacacugccccaccccccuuaccuggucugcagaagauugauuucccugccuccagucugccucauaggagucuaauuuucacacugcucucaagcuaaaaucuaaacuccccuagccaugcauuugaggcuuuucaugaucugguccaugcuaaacuauccaggcuaauuucucagcagaccuucuccuuugcaccccaacauuauacuuuaacuguaucaaacuguucucaguucuuucaaccaccaguuuuucucuauucaucucucuuccuggauuacucuccuaugcaccagcaccaccuuccacccuguucaccgagguaacugcuccagaucucaguguagguauaacuuccuuugggaaaccacucugacacacuaagauggguuggauggcucucuccacauugccauugucauacuauauuguuaauuagaaguuccaugcacucagcacaauaucuugcacaugguaaaucuucaauagauaguagauagacaguaaaucuucaauagauaguagauggauagauggacggacagauggauggauggauggauggaugagugggugagugggugguggaggauggauagauggauggaucagugggugagugggugguagauggauggauagauggauggauggauggauggauggauggguagacagaugaguggaugguugguuggaaugaaugaugaauaaaugaaugaaugagugaauuaaugaaugaggagcuauucaaauuagggcaugauuagaauuuggcagaaaugacccaaaagggcugauucccugcccuacuguaagaugguccccaaaggaagcccgaucagcuuucuaggaagcacugccacccacacccuccucugacuuccucagagcugaaaagugcauugucaaacagggggccgagaauagaugacugacuucaacugauugacguaaaggugcagcucuggggccagucacacugcugaguugggcaacagugaggacagagcagaaacugcuuguucauccucauuucaugaggccugcccuuuggucaucaccucauguugcacuuccuguguucaccauucauguccuuuccacaguuuccaaaggugucuccugccacauucaccuucucgaagcagaggucaggggcaggucgggcuccugggugggcaagcaacaucuaucaguauacucaucugucagaagcccccaagggcaaagguaucuuugguaaagucaugaagguaagaauauuuucugggagggaauacucagccucuucuuccuguucccuccagguuacuccauccccauauucucaacaagaucuacucagagaauaauguuuuauauaaauccuuuuuuuuuucuuucagauggauucucgcucugucacccaagcuguaauacaguggcacaaucacggcucauugcauccuccgccucuuggguucaagcaauucucuaccucagccucccgaguagcugggaugacaagcacccaccaccaugacuggcuaauuuuuguauuuauuuauuuauuuuuuuuguagaaaugggguuucaccaucuuggccaggcuggucuugaaguccugaccucaugauccccccgccucggccucccaaagugcugggauuacaggcgugagccaccacaccuggccuguuuuauguaaauucuuccuaccuuauugaggauuuauauuuguguguggggaggguugcaugcuaagccugcucucuaaugaagaagccauguuccgauucaagauuuuaaaaaauaggucauacaugcauaauauuuuaaagauauaaguaugucuuggaaaauuuuucuuguagucauccaguuccuacuucucuacauccuggaggaauagcacuuauuaacaguauauuuucuaaagauacuuaaaucucuaauuucuguaucuccuagguauaauucuguguguaucuucuagagauaaucuaucuaauaaagaauggaagcauauucuuuuuuuauuuuuuuugagacagagucuugcucugucacccaggcuggaaugcaguggcacaaucucagcucacugcaaccucugccucccaguuucaagagauucuccugucuuagccucucgaguagcuggaauuacaggcguccaccaccacgccuggcuaauuuuuguauuuuuagcaguuacaggguuucaccauguuggccaggcuggucuugaacuccugaccucaggugauccaccugccuuggccucccaaaguacugggauuacaggcgugagccacugugcccagucuuuuuuuuuuuuuuuuuuuuuuuuuuugagaugguacaucccucugucgcuugggcuggaguccuagaguggaguggcucacugcagccucaaacuccugggcucaagccauccccccaccucagccuccugaguagcuaggauuacaggugcaagccaccauaucagccaccugaguagcuaggauuacaggugcaagccaccaaaucuggcuugaaagcauauuuuauuugcuguucuacaccuugcauuuuucacuuaauuuuuuguggaagaugauuuuauucaguaaauauagggcugccuccuuauuuagccauaaagcauugcauuauaugaauguaccagaauuaauuuaauuggucccuacugaaggacacauagguuguuguugcuauggcuaacaauggugcaguaaacaucauaguaaauauauccucacauacaugugcaaguguuagcugcauuucuaaguauaucuccaaauugcuuuccauagugguuauaucuaccuguuucuucacacccuccacaacacuauaucauuauuauuguuguuauauuauuauuaucuuaacuuucagucuuugcaaucugauauaugaaaaaucucaccucaucauaauuauacuuugcuuucccuuaauaugacugagauuaaacgucuuuucauagcuuaagggccauuugcauuugcuucucugucuccauccucugcucauuuuucuuuuggauuacucuuauucaauuguccacucugagaaauaaaagcaucaagggacugggaaggaacacuguccucugguucucccugaacaucuacccugagucaaggggaugaaagagguaguaucuagaggugccauuugaagccaagauuccaaacuacccugagggccaggggaggcuggcugggaaguggugggcuggggagagccgugcuccccaggagagccuuaccggguccccacagcugcuggcacugcuccugguaggugaggcacaugccguuguagcaguaggccuggccgcccucacaggggguaccauccaucugguagaaguugguagggcaguggggagacuugcccguacagaacuccgggaggucacacugccuggccugcucgcggcacagggucccaggagccaacagcugagccaaggaaugagaggaaaacacagucaaucuccuccccacccucaacccuguugcccaagggcucauaaggaucacucucauagaacagaauuuuccauuaccaugauuucacagcacuuuuuacaugaccucauuagcccaaaccaccuucagccuucucaugugaauacugacagaauuucaagcuguuuucacaaaugcuaacucacuuucucuucauagaagucuuaagaaagaggcaagaaauaauaccuauacaacaauuuacaguuuccuacaugcuuuaguaauagcagcuacuuuuaugcagcucccacuuaaguguccaguacaaauaugacuucacuuaguuuucaugacaguccugugugauauaauuaucccuucugcagaugauaaaaucuguaggcuuaaagagguuagacgaugcauccaaagacucauaguaaguggcagaggagccaggcccacuaauacacacacacacacacacacacacacacaaaacuagcauucacauaacaucugugaguuuacaaagcaccucagcaauaauauauccccacuauggggccaggcacugggcugagugugugacauacacguaucucgugggauccucacagcuuccaugggauagauacugcuauuugucccacuuugcagaucaauaaguugaucaacagcacaccuggggcaaagggcgaagagucuuacagccucccuggguagucgguguuacuaauacucuuuccauuuuacagauaaagaaccuaggcucagagaguuaauagguugccccaaaucacacaaccaggguuugaagucagucuuggacaccagggaauccuuucugaggcucaaacggaaauucuuguguggagugaagggguccacuccaugcuuaugcuuaggccuugggccaagacuggaagaacuugacccagcacagccucccagggggacgcacagccaaaccagaugccgugcacauuccgagagccaggcaaggaaaccagugacugagaacagacccccuccccugcuccugggccacuccucccacccacaggguccuuccaggagaaggcagacaggcuucuccaccggccacucucaggccaagacugggccagcugagcagcuugcugagaguggaugcccagucgcaagugugggcaugggugguguaugcaggaggaggcugcaggacacaccucugccauccagaggcagguggaggcaaagaggaccugccccacagccagccugccugggcacacaucccagcuccuuaaccggcagcggggccuugggcaccugcuguguaaccugugugugcucacucacccacaacucaggauaauaacccacuaaugggugauuaaacgugaguuagaacuaaguaugugaaugguaucuggccccuaacgagcacucagcaagugcuaggcagaagcccaggcccacaguuccugccuaaaaugauggggccagaugggguucaggcuuuucagauuuagaaagcagauauuguaauacauagguccauauguacauguguguacauauauaauuacacauguguguauguauauauauauauauauauauauggauauggauaauuacauauguccgcauauauaacuacauauguauauuacauaaccccccagcaaggcuggggauaacaccuucugaucaaacauauuaauauuucuguaaugcaauauaaauauucacuuuaggagugauuuuuuuuuaaaaagacuauaauucaucucaugucaauucaggucaaguuuugccaccaaauguguuuacauuuuuuuucagcuuuuagaacucccuuaauuucagaauuguggaagagagauugugguucuacgguaacacuagcagcaacagacaauuuaucucucacaucaauauuaggaaugugggcaccagagucagggaaagcuggauucagucccuuccugacugccugauuccagauaaaccucuuauccccuauaagcucuaguuuccacaucuuaaaauaaggauagucacauauauuuuaugggguuuuugugaggagagaaugagauaacguacauaaaauucccagcacagugccuggcaucuacuaagagguccauuaaugucaauacaaaugaugauaauuauuauuguuuaugagcucaauaaaaucaagcccacucucucuggauacuucuuuaaaaaagaaaaaaaaaaguaccauuuccaaagaagcgccacccuccucugggaugaucugaauucagugaggcccaguauaggaauaguaaauuuuauucaaggcaccuuuuccgcucuguguuucugaaacucuguugccaucacagccccaggauggaggcaaauccccagccauccaccccagcagagcaguccuguggucccacugucaggccagggcccaaggcguggagaaaagggccacuuaccuuacacugguggcagcaggagccgugagcacacuccgcccccggccucaggguacaauuagaggcauugcagcagggguuguuacauuccuggggaggcaguggggugggugugagugggggagggccuucaccacccccaacauuuuccccacccuugcccacacaccccuggaaccccagcucucuagcaacuaucucuuuuuuuuuuuuuuuuuuuuugagagggagucucgaucugucacccaggcuggagugcagugaugcaauaucucgggucacugcaaccucugcuuccugguuucaagcgauucucccgccucagccuccgaaguaacucagaccacaggcacaccccaccacaccuggcuaauuuuuguauuuuuaauagcgauuggguuucgucauguuggccaggcugguuucaaacuucugaccucaagugauccaccugccucggccucccaaagugcugggauuauaggcaugaaccaccgcaccuggccuggaaacuuuugaccucaaaaaucaugugacagcuucgucacuaagcuaauguguacuugucacaagaaccauauauaugcacaaucauuaguaacaugacuuggacacagcuacaucuuuuuuugagacagucugcaaccuucuccuccuagguucaagcaauucucaugccacagccucccaaguagcugggaccacaggcacacaccaccaugccccgcuaggacacagcuacauuuugaguaugaauauuuuucaaggcauuuucuacacacauacauauauauuuauacuuacuuuacaaaaucauaguauccacaguguuuuuuuacuuaauauaacaugcguauuucucccuguaaccauguagucuucuaaaauggacuuuuuagcagaguauauggaaauuuuauguuuuguuuuucuaauccccaguagaacauccagacacccugucuuucaugggugcccuccugcccccaacccuccuaggcuuucuuaucucaugaaaaggggcugccggugcaagagucugcuggaacaaccucuccaaacaguuuaugucaacuccugggucuguuuccuuagauuuuuuucuccaucugcuucucuuccuaagcccuuccuggccuggaccuuucuggaacagaagaucuccauggguuccuugcucucccccagccugagauuuuuaaaagauuaugaggcguuccagugacccugagcguccucaucacacucuuacaguauuaacaggccaauccaucagccauugaugaaaaguguacggggcuccacagaucucuccaccacagccuuaugaggcagccuugaccccauuccacagacagggaugcuguggcucaggcaaguccaguagcuggccgagggacacaccugcugaauucaagucaggucugccugaggccuaccucauguuuaucaaccuuauaccccuaacuguccagggcucuagcauauuggagagccacaucccauccccugaccacagacaccuguccaccugucuccccuaagagaaggaauagaacacuuuccucccauuauucucccaccauguugggcuccaggaagaccuguauuccugccuuccuaauguaccauauuucuucccacgaaggcacaggcuccccuuccaccugaaaugugccuucccuccugcgugccucacuaacuccuaaugcagccuucagauaugggcuccaggucaccucccacacaagcaaggagguucccccucacauuauauauguucagagcacugugucauuugucuuccuagcacuugccauggacuguacauauauucuuuugcaauuauuucaauauguguuucucccacuagacuaucagcuccccaaggacaggaacuaugucauuuuugccacucauccuaacccuaggaccagacacaguagcccacacucagugugccuguugaaugagcaacugcucagaaccuaagccaacuggccaugcccacucucaggccauuccucaaccccaguggcccuccauguucauaccacucccuccuuucugaugggucuguguugaucucucugggcucauggugguggggguggcauccuugacuaguucuuguuuuauucugaaagugacauacuggcauuaaaaaaagaaaaaucacaucacagaggucacaggcagggugcgguggcucacgccugcaauccuagugcuuugggaggccgagguggguggaucaucugaggucaggaguuugagaacagccuggucaauguagcaaaacucugucucugcuaaaaguacaaaaaaaaaaaaauuaaccaggugugguggcacacaccuguauucccagcuacucaggaggcugaggcaggagaaucgcuugaacccuggagguggagguugcagugaguggagaucuugucacugcacuccagccugggcaacagagugagagagagaaggccauaaaaucagauuuuuuuuuccauuuauacagaaccucagucucacccccauaauuuacuguuacuuguuaucuaccccaaauuguuaugcauguauaaacauacauauuuucagccuucaaaaaauagagacgaaacaauccaguucugcuuucugcagaaaccacaugcauuuguuaaaaaugaccgggcucugccguguacccuccacacucacugugaagaucagaaggaaggagagaguuuacacauaaacaguuccuccuagcagcccuuuugggacuugacagcacuuccuacauccccuuuccaucaucucuccuccagccuaaacagcaugagcuuguuauuuuaagcauccucauaaggccccuguucaagcccauauaucuggcuguguggccuccagaauaaauuccgugcagcuggagggcaagcaggcaugugcagcuccacugaggaagacagagucaacaugccacgugaucgugguuucugguuagaccagacacucauaagaagaacugauccuggacacuagcgaugcuggccacaaacuagcagaggcggcacaaacacuccaacuggaaggcuucuucauaucugauuuuucaugggguauuggacaguuauauguaggaaacaccugugacuaagaaauuuucaauuguguucucuuugaccuugaguuuugaaaccaaugcaaauucuuccccucccacuagcaccauugugaccccucaccucuucuucuccacagucacacucuuccccaucuuccagauacccguucccacaccuccggccuccauacaacauccuggugucuggcauguuggagagacacauuccaccaccugacugcagauaccuguccagcucccuccuguugcauccauugaacacuuugggaaaggggugccuggcagaggacaaggcuggaauuaguggggaguuugagcaucuagcagucaggcaggugucacucgugcugucacuccugcuacccguggggcugacuccaccuggguucagacccccauugucucacacacauacauucuggccccuuagaacauuuaccaauacauuaauuuagaauuuuuucaucccuugaguucguguccuuaguagggacauggaugaagcuggaaaccaucauucucagcaaacuauugcaaggacagaaaaccaaacaccggauguucucacucauaggugggaacugaacaaugagaacacuuggacacaggaaggggaacauaacacaccggggccuguuguaggguagcaagaggcggggagggauagcauuaggagauauaccuaauguaaaugacgaguuaaugggugcagcacaccaacauggcacauguauacauauguaacaaaccugcacguugugcacauguauccuagaacuuaaaguauaaaaaaaaaaaaaagaauucuuucauccuuagugaugagauauuaaccaccccauaacauucuauuuuucuuagucggcaugcagaaagcauuugagaaucaggaguagcaauuucugcccauugcaugagggggcugcgauaaguaaaggguugugaguguguuacaagaggucuccugagacuuagcacugaagaaaacaccagccaaccuaaacuuuuccugaagcugauaucaggugaauauucucuugugacagaggaccaggccaaaaaaaggccaagaucauaaguuuuauuucauuuugggccagugaucucauugcuguucuaaggaugcagagggcauuccaaacucaaccagccaacucauaaacgcaugcucuuuaucacaggaguauggaagguccugggucccaccauuggugaaaaggacaaauaguacagccaucugggucuacaaaaggagaguuauccugcucccaauucucuaaaccaauuaaagguuaaacccuccaagaaacuggagcuuuuccuucagugggaagguaugcuccaaggaauuuguuacuaauaauuguuaaacuauccauauuugugaauaauuuaaaaaugaaagagaguaguaaucaauauaacucucaaucauuugucuucagauacgcuuuuuagauugagagagaaaggggugagcuuaaccaugagcuuauagggauccaggcaugacugugaagcuguauccugccucauucuuuuuuuguuguugugguuuugagacggagucuugcuccguugcccaggcugaaggcuggagugcaguggcacaaucuuggcucacugcaaccuuugccucucgaguucaagugauuuucccgccucagccucccuaguagcugggaccacaggcgugcaccaccacgcccagcuaauuuuuguauuuuuagcagagacgggguuucaccauguuggccaggcuggucucgaacuccugaccucaggugaacugcccaccucagccucacaaagugcuggaauuacagucgugagccaccgcacccagccaacaucauccuuuccaugucacagcugagaaauaauuuuaaaaaauugacaccagagcucuaagaaagcugcacuguuucuuggagacauugaaacaccauucucuaagaaucauaaacaggcccuaaugguguggggugaaggaacacaaggucccaacgugaugccuuccaaagagccuggaagaacccaaugcuuugugcugccugaguucagaugcuagaagacaaguccuuugaagaaacucccuaauucucuucagagacucugguuuuaaaaaucccucauguccagcgcgguggcucacaccuguaaucccagcacuuugggaggccgaggcggguggaucacgaggucaggagaucgagaccauccuggcuaacauggugaaacccugucucuacuaaaaauacaaaaaauuagccgggcaugguggcaggcgccuguauucccagcuacucgggaggcuaaggcagaagaauggugugaaccugggaggcagagcuugcagugagcggagaucacaccacugcacuccagccugggcgacagagcaagacucugucucaaaaaaaaaaaaaaaaaaaaauuuccucaugaccacagggagaugcagcugccucacccuguuccucauggguaauguggccugcaaacucccugagaagucacugugggguguguggauggcccucuucuucaacuuguucuguuacaucggagcuuucagugaagccuggaauugaaacagcacugauccaacucucuugggauagaagaauuaagggcuguggcuaugaucaaaauguguccucauaaaaaauucaugaaauaaaaaagacacauauggccaagccaauuuuauaacucaacaccuuaaaacagaaauuaaauaaaucuaggguuacaccagcaccaaaccuccugcuggaaaguuaaguucuugcugcacauuugccuuggucuucucucaauuucuuuguuguaaaaacuacauuuuuuggccccaucagaaguuuaagggagucucaguggggccagcugggaggaaccccugggucacacuguccaggugugcccgcccuccuccccauccucccucuugcuguuugacucacccaguggcagcugccaugaugcacccaccaucagccgcacuggccgagcagcaaucugcagaaucaugggucaugccaaaguuguggcccaucucgugggccaugguggcagccacgccaauggcauucucggagugguccugcucagaagacagaguugaggucaaggucaaggggacagaucugccucugccccccaucccugccuuauccuuagccaagucuugcaggucuccaccaauuccacugucacugagcauacagacucuccauaugugccucugacagcaaggcugaaucugcugucacuaggaggaaaucaaauguuuaaaaguccauguuuccugaguucucaaagguugcagaccacaacugaccuauggaugaacuuccagaccaauaaaugcuuucagaauaaauaaaagaggaagauuuuuccccauucuucuucugaacauauauauuucuccagacauaaggaaaucaacauagaaaacacgaccuugauucaaacauaggguguacuuggcuuaguguuuccugagaaaaccacacaagacagauacacuccaggcacagcacuugguguacugucugaugaugcaaaagcuaaagaaaucaagaggaaaaaaacccagcaggaaagaagcagcagaaagagauuuacuaaacauggaaguguguuuccugcauuauuucauuuaauucccauuccuauccuaugauuaucaacuguaaaacuaugcguuuuuuacagcugagaacacucauuaacucacccaaaaucacacagcuguucuuugaacccaacaggcucagacccuagagccugugguuuuggccauuaugcuacuuugucgauaaauacagaauggauagagggacagacaaauagaugaagacaagucuuccuugauaugcacuucacagguuagaaaugaagagucaaaacaaauagucucaugaagucagagugaauuucaaaagaaggcaguaauuuccuaaccaugacuuugagacagguucuuguuucuuaaugacauauauaacagcacacgaccugaaauaaaaauacuuuuaaccucuacucucuuacuauuuuccagccccugguuuggaacauaugagaucuagugauguaugcauguaaucucuucaggguuccugagcuugaagauacggaaugaacuauaauaaaugaaaauucacccuucaguaccuccaucucuuagaacuuaaugacuucauuuuaaacaauugcccuuccugaugucaaagcuuuuucugcuacaauaauaaauaucaacuuauuauucaaaagaugaccucuggucuugaaaggcagcucagcgccuucugcagcgcacacacacgggcugagacucaccauguugacuccuccagacugguacacagagcacauggccaugaggggggccaggccgaugguggugccguggaaggacaugccccugcaggaggcaaggagagacggugaccggggacgagacuaagagggcuguuccaaugugccugggaguaaguggccaucacgggguucccuggacccgcugacuuucccaggucauucccaaggggagaggcccuuguaaccaggccaacuggacaacuuccagcucaccacaccucucacuuccucucaccuacucccucaugacuccagaggaacacaaagagagagagaaaggucguuuaucucccacaauauacccauagcugauuccuuggaaggaaaugggcaggguuugcaaagcugcauugcauuccugcugcacaggaaaaggucagaaggagagguugauggaaggguggcacagauucugaugcugaagugaaucaugcccacuuccaccagcugccgggauccaauaccuuaccccuggcucuguggugugagucccacaggguaggggugggggcaucggggcagcagcuguggggccgaugaugcuucauucccacauacucaggggccaaggaaacagcugugccccaucaggagccucacaaagugcaguuggaugcaagaaugagcuguuucugccuuuguuuugcaaugggauccuaaucugccagcagcaagcuucauuuuccccaguugaauacaucccucuuucaguuauauacauccaggguagaggagaagaaaaaaaaaacuaccaguguuucugugcaugccacaaacauguaauguauuuaaagaaccuauauggaaauucauuaugugguacuuaucuccacguuugucuucucaucuagaccaugauaucuuugacagcaagacuaucuuaacuauuuugggaucguagaaccuagcacagaaucucacacauaguggguauacaauaaauguuugcugaauuacaggcagacuuaucuucagagaaacaaucugcaaagaaauaugcaaaaucuaugcaaauugauaugaaguccuacuaguuauuuucuacauguuccaaaguucaggccaaaaguucuaauagccaaagacucuuccuaggcaaauguaguaacuauuuacagcccagguuuuggggacaguuauuuuucccaguuucuuuaaaaggauaagccaaaguuuaaaugauuauuaacucagcuauauuuagggaacagaagaaaaaugguuugaaggccaggcauguguggcucacgccuauaaucccagcauuuugggaggccgaggcgggcggaucacuugaggccaggaguucaagaccagcuuggccaacauggcaaaauccugucucuauuaaaaauacaaaaauuggccgggcaugguggugcaugccugcuacuugggaggcugaggcacuagaauugcuugagcccaggaggcagagguugcagugagccgagaucacgcuacugcacuccagccuaggugacagacggaaacugucucaaaaaagaaaaaaaaaaaagaaaagaagacaaaugguuuuauuaucuauaugccuuuuguuguaacugccucaaaauaccuucagaagucaacacuaauaaauaccaaauaaucacccuggggcacugucacaugugacccccaucacugucucucccaggcugaugaaaaucuagcacaaucccuccucaaugucucccuccaaccaaacccucaguuccugcacugucuaacacuuggacucucucaagcacucagccuugugccccuugggaaccaagugaaggacaacacaaggagcccgcucuccugugccuguguugggagaucagcucauguauuagaacaaagcgccaggaagauugagaugagucucuuagaaagucuaagaccugaccaacagucagucccuucccaaauacauacacaauuauuucagaugcucaauggaauauguguaagucuaauuuucccauuagacuguaaacauuucuuaggaauaaugugacucaggcuuuuaaacauuuucugggguaugcuggguacagagcgcauguuuaggaaaugccugauucucuggaccagggagucagaauggccuuguacaaccaacacucgccauggggcaaacucugagcaugugcugggugggcagaggcuuugcagccaaggacaacacaacauauggaaaaaggcuauuuacgugauuaauugggcguugucaugguacuucugggcaagcagcuugcgccuccaacugagaaaggaccagaggguagaauauggauucucugaaacuucacacauguucccguggguccacacuuccaagcccacgagagcaauccggauguucaaggaucgguaaaacugaaaggacacagaaaaaccacaguaucugucaauaccaccugggauuuaaaagccccuuccuuucauucugguggagcuugagauuaaaaagaaaaaaacuaaaacuaaaaaauaaaaauaaauuuaaaaaaaaagcuccuuccuagccuaagaacucagagcacagauaccagauuucucuucugcccauggcuccaacagaaggaggcaacugguguuacugacauuuuuuagaaagggaaaaugagauccugagagagagcaggacauucugguggcagaacugcagugacuuuguuuagagaugacugagauaggacauaaaauugcuuucagauaugaauaggucuaucauguggaaaaaguuguucugcaugauguucaaguagggcuuaggucaauagguaaaacagacaggaacauaaauuucauuuuaaaauaggaagaaggcuuucaaacaaagcuggucaugagauagcucagagcugagcuuugcugucuucuguaaucagugcccuuggccaggcugucugguacaauuuuuuucucccaauuccuuaugugagccuuaucuuucuuauggguaucuaaaaaguucucuuguauauagauuuuuuaaagccacuucauugagguauaauuugcauaccauaauacccaucuauuuuaaguguacagcucaaugcuuuuugguaaauuuaccaaguuuuaaagccaucaccagccaagcgugguggcucacaccuguaaucccagcacucugggaggcuaagguggauggaucacaugaggucgggaguucgagaccagccugaccaacauggagaaaccccaucucuacuaaaaauacaaaauuagcugggcgugguggcgcaugccuguaaucccagcuacucaggaggcugaggcaggagaaucacuugaacccgggaggcagggguugcggugagccaagauugugccauugcacuccagccugggccacgggcgaaacuccgucucaaaaaaaaauaaaaauaaaauaaagccaucgccaucauccaguguuagaauauuuucaucacaucggugagaucccucaugucuauugauagucauuucccauucucacccucagcccaggcaaccgugcaucuacuuuguuucuauucugccuuuucuggacauuuguuuuacaauaugugguuuugugugucuggcuucucucacuuaccauaauguuuuugagauguauccauguguuagaguguauucguuuaugauuucucuuuauugcugaauaauauucuuucguauggauauaccaaauuauauuaauacauggauauuuuauuauaaaaugucucccacucauuuuggaaguaaaugaguauaaaugacauaaaagugcacagauaugcuuacucuucaaauuuucuuccccaucccuggauagucucagguuuugucaaggauggaauaagcagguugcaagcaauagacuacagacguucuugguaaucuucaggguuuuguccaaaccagagauccugaaauucuauacccaagaucugacucgaccuccucgaggcuagagcuacaucuaaucuuuaugaucuggcauuuuucaccucauacaaauauaagcaggaggaggguuuucuuuaaagcuaaaccacuggaagguguggauacaacggguucuuugauggguccacccuacaaauacugagccagugacuuaauaaaaagccccauguauggagaggacauaaugagcaggagauaccaucuuuauccaaaauugguagguacugccccagcugaaaagaauaaucauagcaccaacauuuuuccaccacuuuuuacguacuaggcacugaggcuuagagaaguuaaggaacuugcccaaagucucagcaagaagaugguggagccaggaugaaggcccaaauuacaaccucagagccuauuugugacccuuuacuacuucagugcugcaguaccuacacauccagauaauccacucgcuccaagaaacgcuggucaagaugggcuccagauucagugaaauaucaguuuauuucaacagaaauuuugauuuuucuguuuugugccaguucaaucguuacagaaaauaaaagguucagauuccaauuugaauuugcuuuacuagggagcuuuugaaggaaguaaacuuggcuuuuuuucacaguuacagaaaaacauuuuggauuggguucaugacucagcacgaguccaauucauuccaguuuuaguucaacaauaguucaguucaaguagcuaggucagcaagcuccagagaagugggcguggcuucccuuacccgccaggagugacuaacaccagccgcgaggagagagccaagacggcugcacaggaugcaugggccacccaggcuuagggcuuucaguaaggacuggggcuugcuggugccucucuucucccuucacuugucaccagcgcccuugguuccaucacauaccccacagaggggauacccagccaaguccgaaccugccaggucuccaaacaauagaugucacaugggggaaagcagagucagccucccauauucuccccagggaaacaagcuucccuuguuuucccagaugucaaauguuuggguuguaggauuauuuaaauguuauucuugagugagucaggagcuagagggaggacuggacugugucccuagagucuguccuuccaggaaaugccaguguuugacuuucaccugucacugaccacugaccuuuguuuccagagccaucuagggcagaaaaaaaccaugggcauggaaacugccaucugaugacuucagaacuaauacauuugccuauuaaucccuaaaacauauuuuaagugaucuccuauauucucuaguguuuaggaaaaaaugauuuucccuuuagaccuggaauucaugaaucccuagcaggcccaaaguuaagcuucaucaauguuaugaguauucuaaaauugugcaauaaacguuaccagauucucaaagagacuuuugaucccaaacacaugaaaaacuacuuuuaaaaacuauauacuacuagccuaccaagaggcuacugucauucuagguuaccuauucugcauuuuguacuauaacaaauaucuucuuucauauacacaauguacuuccaagucccagaccagcccguucuaguaaaauucaaaaauguagguauuuccgaagagcaucuuguaaaagguccugaccuaggaaaguuaaccacugcacauccuuccuaagagacaagacauaauuuuaggauaacuuuacagauggagacuuuauagauuagccccaagcaacccacuucucagacaauccgcuucucaagcaacccacuucucaaacagcccacuucucaacuuuuaaggcugugugucuuucccacccugaccuaccucaauucccuccuaagucagagaaucccugggcuuuguaucuggaaggaaccuuaaagaaccuuaaaggauucuuaaacugggcucuuccaugccccaagcugcucgggagccacugcagggguaagaggaaggggucagaaggacaguguucuggguccucaccccagcucccacuuagagcagucuguuuucaucuaacuuuuauaguagauauuggcauaagauuucauuuuuuaaaauuccaccaggaaaauaaaaauaacaaaaaaaaaccacacauugauuuacgacagccuuucuauuuauaagcugaaaacagaacaaaagaaaaaaaaaugcaacacaaagaaaaugaguuacuugccuaaggguacguaguucagggcucugucaugaccgcccugggccucuauggcacugcucauucccuuucagaagauggcuggggcagccaauccagcagaaggcagcuccagugcccuuggaagugcuggcaccuggcaccuuucccacaaaguacacaccuggucucaccuuaucaacauaguuggcgaucucuaugagcuuguguuugguggcguccuggucucgucgauucuucugaaacuaaaugggacaagcagaaccaugugagaucccagaaccucucacaggaugcuuccugcgccccauuacuugucuuugaauuugcucuuauuuucuucugucuucuaugagccaucauuuuuaugcaauugucuuccccaccacaguaagagcuuuggaggguaggaccugucaacauccaucuucauauccacagcuacuagcucagcgcagcacacacaguaggcaugcaauaauuaugcacggaguagaauugccuuccucuaacccuugaagcacaucuuauucuccuguccuucgaauuacauggccucuggcaaacucccacuggggcuuaggaggacugauccaauccucaccguggucaucaccccaacaugaagccaccauuacacagaucucacgaggcuucccuacauguggucaaucaacaaucaucgaauugcugcugaaugccugcuaugggcaaggcauugugcuuagcacuauguaggacacaaagaagugugagaucuugguucuagccuagaggagcuucaauuaaaacagagagggccagaaauaacuguggcagaugcugagugacagacccuguacuuaaggaguauagaacugaaaugguugagaaaaccugccgggaaaacgugcacagaaauaaccacagugggaggucaugugaaugacaugagugccaacgaggaggaccauaagacacuggcaaauaggcuucaucuugcacaccacucagauccacuggcagugccuucuacagugagaagaaugagaagaauuaugagacugcaucgauucaaucacauuucuuucuuuuuuuuuuuuuuuugagacagagucucgcucuuguugcccaggcuggagugcaguggcgugaucucggcuuacaaccuccgccucccggguucaagcgauucuccugccucagccuccugaguagcugggauuacaggugcucgccaccauggccagcuaauuuuuguauuuuuaguaaugaugggguuucaccauguuggucaggcuugucucaaacuccugaccucaagugauccaucugccuuggccucccaaagugcugggauuacaggcgugagccacugcgccuggccguaaucagacauuucuaaccaagcacaggaaagaaagcuguguuccauuagaaauaucugccauggguaccagaaagaggacauuuuaguaugaauaccuccuauuuaccauuccugccucaaaaagauagaucucucugagcugcaaugaugaaggaaagcuucacaguguaaagagaaaaccugcuacaacugcaaauuacauuuaaaaaugaugggcauguccuguacacugccauuguuacacagaaucuggguccucucuaauuuaucuuagguacccacuauacauguuauuuugauucaaaaucuucacguccuuccuccaccccaucccaugagaauaucuaagcaagaaagaacaagaacagccaaguaaaacaaccugggguauuuguuuggccagagguguguaccagcccugauacagggaagaaauccaccauuucccuuucaccacagcuuguggacauucuuaggcuuccuuaaaacugccacucaccagaagagaaucuguuaccacugcuuucuagaguuagauucagugugacacuguaacuuagaccuuuccaagguguuaauccaggaguuucucauuauagaggccuccuguuucuaaauuggucucucggcacagacagcguugcagcauuuccauucauuuaguaauauuuauuagaacaucagggccagauuucauugucuuucaaaaaaauauuaaucuucucuucaaagaacugcccaaugagaccaccauaauuuaaggagcgaauucuguuguccagaguauucugaagcaggagucagcaaaucuuuucugcaaaggccggauuaggcuuugcggccccauagucucugcuacaacucuucaacugugcagugguggcucagaauaauacagacaccuguauauauaauacagaagccuggauaauacagaaaccaaugggccuggcuguguuccaguaaaauuuuguuugcaaaaacacaggauaggcuggaugugaccaugggguauaguuugcagaccccugauguaaagaaaggacugucucaaacuuacauuuucuagggugacacagugaguaccacaugcagcaccauccuuucccagccacucugcacugugccagcaucauggaaguccuuuacaggccuguguuuacaguuauccugucuacuccuacaacagcccaccuuacucuuuauccccaccuggauuccguuccaccuggggaaugaauaaacugagaaccacccuagaagcucccaccuaggcccagggagcgaggagcugccugcucauuuuuacugcugacaacucucucucuaggcagcagcagggucuugcucucccuaucugugucuccacuuucugcucugcauucagagccccaaggcucugucucugcagcagguuauaaaucaugguaaagcagcccuccccuuuccugccuucccauccucucagauuaauuaauuaauugucaagaauauauuucugucugcagaggauggagacagguggagaggggaugauucgugagccugugaacccagccuggccuguuacacacccccaccccagucccucaaaugaaucauucaaagccuucagcggagggguguccaggacugagaaaugagcacguucccuuauccaccacagcugcaugaaucacagcccuguugggaacccagggcuguugcugagacacucuccuuuguaagagaaagauggcucuagcugacaccagaguccuggaggcaccuugaguggacacuuuuucucuggaggugugcugugacucuggaggucaggagauagaagaugccuaaucccugccucccaccaugcuucccacuucuccagcugcuggagauucacacccaguggguuugaaagccugcacagagauuccucugagaacaaugcaaggccaaaggggagaaacaccccaccuuuaaacagagcagcugggcucuauaugcuuaacuacugggguucccaggaacuuccauguaaccaaaggauucuguagcugaaaaaaaugacucaagaccauuguaucagaugaucacagaugcagaacuuaaguggaaaaaugucccagagucagaggagcucaguuuucuuccaccaguccucccacuacgggcagucaggcagggcaggccagagucaguuaucuccucccacgacuauggagccucagcuggcuuuuaaaccagcuuuggauuuugcuccccacacuauucccccauccuauagacacacuagucuuuggagaggaaacagaaaacauagaacacacacacacacacacacacacacaaacagcuguuggaaaaaccaauaucaacaucaguuaaaauaaaucuaaacgcuuuucaaagcagagcacaauguucccucggcccggaaugcccuucaccuccacuccucugcccaguuaacuccuccuugucuuuuaagacagcuucaagggccaccuccuucugcugcuaacauccagugacuaacacucaaagaccuucuggccugcagccuagugcucuccccaccaccaggcccugcugccaggacacaugcuuuggaaaugugacuagguacagcugccuuagaaugagcucuuugggaagaugguagcuaaacuauguggaugggauacagacagacuggaguugugaugggcucuauccucaggagagaccaaggccagugucugcccugcucgaacacagcgagcgcucagcucauaaugacauccaaugcacagaagaugcacuuaguacuuauaugauggagucacuaaacaaagugagaauuggagguaacagcuggcuaauuuaggcaaauaugggcucuggggccuaaacucacucuuuaggugucugcuucaaugucagggaagcuuucccuaauucccaaaaccauguugaaucccccauuaucugcacuuucaucccuccuaaugguccaucuuagugcuuaucacacuuuggaccuacagguuugugugcuguuacugcaaacucugcgaugccuggggagggucugucuucuugagaucuauauauccaggugcuuggcacauaauagaaaaucaagagaucacugaugaauaaaugaaauacaugaugagccaggugaggguuccucaaauucuuagaaccugucugauuugaggaacauggaguuaaaggcugaacugcuaugccuuuaggucagugguucucaaacuugacugugcaacccaaucgcccagaggucuuguuaaaacauggauuucuggaccccacccugacagucugggauucaggaggucgggggcagggcccgagaauuugcaucuuacacaagggugcugcugaugcuggugcucuggggaccacauuuuggggaccauggcuuuaggucaucauuuggcaucaacaugauuauaaaaauggacccacacaugggcaagaauacaguuuucagucggaugacugggaauauauuuaucaucuuugcaaaaaaaaaaguuuuagaauuuccauagacaauuccggguuccucagaauaaacaccagaaucuaaaggucuucagacccaguacaagaaauguuaaucagacaacugucuugauuuucuaugugacugauguaacaagccaggagaggcuuagcuguguguggaggugggggaggaaggggcggggggaguugggggaguuccccccaacuauguuuaaaauggcaaaaugagccuuuggucagauuuuuuuucuuugagacggaguuucgcucuuguugcucaggcuggagugcaguggcaugaucucagcucacugcaaccuccgccucccagguucaggaaaugcuacugccacagccucccaaguagcugggauuacaggcaugugccaccaugcccagcuaauuuuguauuuuuaguagagaugggguuucaccauguuggccaggcuggucucaaacuccugaccucaggugauccacccgccuugcccacccaaagugcugggauuacaggcgugagccgccgcgcccagccuuuggugagauuuaaggucaaaaucauagaugaacuggagaaagaugaaugggcaacauuuccccaaagcagucuggagccuggaauggaagcuaucaagagagcaguuuuucugcaagacccauugccucccccuuaccucuaaauaaucagccacgagguaaagcuccacauacuucauggaguuuaaaucuucccuuuucaucuaagaaagagaaacagaucagcgcuguagaaauaguggacuuggccucauuuuuaaaaaacugcuaagaaacagagcugcuggauaagcagcagcuaccuccguaaugauuuugucauucggcacuagagauguucuuggcugugguggccaucacucauauaacaccuuccacugccauuugguuauugcuggaggcugcucugggacccuggauucaguccuuuauucucagaaaauacugagaugagcugaugagcacaggcaggacagaggccagcauaugagagggagugugcuaaccaccacguucccacagaaccucgaaaccucgaaacaccaugccauuuucaguaugaaucaauaugaggacugugugcauaugguguagugucuacuccaauagggaaagcauacuuuuuuuccccacuuuuuaauuuuuauuuauuuuucugaggcagggucucgcucugucacccaggcuuccggguucaagugauucccgugccccagccucccaaaguaguugggacuacaggcacccagccaucaugcccagcuaauuuuuguacuuuuaguagagaugggguuucgccauguugcccaggcuggacucaaacuccuggccucaagcaaucugccugcuuuagccucccaaagugcugggauuauaggcaugagccauggcgcccagccuucuuuucacuuuuuaagcuuucugaagucagcaucugaguguuuuaaagguaguaguguuuucccccaaaagcaguuauucuaugaugaggguauuucacacucaacaaugacagaauaaaagaaaaacacuauuuccuuuuucuuaggcaucaccuucaauuuagaaauacuccuggauucaaaguaagcaaccucagaggggacaagccuguccccagguugauuucugcacugagagccucaaaacucacccugcgaggucgcuucuuggucuguuguguaaacugaagagcccagucccugguggugggcuuggagugcucgaacccacaguuucccgggggcggcuugagauguucagaucuguaaauaagguguuggcccuugcugucagggaggggcucgaugacguagcugagguugcugcucaccguaaucaguccucuguugagaggagaaauagaaucucuggucaaagauuaugguucugaaaaagucccuuguguaggucuuaguuucuccauaugcaaaaugacauaguggguuuugaucauugguucuuaaccuaauuauggggccauguaccccuucgugagacucugaugcaagcucacacuuccucucuagaggaaugcacuuauacauaaaaaguggugcaugagcucagggcacuuggaccuccaccccaacccccaccccacccaaccaccaccaccaagcucaucgugagacuccagguuaaaagucucuggacugggaaaucucaaaaaguucuaagaaggcuguaccugugacacuuaaaacuuaugaaggaugguagguccaggauuccaaaaagccucccaaaccaaaacauggcauaugacaaaucaugggucaaaacuuuagagacucaggaaaagcaguacaguggccagagaaagaacaguggccugcaagugaggugaccgagguucuggauuuagcuccaacauucaauugucacaugcucuucaacaagcaucuuaaaucucuccaagcgucaguuuccucaucccuaacacggcaaugauaacuuaucaagacuacuggaugauuaaguggaaagacaagggucuuugugcuuggaaaccagagcuagaugcaucagugaugacacgccuacuugucccaccugccccacgucagcacgguaguuauuuggugaagugacauccaccaccaagcaugagggacuacuuuuuuuccucccuugauuauagauacuagcacugaacucagaauaaacucauguguccuagacauaaucuagacauaauccuuguccuugagaaacucacaguccucuggaagacagucacaaacauuuacugggcuccugcuacgggccagguaucaugccaguugcugaggacggaauagcgaacaagacacaccaagugccuacccuugugaagcguugaguguaaacauuggaauaagucacucuaauguauaacagagagagcaaaaaguuucaucaccccuuggacuggaggcagcugcuucaacuguuacaucaccaaggcuucugagggcuuuucuagccucagcaagaaagaggaccaugacuuauuaucaauugcuauugcuaaugaucagugaaggcccaggcagcagauaucugccaaccuugauacaaugagauaaacaugauuguaaagguauguaaucaaggcuuagugggaggaggaagcccaggaguaagccccauggacucuagcagcauuuuguaugcucuaaaaccucaggcaggcucucauccaugcagagagcucagaaccuacagcaucuccaacccagucuuugccacuguaaauuggcaggaccucucucuuagcuuaucucagcuuccaccuccaccacaaccgccacuugggauuccugcccagauuuugcccuuugggaagagccugugaugcucucuggaaaaucagcgccaggcucugaugggcagcagccuuucccggaucccaucccuggcugaccucauuccagauccaggaagccugaugacuuccugguugccucacccagucugacgcagcaguacccaaucacccccucugacggacaucuaagguacucccugaacaucugggggugggagcguggcaaggagcaagggucgcauccacucccuaauccagccaggaaagggcagaggagagagcugcugcacgcauccuguucccaaguuaucuuuucaucucagccaaccaaggccucucccaucaccucaguuuccccuaacggcuacacacuuugggaacacagagggcuugaccaccaaccagcugaugguucugugugcaccagguugugguugccaagauuacacccagugaguggaaaguuccauagaggaaucagggaaaguuccaauggagguucacaaggcgcaacugaucuggcaucacuugaacaagccugugagcuaaacaggacagagaccaagccauaguguggugcacaauaaauaagaauccucauaguggcugcagauuauagagccuuugcuauggacuuggcacugugcuaagugagcauuuuauucuucccaccaccuuccuaggauccuuacaaauauuguccccaacguacaaaugggaaaacaaaggcucagcaagguuaauuaacccaaagucacacaaacaguaagaguaagaguagggauuuguuuuuuguuuuuguuucaucaacuuuuaaguuccaggguacaugugcaggaugggcagguuuguuacacagguaaacaugugccauggugauuugcugcacagaucagccuaucaccuagguauuaaaggagucgggauuugaauggaagcauucuaguuccaagucccacaaccuuacccugaccuuccacugccucaaucaugauaguccuguagaggcugggcgcuguggcucacaccuguaaucccagcacuuugggaggccaaggcggguggauuuccugagcuuaggaguuggagaccagccugggcaauaugguaaaauccugucucuacuaaaaauacaaaaauuagccaggcguacuggcgggugccuguaaucccagcuacucaggaggcugaggcaggagaauugcuugaaccugggaggcggagguugcagugagcugagaucgcaccacugcacuccagccugggcgacagagcaagacuccaucuccaaaagaaaaaaaaauacccuguagagugaauuagaaagauaccaccagucuacagauggcuccagugauggugccagcagcucucuucuuaggggugauuggccucaccucaguuuccuaagagaaaagaugaaggagguaugcagccuacuuuucaccuucagaugccauugauugagcuaacuggaugccaggcacuguguuuacaaauguuauucuuauuucauucccacaucaucauuauaaggaggcacccucaugagucccacuuuauagaugaagaaacuguggcucagagacauuaaauaacaagcucucaugguuaagggcagugugggcuccaggcauggggacuagguaaucugaagucaaagauuuaagguccacagacucuggaccccauccccuuagccucugugcuuucugccuccaucagugaguuccaagccuaagugucagagaucucuaggagcagaggucucagggauaucuauuagaauauucuacaguguauugaaaacauagguauccaggucugcuguggauaugguuuauuuguccccaccaagucucacgguagaauguggucccauuguuggaggugggccugguaggagguguuagggucaugggguggaucccucaugaauggcuuggugcauccuggugguaaugagagaguuuuuacucagcaaauucccaugagaguuuccucaagagcugguuauuaaaaagagccuggcaccuccucccuuucucucucacuuucucucucaccacuugaucucugcacacacaggcuccccuucaccuucugccaugaguggaagcagccugaggcccucaccagaagcagaugcuggugucaugcuucuuguauggcucgcagaacuguaagccaaaauaaaccucuuuucuuuauaaauuacccagccuuacguauuccuuuauagcaacacaaauggacuaauacagggcccaaccuaaaaaacgcagagcugcaggccugaguaauucccugccuagccacacucaggaacuuuggccuacagaccacccucuguagcaggcaccugcuuuucaccaggcccauaguaauucugauucagggagugggcagauuacaauuugagagaaacagaggcucagaaggacccugaaggucguuccagcaauaggauucuguggccacuucccucccuuccuccaacugcuguuccugguuauuugcccaugucacgacugcaauccucucagacggccuggggauggaggagaggcuggcacaagccccagcacugucaguggacugcagcuuuguugcugggggaaugucugagaaugugguuccaggggcuguccccgcccucaacccuaauuccuuuagcugcccucuuccaagcaccaccaguuguuuauccuucuaggagccuugguugaucuaauuugcugaauguuagcccuggcaaaggcagaacucagccagaaggcaugagcuggggcccaggaggcuggguggccagccucacaugccauucuccauucuguucuccauccuauugcucaucguuaagagauggauacaaaugaaauuguauaggaaaacccgggcaggccaggccaggcaggcaccaagcaauucaugccuaaccccugcauaacugaaggauucaccaaaugcauucuucaaggaacuaggccaacaacugcuuccuggggacuuguccauucagagcuaaaccaaaggggacacauucuacaucccuauacccagaggugcccuaaaaaguaacuacccugcuacccuucuuuccucuccccuucucugcaaauuauauccauccaaaaggaguuacagggaacuccaaagccugcaaaaaagagaagagaaggcuuguaggucauguacuuucucaaggacagggugcccccauauagcaccuggauucaaacucuggcugugcugucuccuagcugugugguaagugauguaauaacacugcccaucucacagaguugcugugauaauggacugaauaggcaauauuuacuaauaaccaaagcagcauuuuaaaagaacagcuaacggucauugauuguguauuauacaucaagcaaagcgcaaaguguuuuauucgauagccauucuacacaucuguacugagaacccagugugugacaggaacuguucucagcucgggaaauagcaugaucaaagcaaagucccugcugucaaggaguuugcacuccucaccuauuguaaauccaccagugaugucaauauuguuauucccauuuuauggaugagacaacugagacuugagaacuuaaguagcuuggcaggguuuaaaccaggaagugucuggcuccagaaucuaaauucaucacaacuuaauaacacuguccucugagggcuuaaucugugcaaugccugacacggagguagcauuuaugauccauucugcagaaggaaggcaaggaauucaaagguggaaaggacuugccacuucuucuccagggcuggcuguguguauaugagccaccuccuucugccccaggcucccaccucccugagacucugcccaaccucucugcaucccaggacuuccaacacagaaggaagcuuuuaauggucuggucuacucuuguuuuacagaaaagaggaaagcccacccaaaaaagaacuugcccaagcucaccuagccaguuaaugugagagccggggcuaaucccagcucuccuaauguucagguucaugacucugggguaugccccugaccucacccccacugaccacccaccccacucccaggacuuagccaccuuuuggauagaguaggggccuguggagggaccagccuggccacagcaaagacaaggaaaaaauuuaauggggagaggaaaacacagagauccacacagccaggaaguauguagcuagaucuuaaacguggaucccuugacuuuacauuuugagcuuauuccaggccaucaugcacacuuuccuacacauucuccugcauucauuuucaaucucauguucucccucucucccucucucacagaaucugaguccagggaccacgguuaagguguaauuacagugagagugagcccuauguuuucgaaggcagggcugcuguaauauaagggugauccaucaaauagaccacuauggaugauuuauugcauaccucugaaagacuuucuauauaaugaaacgugccagacauuaguacaaacgauauuaugcaaccauuaaaagaaugagauagaucuauguauaccuaaaacauaaugcuuaaguuggaaaaaaaauacaaaacuguaugcauagggugaucucauuuggauuaaauauguucauauauacauauauauauauauacacacacacacacacacacacacacacaauuauguauuucaauaaaggauaccuccaacaguaauuaaggauaccuccaacaguaauaacagauggagaaugggauugguuggaaggguaggacaagauaaacaacuuucacuuuuuaaagcuuacacauuccugcaugauuugaacauuuaacacuaaaccuguauaguuauauaaugauaauuuuuaacaaaaaaaaauuuuuaaaaaaguaaacaacuuaccaaccagauacacuuccugcugauagacagugagcuacagacucacacacagaguuucccagaacacacaggcucagucagagacaccuuaacccaguauagauauuuagagaaugucuuaaucugagacaggcuugggagaaugaaacuugacauccccagugagaugggaugccacaucuuuuuauuggugucauuuuuuuuuuuuuugagauggggucuugcuuugucgcccaagcuggagugcaguggugggaucucagcucacugcaaccucugccucccggguucaaacgguucuccugccucagccucccaaauagcugggacuacaggcaugcaacaccacacauggcuaauuuuuaaauuuuuaguggaaauggaguuuugccaugucggccagguuggucucgaacuccugaccucaagugaucugccugccucggccucccaaagugcuggaauuacaggcgugagccaccgcgccuggccuauuggugucauuuauaaguacccauagcuuccaaucaauucucaaaggguccaggggcccaaauaagauuacagacauuauauuccuauauuaguccguuuucacacugcuauaaagaacuacuugagacuggguaauuuauaaaggaaagagguuuaauugacucacaguucugcauggcugggaggccucaggaaacuuacagucaugguggauggcaaagggaaagcaagcaccuucuucacaagauggcaggagagagggagcacaagggaaacugacacuuuuuuuuguuuguuuguuuuuugagacagacucucacucugucacccaggcuggagugcagugaugcgauuucagcucacugcaagcuccgccucccggguucacgccauucuccugccucagccucccgaauagcugggacuacaggugcccaccaccacgccugacuaauuuuuuguauuucuaguagagaugggguuucaccguguuagccaggauggucucgaucuccugaucuugugaucugccugccucggccucccaaagugcugggauuacaggcguaagccaccgcacccggccagaaacugacacuuuuaaaccaucagaucuuguaagaacucccucacuaucaccagaacagcauggggagacugcucccaugauucaaucaccucccaccaggacccucccucaaaacauggggauugcaauucgagaucagauuuggguggggacacagagccaaaccauaucaauuacauaucuacguucuuuuuucacaaggaauauuccuaaaaggauauacaagaaacuaguaacaacggcugucucuaggaagggggaaaaucuggaaaucuggggugagaaagagauguuaucuuucauuguacacucuuuuguacuuuuugaauuuauuuuuacuaagauaauacaugacuucuucaauuaaaguaaccuaaagaacugcuuugaagagaagagggggccuagcaaccaccuagaagcucagcugaauuccucuugguaucaucagcuugaagaucucacuugauagaaauccuaccuauuucuccaaucaugggagcauguuuccaggaaagaagaacaaucacuauggagauuuuucacugcagcagugcuuuaugagcuuugggaggcgccuaguguuuugacgacauggguuugaauguugcugcuguugcagcugcuccuucuccaggguucaaauggaaccaucuggcaugagucuccagcucuuaaaucaguccacccacagccuugguuucuuaaggcguguguagugagaaggcugggaaaguaaggcagguggaccucaccagacggaagcaugcaaaacagaaacacacggacagcucacccgguaucccccucccuuucagcacugcugcuggaaugauuuacaagacgccaagccaaguucccacugcuccagacugaggggauggaggaagaggcagacagaagcaggucacaccugcauguucuuuuuccuccuucuugggacaaacuuuguuuacuugcagacugcagguggcgguggcugggcuuguaaauaccacugcgaggccaguuagcuuggcucaaucaggucacuuaagcagaggggauuuggggccacucuguuauugcuucccauccaaagcccauuuccugccugauuuccuccagccaacucaccaugcagcauucaaacaaagucauggcccaauuuauaaacagacacuugggaccugcagugugagaaaccuuccauuuguauaggagccugcauaagucuuagcaugguuucaccgacguaagaggaggaaaaacccuuauguuuaaaaguacuauaauuacagcaauaaucucuaccaugcuuaauacugauguucacuuuauugacaaggaaacugagggcuccaaaauuacagugcugguuuucccuccaccuguguaggguaugggcauuaggaagacacccaauuucuauuugugaaugaaaaaugcaaucauugaaugaaugaagcaaucagucaagagaggaagaacacacaauggagccaccuccuaucagcucaccagagccaaucaaaggcauaucuucccaauucugccuucaauaacaucacaucgguagccugaaauugaucauggugggauuaucuuugucagcauauuggcagaugcuacaaaucagggcuuuuuccuuuuugucauagagccaguuuacacugggcugaagugucucacacugagccuguguauucugggaaacuguagcucacugucuaucacugcacagaggcaccacauaguacagacaaucaaaacccaggcaauuaguauaugcaaugagauaccagguuuuuuagaucaucauccuucuucaaaaaaaaaaaaagaggagggagauugaaaguggucuacauaaauaagacuuauuaugucaacauacauguguagauccuacugcaagcaaggcauuaaggcaggcugguggagagaaauagauauuugagauauacuucauauucucaaggaacacacauucucagguacagacuguaaugggcacacaaaucacuugggagucuugguaaaaugcagauuaaaauccaguaggucugcguggaaccugagaugcugcauuucgaacaagcucccagguaaaguugaugcugcccauccauggaacacaccuagagaagcaaaguccuaggaguucacugcaugcugacagugugccacugcaaguuccuagguaagauagcuauucacaagcugaauccucacaacugcaggcauauauucuuuuuauccacauuuuacaaaugagaccacugggacccaaggucacccagcugguaaacugcuaccagcucaaagccagguagucucacucagagaaggaagggucacucucaaaagcacauucuggucagaacuuuucaguugauuuucugucuugaaaauuauccuugccuuuccuuucacuuccuacucucuguucauuaaccguccauuuccuauuucaccaccuccaaguacaucucccagagaagaacugaggagguguggaaccaaaugcccaaacucauccaucccgagcauauuaaccaugugucuucuuuuuuaucuucuguuucuuugacaucugggucuuacugaccauagagggacugccccuuccaggauuagccaauuccuagagauggucaacaauuucccagcuaccuugccuuucaaaugcaagccaaccaauccagaguccauacccuagccauuuauuuuaugggcacucucacccucugggccacuaucccccuucccuaaucaccccagaaccagguauaggacaacuaaggacagagagcccauaaaccccagagccugcugaaaugaugcaaacuagccaauccuaaaccugcuuucucugccucgcccauuccuucccgcagaaaccacaagaagggcgucugcugacauuucuccagacucccucugcccgcugaccaaccccagugccuccccgugccgccccccauggcacagccgggccccucccuuuucugugaguaugaccaucuuuucaauggcagucaucuccugauuuuuuggccuuaccauaccuaaauaauaacaaaaccuauauuuuaaaacaucaaguucaucaggaaaguuaaaucccaauggauuucuggauuaccuaggcuuucccuugcccauccucccaggcucagccccucucugggcuggcuugcacacauucucaauggacuccuucccaagguccuugccucagccuugucuaucuugaaacuuccauuccuggggagagugcccggugccaccugcagccucagggucucuuaccuaauuccucggcaagugcugagcgugacgcuggacaguucugucucccucaccgugccgugguaaaagcagugauccuagcaaggagaaaggagguggucaggcuaaagaacacugauaagcauggcaauguuaauaucucaggauggucauggaugacucauggcuuauuauauaccuacccaaccuuauagcaccuuacaaccugcaaagagcuuuccaagccaccauuucaucugauucccauaauaauccuaggagacggggcagggaagaugucauuaucuccaugaagcagaugaaaagcugaggcucaaaggagcaaagagauuugcccaaggucucccugcugauuggaaaauccagaauuuuccuaguucagggcucuuucaggaaucaguguuuucuguggccaaaagcaugccauggaaagaacuugccuccccaccaauguuaucuuugcaacccccugcaaugaguugaauagaaucccccuaaaauucauguccaccucagaaugugauuuauuuggaaauagggucuugcagauguaguuaaauuaaggugaugucaugcugggccaggcgugguggcucacaccuguaaucccagcacuuugggaggcugaggcagauggaucacuugaggucaggaguuccagaccgcccuggccaacauggugaaacccugucucuacuaaaaauacaaaaaucagccggaugugguggugcacaccuauaaucccagcuacucgggaggccgaggcaggagaauugcuugaguccaggagauggaggcugcggugagccaagaucgcaccauugcacuccagccugggcgacagagugagauucugucucaaggaaaaggaaaaaaaaaaaaaagauggugucaugcugaauuagagaagguccuaaauccaaugauuuguguccuucuaacaagagggaaggacacacagacacacacacagaaagagaagaaggccauuugaagaugggggcagagacuggagugaugaaguugcaagccaaggaacaccaaggauggccagaagccaccagaagcuagaagagccuggaaggauucucuccagaggcuuggagggaguauggccccgacaacaucuugaguuuggacuucuagacuccaggacugugagaaaguaaaauucuacuguuuuaaaccuuuaaguuuauggugcuuuguuacaguagcccuaggaaacaaacacucccuacucuuccacagcucaagaugcucuuucacacaaaucccuccacaucuggauuguacuugauuugguaccugugcccgugaggucugcugcugcucuccagccacugugucucauggcugucagaauuucuccaucacuacaaacagcugugaccaccgcucugugccaggccaggggccagccccuggagacaccauagccagcaaacggagucacagcuucagccuucguggggcuuauggucuugugagaggcagucauuaaugagaaauccaaacagauauaauuacaaaccaaaagaaggggcuugaaauaaccauuucaagugcuggccgagcauuuuauaagucagguaaccauagaauuuaggaagcaaauacgcacuguugggcaugcuaaagugcuaaaccagacagaagggggugaaaucaggacgguguccaacgaaucagggguaacaacaagagacacauuccuagaggcuuccucccaaauaagucaagagagaugcacuggucagaacagagagaagauaaaacccacaggguagagccaaguucuggaaagaucucaaaagggauggaugcaaaccacacaguugcagacauggaagcuuucucuuuucccccaucucuaggaccaugcugcuugcaguugcuucuuuguccccaccagacagggaugugacccaauaaucagcuaccccgugugucuguauucucuggcuccaccucccucccagcucuaauccugaguauagacaaauaauuaaauucaaacauuuuggcauagccaggcauauuuaaauccaagcauacgcaguuccacaacucucucugaccuucagugucuuuagccucuguaccccagagugguggugagaauaucguacauaaaggagcuaguagaguacuuggccgagaguggcaggcgauaaacaucggcaaccaaauaaucaugaaauucuccuuuaucaaagaauauggccucaaggcgccuggaagcccaccaagaggcugaauccaaagcccuagcugugccaaugcuccagcauauccagccagccaugcagccagaucaaaggauacaggccaagcugacacucaacacggccucguucuccagaccacaggugcccuuucaucugcauaugauccaucggccagcgauguggcuccucugcccauucaagcucauagucaggaggagggacagagccaaccccugucuuugcaucaaacucuucuggacuuuaaacaagucagaugccacccuugagaggagcacaaaggaaagccagugugcugugauuaugaaagaaggcguggcaggcaaaacccuccuccuggccaggauuccaacugcuuucaaaugccagccugucauguggcuucucaaccuacccgugggaucugggauuuggaggccccucaugaagcacucaaguccugaaccugguccuuagaacucaacaggggagccacaaaccccguagcacaggauuacucauggggagaagaggggccgggccuguguggaguaaauggggcucagagaaguuggaaugacagagaaucaaggaguucagaaacguguaucagcuacaguuucaaaacgcugguuaacagaaagaacugaggccaggcgcgguggcucaugcccguaaucccagcacuuugggaggucaaggugggcgaaucaugaggucaagagaucuagaccauccuggccaacaacacggugaaacccugucuuuacuaaauauacaaaaaauuagcugggcaugguggugcacuccugucgucccagcuacucggagacugagggaggagaauugcuugaacccaggaggcggagguugcagugagccgagauggcaccacugcacuccagccuggugaccgagcgagacucugucuccaaaaaaagaaaaaagaaagaacugaaacccagggauggcugugaagaaucccugcaccucuuccuaucuuugaauggaugcuaagaguguucacagcccuaguucucucgaaaauagagcaccuggcuucuguagcaugcuuuauaauuuacagagcuuucacauacacuaucucuugugaugaugacaccuacaacuuacuauuauuaacaguaagaggucgggugggguggcucacaccuguaaccccagcacuuugggaggccgaggcaggcaaaucacuugaggccaggaguuugagaccaccuuagccaacauggugaaacuccauuucuacuaaaaauacaaaaauuagccaggcgugauggcgggcacuuguaaucccagauacucggaaggcugaggcaugagaacugcuugaauccgggaggcagagguugcauugagucaagauuacgcuacugcacuccagugugggcaacagagugagacugugucucaaaacaaacaaacaaacaaacaaaacaauaagagcuaacaucuaaccaggcauggcggcucaugccuauaauaccaaugcuuugggaggccaaggcaagaggaucacuugaagcuaggaguuugaggcugcagugagcuaugaucaugucacugcacuccagccugggggacagagcgaggcccuaugucuaaaauaaaagagcuaacaucuacccagcucuuacugcuugcugaacaacuuagcagauuuuuccuugugauucugaccacaaucuuaugaggcagauauuauuauugccauguuuuaaagggggaaauugaaagagagguuuuaagucauucacaaggugacacagcaaaguggauacuggaaccccagcagccuggccccaagcuccauccucugccucucccagcaguagcaaaggaggaacuuggcuugucagagcucuuuuauccccaccuucucuagcaacaaaggagacaaguucuagccuaagccuugccacuuacugguuaacugaacuugggcaaguuacuuuuccccuucuccucucaguuuccucaucuguaaaaugugggguuggaagaguugcuuaugaauucccauaaaaauuagugauucaucuuacccuuccacagcccugcgagucagauaucagcauaugcaauuugcaaaugagaaaacucaacacuaguguggucaaggggguuguuuaaggucauauaacuaguuaaagccaagauaacaacccuggcugcagauugcaaacccugucauccuuucuguuggaacacauucacagacccauucccccaaccgccugaccuagaugcaggcugucgccuaaaggccugacugaugagucuugauaagguucccagaacuccagcuaccccaggccaaguuugguaguagagugcagucuccaacauucgggucaagggcagcugaguaguuuauuccauucccauuuuucauugagcucucagcucccaaaugggaagucugacugagaaccccaugggccugggugggagcuuugcaagagucuaguagcaggggauguaagcaaacaaugaguuguccaucccaagguucagcuaggaugugcuucagucaacaagaccuucuggaaggaggggauucugggagagggggaguucuuuuccaauccucucuuucugaaaggcccuuacaacaucucugccuaaugcacaagcagagagcacaaagaacaagucaaggaucagucaugaagucauugcauuccucagcuucucagccugauggggccaccccaagggggcuuucauagcaggaagcgugagcucauggcaaauucguggacugagacccauucuugagcuguggguacagaaguggcaggauccaaacucagaggagaguguuugaaggaggcugucauggcuaacagcuuucuaggcaugccuguucccccaucccaccccugccccuggaggcagagaacagaggucucaagaagagaggaaaaguuuugaccaaggggcauugaagaauaugaagucacaacuggacagccucccuggggaugagaagacacaguccaacuuugcugcaggcaccggccacacuaccaacuccuuccccauccaagaaagucuugguuaagaaggcagcacuggucuucacauucagccacaaaacacagccccugagcuacccaguuacuaugcgccacgucucuuggaucuaucaaaaacuguggccgggcacaguggccuguaaucucagcgcuuugggaggcugagguggguggaucaccuuaggucagaaguucgagaccagcuuggccaacauggugaaaccccaucucuacuaaaaauacaaaauuagccgggcgcaguggaucaugccuauaaucccagcacuuugggaggccaaggugggcagaucaccugaggucaggaguucgagaauagcuuggccaacauggugaaacccugucucuacuaaaaauacaaaaauuagccaaguguggugaugcaugccuguaaucccaccuacuggggaggcugagacaggagaauugccugaacccaagaggcggagguugcagugagccaagaucgcaccacugcacuccagccuagguuacagagugaaacucugucacacacacacacacacacaaaauuaccuguccugugucccuuuccccauccagggguaaucuggcgaacuaaucugagcuguuaaugacugauaguggccaguguuaucuugcuggacacuugcacuccagcagggauauuuuaaagaaugggccugguagaacacucagguuccaugagaagcugcugaaggaguccugaugcagagggaccucuccugcuguucuccacaccacaacucccagucugugugccucaguaguccauuauguccugccccaaaggcaaaggccacugcugcuccugccagugugcgucuucccuucuucacccccaucucaccagcccagacuuugagaauggucauucgaauccaggguuucucaacuugggcacuauggauauuuggagcuggauaauucuguugugggggaguggugggucuguccuaugcauuauagaauguagaugccaguagauccucccugccagucacggcaauaaaaauugccugcaaacauugccaggugucccucggggucggggcaacgccauugguucuccugguugagaaucaacguucugagccuacaaauuccaauaggcaucccuguaagaagagcuagccaccaugaaauguguaucauucacuacuuuaaaugucuaccaguggaguguggcaaagcaaacugacauguaaccaucugaaagaccauuuucuaaaugaaagaucuuugacauugcguaaacaucccuacucaaaaacaacuuugagggaaaaaauguccaauaugaauauagaagcaaaauaaaauauucauaacuuaaaaaucacauuaaaauagcagacuacaaaauguauaugcacagugauuacaacucuguaaauguuauacauccauuuaaaaaggacuaaucaaacaucuaauuggaugagacgacaggauuaugaguaagucacuccuuuuacuaaaacuuuuguuaacauguggguaauuaacauaaagcaaagaacauguauauuucacaguaauuugcaucaauuguaauuagaugcaauuacccuaaaauagucuauguuucuuuagccauuguagucagcaaaggaggaggagcaccuaugaacaucaaauacauguuuugcuucucguuugcucccuuggucuucgcuugggggaaacacucccuucagaggagagaccaacuccaucaggcaucuccugagguccuaggaguagggcugggagaggacagcugcuggauagacauuuguugaccugaacucaccuccaauuuccguguggugguuugaggguuaccacuugaaguauaauggguuucuguguaggaaggagcaaaaaguugccugcaaaaaauaaaaagagacauuuauaucauaaguggaugaacuccacccuccuagcaacaacgagugauuuuaacugaaccaggcaggacuaucccaagcaucuccauacaaaagaaacuaggcagccacaaggggcuaaggaacaaaaaggaaaaccauaaguuuguuauuaauuuuauauuuaauguaaauuaaauauaauuuaucaucacuaugggaacaucacuccaacuagauggaauugacagaacuaaagcaaugaucuuaauauuugucuggguccugggaaaacagacaugcaaacacaugcaaaauuucccggggccuaugaacccuguuguguaccgugguugauuuuuccagcacuggaucuaccaauuuuuaguaucagcagaccaauuuuucuuuaagggaauaacucuucccugaugcauauuuuggugagauugucaaucaagguguccuacuuggcccuggccaaggggugaccuguauuucaagcgaagccaguggagagauacugccaggucugaacagauggaagcaaugcaucuguucuucuguuccugcuacaaggguucccuaagcuuccguugccugcccuuucggacacuuagugguuccgauuuccugagaccugguaauucuauguuacucuuccaauaaauuccuuuuuuucuuuucuaaacuuggacauugguuucucucaccacagaccccuugaaguacagguuaagaauccccucaccaaaggccaggcaacuucaagaaauguucuuagaauuuucucuaaaaauuaaaagaaaaauauaagagucaaauggauguuucaacuauuaauaguucagccacauuaaaggcagaauugaucuacagaaagucaaggucagccaggugugguggcucacaccuguaaucccagcacuuugggagacugaggugggcagaucaccugaggucaggaguucaagaccagccugguuaacauggugaaaccccaucucuacuaaaauuacaaaaauuagccaggugugguagcaggugccuagcugggaggcugaggcaggagaacugcuugaaccugggggguggagguugcagcgagccgagaucacgucauugcacuccagccuaggugacaagagcgagacucugucucaaaaaaaaaaaaaaaaagagagagagaaacaaaugcccuuuguugauggugauuaucucagggguugcagaagauguuuacaauauaaguugcauauuucugaaguugguugacuuuuaaauuaacugucagagagguguuuugaaaacugaaauuuuaauuuaaaacugcucuuaaaaagaagaaaauguaggcugaggccagcacagaaagccaaaggaaucugcagggauaacccagguuuugaaagaggugacauuucccagcaagagagggucaucgcagagggucucuagaauuccucuagagucacuuccagcucuaaguucugggaucgcucagauuucccuccauccccaguguguggucagaaggcaaaugccacaagaauugucuccuguacuaugucaaggccuucaacuucucgccuuggacaagaagaaaagaagcccaacaggaaaauguaaaaauaaagcaaagcacaaaccccagcuuugugaagagaaauucucauucacauggaaacuuugggucaguggcuaaccugccagaaucugucucccaguccuuucucuuucuccuuagcaucuaacuaguccaagauuugagggaggagucacccauuugccugagggagaaaagcuguaagccucaugagggcagaggccaagcaguuuugcucacugguuuaugucagugcuuaacauuuguucaaugagaaaaccacuuaacuaguuaccgaaugaauggauggaugaguaguucaguguacuagcagcuuagagcauggucuggagacuggaaaacugaaguuuugauuccagcucugacauucacugccucuacggccgugaacaaguacauguaugucucugaaccuuuguuuccucuuacacaaaaaagaggaugauauacucauuugauagggcugugaugaggaucaaacaacauaauaaauguagcagacuuaaugccaugccuggcacaaaguggagcuggguaaaaguuagugauaaucauuauugcuuucaacagggauuaugacagaagaacccagaaaguuucucucucuaacuuuccccagccaugaacucuccaguacaucacuuaagagaggugguaaaacgcaaugugcucauuccugcagcccauuuccuggguuugcuuucacagacugcgccauguacagcuggucaggaguucagaguuuaauaguucauuccaggugccaguggggaagugugaauuuucccacagaaaaugcacuccugguaaaaauauucucagccucuucugagacuuagcaaggggggagaaaucauucacccagugacauuaccccaucaucacaggccucucugacccucagcacugaaaggaacccuagaaaucauguagucaaaccccaauuacacugugagcuccccaaaaacagggaccuugugucuuugaagucuucuccccggcccccagcaccuagcaagcaggcaguacaugugcauucugugaaugagugaauaaacucgcaaacgaaugaaugaaccuuuuaucucguguaggaaucugccaaauggcuauucaccacuggacaccuccagggagaggcuacuccugagacuacccacuccauuucugaccacauacaguaguuuaauguuuuacuccggauuaaaaacuacaccucugucacuggcacccacaggccuucauucuggccucugaaucuacauaaaacaauccgcuuucauuuuccaccuaaucacccuuucugaagcagcaauaucagcaucaucuagaaacuaguuaaaaaugcaaauugccaggcuccacccagacucaugaaucagacagaaacucuaggguuagggccagccaucuguuugaacaacucugcagcucccccaagcuagguccacauacgcccauguguccaggugcugcucucagaaccaaaggacgcugcugucccacagagaggagggcacauggucacugagcagcccggcccagcccagcugccccauucucugaccacaucuuguucucaucuccucccugacgaggggcuggcucagcagaccggcaggaagccgucucucaccauuggauugcauuaggauuuucaggaaacgacuugugagugaugugcauccaggaagagaaaggacugugcaagauuucccauuccgcccacuccuuuuuucuagcuuuaaaagaaaagcaauuucuguucuacccugcugcccccugcucugucugcucugugcucaggagcccacggacaggcagaaaucaguaggacacucugccaugucucggcaccaucauaauaauagccagcacuagaguugagcaaaaucugggucauuuagauuccaaagucccugagcaaaaccugcaucuucagacucccaccuaggaaaauaagcuacccccaaauaccggacauaaaacauuaggucacucucuagggaagaagaacuggaaccuguacaagcagccaggcccugaaaguacacugcagccugaaaacagcucagacccgucuuuccuaaggcucagaagcuucaaacucaggacaauuccuuuaaguucuauuuaucgucagacaaauuucaaaugccucucuaggcuaaaccacccucuagagaggaaggagcagugacacuaaaaugaauuugcaaaacaucuucugggagcucaaaccuucuuccuccugcuucagauaagcaaaccagugaagauaaagugauaacaauuucccauuuaccuugaaaaacacccucugcagacgagcucagcauaggcgagcaucacucugcucaucucaguagcaaguuuugcugacaccuccuuucucugggccuuucucuaucuaauucuuccaagagucuccaggcauuuauacccugaugaugccuugggagguccacuuuucuggucucucuuauuucaccuggagggucuucauccugccuauguuaguaauaauguucucaccaugcgacuuagcccaacaacugcacaacaccuggaaagacuguucaaaaauacacaauccccucccuuuucuagggaaggauuaagaaaucuguauuuuuaauaguuuuuuuuuuuucaggugauuuauguuuucggguucugggaauuauucuacuccauuugagcaauuuuaacauuuuuaauucuuuuuuuuauuucuagccuccuaaucaccuuccaaaagucuaaagauggugcuaacccagcauagagggaaagucggaaugcuuugguuuaagcagcagcugcacuaggcaacugcccuuccaaagccuggaaaugaagcaaaagaugacuaugguuccucucaaugucacacaagcguacagccagggcugggugcaauggcucacgccucuaaucccaggacuuugggaggccgaggcagguggaucacacgaggccaggaguuccagaccagccuggacaacagggcgaaagcccgucucuacaaaaaaaaauagccaggugugguggcgcgcaccuguaaucccagcuacucaggaggcugaggcaggagaaucgcuugaacucgggaggcggaagcugcaguaagcugacauugcaccacugcacuccagccugagugacagagccagauucugucucaaaacauuaaauuaaaaaacacuaagggagcacagccaagccuuagacucucagaggccugucuacgguucucuggacuuuaugggaagaguguggcuuugaaagauguacuauuuacaauuaauuaggacagcccuuguuccacucuguaaaaucagauguuaacuuguaaaaacuuaauaagauacaacagaaaugcaaauauuuccaucuaguagaaaagauaaccccaaagguuaugauuuuacagccccuaggauauuaacuaguuuugugucuaauuuagcaaucuuaucucagcauuccuuuuuucacuauuaaauacacacacaccgccacacaaauacgucuuaguuucccuuauccaauuuuaaaccaguuuuaucaucuugcugguuagcccauuaauuagauaaauaaaacuucgagaagugcucacuauguauuuguauaaaaauuguuuucacgugagccacauaaacccccuccauuuucuagacugcaaaaugaacagacuaauaaucaccaucaguaucacagcgaugcugaggaucaaaugagaaaauacauucaaauccuagcucuuauaagucgugugaauucagacuggucaguaacuucuccgugccuaugguuucucaucauaaaaugaggagaaugacaaaaucuacuucacagugccccuguaagauguuagaauagugccuggcauauaggaagaucauaugaacaaaugugaaagaauuauuuguaaaguagaaaguauuugugcuuuacaaauauugcuaucauuuucuccagcacuagcuauauauacacguggcaaaaucuugaucauuguuaaaucuagguaaugggcaucugagguuuauaauacuagucucucuccuucuggguuuguaaauuuugacaauauuuuuuaacuggcuaggugauacggugcaagucacaaacuacucagccucaguuucccuuucuaucaagcagaaauggcaaugcccaggacagacagguacuggaaagugucucugaaaagcagagugcuauucuaaugucauggccugcacuagucuagauuugggacaaaauaaauucagugaguauuguuuuguuuucuaagaugcugaaagaaaagcagggaagagacagccagagcugcuucagaaccaagauuucuacaucaguacucauuccaccucugacuccaaaggaauggaaacaaaccaacgugccaaaggcauggcccuaaagccaaauaagggacugaugaguccagggggcugcaagcagacacauuccuuuaugagggaacagaaaggcgaaggaagggggaacuuuggagguugcuccuagaguaaaaaauugggaccuccuccuaucccagggacucccuugaauaagcaccaucguugccagaggaccagcuuuggaagcaacacuccgaaggcaaaaauggcgccauccagaagccuggcaaaaggccaaugcuacucaguauguuuucuuuaacuuccuauuaaggaaguuuccaaacaaugcguuaagucaacacucccuuucaccaaccacuucccacgacaucuucucccaguccgcacaagaccuggcacccuuccgaccaguuucugguccuguguuuugcuuuuacauuauauaccaaaggauguuuggaugagcaccacugacuccuuuggccagcagggucuuuacuuaauccucuucaggccucccucguggcugccucugugaagauggguaaccucucugcacaaauagagcugacuucuugagaucagacaacuuaacuggcagggaccugcggggcccucaaaauggcucacccaagaagaguucacaaauuuguuuuccagugucccgaauagcccauuauguguauuuguuggaauuagauaagaacaguucggggaaaugaggugcuaccuuuagaauuucugagaaaaaucuaaaagcgaaaauggugaguaggaacaacuucucuagcaaccaguuuuugguaaauaaccacaguguugaucagauuagccgauaccacagaaaaccugaagggaaagacgaauguaagaggguaugaggaaacugccauaucauaaagaaaaacgguguggauaagacacaggggaaaugaagagaaggacccucugagaucacuggagcugugagaauaugcuuagaaaaaagggaauaagcggaccacucccugaaacuaacaaacaaacauaaaacagguaggugaggaccacaaaccagccugcuaaauguaggugcuuagcccuuuuuaagcucugauuaaauaucccaguaacuuucauaaacuugcccaauguuucuuagcauacuaagacacagaccgcacccaaagcauaagucaaggaugucagaacuuggaaagcccucauagaucauaguggauaccuauugucagagccugcccagcauccaugccaccuucuugagauaaacaguggcccaacuugcauuuaaagaaauacuccccucucguugcauugcugacuagggcaccuggaguuggucaagaucccugcccuugccuggccaaaugaaugcuucaugauaugccuggacagucagaucucaucucagaauuucaagaugauaguacaugaagggaccgucuauucauucuaggaucucaaccuuuccaaaccuuaguuuuucaacuuuucccucauucuaugcguugccccauauccuuuccaaaaagauuguuuaggagaagcgaggguuaguguguaaguuacagagucuaccgcaaugaaacauuauuuauauaccacccucucugcccaacccugaccuccacuuuuacagaugaagaaucugaaaaaaagcaaaagcaacuugcccagcaucacacaguuuuuguuucuaaacccaucauuucaauaaacuagaguaagcuaaaugucagugguagacaagccaagaguugggccauccagacacacccaguaggcagagagaaaggcucuucaugcaaucucaugaauaacugcauauuaagcaguguaaugugguacaaacugcaggccaccuggcaucaggaggccagaguuucucacagcuugauuucgucacuauuugcuggggguccuugaucaagacgcagcaccuuucugagcaucaggccuugcaggcccugcaccugcaaguccacuugcacccuccacaaacauguauggagguccgugaugugcaggcacuaugcuaggggauggggcuucagcagccagugaggcaggccuagguuuccugccccucuccuggcuuggcaccugcagcucccaagugcuuggcaaaugcugacaccaugcagagggcaggugucacugucugguccccagaaggcacuguuucacagcucaucuuccuuccuggaacagcugcaaaccagugugguaaccaauuucuaguuucuccuaaaaagcugucuacacaguuauggagaagggauguauaugugcacgcacacgugugugcaugcaugugugcguguugagagcagagagcaaggccagucuagggaucaggaauuaaggauacucacucaacauggcugcccuccuucuccaaacccauauuccuaucaccauaucccugagaggccaguuugaccuuugcauucuuacccaagccccaaaucuagcaucagugagucaagagauaaagagcuucuagaauacaaagagccugacauuccuuccaacacuuagaucacucuuuuccccagcacuccagucucccuccaaaggagucccuuuccaugacuugcccuucccuucuccagaaggggggccuuggaaaaagaaaccaugcuugauauaaugcagccauuauagcuccuuggcccuucuggcccucuccccggggagacugaugcaagaggagaaaacguggagacugccaguuuucugcaaggaggaaaggggggaagugagacacaugggagccauggaagaggcuggaaaagagccacaaguacagaagucauaaagaccccauuucuccuucaaccggcugaggaaaguccggcccagcuccaccuacucaaugauaucauuguuuucaacaaaagccgguuucagaaucccuagagagguccccaaugaagccucagcugcuggaaugggcagaggucucaccaguuccuaagagaccaagugcuuagaauuuuagauaaggaggagaaaacagagaaaaccaggggaggcacagauuuugcuucugcugggccugucagcguuauggaaagaguacaggacacugcuuuucacacagguuuuauuauugcauccccaugaugauccugccaagguggugacuaggaauuauuaccuagucuaauuaguccauugagucuaauuaccuaucuaaugagaaaccuaaagauccaaggaaagagguggcuuguccaaggucccaccacaagcuaaggaaaacuccagggacagacaccaccauugcugugguuugaauguauccccgcaaaagccuguguuggaaacuuaauccccaaugcaacaguguuggaagguaggccucaugaggagugauuaggccaugagggcuccaccauaaugaguggauuaaugcuguuauaaaagggcuugaggcugcaaguuugcucucuugcucuuuuuuucaugugcuaucuugcccuucucccuuucaccaugggguagcauagcaagaaggcccucaugagacgcugauaccuugauguuggacuugccagccagcagaacugugagaaacagauuucuuuucuuuauaagugacccagucucuaggauucuguuuugccaaugcaaaaugaauuaagacaacuauccugcuacuuauucaagcuagaaacuuuggacugucccuugaaaccacccucucccucagcccacaugcaacccauuucccaguuuccaugauuccacccuauaaauaucucuggaaucuauccucuucucuuuauaucagcuaccucuucccuaaauuaguccuucucaaaugcguuuuggaugcugucacuaugugacuuuuaaaauauucuucauccgcuucccauugcccuagagauaaaagcccaaacucuuuaaggugccuacaaggcccuuuaaggacucaccucugccugccucaccaauuucuucucucaucauuuccuuccuccugcucucuguucuaacuauagagaacuuuucauuuucaaugucauucuugccuuugggccuuugauccugugaucugugcugccuggcacauacucccuauuguaugagccaacucugccacacucuccaccaccaucacacucccccuuuucuuuacuuccuccuaucagacuucccgugcccccaauccagaggaaguuccccuuccccauguuccuacaguacccucuacuuccucccuccuagcaggucccacauuguucuguaacuguuuaauuaucuguccccucuacuacguucuaagccccaugauggcagagacuauucugaucaccauugauucucccgggaauaaccaggaccuaucccagugccugccacauaguuggcacucacaauauuuguuuaaugaaggaagagaagaaaggaauaacauaaauuaggaauucucaaugaguaguccagaacucaagcccaguacacugggaagagacuugccagaaaagccagggauucucugacucaauaccugccccaguugaguuugugcaagaccuagcaacuugccccauaguacccagaagacuauucacuuaguuuauucaaggggucagccaaaggucuguguaugucacugaguucuaaauaaagaaaaagcaaaucuuaauugcucaaaaucaaaaacaucuccugggugaaauguaaauguaguuucauuuucaggacagaaucuguccaggggccacauugucagccuccucucauuuuucuccaggauagucaugcuccauugcccaaccacaaaggguaaagaguaggaaacacccuccaauuuccagagagccuagaugaagaguuuaaucacauccucggagcugggagaaaagagaaggccgaaagagccucucccaaauccaaauguauauccauaaauccgucugcaucccgcccaccagccuugcaucucaggaggcuuccccaucuacagaaguugugaagaagccaucaaugccuugugcucagccccuuccaauccaugggcuccauccaccaaguacaccuccauccucuuggcucagcccaaauuguucuucaguggggaggggugggaggaaagcuacuucucuuccaagguguagaaauacagccuagcuuuuaagugcacuucaaguauguuuccuagaaguagcucaccuacuucccugaccacaugggucugccugaggcaagagaaugcaacucaaagucaaaaaugggagaauuaaaauauugagcucuaugccacucaaauccucugguagcccaccaguggaagaaaaagcaacccguuccccaaccucaacauaucacucuucugaauucaaauauuuggcuaguuagggauacuaaauuccuaaaagauuaguagcacuacaguuuuagguucccuuugauccagaccaaacauuuacacauuguuuucucagucugaauuccuuucucauucuccauucaucucaucucccucccucaucaaaagccucccaucauucugcaagacaauauuucaaguaacccucauuagggaaggcuccccucuuccccagucacaaauucccguuccucuugccuucgcaguucuuuacuuucaauucuaccauguaaauuuguaaucuguuuuggauuaugcuguuugcaugcuguuuucucucccacagagucuaaacugccagaagguaagaauauccuguuuucaugccuagucucuacagcaccuagcacaggauucuacauagaggugcucaaucaguauccccugaaaucaaacuuguagaauggagaaaaauuagcucgagcuuaaaaggcagaucuaucaacuaaugaauggguuaacaaaaugugguauaucuauauaauguaauaccauauagcaauaagaauacugauacauacuacaacacgaauaaaccucaaaaacuuuacccgaagugaaaguagccagucaaaaagaccacauauuguauaaucccauuuacaugaaacauccagaauaaguaaaucuggagacaucagauugccagcuucauaggacugacguggggugggggagaaugaagaaugacugugcuccuuuucuaggacuaccguaacaaaguaucacaaaccaaguggcuuaaaaaucggaaguuuaugucacacaguucuugaggcuaaaaguccaagaucaagcuaucauccucucucugcaggugcaaggaaagggcuuaucccaggcucucuccuggcuucugaguuccuucgccugugguggcauaacucuaaucuucacauggcauucucccagagugugugucuguuuccaaaccucccccuucuaaaaggacaccacucaugcuggauuagagaccugccauacuccaguaugaucucaucuuaacuaaauacauccacaacucaauuuccaaauaaggucacuuugagguacuggggauaaggacuucaacauaugaguuuggggggacaccauucaacucauaacacugcugauguuuuuuccuuuuggaguggugaaaauguucuaaaaucagauuauggcgauggcugcaugacuuuguaaauauacuaaaacagaugaaauuguauacuuuaaaugagugaacuauaugguaugugaguuguaucucaguaaagcuguuuggaaaaaaaaaaaaaaagacaagagagcuuggguuuaaagagucugcccaagcucaauaaucaacucaaugguguguuugggaaaacaggaucucucaacaagggcagugagauauaaacuugcagaggagccaagggcaacuugccuuuauauauccacguuacauguaaauucgcuuugacucaguuggguauacagugauucauaccaucauucucucuacucugcacguuugauaauuuuucacuauaagaagcuguaagaguuaaucaugcauacacauagacuauaauaucacacagccacgaaaaugauaugauagucucuucaauaaauggugggaaaaccauaugcagaagaauaaaacuaggccccuaucucucauuguauacaaaaaucaaaucaaaacggauuaaagacuuaaaucuaagaccucaggccaggcacagugguucaugccuguaaucccagcacuuugggaagccgaggcaggcgaaucaccugaggucaggaguugcagaccagccuggccaacauggugaaauccugucucuacuaaaaagaaaauaauuagcuggcgugguggugcacgccuguaaucucagcuacucgggaggcugaaacaggagaaucaauugaaccaagaaggcaguggcugcaaugagcugagauugcgccauugcacuccagccuaagcaacagagcaugauucuguccccccaaccccaaaaaaaaaaaaaaaaaaagaccaaaaaaacuaagaccucaaaccauuuaacugcaacaagaaaacauuggggaaaaucuccaggacauuggucugggcaaaauuucuugagcaauaccccacaagcacaggcaaccaaagaaaaaauggacaaaugggaucacaacaaguuaaaaagcuucugaacagcaaaggauacaaucaacaaagugaagagacaacccaaacaaugggagaaaauauuuguaaacuacccaucugacaagggcuuaauaacaagacuauauaaggagcucaaacaacucuauaagaaaaaaaaaaacuaauaauccaaucaaaaguugggcaaaagcuuugaauagacauuucucaaaagaaggcauaaaaauggcaaacaagcauaugaaaaggugcucaacaucacugaucuucagagaaaugcaaaucaauaccacaacaagcugggugccuugacucaugccuguaaucccagcacuuugggauggaucacuugagaccaggaguuugagacuagccuggucaacauggcaaaacuucaucucuacuaaaaauacaaaaugcaaaaaaauuaaccaggugugguggcgugcaccuguagucccagauacucaagagacugaggcucaagaaucgcuugaacccagaaggcggagguugcagugagccaagaucgcaccacugcacuccagccugggggacagaucaagacucugucucaaaaaacaaaacaaagcaaaacaaaaaaaaccgcaaugagauaucaucucacccaguugaaagauaggcaauaauaaaugcuggugaggauguggggaaaagggaacccuuguguacguugcuggugggaacauaaauuaguacaaccacuaugucaugcuaccauaugauccagcaaucccacugcugaguauagacccaaaagaaaggaaaucagugggccaggcacgguggcucaugccuguaauccuagcacuuugggaggcugagguggguggauugccugagcuuaggaguucaagcccagccugggcaacaggaguuugagaccagccagggcaacaaggugaaaccccgucucuacuaaaaauacaaaaaguuagccgggcaugguggugugugccuguagucccagcuacucgggaggcugagacaggagaauugcuugaaccugggagguggagguugcagugagccgagauugugccauugcauuccagccugggugacagagcgggacucuacucaaaaaaaaaaaaaaaaaaaaaaaaggaaaucaguauacugaagacauaccugugcuccuguguuuguugcagcagaguuuacaauagccaagauuuggaagcaaccuaagucucuaucugggaugaauggauaaagaaaaugugguacauauacacaauggaguacuauucugccauaaaaaagaaugagcuccagucauuugcaacaacauggauggaacuggagaucauuauguuaagugaaauaaaccagguacagacagaaagaucaacaucccauguucucacuuauuuguaggaucuaaaaaucaaaauaauugaacuccugggcagaaagaguagaaggaugguuaccagaggcugggaaggguguaguggggagaugcagauaguuaauggguacaaaaaagaauagaaaaaaugaauaagaccuauuauuugauagcacaacaaggugacuacagucuauaauaauuuaacuauacauuuuaaaauaaagaguauaauuggacuguuugcaaugcaacggauaaaugccugauggaauggauacccuuuucuucaugaugugcuuauuucacauugcauguuuguaucaaaauaucucuuguaccccguaaauauauacacuuacuauguauguacucacaaaaauuaaaaauuaaaaaaggaaaagauaaaauuacugagauuuguuucaugggcuaaaaaguaaguaaaaauagaacuucuaauuaauuuuuuuaaauaugauaaagguacauggagacauauuuauaauaugcucauaaugugaaaugguacauucaaccuuuggggagguaucuguuguuguauaaaugcaaaaugguacauucagccuuuggggagguauuuguggagugagagguacaacuugucaaaauuuaaaagcguuuuaauuguguacuccauaggauccuguaacucuacaucuagguaucagugcuacagaaauacuugcaaaugugcuuaaagauuauguacaauccuauugcuaggauuauuuguaauaacaagaaaucagaaaccuaacugucaguuaauaaggaaauuaauaaauuuugauucauccauucaguggaauccuaugucaccauuaaaaagaaugaaacaggucuauaaaugugcucauguggaaagacacugaagacaaaaaauaaaaaagccaauuauaaaauaguauauaaaguacgauaccaugcauuuaaaaacucuauaacuuguuuaauuuuucucugaaguuuuauuaugaaaaaugucaaacauuccaaaaaguuccauguaaaaucuuuuaaauguuuuuaaaugcccaugcuauauuuccaagugaaaaaaaauagguuacaaaaccaagaauacacuaugaccucauuuguauauaaauauacauagggauuuuuaaaaucuacauaaaauauuaaguucaugguaaaugcucacucccucaaugccagcuauuguuguuaucugaagguaagcagccugaugauaaagggguccccaaacccaagcauccugacuucuuccaaguccacagcuucccuuaguucggauaaggguccaucuaaggccaacagggcaguugacagcuuccucccauucauuuuaccccgugcuccugcugaagagcagccaggagaaauaagcuugagacaaaagaaaaccguggacauccuuccuggcugcacaggcagcccuggcugcggaucccuggaaggagagccggaaccagugaacaaaucccaaccucauauuggacaguucagggccucaucugauucugcaggcacagaaaagagguacaguuuggcccacuggagaacacugcaaagcaguguuuucgagauacaauuaggucaaacugggcaucgcuggagagcagaaguaauuuccucccaggggcaauggguuuuaaggucaacucuucuuaauuacauuuggaaaccaacucaggggaauucccucugacuucauucuuaaaugcuuuucugacccugcaaaacacaaauaacagugucuauuuauugugcucucauagugcaccaggcacccuguaaauccuuuaagagcauuacguuauugaauuccacacacauccuaugagguuauuauccccaucacguagaugagaaaacugagacucucaaagguugagcgacuugccaaagcuuacaccuccagguagugcaaggagccaagcuugggaugcacaccugccuggauuacacuaucacauuacacugacaugcaaauucuaaccagggccugggaaagguaggaggaaagggaagggggagaguagaacaaugaagaagaaaugccagugcuaaccaaaaaagagcccaaagcauaaugagccaggacuaugcaucugagaggcaauauacugccccaguuaaaagccuggacuugggagucaaacagaucuaguuucacauccuggcccugcucuucccacccacaugacuuuuagcaagucacacugcuccacaccucaggguccccaucugccaaauagggcuaauauaggaaucuacucuucauugguugguugugacaagugaaguagaugacccauauaaauaccacaguacgaugccuguuauacaggcaucuccuacuuuuuagcuaucaccauuuguuaauaugugacaaucauuccuaguuauccucagccagaaguucccuaagggcagacagagcaucagagaacaugacccggaacuuggguaauguagauaagcaauaaccacacagauuauugcucaauauguuuuuuucucuugucauuuucaugcuugaagaaagcugcaagggccacaugucacagcuugcauccccaaaacaccugaaaacauuuguucuggacguugcauuaguacaaauuagcauguauugaaaaccugcuugcuaugugccagacguuguacuaagugcauugucauacauuaucuccuaaccucacaaacccuguguguguguuuccuggggcuaguguguaauaaauugucacaaaauugguggcuucaaacaacagaaaguuguuuucacacagcuugagaggucagaagaaugaaaucgguauuauugggccaaaaucaaggggucagcagggcugcgugcccucugggagaaucuguuccuugccucuuccagcuucuccuuggcucauggcugcaccacucuaaucucugccucugugaucacaucacugucuccuguucugucuauagucaaaucuccuucugccucccucuuauaaauauauuugccauuguauuuagggcccauccagguaauccaagauaaucuucucaucucaagaucuuugauuuuguuguuguuguuguugcuguuguuugagacggagucucgcucugucgcugaggcuggagugcaguggugugaccucagcucacugcaaccucugccucccaggcucaagugacucuucuuuacugcaaccuguuuuaucagcaagguuuuuauaaccuguuuuuuuuucuuuuucuuuuuuuuuuuuuuuuuuuuuuuuuuugagauggggucucacucuauugcccaggcuggagugcaguggcacaaucucggcucacugcaaccucugccucccggguucaagcaauucuucugccucaaccucccgaguagcugggacuacaggggcgcaccaccaugcccagcuaauuuuuguauuuuuaguagagaccagguuucaccauguuagucaggcuggucucgaacuccugaccucaggugauucaccugccuuggccucccaaagugcugggauuacaggcgugagccaccaugcccggccucaagaucuuuaacuuaaucacaucugcaaagauucugccacauguuccagggauucgaaugugguuaucauuggaggggagagggugcauuuuucagccuuccacacccugcaaugaagguaucaaugucucuauuuucuaugcaagugcuauaauguaguaagaggcaggcaggccagaguuugacuccuggcuaugcccaauacuggguaaauuauuuaaacuccucaugcuugaguuucauuauaaaaugcagacaacaauaucucauucaaaggguugccaugaggauucaauaagacauugugugaagugccuuuuccgaaguauccauucucagcaaaugcucacaaagcagugaguauuauuacuauuauuugagacagcaucuggcucugucaaccaggcuagagugcggugguaugaucucagcucauugcaaccuucaccuccugggcucaaaagauccucccacuaaagcuuccugaguagcugggacuacaggcaugugccaccaugccuggcuaauuuuuguggggguuuuuuguuuguuugguugguugguuuugguagagacaggguuuugccacauugcccaggcuggucucgaacuccugggcucgcgugauccacccggcucagccucccaaagugcuaggauuacaggcaugcgccacugcaccuggccaaguaguauuacuaugaauacagaugaagaaguaaaacuuagaaggcaagugacuuaccaaagaccacccaaccggaagugucaguaucuggaauugaaucagggucucugggaccaaaguccaaaucuguucuacucuauggauuaggauguuuaaggcuugugugcacaaggcuuucagaaucaacacaucuaggcuauuucaauuuuggaugcucucugauaccuuagacaagcguaucaugaagcugcaucccuucagaucaccaggcuuauuacugagucugagcuuaagcaauggacccuaagaaagugauaucauguguccaauauuuuagaaauaauggcaucuuaguccauucuggcugcuauaacaaaacagcauaaccuggguagcaaauaagcaacaaauuuacuucucacgguucuagagucugagaaguccaagaucaagggaucagcagauuucgugucuagugagggcccucucuccgguucauagaugguagcugcuagcugugucuucaccugguggaaaaggugagcuaauucucucgggucucuucuaucagggcacuaauccuauucaugagagcagagcccucauaaacgaaucauauccaaaaggccccaccuccuaauaccaucaccuuggggacuaggacuucaacauaagaauuugaagggagacauaaacauucaguacauugcaaauggagacccugcuuaugcuggggugggguugagaguuuggcuuauaaaaaaucacaucagacuggcuggcaauccauuuguucugcaacuccaggcauuugggacaacaugggaaaugcaaaugaaaucauucucagucuacaaagcuacaauuagaaacuacaucucaaacaggacuaccaggucucucuggaaugacgugccuagcaaagcacuuggaauuuaaauccacucaugcauucacugccuucagcgucaacacagcaggguuaaaccaguucuucauacuuccaaagaacaugugaagaaaauuucagacaccacaggcagcucucaucaaauucugguguccccacccauucauccaacuguuuccucagcaccugucuccccggguuauacaaccuuagccauggggaauggggagcccagcugcgaguagaguuuggaaaaacauuuugaauacuuuagaucugccaaauacuugguuaaagaaugauauccuuuaauuucuugagccauguguauuuuaagugcaauguaauccauaugucuaugacucauuuaaaugcaacucagugaagcaugguuuacuaagagcauugggauaccaucuaagccuuucuaagcugcucuuugauccaggaaauugaauuuugccaacaacaaaugaagcuccugacaagagagggucaaagagagcuguccuuuauccuagguaagauguuaaagucuacucuugaccugggaggaagcugggaggguggagguggggagagcuccacugccuaagugguauucauaguuuugcuuugggucugcuacuauuucuaccagguauccuugaaaaagaagugcaggaauaagagauggcaacuaaucugccccguguguugcugaaaaauuccuuuccugccugcuaauucugcccuuccucaauuccaccaguauuaugcaauccaaauuguauaauggacuugaggaaaaacgagaauguuagggagcuagauuacuccauuagcacugaauguuaauuuuccagauuguagcuugauuuccaggacaaugaaagccuucuccuucccuaugauaucacugaaggacugauaagaaguuagggauaggaagaaagauuaaaguuggaaguaaugauagguauuaaaaucaguaaaccucuaaaugcccaaauucugccuugacaauugcuguuccccaggugguuuggagguagacauacucacaaaagaaaacaaacgcccguucuuauuaacuaaacuugagcaaauaagaucucucuuuagcuaacugggcuggagcacaaauggaugggguuagaccaaaggacgucucucccuuucucaagccaucaucauuuggacuugaggaaggacaguguauugaagaaaugagaguccuagaauguguuuaagauacuagaagacagaagcauauggccaaagagccucugggcaaagugccuacuaguugagccauucauuugcuuuugaaggugaucuuguaauagagugauccugcucacuaguaaugcggcccagugagcauccaggaaucugguugagcaauucagugugcccuccuuuugggaaaaagccaagaaaggacaggauauggcgcuggggcucacauaacccuguucaucucccuggaugccugcagcuaacuaaggaggauuccauuugauuucagcaaacaaguuuuugucaaauauggguuccuggguuggugagguagucucaggacauggggaaaagaacauagagaaaaaauauggauuaaugcucaaaucuguggguugugcaaacagcagucuauaauuucugcucuguaguuucccuucuuguauuuucuguugccugaaccugcggguucugaccuagaaguucguccccaacuucaaggucccgugauuuggggcaccuuuuuccuuuaucccacugcccacuauuucccaggaugucuccacagguagagcaaauuuccugaggcagagacuucuuuugcauuuuucuacucacagagcauccuuuaaagagguagugcaggccgggcgcgguggcucacgccuguaaucccagcacuuugggaggccgaggcgggcggaucacgaggucaggagaucgagaccaucccggcuaaaacggugaaaccccgucucuacuaaaaauacaaaaaauuagccgggcguaguggcgggcgccuguagucccagcuacuugggaggcugaggcaggagaauggcgugaacccggaaggcggagcuugcagugagccgagaucccgccacugcacuccagccugggcgacagagcgagacuccgucucaaaaaaaaaaaaaaaaaaaaaaaaaaaagagguagugcagaaagagccuucagagccuauccggggccaaaaucugcauuuuacagaugagaaagcagaggcucaggggagcuggcuggcuuuuugaccaauuucauaucaucugucucugaggucaaugcuauguccacuguaccacacugccucaaucacaaguuucuccaacagcagcuaugcaccaaucuuugcaaauuaugugauuacauguguguauaaauauuaaacaauguaauauauacuuuauuagagcagaagacugucuucaugacauccaguugaguucaaaaaaggaaaugcuggagcaauaugucugacauaaucucauuucugcuccucccuccccaacaaaaauagcagcuucugugugacugugucuguaugugauugugucugugaggauucaugugcauguucuuguaugcauagaaaagguccaggguuugcucaccaaacagcaguggauuuuccucgugggagggaaacuuucauucuuuuguuuauuuggaauugcuacauguuuuacaaugagcaugcuuugcuuuugcaauuuaaaaacaaugagcaagaaauaaucauagcuaccuugagcuuggaauacaaacaaggcacucugcuaaguccuucaccuguaccaucucauuucauccucccuguggcucuggcucuaugacaugggacuauaauuacaccccagaugcacaaacugaggcuuaaagaggcuacaagguaguaaguggcagagccaggaucugaacacaggaauaaccgacacaaaagcaaugcucagauuaucccuaaagggucacuguuuuucaccugcacucaauagagaaaagaaugugugcuucucacggaugucauccgugaguugcugaguugcuucaaagcagagacaggcugccggcugccgcgcuauuguaggacaccucagugugucugcugccugagcugaagcucacuuugcuguguucccccuccucuccuggcccaugccccaugccuuuccauccucaccauucuuggcgaucucuccaugugugaauuccauuaaaggcuugcucacugcuauuuugggccaugcauuaauacgugggcuuugauuugaugggagaaggccagacacggcaggaugaugaaaaagaaauuuaaaauguccucucccuccccccagagucccagaagcccuugcucaccgcuccugggagaccugagaauccaguguauggggaaauguacagagggagaguggaaaccuucaucaucuauuagggccuuggaacguggcuguucccucuccuuggaauugucaucucucagcuacccauauggcucacuccaucaccuccuucaggucuugacucaaguaucaguucaccugaaaggccuucccugacugccauucagaaacagcagcucccauucuaccuccacacuccccuggccccacucccuaugcuccucugucuccugcacagcacccaucaccugacggacggugcacucacuugucugcuuacuguuucccacuagaauagaagcuccauaaaggcuguacuguuuuauucacagcuuuauccccaguaccugcacuggugccugaaaugucacagaggcacguagauuaaaaaaaaaaaaaaaugaauacguugaucgaggagguuaagaaccagaggcugagaaauggcuuggcccagggccuaguuucccccaaaugucaugagauuauagaaacuucaacacagugauuugaaaaauuagaaaaucaucucccccgcuccaaagcuguuuugaauccggacucgcacgcaccaugaaugagaaggcuuugggaaauaaacacacuaggaagucgugugcaguuggaguuccgcucacuaacacauguucaaaacaaaaagcccaauuuggaugaaaauagcaggaagccgucccccagggacaccuggugaggucauauugcuuggcucugcugcuuccauuuuuaccaacucugcugccuucugccaauucaaggaggccaggaaccacauccagccccaugcggcucaaugggaaacgagagcugcucucggaaaagcagaugcuagaaccacagccccgggcucuccucuggagccucagugugggacaauaaaaaucccaacaguggcuggccacucaccaugcgcugugcaagcacuuccugcacuucaccucauuuauccucacaaccaucccacgaggcuggccuuauuacccucauuuuauaaacaaggacaccgaaguuccaaaagauucagccauuugcccugggucacauucuguaacuccagacucacaccaagaauacacaugauccuaguuucagcucuuucauuuacuugcuggguggccucagacaaaugccuaucccucucugaaucaaaacuucugcauccauaauuucagaguuuucuaagaucauuccauucaguguuuucuaaggcaucuuccugcuuuagcuuccuauggucuguagcaaauguuucaaaauaggagggaaggauagagacuugaguccugggacuccugcuuggccaguccaacuccuaagcauuuucccacaacaccaacacuaucacuugggcugaccagagggagcugaagggccacaggcucuacugggggcagaacaggagagauuagacacaggcaacaacagggaacacuuagacuagaguuaaugggaacaaagcugccgugagcaacaaaggcaggcccccgagagacacggucaagaacaaacccucuaagggccuuuucuuguaggaccaaaggaagacaaugcaaggaaaaauccagggccaauagacgcugcacugucuagggacgcagcuggccaggucuauuccagggacacaggagagaagaaacacagccuaaacuggcuuuacucucaagaggagaggaacaaaaaugacugugauccccaucuuucuggcuucccgaggccaccauguccuggaggcagaggaaggauguggaugaagccccaccacugcacaagcugugaguuguauuuuaaccacacucgggacagcacucauccuccuuugcaagugcccaaaaagcccaaauuuggaauaaauuauauucucccuuuccacccaagccuaaaagcuauucccauccuuuuguauacaggaagguccuucuucauccuuuucuuggcagugaugcauuugauuacucauuggcuuccaggggguucuggaggcugccaagaggagacaggcagcucuccaagccacgcagccuuaucugcgacgucuguguggcagaacgaaaagugggacggucaguggggaaacaccaaauguuuucagagucccccggccaaguaaggagagcucuucauggcuaaguagauggggaauggccaaagaaugagccacagacauagccaugcaucgugcccauucaccuccuccauuacaugaauccagauaugacugcaucugauggcaaaucaaugugcaagugccucugagccaggcuaccacccaagaugaaugagguuaagaagauggaagagccgggcccgauguagccaggagacuguugacgaugcccuguugacaaaaucucagaugcggcugaaccagaacacauggaacaaucugagucugaggcuccaagccccagcacacccugcuuugcucgcuccucucugcuguuuuccucuaaucuccuucauuuccugccacacacuaggcuggcgcuaguaaggcagcugccaaagaccucugguccauccacucccuuaaucucacacauacacagaccucugugugcccgcagugaacuccaggggccccugaaauacugccuaaggaaauuuuagcaacacauuuagcaguccagcaaucucacaucgagucaagaggcuguggaaaggcucuggcuuugcaagaugcugccugaaagaaaccaaggacugagagcuuggggucacuccauugacugcuuccuuccagaacagcgacaccugcguccggcguugacacagaaguuauuuguuucauuuuagacaaaggaggaguccacuuacucauucuucuccagguccaggaucaguucucgccccucagccauuacccugagcucagcuuugaguggaugcuaaaagcaacaacaaaacaaugucaguuccuaaaagccggcaccaggcucccugggucgggcacaggaucuagcacagcgcuccaacauugauccacaggaagugaaugagcaaaggucaauugcauuuccagcccacauguaaaaugaccucaaucccagaaugacccaaauccuucccccaucugcuuucuccugaaaggcauagagaagaaacuccaggcugcaaugugguguaaguguauguauguggugcggugaagggaaacacuggaaaacacaaucuccagcaguaaauguccugcagagucagaucuggauucaagcaccggcucugacaccugcagcugugugaagucggacauguugcugagccuccccacaucucaguuucuucauguaugauacagagauaguaauagucaauuugauggggaucuuguaaggauugagugagauaaugagcauaaauaauguaucacagugccuggcacacggcaagccaugauacauauugccuauuaucuuguaaaauacuaggggauccucuucguaguggguucuuauuucauuuuggcucuccguuuggaaaaccccaaucaucucagaggaagcaacuaagagauccucaaauuaagguuuuauaggccaaaaaguagauacauuuuacacauaagcaguuugguaguggccacaggugcuacauauccagaacggaucacuuaacauauaccagugguugauaagcacaaaaacuauguucgacaucgcuaauaaaccaccuccccacguccagaaaaacaaauuaaaaauaauaagauaccuugaaaaaaaucaaagugccagagguuaucuaaaacucuaaaucacaaugcacaaugcccacuguaaacugggcacucgcaaucccuaccacugagaauuuaaacugacggcaacucucugaaagauaacaugacaguaugcacugagaguuuaaaaauguuuagacucggccgggcacaguggcucacgccuguaaucccagcacuuugggaggccgaggcaggcagaucaggaguuugagaccagccuggccaacacggugaaaccccgucucuaccaaaaauacaaaaauuagccaggcaugguggugggcaccugugauccuagcuacucgggaggcugaggcaggagaauugcuugaaccugggaggcgaagguugcagugagcugagauugcgccacugcacuccagccugggugacagagcgagacacucucucucaaaaaaaaaaaaaaauguuuagacucaggaaugugaggcuguuugaaaggaauaaauggaggcacaggcaaagguuugcacauaaggacauuuauuacuuauaauaaugaauaaugggccaggcgcaguggcucaugccuguaaucccagcacuuugggaggccgagacggguggaccacuugaggucaggaguucaaaaccagccugaccaacauggugaaaccccgucucuacuaaaaauauaaaaauuagcugggcgugguggugcacaccuauaguucuagcuauucaggaggcugaggcaggagaaucgcuugaaccugggaggcggagguugcagugagccgagagcaugccacugcacuccagccugagcgacagagcgagacucugucucaaaaaaaaaaaaaaaaaguaaugaauaaugaaauguaaccuaacuguccuaaauauaaccuguuagagaaugguuaaauaaaugaugauccauucauaugacagaacacugaaugaucauuaaaagcagcaacuuuaaguaguuguuaaauuacugacaaaauguacacaauaaucauuagucauaaagcucaaaauacaauacugaauauuuuauuuaaauacacuucgcaaagggaaaaauguagagagaaauaagccuaaccauuaccauaguuaaugggaucaugaguuaauuuuguuuucuuuugcacaucuuuccacauguuuacaauugcuuucacaguuuaagaaaagaacuuuuuauuaaucucuuuuuacuuuauuauuguggagaauuucaaagaaauuuaaaaaccaagucauaauaaaucuccacgcuucaacaauucaacuuaaggcuacugaacuuuuuucgaagaaauaaauuauuuuuuuaaaaaaggauauuuacauauuuaaaacagaacagauucuuuggaguguuuuaaacauaagcucucuauuuugggacuaaggaacugacaacuuuuuuugagacggggucuugcuuuguugugcaggcuggagugcaguggcacaaucacggcucacugcagccucaaccucccaggcucaagcauacugaguagcugggaccacaggugcaugccaccacacugggcuaguauuuuuaaauuuuuuguagauacugggguauuaccauguuuccaaagcugaucuugaacuccugggcucaugugauccucccaacucagccucccaaaguguugguauuacaaaugugagccaccucauccagcagauaaauucuugaagucccuuucaauccacaaaaucauugcuagaguagagcuucuagcccuucuaagguugaccucaaagcuuacuucuugcaugucugagaaaguaggucaccuguucugccaccucugguuagaagccuaccucgucuaagcacauuccccuuccucgcugcaaaccccacucugcauuaggauuugggcauuucugagacuuugaggucaccaagggcucugaugagaucucaacauuccgaucaaaggcucuugggcaacgcuggccauugccuaauuaaucguauuacuucaucucaagaaggaacauuucaaacccaccgaaguaggaagcuggggagauguuugaccaauaacuuucacuaagagauucacuucucuguuugucaugcccugauucagcucugccaacaccuauucugguugcagauccuuugccacuuuauggaguuuuugaggcagugcccugcccaaucacacugagcaucagggaccccagcuccaagugggcauuuaagaaagaccacacagaccgggcacgguggcucacgccuguaaucccaacacuuugggaggccaaggugggcggaucccuggagaucaggaguuccagaccagccugaccaacauggagaaaccccaucucuacuaaaaauacaaaauuagccaggcaugguggcgcaugccuguaaucccagcuacuugggaggcugaggcagaagaaucgcuugaacccaggaggcagagguugcgguaagcugagaucacgccauugcacuccagccuaggcaacaagagcgaaacuccgucuaaacaaaaaaaaaaaauaaaaaagaaagaaagaaagacgacacagcaacagagcuacagcaauucccucauccaagagguagguaaccaugugacugcccccacagaaaaugaauacugccccaaaucaaagcacuaucuuccccucccccaaagagacacaagcugcagcaggaauaguaaucuuuuuuuuuuuuuuaaacagagucucgcucugucacccaggcugcagugcagugacccaaucuuggcucacugcaaacuccaucuccaggguucaagccauucucaugcucagccucccaaguagcugggauuacaggugugcaccacugcgccuggcuaaucuuuguaauuuuaguagacaggguuucuccauguuggccaggcuggucuugaacuccugaccucaggugauccacccaucucggccucucaaggugcugggauuacagggcgugagccaccaugccccgccaggaguaguaaucuuuauuuuuaugugggugauccaaaaauaauucucucuauucuggaaggugcucaggcacugauauuuaaaaaaggauguucccuuuuucuauggggcauuucaagcaaaacaaugaaacugcauuuuaaggaucuaugaagcuuuucuguccggcucuacugaugagcuuuucugaugaaacuccacucuguauuaagaagaggcaccaucagcucuccucuccuaugaaguacaguaagcugacccacuauuuauaccucuccuagggauggguuaaaaauucuuuccccuucagucuagauuaaauagaucuuuagcuccauaggguauuggaaaucuguccuauauuugcauucccccuaagaucuaguauaauauuuaguauacaguauaaguauucaguuaauguuuaaugaaugugagcuuuaagucagugaugagaaaaagagaagaaaaaaauguuuaaugagugaauuaauuauauaaaugagaaugagaggcccaagugaaauccagccucuagucucucucucuucaacauucauucauuuguucauugaacaaauaguuacggugccaggcacuaugcugacuauuccuacagaauacaaugacccauaugcugggcagacaaugguugggaacaaagacaggaucugguccucugcuuuguucucaggcccuuccugaggaugcccggcauccacaucuggagagaacaaagaagccucuauaaaaaguagcagguccauuccucaggggguaugaauagguugcaauacccaagaucuuaauuguuaaaaguaaucugcucuaggaugaccauccauuaauuugucgagacuuuuccugaagcuauuuucagccucuccuacuuuuugaugaaaugaauuccaugcguuuacugccuuuaggacaaaauguuacuugcuuuuauuuguccugauuuuuuuuuuuuuuuuuuuuuugagacaaggucuugcauugucacucagacuggaggacagugaugcugaugcgacuauaucuuacuauaaccucaaacuccugggcucaggcgaucgucccaccucagccuucagaguagcugggacuacagacacacaccccuaggucuagcuaauuuucuuuuuuuuuuuuuuuuuuuuuuguagagauaggaucucaguauggugccccaggcuggucuuaaauuccuggccucaaaugauccuccugccucagccucccaaagugcugggauuacaggcuugagccaucgcacuuggucuguccuaaaauuuacacuguuagguucccuugguaaauccaaguuggagccuuuuuggacaugucuguauuauccuggccagaguuucaaggauccuggacauugcuccuuuccauuuaucuuuccagauucaacagccacaaugucugaagucuuuccugacacaucucuuuccugcuauaaucuugcuccuauauguugcccaauaaaucacaaaucauuuuaacccaaagagaucuuagaaaaaaccccucuccccagcuuucuuuucuccuuauucucucuaagcacuauuuuauaaaugaagaaaaucuaccacuucgcaaguggcaggucacauagcugguuacuggcacacaacaaccgcaucuuccuuucuugcucuuucacgucucacuugcuggaaaaaccaaaaccacagugggccacaguggcugacgccuguaaucccaacacuuugagaggacuacgugggcggaucacuugaggucaggaguucgagaccacccuggacaacauggugaaaacccaucucuacuaaaaauacaaaaauuagccuggcuucgcagcacacacauguaaucucagcuacuccggaagcuaaggcaugagaaucgcuugaaccugccaggcggagcucacagugagccgagaucaugucacugcacuccagccugugcgacagagugagacucugucaaaacaaacaaacaaacaaaaaaacaaaaacaaaaaaacaaaaaacaaaaaccagaaccacaaagaauauccuaaaugcucagguccucucugcaagaacaggacaguguuuuuuguuuucuucccaaucucuuugauaaagccuauguguuuuccugguguucuggccaggggagccuacuggauuuuaagauacauuccccaguacuaggucucuacgcugcgucuuauuaaaauaguuuauaguuuauauuauuaucuuuuuucucuccaaguacauuauuccuucaagaaaaugaaguauguauuaugcagagcaaaaauaacaaugacaauauuuaaugaauuccaaucaagacuaagugauuucugugacaccaacacaucugcacuuagcuugugucagcauuaaugugaauuuucauuuccucaacuaauagcauugggaaguguucuagaaguuugucauacaaggaaggaaagucccaucugugaucuccaaaaugggcacccagaggacagagugggccagaaacagaacuaauggugaugacugggauucuaagaaaguugaguagguagcccaaaccucaguugucaacuccugccaguguaaaugaggucuuuugagucuuaccuuuucucucacggggcuuucugaagucuuccacugagguaugauaaguucaugcugcagcuuggggcugccuuccucacuuccuccugccaauacaagaugcaaaaccauuggaaucccagaccucuauaccccagcuaagccacacaugcacuuucugugagcugccccugcacugggucauuagaagacuugcuggauuucaggcucuuggcacuuccuaggaacuaggcacucuaggugucggugauauugugguaaauaggacauauaaggucucuguacuuguaaaggugggagacagacaaugaacaaauguucucacauggugcuaaguacccugaauaaaauaaguuggggucauggaguaaagagacaucuaucaggaggugccuauuugaaacaggaugaucagcauagauggcauuugaguccugaggagccagaaggcagccaugcaaaaacgugggggaagagugccccagguagaggaaacagcaagugcaauggcccugccugagcagaagugaacuuggccuguugaaggaacaagcauaagguagggguagcuaguaaaugaaagaggaaguugguaugagauguggucagcaagacagccaugggucugauaaugcagagaccacggagagugucuggauuuucuuauaaauagacuuggaaggcacuggguguuuuaaauacagagcaauaugaucuguguuaaguuuaaaaaagaucacucugccugcgugguggagaauggggguggggugaggcagagcggcgagagugagagcagaagcaggaaggccaggcuagagauaugcuggagcccuggugagagaugaugguggcucagauuagaaugacaucaguggagaggaaugaagcggugggauucugggcauauucuggaggucaagcccaugaauacugcucccauggagcuuuaguuuucuugccuguaaaaugaagacaaagaugcuaccugcccaucucacagcuuuauugugaagagucaauaugaaauugccuccuacuccgcagagcaucacugcaucaaguuacauuaauuggagcuuccuaauggcaaguuuacauuuguauuccacuuucuacuucccaaaucacucucccaaaccaguucuccuucaugcucaaggcaacccugggaaguaggaaguaggaguccuguuuuuuuuuucuuuugagacggagucucgcuuugucgcccaggcuggagugcaguggugugaucucggcucacugcaagcuccgccuuccggguucaugccauucuccugccucagccucccgaguagcugggacuacaggcacccgccaccacacccggcuaauuuuuuuguauuuuuacuagagacugggaggaguccuguuuugcaagaaagagaauuuaaacuauaggagagauuuguucagggcgcugcagaacucaaauacuggcggcagacuaucuuaacaaaaugguaauuucccgacaccuaaacagacuggucuccguaguguuccugggaauggggcugaggacuccaaaaucuauucugucuaaacuaacuacaucaaucauacagaauaugaaugauaaaaagauggccauaguuguucuguuagaguggugauuaugaguaauuauuaacauucucuucagaauaccgauauaaugcacuugcagucaacauagauuuuaaaaauaaucuuauuggaccaacaccaauucaucagacaggcaaauauuagaaacaaugcauucauauauuuaucaaauauuuucugaguacuuaacuaugugccaaguacuaugcuaugaauaggugcuuaauauucauggaggaacaagacaagcauacugcaggacaggaacgguggcucacaaccuguaaucucagcacuuuggagguccgaggugggcggaucaccugaagucaggaguuugagacuagccuggccaacaaggugaaacccugucucuacuaaaaauaugaaaauuagcugggugugguggcgcaugccuguaaucccagcuacucaggaggcugaggcacgagaaucccuugaaucugggaggccaagauugcgccagugcacuccagccugagugacagagcaagacuccaucucagaaauaaaaaaaagacaagcaucgcucuugcccugguggcucugauaagucuauauuauuuuaaacaaaaaggaauucuauaauauuuaauggagcauuuaauggaauuaaaugauaucuacgauuguaaaaaaauagugaaagcaaucuaaaaucucaccaaaagaggaacauaguacauguuaagaaaaggucuccaaaacuuggaaauaaggcaagagcaagcaagaugucuucucaauguuguaucagagcauuguuuaacagacucacccauggauuacugcauuaucuaggggaauguaccauugacuuuuuauuuaccauugauuaaaagcuacacucugugaaguuauauaaucuauauauaucuauagaauucugucugacagagauguaagugauuucagcauaguaaaaagauaaccuggccaggcacaauggcucacgccuguaauccuagcacuuuaggaggccgaggcgggcggaucaccugaggucaggaauuugagacuagccuggccaacauggugaaaccccgucucuacuaaaaauacaaaaacuagccgggugugguggcacaugccaauaagcccagcuacucaggaggcugaggcaggagaauagcuugaacccaggaagcagagacugcagugagcccagaucgugccacugcaugccagccugggcaacagauagagacucugaaaaaaaaaaaaagaaagaaaagaaggaaugaaggaaggaaauuaaaaaagaaagauaaccaagaauuaugguuugcuucauggggcauccaccauuucugcaucugcccugggccacaugauuucaacauucuuucuccaaugcuuguaucaccccuuucuaaugcucccugaaucagcuuuacucuccuguuugcuaccucauuaaugaguugaauaaaucuuggccacauuuguaugagucguguuuuuaacuuuugaaaacuuuguauagagucauuaaaaucauguuuuacagagaauuugaugauguggaaaacgcucauggugugaagugaaaaacgcaagacacgaaacuguacuuauggguaugguuccaauuuuaucaauauauauccauaggaacacacaaagaauguggaggggaaaaaaaacaaaauaucaacagcaacuguggauuuggggguugcagaucauuuucuuuuacacuuuucguuauuucccagauauucuacagcaaguguucuccaaggacucaaaacucagagaaggcgccugugcuaggagcaguaacuagcuuuccuugucuuucuucaugcuuuucuccugcacuaagcacugacacaggccuggugcuacccuagaaccuccucugugccucaguuuccccuucggaacaacagcucaaagggcgguuccuuugagcccuuugggaggaccgcccgaccucggccccuggaaguuccgaacugucggaagagcucucagccucuggguuugaggcggcccggggguccagccagcccacccucgcuccgccggugcucgcucuauuugaaaacgcugacuguuggucccccaagcagcagucuggagucagcccagcccgucugcagcgguggagccagggcuaagccuucuccggucauaaugagagaacccgggcaccgccccccgggaccaagccuuccgcgaaaucugcuuauagcccccgagggauggagccggggaggggauuggugucugggaaacuaguccugagaaacacggacaucacccggcaucuuagcuggaaacaucgagucagaccccuucgcuucacagaaggggaaacugaggaccaaagaaggcggccgucggguuggcguggaaagagagcccugguuuccagugccaccgcggaccucaacccguggcguggccuugggcaaguccuuucccuuuugugggccucgguuuccccaucugugaaaugggugcguuugacuuggccuucaguagggcuccugccagcucggggauccgaaguguguggcugcagauacccagcgagccauccccuagccaaggcuaccacagucugccgcgggcauuuuauguccuaccccaccaguguggcaggcaccgagccuggucccaggaagccgcucccaggccacacgggcagggcgcucgggaugcucggcguuggcgagugcagcgggcgguagagagaaagacagagagagaggcggagcggacacgagggaccgugagaaaacggaggaggauaagccccgagaacggcggaaagagaagccaaaagcagaaaaacagaggaaggagaaggcgagaagggaaggcuagccagugagcggaccggcuguuuucuggcugcgccggguuuccccgaccucugccaccucccagggcgcagaacgugggaacaaagcccgggcucccaggcuggggacggcgggggcgcaggccccgcggaguugcgggaggcgcaggggucgcggucccagcgcuccggacccgcaaggcuacucccaggucuccgggccacccagccuccauccccccgcgccuggccacuuacuuguccauccaggcucccgcgccgcccgcggccggaggggcugcagggcaaacgccagcaagcagagccgggcggcgccugcgcccccuggcaugguggcggcggcccuuagcgcucggcgcucacacgcccucagccauaccugcccacugcccggcgguggaggcgcgucuggaaccccccggcucgccccgcgccuccccacccggcucccagcccucugccgagacgcuccgccuccagccccgcgggccuccgccaggggauggaggaggggaggcuccagcccggagggggcuggagggaggggccggggaggagcuggcgagacucgggggagcggggcuggcucaggugagggagaccgcggggaagggagaauccgagccccccaggaggagggauuugugguggacgcggccuguagagggucggggacucgggcuucuaggaguuaaacuggaccccucuccgcacagcggcccguuuacugucccgcacugugccagacgccuugggugacacucagaggugauucacccagcgccgucccccgggggccgccacucucggagacaggcucagaaagaguuaacccaaccgccaggcacaaagaacuaagugcuauauggacuucuuuuuuuuuuuuuuuuuuuuuuuuuuuuuuuuuuuuuaagcaggacacaaauccaggagccauuccuucugccugggaggagggagugaugaagaccagaggaaucccagaggagaagccaucugagaucgggaggaggagaaauggaacaucaggcggaggaaacagcccagacaaucgcacugggacgugaaaacccuugggcugcaugcggggagaaaaccagaauuggggaugguuaggguuuuggagggaaacacagggacaugugaccaaaaauaauaauaacuacuguuacuuauugaggacuuucuauguacuagaauaagaaaaucaugauagcuaagacugauaaaacgcuaagugucaaacgcugucuucagcacuuuacacauauucacuuauuuaauuaaucggagaaaauaacuuuuaugagccagggacucugcauacauuaucucuuuucauuagcccaguaaucccaugggguagguacuaguacuaucccuguuuuagaaaugaggaaaucaaaccugagaggcuaaaccacuugcccaagauuacacagcuaaugucagugccuagauucaaacccacauccguauaacuccagagccugaugcaacacaccuuauuuuccagguggagaaacugauaaugagagagaaaugacuugccuaagaucccucagcaaguuuuagcaaagccucguuguagaaucccagccucaaaccucguccaucuguuccuuuuucugagccucuuuagucaaacccagguugacuagagaagugcuaaguguuggagagggcgaggcacuccugaagaugauggguagguaggucuaucaaacccuacucaugggcacccaugagggaaaucaaauaagugguucuggccauuaaugucguuugggacuccguuagucuccagcugcug

SEQ ID NO: 16549 - RNA, 4010 nt, Homo sapiens
cugugaguauaugaaucuuuauuuguucacaaguagcaggaaugggggcaaaagucugggugccgagcagggaaugcaugagguaggcaagggaauagggauguggggcuucucgucuuggcuucucagcuccugcuguuucuuaguugauucacugcagugucguccugugauucugggauuuugugcucuauagauauaagaggguacugggaaggucuuggaugaugcuuggagaguacaggcgucuucuccagaacagccugccuagucuggucaagacaauuuucucaaaucaagggaagcugacugacagcauuugaggugguucacagacauggcauuuaacuaacacugacucgcaaaguaaaaacagcacuucccuuuucgauucucuuucaaaccuuaugcuauaucaaggagaaagacaaauauuggugcuaauaugucuuuauuaccucuccaacacuggaucucccuuuuuaucaaagacaagcaagcaggcauuaagcucagaaucacuggcaggcaauagaagcuaagucagauuauuuaauauuaucuuguuuucaugauguuuauucuuaugucucuucccuucuguuugcagcaggagggugcugguuuuucacuuauggaguaauauaaggcugucuuugaaaauaaguuuacgcuuaaaaaaugagucaauuuaaaggaaaguauuauuaauaauagugaagauaauccaugguuuuaaaaaauagagagcggugguaugugauugccuaaaaguuggaaaacacuccagagcaaggguucucacaaauuauuuccaaauaaucccaaauuauuuccaaauaauccccucaagggcagaggaaacuggacaucuaccuuugcccaaaaguguaccucugagagccuacuuguaacucaaguguuuccuucaagugcuguguuuuauuugucaugcaaauuuuugcuuucuacuuuauaacauauccauguuuguuuuaauguuaaaacaaugcuuucaauucuuaacuguguccuccgaguggacgcugcugcugagaugccucguuugugccuuggcauacccugggggauacauuuuccagcuugagaagcuuugucauggggcauucauccaacccaggugaccuacaauagcagugacguuugaugggagagaaauggguagucuauagacacauuuguacaaacgaccuacuguguggaaagcuuuaggcuacaugaugcgggcgcucuccuccccacucucauuccccacaaugaggcaguauagcgggugggucaccacccccccucuguaaggcacccgcaucaggggcauccugguuggcuucgggauccaguucagcuccaucucuggaguucuugcguggcauuuccaccagggggagccccugcaggucuuccucccucugaccaagauccggggccuccucuggccaucucaccaacccauuggccuccuccauguggccagcccuguaagaccaucgcggcucauggcaacggacacaccagaacuggaggcagaugaaggccaagacggcugugaagcaggccagcagaauggccaucagcacccaaagggagaucugggggucuaccagggagcuuccaggagccagcggacucuuauccaggguguggaacauggugcaguagugccuguaagggaaggcagccuucuuacagcugaugcacaggaaguagagaguggaaggggcaagauguuccagcaccacggagcugaucguucgaggcaccuucuccucgugguggaagcuguagcgaagauagccagagaagaugcuguuccaguugggccuguacauaauaugguaauaguccuccaggcagggcuccgaggacgaccaggagaugauggcuccuguauaagaaauguuccccaccucgauguucaucccgauucuggaaccagaaucaaagugaagagugacauccccugauuuaaguauguauuuaucauaaucauagccaccauuuauugcacauuugagacgggcacucauguugcccucaucuuacagacaaagaaauggaggccgagagguucuguuauuuaggcauagcgaaaaaguggcaggacaaaaguuaaaacuggggcugucccaugccaaaguucaggccuaagaacagaugcacccaugcaaucccagccacaucccacccuagcugagauccuucagauaacaaaggggauuuucuuaaggggauuguucucauccccuuaagaaaaaagaagaaaagguaaggagaaaucaguagaaccucagaggcuccaccuuuauucucaggucugugaccuccccucaggcaauugauucaccucaauuuuccuucuugaccuccuguuucugcuccaaguacugugagcucagugaucuagaacauucugcccacugcuuuuuuuagccuccugguucuguugcccauggugaguggaaauucgcuucgucacucuuuggcagcugaucucaccccaaagcuucugcucuuguuuuguuuguuuguuuuuucaaagccagcgguaccaggaaauuuauuuuaugggugaagauaaucagccccuaauaucagcauaacuaccacuauuuaauucugcuguuauuaugaauguuaaucaugguaauaaccacucacaguaagugguugcuaugucacuugucaugcuagaugauucacaggcaguaauuaauuuccuuuauucuucaucacauccucugagcuagauucccauuuuacggaugagcaaccugaugucacaccgcuaauacguagaaaaaggacuuagugccgccuaaccacuacauuuccuaaugcaaggcugccggguuuaguuacagacguuaucgcaaaaugaggugccaggacugagacccaguugcuguuuuuccagacaaaucaaaugagcccucuuuagauugccaggccccgcuuugauaagagagagccaucuucaaguauuuuaguuucucucaugcaguucccucuacugauugccccugaucagaaauacagagacagucauagucagccuacgcauauucacauaacagucucacccugcuuugucuuccgccucuccucccucacaugaaaccccguagguuucauuuuggguugcagugacauaguaaacagcugucaacuggauuuucgccugcauuggauauuaagccaaaccaauggcuauuaugaccugccuuucucucaccucugcuuucccccauccucuuguguuugugcccauuuuccuccaggaguggagcugcagaaaggugcacagcauugaguaguuucuuaauccuuguuuuucuucuguaaggguaacagugaacuaagauacucaggaaggugaauagugucuuucuauguggcugaauauuucuucccaguaaauagggaacgaaagggaugagacggaugugcucagacccuuccagggaaggucaucaugaaggagaccgaauguuuauguuuccuagcuugguguccucuacacacucauccuccccacaccacacaucacuauaaauacacuuucgaccacgaugaaaagagcuuaauucauuauaggcagccaccuguguaaaaccuuuccaucaggaguaaucaggaauccuguuucuugucacgcacaaauguucucuuggcuuccuaucugccacuagcugucuguacagauggaauuaccucagcagacauuuuuaagagcuuucugucaagacgcaaauagcauccucaccuuuuaggaccagguccgucucccuuauugauuuuucuuccucuguuuccguuucuaaauucuccccuauuuuuaacuauucauuugcccggcccuucuccaagcagagugugaaaagaagccauuuccauuuccaagaagagccaucuauaugucuuaccugaugcuugcagcgugucugguuagagcucugcccuccgaggugcaguagauuaaagcugagaga

SEQ ID NO: 16550 - RNA, 1461 nt, Homo sapiens
gcagguuguccccccggcacgcuccacagcuggugacccgacaguuccuggcuccuuguucagacagcuugucagugaagaagacaacacgucugcaccuucauuauucaaacuuggcuggcucucuaguaugacuaaguaacauggcaacacaucugucucucccuaaauaaauacuaccacauuauuucuucuaaaggugccucugcucaucugauucucagccacaccaaucuuuccaguuucacugauggaauguggcccccuaguuacuguuggggguuacuuuaagcaucaaguuaauccuugucccaaaauuucacaauacuuguugcuuuagacaucaguucagguagcuuacauuuuaucagcguucaacaacaccuuaauuguugacacuacaagguggaauugucaaugagaucauguaagcugcugacugaccaaguuuguaggacaaaaagucauuacauauuacuuuacuugcagaacugugccauguuuccuacuaaagucugaggugcagacucugguggaauagugacacagaaguuaucuggguauacaagaaucuaaaagacauucucucuggaaauacaaauauauaacaaagaguagagacuauuauuagggagugugcuucacugacagucugaauuggaucugauuguucuccuguuacacaggagagaguacuuucaauagaacaucuacauacugagagguaguauggcaguuaauuucagugcaagacugaaucaagcuuccuauauuuuggaaaaaaacuuauguuuuuucauggaaacuagauacucuuuacuaguuuauugaauaaaaaaaauugaagaucccgcauuuuuaaaaggcccuuuacauaaaguagaguuucuaguugacagauuuggaaaucagucugaaugggacauacuauggauucaacacacagaaugaguuuuccucaaaccacuaccuugacauagauuugauacccucccucaaaagaauccuauaaaaaauugcuucaaagccccuuugaaauugcaauagugcagcaaaaccacaaguaaacaacugccuguuaaccuguuauuucaaauauagacugaaaagccaacaggcauuuuucgugugcaauuuuucuuuuaaaacaaguuguaaguugaaauaucaaaucugcacagcgcugucccuucacagaaggcaagaaacugccggcacaucaugucagaggccgcccucggugcuguaggcuguggaagugggccucccucagggucugguugauguggaaguagaggccuuggcacagcgcggacugcucgggcacgggcugaggcguguuagggcuggauccggccauggucuggcucaagcugccuuccggcccgcuggcccuguccgggcuauugaugcugcugcugcugcugcugcugcucccaccacugucacugccugaagacu

SEQ ID NO: 16551 - RNA, 1461 nt, Homo sapiens
agucuucaggcagugacaguggugggagcagcagcagcagcagcagcagcaucaauagcccggacagggccagcgggccggaaggcagcuugagccagaccauggccggauccagcccuaacacgccucagcccgugcccgagcaguccgcgcugugccaaggccucuacuuccacaucaaccagacccugagggaggcccacuuccacagccuacagcaccgagggcggccucugacaugaugugccggcaguuucuugccuucugugaagggacagcgcugugcagauuugauauuucaacuuacaacuuguuuuaaaagaaaaauugcacacgaaaaaugccuguuggcuuuucagucuauauuugaaauaacagguuaacaggcaguuguuuacuugugguuuugcugcacuauugcaauuucaaaggggcuuugaagcaauuuuuuauaggauucuuuugagggaggguaucaaaucuaugucaagguagugguuugaggaaaacucauucuguguguugaauccauaguaugucccauucagacugauuuccaaaucugucaacuagaaacucuacuuuauguaaagggccuuuuaaaaaugcgggaucuucaauuuuuuuuauucaauaaacuaguaaagaguaucuaguuuccaugaaaaaacauaaguuuuuuuccaaaauauaggaagcuugauucagucuugcacugaaauuaacugccauacuaccucucaguauguagauguucuauugaaaguacucucuccuguguaacaggagaacaaucagauccaauucagacugucagugaagcacacucccuaauaauagucucuacucuuuguuauauauuuguauuuccagagagaaugucuuuuagauucuuguauacccagauaacuucugugucacuauuccaccagagucugcaccucagacuuuaguaggaaacauggcacaguucugcaaguaaaguaauauguaaugacuuuuuguccuacaaacuuggucagucagcagcuuacaugaucucauugacaauuccaccuuguagugucaacaauuaagguguuguugaacgcugauaaaauguaagcuaccugaacugaugucuaaagcaacaaguauugugaaauuuugggacaaggauuaacuugaugcuuaaaguaacccccaacaguaacuagggggccacauuccaucagugaaacuggaaagauugguguggcugagaaucagaugagcagaggcaccuuuagaagaaauaaugugguaguauuuauuuagggagagacagauguguugccauguuacuuagucauacuagagagccagccaaguuugaauaaugaaggugcagacguguugucuucuucacugacaagcugucugaacaaggagccaggaacugucgggucaccagcuguggagcgugccggggggacaaccugc

SEQ ID NO: 16552 - RNA, 12542 nt, Homo sapiens
agcaaauaaacauuuuauuuccacagcacgccuucccuuuucccaaagaacaugaguucaccucagccaucaaagcagagggcgaaagcugcaagugacaaggcaagaggcuccuagaaaaauagauuauacccaaggcucuccuccuggggacccaaacccguccccaggcucccccucagagcuugccaaauggagugaaaggcauggaaaggggcugggagaaaagccagcuccacugaacaaaggggagaggagccuggcagugagcagaccugggagggguguggggugggaugagcuuugcuccuugguugagugcuggaaaagggaagggggaagaaauaauuuauguugauguaauuaauguaaugaugauguaauggugcgugguuucaaucauggcgaccauuccagaucucucucaagugaagcuaaauucuggccggucuauggagguagaaauugaggacggaaggaaaguuuagaaucccuccuccccaggagaauagacauuuauuacccagcucuacccuuuggcccagccugccuccccaaauggcuuccaaaucccucagcuaaaaucugcaucagaaaauggaauuggaauggggauguugccuugcccaaacccuccagccucagaacugauaaagagguugaagagcagggguggggaaaaggaaguuaaggaaugaaauuacaauuuccccucauccccuacucaaauuccagucccagggcugggcuaggcagacugggagagaagaccaggcagcuguucucauuaucagggacccaugcagaccuguuggacagacauaguaggugagagaaggcugagcuggaggccaggaggguucuuuaggcuccuagagggagaagcaggggccuggggucaagggggagugggaagcaacacaguaacaagcagugggaagagccuuugagcccucaaacuuacgggccacccuccaccacccaccccccaagugcugacagaggggccccugcggguggcaggauaaucaagggcagagcuugaugcgggugcccuuggagagcacccggaagaaaggaaagacacgcucgcccaggaaggcagccgagaaggugugcacgugggcuagagucucugcguuguagaagcccaggcgcccagcuucauaguccagguacacaccaaagcgccuugguuucucacuggggcucagcagcgucuguucuguggagcucugggccugauagcguuugccguuggugcccacgcaccacacuucccgcuggagcaggggcugcuggggcagguggagccggcggcggcgauggugauggcgcgaggagcuggcauccccgcugcccacggaggaacccccagggcccaccuuuuccuuaugauggguugauucacgggcagcacccaccgcccagccccgccgcccgcccaccucuaccucccaguagugccggccggagcggaagcccugggcccccaguacgcagcagucggccgagaagcgcuugggauggucagcaaccuccugccgccgcucugccaggcggaccccccggcggucaggggacagcaucagggccgggugagccgugucaggguccagcgucagguccacuugggagggagggaggacaaauacgccagggcuggaacggcuguuccccugucagcagccaacuccacagauugggcccccuuucucccugaauccagcuccccacaccaucccagaggccagccucagauuccugcaggcucaucuugcuccucacucuuguuccuaggauaccugacaggucuucccccagccuggcucuuccugccacuccaccccaccccacccuccaggccugccugcacuaggucuaccugcucauggcuugaaaccucaaccucagaguggcugccuggauccugcuccaucucaagccccacaguuucccuggggcccaacuucccucaggacccagucucaggucugugaagggaaaggcaaaggaaggucguggaggugaccucccuaccucucgcagccugacagaacauccggcucauuuuccucacgauggcaucugucaggaagucauggcuaugggguuggcacgggucaggggaccagaccucugggggcugcagcuguaccucuucacaccuggaggaaggggaccgggcagggggugggaccacgauauucccagagggaaaagcaaaagcugaggggaaggagaggaggguccaggagauggaaacucagguccuggggaaggaaggagaggagagggauaccgaagagaagcagggacagggaaccagaugccacugggucacgaagggcaaagacugggaacacaccuauugaaagucuccuugauguccugggaauaagagaaacaaaaagagggagagggagaaagagauaaagagagugucagcugcacagggacagcguuccccgaucuccagucagagacugaaccugagcaggaagggagaagcagcacccucacggcccucaaugaacacacauccauuucaaccaccccaugccucgccauaccuaacucgccucauccugcugugagcccagggauacugucauuuccacaauacgacuugcucaccuuuuucaggaugucacugucaaaaagacuuuccucaacugucauuuaaaccucuccuacaaccgaaucuucaugcuuuucacuggguauaaucgccacacauaccacauucgacauuaacucuguuuccagcuuuaaaacauguuuuuggucuucagguucaaucacuguggguuccucccagggagaaaagaggcagcucuggacaggcguuugguaagcacugccugacagccaacacagaaugcugggggaacagggaggggacauugcucaccuggagcagccggagaccccccugcuggcuccgcuccugggccucugccagcaggcggcugagcugggcggccuguucugcaaggcgacuagccgcggcucccgcacgccccagcugggcuucaugcaucucucugagacgccguuccagcccugccugcucuucagccagaaaccgugucagucgcccaaacuccgaggccaccgcugccagcucugacuucaucuggcucuggaauggugcaaaggggauggcagacaccaccucaacacguacgaagauaaccuccaguuuugcaacuacuacuucucaaugcaaggcaaaggagcccuacacuccccagguccaagauagucccggaaagaggcucauccccuaccagccuuaccagauaccacccccuugcucccagcacaguggucucaaacucacuaaccucugccuggaacacuccucuccaccugacucuaccuaaguugacucauccuucagguccaaccuuaaauauuccaagacaagccuucccuccucuccagaucuaaaucgggaccauccccacaaauaucacuguaucucucuguggcacauauaauauugaaacguuguguuuaaaugacguaacuguuaacauccuuucccccacuguaccaugagcucccacugacagggacuaggaaugucuuuguuugccaggguccucggacccugacauaguaccaaucagaguaggcaccugguaaaaauuuuugaaaugaauaaauaaaagaauucaggaaucaaaacaugaaguuagggucccgacgccauuaaacacagugaccuuaagaaagucacccaaaagccccagaucagaacucggaaaaacuuuuucugugaagguccagauaguaaguauuuuuaugcuuugugggcuaagaggcaaaaaucaaggauauuauguagggacuuaauauccuguaacagaaaaaacuccugcccagucccacccuauuugccagggauggcccuuccugggugguaggcacacuuuucacacagcuaccaucggcugcagacgcugugagcagcaggccagaggagggucccaacugaccagacgcgugagggaacagccgccacagucagcuucacucuaugccaggggcacacagcuccuguuaccucuauacccaggagagcccaaaaguaucaacuugggcagcuggccagaagcacgaugacuuccuacucccagacagauccuaccauucagugccuagcagucgccagcagcagagucccuaacguucagguggcagugagcaugggcccuggguaguggcaaggcccaggcacuggcugggaagggaggagggaagagggacagaaggggagguccuggcuuggucuaugaagcucacagugccagcccaucccagcaggaccugcugggguuaugaaaacaggcgggagguggggauggaaaauguaucuuaaaagacuccuuggagaagggcgagcaauaauggaaaaaaacaacaaaaaaagcgggggggucggggugugcugagaaaacacuagacuaggaaauauuaggucucugcagugcuaacauacacuaaauccugccccagcuuaaacacacuggcccccucucaggacacagcaagugucccaggacaguguccgccucaugcuuagggcugcucugcccagugccugcauggauccuggggccggcagcuucucugauggcugcuauguggguuuugcuuugcccccuucaggcucuggugucggguagaaagccuguucugcagccuugggccaggcaccuaggcccuccaauccaggccucaguuuccacuccauuuuggaaccaggaaugaacaugccuccugauucucuaaggccccgcucuccucagcaccuagggaaagcaucuaccccucucccaggccuuagcuguccccuccucaggggaccaagucacucccugugagagugggaagcccuaccuuccuugccucgacuguacugcccaucagccccgucgagaacauucacccaccuucaguucugucacucgccucuccuccuuggcuuucaucuucugcacugccuccaggugcuuccucagugguuccacgugccccugcaguuuggccugaggaaacagaaaaagaaaagugggggcugggagaggcaccugcccuucagagccuaccucugcaauccucccuauagcaagaugggucaaagccugaucccuacccccgaaaaugggugucaagugaguauuauaccuuccuccacuuucuucuuucagaugaugacaaaagccuccaaucccucugugcacgucugcagaagcccuguguguauuuuuuuuuuuuuuuuuuuuuuuuuuuuuugagacagagucucgcucugucgcucaggcuggagugcaguggcacgaucuuggcucacuggaaccuccaccucccggauucaagcgauucuccugccucagccuucccaguagcugguacuacaggugcccaccaccacgccuggcuaauuuuuuuauuuuuaguagagacgugguuucaccucgccaugcuacccaggauggucucaaucuccugaccucgugauccguccaccucagccucccaaaguacugagauuauaggcgugagccaccgcgcccggccggcccuguguguauucucuaaagguaggagccucaagacuagagagcucccacgcucacagcugaggggaaguggcuugagccccgcaccagagucuuuccaggggugcccucaccuuugguccccuuccccuucacaggcgaucuuccccagaacucuucucucuaaauacuuuucugaugauuuuuuuccuaugcuaaaaccuuuccaugggucaccaccacuuccaaaacauugaccccacacuuccagccucaccucuacacucaacgccuuccacacagacucuuaacacguuugaccacauaaaauuacuugucauuuccugaguauaauuccaugcuguucccucugucugggagugccuuucuccacuuggcccaagguauucuuccuuuaaaacagcucccugaaaauggcccugauccuccccacccccaacauccucugugaucccaagaaauaucuaauacaugaguucccagggcaccaaugacaggugugccuccuccaggacacugcggagucccugcccacacucuacuuauuucaacuucuuugcuucuuucugcucaucugcuuucucuccugcucaauuacuugcuaaauggcaaaggacaccgaaaccccucuuccaaagguuguaacuguuauagccaauaggcacacgagcucuguguuucuacaauuuguagccaaauacuuuucuuuaaagggcuguuagcccagaaugaguggaauaagcccuaccuauuugcucuuaccuuuucuaugucuucuacuagccugucuccuuuucuuugagagagaauauaggguaggagagcuccagccugacuccagucaggaccagagggaagugaagugaccucaggcaagccaugcuuucaguuuccucagcuucaaauaagaagagaauggaccucauggauagcacacuuacugcagugccuggcauguagcagaagaucaguaaauguuaucuaauauuuguucccuauaccuuaagcugccagugacauccugauaaugaccccugaacuaaagaguuuaccaagccagagugcaaacagcaguugcugcacaggauaagugguuguagacaaaauuacaguaauaauggaauuauagucaacucgugacaauagcaugaacuacacaaaauuuggccuucugauauaacuuucuacuuuucuagucaauaauuucuccauuaauucagaauuuauaacgcuuaaauuuaccauuuacuguuuuuuuuuuuuuuuuuuuuuuuuugagacagagucuugcucugucgccuagaauggagugcagcagugccaucucggcucgcugcaacauccaacuccuggguucaagcaauucuccugccucagccucccgaguagcugagauuaaaggugcccaccaccacaccuggcuaauuuuuguauuuuuaguagagacaggguuucaccauguuggccaggcuggucuuaacuccugcccucaagugaucugcccaccucugccucccaaagugcugggacuacaggugugagccaccgugccgggacccuaaauugcugacaaaaacaaaaauuaauaagcacaaauucaaacagaguucuauuuaagauauauuuccuuuuuuuuuuuuuuuuuuuuuuugagaugggagucucgcuguguugcccaggcuggaaugcaguagcacaaucuuggcucacugcaaccucugccucccagguucaagcgauucucuugccccagccucccgaguagcugggauuacaggcacaugccaucaugcuggcuaauuuuguauuuuuaguagagacggaauuucaccauguuggccaggcuggucuugaacuccugacuucaagugauccaccugccucagccucccaaagugcugggauuacaggcgugagccaccacagccagccaguuauaagagaaauucucaaaacauuuuuucuuuuuuuuuuugagacagagucucgcucuguuguccaggcuggagugcaguggcgugaucucagcucacugcaagcuccaccgcccccggguucacgccauucuccugccucagccucccgaguagcugggacuacaggcacccgccaccaugcccggccaacuuucaaaacauuuaacugucgggcagacacaguaaucccagcacuuugaggggccaaaaugggaagauugcuugaggccagugguucaagaccagccugagcaacacagcaagacccugucuccacgaaaaaaaaaaaaaaaaaauuagcugggcaugauggcacacaccuccagucccagcuacuacucaggaucaccugaacccagaaggucaaggcugcagugagcuaugaucaugcuacugcauucuagccuggccagagugagacccugucucaaaaaaaacaaaacaaacauguaacuguucaggaacuauauuuacauaucauuuguguguuauuaccuauucaacaaaaaaaauuuuuacaaaacauuuugccaagcuacugguuacugcauguacauaucugaaaagaauaaaugacccacuuguggcugggcgcggugcucacgccuguaaucccagcacuuugggaggccgagacgggcaaaucagaaggucaggagaucgauaccauccuggcuaacauggugaaauccugucucuacuaaaaauacaaaaaaauuagccaggcgugguggcagucgccuguagucccagcuaccugggaggcugaggcaggagaauggcgugaaccugggaugcggagcuugcagugagccgagaacacgccacuggacuccagccugggcgacagagcgagacuccaucucaaaaaaaauaaaaauaaaaaaauaaaugacccacuuguaaaauagccuauuaagucagaaagggaaucacucaaauuaguccuauacaauaaaacuauguauuuacauuuacucaucacuuaaugucagauuaaauauguguauauggccucccaaacugcagagcgcaguaaacagaucaagaaaagagaguauggccaggcgcagugguucacgccugcaauccuagcacuuugggaggccaaguugggcggaucaccugaggucaggcguucgagaucagucugaccaacauggagaaaucccgucucuacuaaaaauacaaaaaauuagccaggugugguggcacaugccuguaaucccagcuacucgggaggcugaggcaggagaaucgcuugaauccgaggcagagguugcggugagccaagauugugccauugcacuccagccugggcaacaagagugaaauucugucucaaaaaaaaaaaaaggggggaaaagaaaagagauuaugacuuuuuuuaauuccucaccuacuucaggaccuaauacgggauuucaggcagcuggcauugaacaaauuuggcuaaugcaaauuaaaauccaguuucagaagcuccuuggagcaguccuacagggggaggugaaagagaaaggguggaaugcccauggauaguuuggccuggguuccuguucacaaagugaccacacaugauaugauggguaugguuaacuaggaacugaggagauggaaaggacaacaggaccucacaaucucugcuaaaaaugcagggacuaacagcuaggcaauguuaccaaugcagugauccccaugcuagacugggcuuuuuaaagauauucuccuacucacugauucagaaacucuagugguaggauccacuguauuuuugaaaaccuccccuaguaauuccaacaaucaggcagguuuaacaaucuuuguguagccaggcacaguggcucaugucuguaaucccagcacuuugggaggccaaaacaggcggaucaccugaggucaggaauuucagaacagccuggccaacacggugaaaccccaucucuacuaaaaauacaaaaaucagccagcugugguggcgagugccuguaaucccagauacucaggaggcugaagcaggagaaucacuugaacccgggaggugaaggcugcagugagccgagaucaugcuacugcacuucagccugggcaauagagugagacuccgucucaaaaaauuaaaaaaaaaaaaggccacucuguaaaagaaauuguuacuugugaugagguaauguagguaugucuagcuguaccacucagagcugagaaacccuagacacauuacucuaaaauugggguaacgaaaauaauaccuaaaugaaguuauagcaggaaucaggagaaggucugaaaacaugaguuauaaaacaaaaaaagcucugugcagaccacacagaggcuacccccuccuccuccuggucccacugcuucaaacccauccaggccuucacuaaguagugcuauuugugcuggcugccuugcaaacaaaucuccuuuaccuauguccaaagaagagucaaaaugagaaguaggggcaagguauuugucaaacuagaaucagacuccaagaaagucacaucagaaaagucaaacaacagacauccaaauggugguggcguuguuaguauacaccaggggaagggacaguaaauaacuaagucaauuauuacugaagcucuguggcccucuguaugguacuuaaagccucucugacuuuguuucccaaucuauaaaaugggaauggaaaacauaucaaacucaguguugucuggguuuuaacgagacaguccaugaaaagugccuaguacagugccugguauacauauaaauguccagugaauauuaacuaucaauccuggacaaauuaaaguccaaagacacucacagacuuaaucaagauuugacaaugcaacuugcagagccaggucuucugacugaaaagcuccugcuuucuagucagugcauaagaaugacacagagccaaccaaaguccuugaagacagaaccaagccauaucgugguagguggggaacccacugggaggcaagugcagagcauuugggucugacacugacacuagcaguuaucucuguguuccugcuucugagccuuuucuuguccuuugaagcccccaguucuuuccaucucuaggugucuccgucaaggacagacuuaagacucacccgaaagaaaacgagacuucugguaaagcccuagagaccugaucuggcaucaccggcuuugcucuauuugcuuugaggaagccauccuucccuggucgucuucacugcaucugcucuguguacagaauccuucucauucuaauccaccuugguggcaguaagugcuuagauaagcaaacuuggcucaccaauaccaugagguucuuuggugggugaagagauguuuccuuuucccagguccccuuacuuccucuccauccccccacuaaacucccaucuucucucuguacuucucucaccuuguacuccugcaccaccuccuccaauggcaccacgcugugcuguuuguggcuccuggauucucggcacaccacacagauggccucuucgucuaccucgcagaagagcuucagggcuucuugguguuugggacagaugcccugaucggucacgcggcucccucgaccagggguugggugcaucugccgaaucaccuggaccauauuggccagcugcagguuggggcggaagcuccgccgaggaaagcucuuucggcacugagggcaugugaagcaccuccgaggggcuggaggcgggggcaguggggugacggggucuagauccucuuccucaaccuccuccagcacuuccuccucguccuccucauccuccccccucagguccuccuccuccaugucccccaaguaguaguccaggucuuccuccucguccuccuccucccacacauaguccauguugucccagcuggaccugcucaugccacugguccagaacacacccucuucuuccuccucgaccuccuccuccaugucacccucguagucuucaucccgcaugggggugucccaccccgcgccagcccccacagccuccacuuccuccuccucuccguccuccuccuccuccucccgaucuaacucaucucuguccuccucauccuccccaccccacaacuggguuacacaaacucggcagaaguugugcccgcagccgauggacacgggguccgugaaguaaucgaggcagauggcgcacaccgccuccuccugaagggucugcacaggguugggugucauggcaacggcagccaucuuaguguccagccagccaguguagagguucggugggggggcgaggggcgggggucuucccuaccgacgcccuggcgacccggcuccacccccagcccugccccuccacaccucgccccaagagcagccagagagauguccugccgacaacccaccccaacacaguguucccuacucccaaacgacaaccgugucucuacgaggggaggggacagugcugggcgccaccgccaagucccucagguggcucugaguacaagucugccccaaugcucccuuggacuccucauaaacccccgccccuccucacuuccuggccccgccccuagcuuccggccuccuucccaacacuuccggcgucuacacaccaccuaagcucgcgacuucccuccgcuguccugcuacucccccuuuuuccccgcggggccccagggcgacaggaaauggcgaggagacgcucuaguccgcacuagagaacagggcgggagggcuaggacgguggaggcccgcgucucugugguaagaggccgcggggaacgcagaaagaacagaggaaccgccuacccccaucccccgccgcuggggagaaacuucgggggguagggggagcgccuggcggccgucugcuuucggugcuaucaccgcaucggccagacgccauccuacccucccggcacagccgacugcagccgguacuccccacagccgaugccggaagcgaggggguggguccgcggc

SEQ ID NO: 16553 - RNA, 10883 nt, Homo sapiens
uuguuaaugaaaauaagcuuuauuacaucaaguaauaaauacauacaaagaugcaaacaguuuuagucauuuucuuccagauguuuuuaucaacuuacaauaaacgcagaacugagaucuacuuacagucuuaguaugaaaguguucggggguccuuguuagguuugguggguugcucuuucuucuguauuuauaacuugugcauuuuuaaaaauugacuuugaagcacuaauagucaugcaaaugcuuaagcaaaaaagaaguuacauuaagcagaaccuacauuguauggcaaaugggaaccggcuacuaaguaaagcgugcugucaauaugcguucaaaacaaaaucccuacagugguauuagcuuaugaaaaggaacaaagaacaccauggguaacaaauguauacaaaagagaagauuaaagggagacaauggugucuuggaggcaaacuacaguuugcuguaagauaacuuuccgugcaucuuuuaaaucaaugcuuaaaaaacaaaaaaaaccugggcaguuccuaacuacuuaaaaugcaaauccuaauuaacugcaaaaucuuuucucaaucuuugagacuguagguucagagccaagugaaccaugggaggaaaaacgaaacuguaaccauuuugaaaacaaggguuucaucugaacaggggagaugaacuguaacuucucaucuuguaaaaagauggaaauccuucaaaaccaacaaggcagcuaggaucuggcauuccguuccguuucugccaagcacucccgaaccaguccucuagcgugaaugaugccugaaacagaggcagagaccugaggucagcaagugcacaggaccagccagcaaagcccauucugaaacagcaagaggauccauccuuccacagccuguccacaaaacccucagacauaaagagaaccagggaaaccuauaaccaagcaacccugaaggacgcuaacaaucccaucccucucuaaagcccuucccuccucaccacaacucuuccugucucucuaaacauuuuuuccugcauucaaggugcaccagcaagcuguccuuccacgacacuguuggaugaaagacaugucuccacccaaauucuuuugcuugacccacuauggagauuuuucucuggcuucuucagucugaauucuagacagggcuugaccggcguaaguaagcaagagaauggcuucagcugcacacgugagggcgcagagaacugacuacuacccacgcgggacccuggguccacggggacaaccccacaagacugcagcuaccuucugcccgaugaaucuuccccagucuuuugucucugugguuuggugcuuaccuuuuuuuucuuucugccucuacugaacuucaugaaauaugaucuuuuaauagacacuaaggauucuauuccuucuaauacaugacucccagaggccacugggaaugacaucccacaucaucaccucacaaaucuuagaaacuaacucagagccuuggagaauguuuucugugaggaccagacagcaaauauuuugagcuuugcaggcuacagucucugacacaacuacuucacucaaauuuuuuuugagacagcaucuugcccugucacccaggcuggagugcaguggcacgaucacagcucacugcagccucaaccugccaggaucaggugauccucccaccucagccuccggagaagcugggacuauaggcacgcaccaccaugccuggcuguuuuaucauuauuuguagagaugggaguuucacuauguugcuccuggcuuuagccucccaaacugcuggauuacaggcaugcaccaucacaccuggacccacaaaccuuuauuuaugaacacuuaagucugaauuucagauaacuuucacacgucccaaaaucauuuuuuuuuucaaccauuaagaaccaugccugucgcgguggcucacaccuguaaucccagcacuuucggaggccggggcggguugcccacuugaggucaggaguuugagaccagccuggccaacaugguacaaccccaucucuacuaaaaauacaaaaauuagaugggcgugguggugggcgccuauaaucccagcuacucgggaggcugaggcagaacugcuugaacccgggaggcggagguugcagugagccgagaucgcgccacugcacuccagccugggugauagagcgagacucugucucaaaaaaaaaaaaaaaacaaaaaaaaaccacuauucuuggcuccuggcucuugggcuguaguugccaaccuaccuacaaugcuccuagcuccuaacucccugaccccucuaugacguguuuucacccugcugugacaugagcuugguaagcuugggcuuggcuguuggccaagggguagcacuaggucuuccuuguuacuaaaagacuggcaguuuguacgcauuugcugacuugaaccagugccuuuucugggugacugcaaauuaccuguuggacucugggacccagcaucuucccaggaauuuccauucagguaagcagcaccccagcuaccggagagcagcccugggaccacccaacucuccaggcgagaccaggguugggcucugcaucccuucccccaggcccucuucaaucacauccucuaacccugguagucccaaccuagcuuugagacccgucaaccucuucacaaagguuucauaaacuccagagcaaccccgcuccuggcagcagccuguccucaacuggcccucgugucacuggggcauaacuucaacuacagcccccauuuaugcuacagauuuacaaccaaagaaaguuccucucccaggccgggcacgguggcucaacgccuguaaucccagcacuuugggaggccaaggcgggaggaucacaaggucaagaaaucgaaaccauccuggccaaccaacauggcgaaaccuggucucuacuaaaaauacaaaaauuagcuggguauaguggcgcacgccuguagucccaacuacucgggaggcuugaggcaggaaaauuguuugaacccgggaggcggagguugcagugggccgagaucgugccacugcacuccagcccaggugacagagcuagacuccaucucaaaaaaaaaaaaaagaauguuccucucccagguugcuucuccagccuuuuuaagaaccccaagucccaggccgggcgugguggcucacgccuguaaugccagcacuuugggaggccaaggcagguggaucaccugagguugggaguucaagaccaggcugaccaacuuggagaaacccugucucuacuaaaaauacaaaaaauuagacaggugugguggcacaugccuguaaucccagcuacuugggaggcugaggcaggagaaucgcuugaacccaggaggcggagguugcggugagccgagauugcaccacugcacuccagccugggcaacaagaguaaaacuccgucucccaaaaaaaaaaaaaaaaaaaaaaaaaaaaagagccccaagucuccccucaucuugaaugcguucaugggcuauggcucugcugcacugucgccuucuaaaauagaaauccuguccuaccuccacuccccuuuuauuucagaagguagcaaccuauuuaacguccuuucgaaaucagacggacagucacaccuuaacacgagucccuugugcucugucaucuccugccugcccucccucuccaaccauuaaagaacaaagugcucucagccucccuccccagacccuagcacagacccacacacuuccuugggucucccuccaaagaggugacagcagagggcagugcaggcaccgaugaacccugagcuuggcuucccuaggaccagugucggcccacaggagcagaccaggcagggucgggggcagggggcacuucgaacacacccuugaaagccagcagacccccuggcagcacacaggguaagaagggcucccugccugggcugcccuucccagaagaccccucugaagacauccagccccccaggccccucgcuaccagacccaucgccugccugaggccuccaccacagacggcaacucuguaacaagacaggagcucccaugagugagccucaucccuagcccaccuucccacauuuuccccaaaagucuuuccagaguuaaaggucuagcacuguggucaccgacagggcagcggggccgggcuuaccgcgcuucagccucuccauggcacucuugcucccugcguacgugggucugaucuccuuccccagcucuucaaugauggccagcagcuccgcguauuugcuuuggggcaccuggcuguucccaguucccuagaaucagaaagaaauggguucagcaaaaucagccgggcgugguggugcgugccuguagucccaguuacucaggaggcugaggcaggagaacugcuuggacccaggagguggaaguugcagugagccaagaucacuccacugcacuccagccugggcaacagagcgagacuccaucucgggggaaaaaaaaaaaaaaggguucagcagccugaccccaaggccacaggcagguggguggagagggccccgggccggucaggauagggaacgcagcccagccucagacuucuggggcagccaccucagcugggccaaggcacgucccauucuaggggacaacuacaaguuagggagaugguccucacccuccuauccucacacacucagggaggccacccagucgucuccaggaagcaacuuuauuaucuccaaugaacaaaacaggggaaacagcucauuuuggcacaaaagaguccaaacagcauuucccaggaugcagauggaugggagggcacaucccaggugccaagccuccaagccaguggggagacaagaggccacaccugggccaccaggaccacagcgauccgccauggcccagccagagccuggaaugcauucccuucucucauccucccaccaacagggcccaacccccagaaaaccuuuccucccaccaccacugggagccccacagcaagcacccggaucagcgaggcugggcuuccggcaagcccacaagcccgcaagcccacaagcccaggcuaccuccccuuggccaccuccucccauagacacgccagcucccugggcgagguccuugccuccccccuccuccaccaccgccucuguccccuggccucgcgcucuguccuguccucguccugcuccggcugcucugccuccccacggcacugccuccaggccucacgggccucccgccuguccuggcgccgccgucgcauggccagaacguggcacugccaacucccggcugccccucugccuggccucccacagccaccgcuucuucagccggucccgcucacaggcccacaccugcuucuccuccuggggcagggcagccugguggggcauggccggggagccgcccacuuggcgaggaacaggcuccauagcgaccucagaacacuggugcuggggcccagccagggagagcaucuucccgcugggaccuuccccggggcggcucaucccuuggagauguagggugcagcugagaugguggcggccccauuccugcuguucgccagccugggcuggggguacuaggaucacccuugggcugaugaggagcccgggucuugggcaguuaccaaguggggggucacagucuggaaagugguggaaccagggagcggccucgcccaggccacacucucaaauacuggcccucgacaaaaggcagcugggcucucaagacagggccaccuccucucugcugggcccgcgcccguggagagcaagugggaacugacccuaucuucugucccagcuuggagagccagcaucaaggucaggccucacuugcccaagaaagaggagugaggaggcccacuggaggaacgcguggggugggagccucagcacagcuugggcugcugccccuuccuggugcucuccuguccccuccaccucacacguccccgcgaagcacaguccccagugcccuccacucugauguguucugagcaggagcgcagccagggccuugggcugagaaagcuccgucccauccuuucugcuccuucgucucuuccaccaacuucucuccucugauggugggaagcaugucucccccuggcccucccaccaugccaucacccccauugacauaccuggguguagccuagggacgguggcccguagucacugagcagcuggcgguacugugaagacguugccaugcugguggaaggcgaguggacacucccagcugugggguggggagagagaggccaggagucagcucagccaguuguaccaaggcaaggacuccggguccugcaacagcccuugcccaggacccacaccaccaacuguagcaggauggagaacccugcucuccaccuccgguuugaccagcauauaagauggauaaugaaauguagcuacaaggcaccugaccauccccagcucugcagcagccgcugguccucacagagcuccaucccauccaaccagaaccuuccaagcagcagggcugcucccaaagauaaaauuauugccacuccuggccugaacucugcccauccccucucccuguguccugguccccagaggcugagaaccuagaggccacaucacaccacagcgccacauaggcuggucgaaaccaggcugagcuuccaagccuuuuugcuucuaugcgcucaaaucucugcugugcucaaugacagggaagacaggaaggccuuggaguauuugagacccaacccuggcuggagacaggcacgcuggacaucaaaucagaaaucuagagaacaccauggccucugugugccccagauaaagccccucaaccccucugugccugucucccccuccccaaagaggggaccagacucuuagcagucuaugccccaagggcucuguaucccaagacaggaggguugaggccccacauaugggaugcaacauuggggccuguccagagcugcagucagugaccaagcagggcccagcccagaacgcagccuccuggaucuggcaggggaguccguggcuaggagcacgcggccccgcaauggcgucccaguggccauuagcggguaaaggauauccugcagaaugacaaacagcgguaaccauggagaauuuaccuaguccuccucggcagcugcccgccugccgcccccagagccacacggucucucucucacacacacagugggcgccgcagacuuggccucggggacagacagcuggugccaggcuggccaaacccaccagcugcucgcuuggugugggugaggggaggggcagaggaggaaggaaguucagggccucaagcugggggagccgggaggagcacuggagaacccuggcuccaggccccucgauuuagagaaauggaccugaagggguggccccagggcacacagcauagaggagaccaaagcagggagccagcuaccccggcaccugccccucucuccgagaacggggaccguuccgagcugucuccugagucucaggccagcccuggaugcugccacugcagcccaggguuaugcuccagcuugggcuggaacugcaaacguggacuuggauccugaacugggcagagcaccgugccacuccgagccucaguuuccacgccucccacguggggaugaugagacacaugcggaugaugagacacgugcgcuauaggggcggguugcuugggagggggacgcacaacgcccacgauaucuggcacguccauggccacugcaggaauugggcagggugaugucccccagagcccccuaacuacaucagccaaaccccaguuuccugagcuucugauguggcagcaagcauggcauggcgaacacaggcucugccggcacagaccuggguucugauccuggucacuacaccucucuggcuccagggccagucgcuggggguagcaucgcgcacagcaccccaggcguuugcaagaucccagcgcccuggcaggaggggugcuggccacuucccacgcacccucgcauucccucggugugcccccguccucuuccccaacugcucugcccacugcuccucaccuccccuuuucuguccuccccacuggacuucgugccagccccagcugugccacuccuggcugugugaccucagacaggcuccccgcccuccaguccucaguuucuccauuuguuagaggcagugcuucccaagagaaggucuaugggcuccaguuccuacuauuugaugauacugggguuagguuuugcagggcugagagggaggaggaaggagaaaucgucccauuuuggcugggggacgaggagcaauagcucggugaccccagugcucuguccaggccacucccuuguucgggggcgggggggugucuaguccuggagagagauggcggaagggcuccgaguuccacuccuggucacuccuuccugcagacacagggaccaggacacagggaccacgucagcgaaggccgucucggcgcaucucagacaaugagcgcagugugcaggagcgagggguuggcagaggccaggaagcuccuggggccaggcgcggcuccccacccccacgccagacaaagagcgcggggccuggggagcuggcggccuucccgccacuuggggcgccuggggggcucuggggcgggggaggcgggggcuuugucuaacuccgccacugccaccaccggccaggccgcggcuuggcaacccgugaacaggaggcagggcugcagggcgugagggaugaugacaaggaagccggaggagcagcggcggcagcggagaguccaucuuggaugcaaauggcaggaggggagcugggguucugcaaaggggcccgugggggguugggaggggcaccaaaaagcccagaucuggggaucucggcacuccuggaauucuccacaggacaaagaagaaaagcugaguacagguccagccagcccagaacaggacuucagggguccccgugagugccgcugucccugugaccccaaaccccgagggucccaguuuagggccccggccccaaugacaccaggguaagccugagcucagccuugcccaggcuggcaacaccagccccugcccuccccacaggccagaggaagaaggcugcuggcaguccuaccuggcaacaaagcccgucuuuguaaggucugcggaccccagaggaggugagaauguuugagaaaaaaacaguggcuguuugcucuuugggacuccgagcccacaagugagcaauucaacucucccuccgcacccugacgcuuaacccuuuccugccccuacaccucaguguccaagauuuuuuuuagguaucguuuuuaugggucccacuuccgauuugggggguuacgaggucaacguuugcaaacaaggcccaaaacucgagcaggagagccagcguggcaccggugaccaacggggccacuccucuccccgucgaguccuuccccccaucccgccccgcaacacaaccgccuuuugggaagucuguuuccgaccaagugucagagaagaagggccccagugaggucacaaagcccggcaccuacgaaucccucaauguugugcccacuccccauggcucccucgguccccugggcucagcccgaagcugccugacaacuucuggaggaguuuccugggagcgcccggcugcggccgcagccccaggaagcuugaggggagccccucccggcuucugcaucgagggccuuccagggccagcccuugggggcucccagauggggcguccacgugacccacugcccccacgcccgcgcgcgggccccagcagccccagagcugcgccaacuucguucacuccgcgcucaccuuacggggguccccgcgugaccgcaugggguagccccugcucccacgcucccggccgaggcccccgggccuccgaguacgcugcccgccggcgaccccauccuggucccagucccggcggccccgcgaccucagggcccccggcagcccggcagccccgcagccccgcagccccgcagcccuccauccgcgcccgcccgcgcggguccuggcccugcccgcagcgccccccgcccgggcugcuucacgaccccgcuccccagggcggcggggccccgcgccccgcucccggcgcggcccgggccgcucccgacucccgccggcaggggcccucgccgagccgcccagaagccggaggaaaaaggagccgagaacaagccucccccgcccucgcccucgcccgccgcgcucccugcgauccgcagccgccggcgcgggggucaccccgggccgcccgccccgcacccccagccgaggcccucggcgugcggggcgcaccagagaacuuucgcggcgcgggcucgggaaucauggcggcggcagcgcugccccgggccgggacccugagccccccgcccccggccuccgcgggcgccccgggcauccccgggccggggccgggcgcgcggacccccaacuuggcggcgcuuggggcgcgucgcacgcggcucacucaccggcguugagggcggcggcgggcaugugcgcggccaaguucgguuuguaagacauccccccgggcggcgggcgcgccgggcgcggcggggccaggccgcgagggcggcggcggcggcggcgaggccgggcgguagcgcugcagccccgcgcccguccgagcgcccgccgagcgcccgcgcacuuuuuguugucggcggcucgggccgcgccggcaaauauggccguccgcgcccugccgccgccgcagucucacccaggccccgggugcggcgcaggggcggccgcaaacuuuccgcggagccggcggggcggccggggccg

SEQ ID NO: 16554 - RNA, 70952 nt, Homo sapiens
agaagcuaaugggcacggaaacagaaagccccgcccacggccuccuggccgcgccuggagcgcgcgcccugcagcugguccucaauaaauagccgaggaggcgcuccccucccucccucccgccggcgccgucggcccggaccaucgagucaguccuccagcgucccagagagggcgcggaagugccccagggccggcgcggguucuuccggccgugcgguccgcgcuuuugucccgcuggcggccggguucccgcggcgccgccacagccaguacgugaguccgcggccgcccgcgcucccgcccccggcccuugccugccacgcccuccccuuuuuggccgggucuuggcugcuccgcgggucucgggcgggaugugggaguaagcgugcccccuccccgcacaugucucagugggugcguuucuggggagcggaggggagggaagaccucgggcaggcagaggggugcagggcgcgccccuggaacagacugggcucugugugggccacaacugcgacguuugaacggaccagcgucauguuaggucugcucaacguuccgagaagggccagggccccgcuccgguguuccucaacuauucaucccuguuuuggaugggaggggaucccuaaaaauuagcgcuucaaaauacccaccauuucgugcucccucugcaguuaaguuugguacucuaggacuugagagugauugcgagggcagagagaccucuaggggugaucugauucgaccuucuuccccuccgcuccaccccaccaccuuuuuuucuuuuuuuuuuuuggucggugagugaugaugauaagcucccgcugcaggugugaauagagaccccggaggugcguccuagcccucaucuggggaagcgcaccugcauacagacgggugcaccggggaggaggcgaccugccgcguguuccugcaagcagaaaaggaguuaacuagguagggagaggaaggucgaagaguuucuuagacccaggggacagccugcgggaacccaggggugggacggaaaagaucacuggggaaugccagggcugggugugcugcucuaagacauuuaaaguaguuggccagcaggagcauuucuuugugaaagcucaaggcuuaaaaaaaauaauaauaugaaauauguaauauauucauauggcugggauauuaaaaauauaaaaaguuaccagugaaagauuucuucccaucccgcuuagguaucuuccuaggcccuacccucuuagguaaccacuuuuguuccuuuguaucuuuuccgaauuucugcaaauacuggcaaauauaacuaguuaguucccccuuuuuucacacaggugauagaaauccuucuaacuccuugauucuuucacuuuaucuuacuggucucuacaugucagaacacagaaguuguguuuuguuucguuuuguuuuacagagcugugguaaguauuggaugggccauuguuuggauguuuucgauguucuguccuuuuuuagaucuauucgggggcauuuggguugucuccaauuuguuguuacuucaaacaaugguauacucaauacaguguauuaggguagggauuuuuacagaagaaacuaaacagccguuagaaaauuauuuuuuuacauuaacucaaccaguuauuggcagauuguuacauaugacaagucguuaucaaaaucacugauguagaguguuuaaagaacaaauaagacguaaguaguucuucccuucugagacuugucccuauauuuaguguuacacuagccuaauagacuaauugugucaaugacuccaagccagucccugccggguuugauucagaaaaucagccucccuuuuaguaucgccuuugcucaccuccuccccuacgacaacuagaaaucucuucuccacuacuuggcaugagaauguucuauuucaguuuuuuacuuuaaggaaaaaucaccuuucauucuuauuucuauauuuaagcaauagaaccaacucacguuaaucauauacauuccuaauauucauaagacaaaugcaacaguagcuagaacacaaaccauauucucuucucaucugcauaucacuucucuguuccuuagucccaucuuuccuuuguacauuuugccccuccuagguacucuuuguucuggguugguaagcauuuugucacuuucucuugucuuguuuccuuucuuugcucaucuccaaaucaaagacaguauccaaggauuuaagguguagaauccacgcgugaaccuugaggugguagauugucuuguggaauaugguuggacucugcaaauugaaagucguuccgggcuaguugcagucuguuaauaggaagggguuuucggccagagcaggccacggcuccucucuaacgaguugucucggcucuugaaaaguggcuccugagucucggaggcagagacagcaagaauguagggccgguucuuaacuguuugcauucacuuuucuaggccuuggcgauaaagcaugaacaagaagcucggaagagugcccagagguuguuggucguauguaguuuggaaggaguggguggcguucuaugucugacgcuuuuggcugauguaaccaggcuauuagacucaugcugcguguugaaaacugguuagaaagggcuuguccauucagccuuuagaacuuuuaagaaauucaggaguuucugggucuuuauauggaagaguuguguuuuggggguaauuccuuacuugugucaucagggacacaugacuuagcuaccaaaucagucuugauuggauuauagugacuuacuccuggaacuccaggacucaguccugucuugccucaauccauucucccacugcaacuagugugagugaucuuucuuuuuuuuugagacagagucucgcucugucaccgaggcuggagugcaauggcgcuaucuuggcucacugcaaccucugccucccagguucaagcgauucuugugccucagccucccaagucgaguagcuggaacuacaggugugcaccaccacaucuggcuaauuuuuguauuuuuaguagagauggauucaccucauuggccaggcugguuuugaacuccuagccucaagugaucugucugccucagccucccaaugugcugagauuacaggcaugaaccacugcaccuugccugaucuuuuuaaaauauuuuucuuuuuuuucuuuucuuuuuuucuuuuuuuuuuuuuuuuuuuuugagacagaguuucacucuucuugcccaggcugaagugcaauggcacaaucucagcuuacugcaaccuccaccuucuggauucaggcaauucuccugcuucagccucccaaguagcugggauuacaggugcccaccaccaugcccagcuaauuuuuuuuuuuuuuuuuaguagagaugggguuucaccauguuggccaggcuggucucaaacuccugaccucaggugacccaccugccucggccuccgaaagagcugggcuuauaggcgugagccacuguacccggccuaaaguuuuuuucuuaugaacuuccauauacccaucacuuggauucagcaauuaucaggauucugcuguuuaacuuuucccuuuuuaguuuuuccugauugaaauauuuuaaauuccagauuccaugccauuucacugcagacuucagucugaauuuaaaaaaaaaaaaaaaaggucugggugcggugguucacgccuguaaucccagcacuuugggaggcugagacggguggauccccugaggucaggcguuggagacaggccugccaacauggcaaaaccccaucucuacuaaaaauauaaaaauuagcugagcaugguggcacauaccuguaaucccagcuacucgggaggcugaggcaggagaaucgcuugaaccugggugguggaggcugcagugugcugagacgugccauugcacuccagccugggcaacagagcaagacucagucucaaaaaaacaacaaaaaaaaaacaaaaguucuaacauagccacaaugccguuauuauaccagccuaaauuagcucugauuccuugauauuaucuaacagaggugggcacacugcugggcuuguggacuguuuuuguauggccuacaaacuaagaaugauuuuuacacuuuuaaaggaaugcuuaaacaaaaauaguacucagcaguucuguguggcccacaaagccuaaaauauaugcuaccugguucuuacagaaaauguuugccaacuccaguuuaauaaaauaaguaauuuuuccaaaacgcauauccaaguuugcuacuccuuugcccgaagcucccgaggaucaagucuggacuccuuaugguugcagcccuugucuuugccuaccugucugauuuucccuuugccugccccagaugucuucggggggugaacaccaguuccucuguaccugcucuucccuuggcacucuucucuuccugaagcuauuccuguaguccauccccccuuucccacccuccauguccuguauuugcuuuuuuuuuuuuuuuuuuuuuuuuuugagacauagucuugcucugucacccaggcuggagugcaguggcacgaucucagcucacugcaggcucgccucccagguucaugccauucuccugccucagccucccuaguagcuggagcuacaggcgcccaccaccaugcccggccauuuuuuuguauuuuuaguagagaugggguuucacgguguuagccaggauggucucgaucuccugaucucaugaucugcccgccucagccucccaaagugcugggauuacaggcgugaaccaccaugcccggccgccucugucauuuuuaucauaugguuauuuuccuaccagacucuccuacuagucugcaggcaccuugauggcagggccuugucauauccaugucuuuggauaggaauagcccggggccuggaaaacaaacaggaugcagacaauagucuuaaguuccuugggcaacacuuagccucagaaauaacugauacccuagaaugcaucuccaguauuguuuauaaggauaacuuaauuauccuuauguguuacauucuuuguauugucuuuauguuuuagcagcauuuacucuagugcugucuuggugcuuuucugccuguguuuuugauggaucuuaguauugauuaacauagauuucauuucaagccaucuauuuucauugaagaugcauguuuauguuaauccauuuugauuucacucaagaagaggauuggaugaacuacaucaggugacgggacaucaugcgccccaacccaaacagagggguuuaagcagagccagaacagggaggccccuggccuucaccuagguuagagagguaaguggcaaagugucugugauuuuaggcagaccaggccagucagcagccagucuaacauggaaucccagaggacaggaagaaaacgaauaauccacuugucaaagaaacaaaggaggacagaucaggcugagaaucagugaguggaguggcagugaggguugacaguugcacaggcggcuggugcagaaggcuuuaggugccacaguaaguagccugggagaacuuggcacugcccagugacuaggugugcauuuuacaaaaauucuucacagugguuggagaaagaauugggcagggauaagagugaaggucuagaaacgauggcagucaugcagaagagaauuuagaaggcucaaacuaaggccuuagcaguaagaaggaggugggggauggggugggagcuucagaacuacuuaggcaauagaaucagcgguccuaggggcuguuuuggauguggccaagggaaguagcccauuucugauuuaggcaaaaguguggguggcaagguggauaugaggcucuguaauugagagggauccugggcagagaugaggaccugagacggugugugggagugcugggagccaugagggcucccaggggaauauguggagccaggagaggaaugucucaagguggaaggaggggccagaaacauccaggggcagcagcgcggagggcaagcagcagccugaagacgcuaaugcaguguggucugcguggaagaaaugaggcaugagaggagugggaugugaagaccacuuuuuccagauacaacaggcaguaggauggcaaagcaguaccuggaggggaagguguagaagaggaaacaaauuugcuuucugauacuuuaaaaacuuuuuguuugguaauaacuucaaaugcacagaaaaaauucaagaauacgaacaguaaaaagauucccaucacucagauuuaccugcaguuaacauuugacuucauuuuguccucuugcucucucuuucauacaugcaaguauuuuucuaaaccauuuguagguaauuauauacaucauggcccuuuaucccuaaauacuucagcguauauuuccuaaggauugggauagucucauagauaacuacaguaaguuuucaaauugaguaaauuggaaguugauacugcuuuuaccuagucuaccauccauuuuccaacuuuuucagcugauguaauuguuuucuauaacaauuuuccccuccgcuacagauccagucaaggucaggaauguaauauaguggucaagucucuuuagccuucuuuaaucuggaacauuuguacagcucuucuuugucuuuuaugaaaaugauguauuugaaaaauacaguccccccucuucucuccacccucuguuuuaguagaaaacauuguucguuuuggguuuaccuggugauucaguucauguaaugcauucucauaggugauguguccuucucccuacuaaaagcauauuaugucuaucugccccucuggagguguuaaauuagaacaccuggccaaggcauugucucuccacucuuguauuuuucccccuuguaaauaauuuaagcauuauaaauauuuaagaccaugcggauauccugcuccuugucagaauuuccuccuagacguagaauucacugaugauucucuccugauccagucuuuacucugauaguugcagagugcugacuuuuccaauucugguauuccuucuacauuuaucaaccagcacucacauucugcuguaagcaagaggccucccuuucuccccuguuuguaccuguguagacucaugaaauccuaucuucagugguuuauaauguaucacuauacuuaguuauuacggugcuugaacacuggauguucaagcugggucuugcagcgugucccuacccuuuuuuugagccucucuuuacuugcugguauagcaugaugcucaucuuguauguuuccugcuuucagccugcaaucagccauuucuuugaggagcucugguuccuuuuaguaaauaaugguaauaguagacccagaaugggguacuagaugugcucauuaccacuggaguguuuuguuuuuugggcuuucagcaaacagaacuaggaaaucaggaaauauaugcaaauauaugcauacagccauacaggcuugaauauacaugcaugcacauauaugugauuuagaaaucauaaguucacaccaguacugcaaauucaucccaagguucauuuucgccuucuucucuugcuuauuuuuaugucccuuucucuaggagagcccugagcccaacaaaaucaacacauuuacucagguucuuaauacaucuaaaguuguuucagaaucgcuuuguucauaccucuacagaaaaccugcuaacaguugaauuauuuguaccucuucccacugccccgccuccagcuuuccccagacugaauguacuuacguagucaaauacguuucuaaguugccuggauuacuucuguauuucuuuuuuguucucuuccugcgauugugguauucaugggaaaugcaaauagguugauuuguuuuguuuuagcaguuuuucuccuuucccauccucacugauguuuaauuuuauucuuugaauauguagaauauuauguauuuuguauaguaaaaacuauuaaaaaggcuauauacucggagucucucucuuucucccaucccuucugcuccauucuccacacuccucccuuguaggugaugaaccucauuguucucugguuuaucguugcuauaaagagaaacacauacgugcuuguuuuccuguuuucuuuccuacacgaaacguagcauguauauuacucuuuuucacuuugaccuuuugacuuuaggauauacagauugcuccauaucaauucagaagcgcuccucguccuuuuucaguacuccguuguguauaugcuccaguuuauuuaaccagucuucugugcuuggagauuuauguagguuuccagauuuugcaguuacaauuaaugcuauaaugagucacucugugcauguauguuuuuuauauuguuggagguguaucuucauuauaaauuccuaaaguaggacuucuggguaaaugcauauguaguuuugauagauauuggcaaauuccccuuaaaaggggcugugccaguuugcauucccagcaguguaugagagugccuguuuccuccacagccuuaucaacaguguauugucaagcuuugaacauuugcuaauaugacaggugagaagugguguuuuacaguaguucuuauuuaucuuucucucauuaugaaucaagucgaauguuuaaggaccauuuaaaagaauuguuuguucaucuuuuuaccuguuuuccuguaugauuuguaguuuauuuuucuucaguuuuugaaaauguaucagucuuuuguugcauaugagucaucauuagaaagcuuccucuauacucaggccagagaggcauuuacccauguuuucuggcauuuguacagcuuuuuuauauuuagagcucuauuccauauggaguuuauucauguguguauggugugaagaaugggaucuaauuguaucuuuuuuuuuuuuuuuuuuugugagacggagucuugcucugucaccaggcuggagugcaguggaacgaucucggcucacugcaaccucugccucccagguucaagugauucuccucccucagccucccaaguagcugggauuagaggugcgugccaucacgcccagcuaauuuuuguauuuuuacuagagacggcuuaaccauguuggccaggauggucucgaucucuugaccucgugauccgcccaccucagcuucucaaaguggugggauuacaggugugagccacugcacccagccuuaauuuuaucuuuuuccauauggcuucauaguuguuacaacacuauuaaaaggaccaucuuuucucugguaauuucagauaucaucuguaucauuaauuucugugucuaccugggacaaugucuggacuuccuguucuauuccauuugccugucuauguaccaggaccauacuauuuuaauuauagacguuuaauaauauauuuuaauaugcagguugccuucuuccucaucucugcaguaacugucuucaugguuucauagccuucucccugauaccccuccccagguacuaauuuuuucucuuuaguuuugucuguccucugcugauuuugucuaacuuuucauaauaaaaaaaaguuuuaccuaacuuuuguccuacuuaugaauuuuucugucuucuucagagauuucuucugcccucuuguuuguuuuuccaugacugggugacauuguuuaaaaacugauugguguugcccaugguucugugcaucauuucacccugcccuaugcuaagcuguuaugcaagaauagaaaagcucauuguuccauugaaaauccaggguucuagcauuuuaacauuaguuccacaggggcagaaauuuugucauauucauuguuguaucccuaguacuuaaaaaccgguacauggcacaugguaccugucacacaguauguugucaguaaauguuugucaagugaauguuguucauuguuauuccaguuuguuuuuguuuuuuuuuaagagagugaauagguguccuuuucauuuucuugguuuagugucacauuugaagacgagcacugaggaugaggaaccaacugaagaauaugaaaauguuggaaaugcagcaucuaaguggccaaaaguggaggauccuaugccugaaucuaagguuggugacacauguguuugggauagcaagguagagaaucaacagaaaaagccuguggaaaacaggaugaaggaggacaaaagcagcaucagggaagcaaucagcaaagccaagaguacagcaaauauaaagacagaacaggaaggugaggcaucugagaagagcuugcaucugagcccacagcauaucacacaccagacuaugccuauaggacagagaggcagugagcaaggcaaacguguggagaacauuaauggaaccuccuacccuagucuacagcagaaaaccaaugcuguuaagaaauuacauaaaugugaugaaugugggaaauccuucaaauauaauucccgccuuguucaacauaaaauuaugcacacuggggaaaagcgcuaugaaugugaugacuguggagggacuuuccggagcagcucgagccuucggguccacaaacggauccacacuggggagaagccguacaagugugaggaaugugggaaagccuacauguccuacuccagccuuauaaaccacaaaagcacccauucuggggagaagaacuguaaaugugaugaauguggaaaauccuucaauuauagcucuguucuggaccagcauaaaaggauccacacuggggagaagcccuaugaauguggugagugugggaaggccuucaggaacagcucugggcucagaguccacaaaaggauccacacgggggagaagcccuaugaaugcgacaucugugggaaaaccuucaguaacagcucuggccuuaggguccauaaaaggauccacacaggugagaaaccuuacgaaugugaugagugugggaaggccuucauuacuuguagaacacuucucaaccauaaaagcauccacuuuggagauaaacccuauaaaugugaugagugugagaaaucuuuuaauuauagcucucuucucauucagcauaaagucauccacacuggagagaaaccuuaugaaugugaugaaugugggaaggcuuucaggaacagcucaggccucauagugcauaaaaggauccacacaggagagaaaccuuacaagugugaugucuguggcaaagcauucagcuauagcucaggccucgcaguccauaaaagcauucacccugggaagaaagcccaugaauguaaggagugugggaaauccuuuaguuauaacucacuacuucuucaacacagaacuauucauaccggagagagaccuuauguaugugaugugugugggaaaacguucagaaacaaugcaggccucaaaguccacaggaggcuccauacuggggaaaaaccauauaagugugaugugugugggaaagccuauaucucacgcucuagccuuaaaaaucacaaaggaauccaccuuggggagaagcccuauaaauguagcuauugugagaaauccuucaacuacagcucugcccuugaacagcauaaaaggauucauaccagggaaaaacccuuugggugugaugagugugguaaagcuuucagaaauaauucuggccuuaaaguacauaaacgaauccacacuggggaacgaccuuacaaaugugaagaaugugggaaagcauacaucucucucucgagccuuauaaaucauaaaaguguacacccuggggagaagcccuuuaagugugacgagugugagaaggccuucaucacauaccgaacccuuacaaaccacaaaaaaguucaucuuggggagaagcccuacaaaugugaugugugugagaaaucuuuuaauuacacaucgcuccuuucucagcacagaaggguccacacuagagagaaacccuaugaaugugacaggugugagaaggucuucagaaacaacucaagccuuaaaguucauaaaagaauccauacuggggagaggcccuaugaaugugauguguguggaaaagccuacaucucacacucaagccuuauuaaccauaagaguacccacccuggcaggacaccccauacaugugaugaauguggaaaagcuuuuuucucaagcagaacucuuauaagccauaaaagaguccaucuuggggagaaacccuucaaguguguugagugugggaaaucuuucaguuacagcucucuccuuucucagcacaagaggauccacacaggggagaaacccuaugugugugauaggugugggaaggccuucaggaacagcucaggccucacagugcauaaaaggauccacacaggugagaaacccuaugaaugugaugagugugggaaggcauacaucucacacucaagucuuaucaaucauaaaaguguccaccaggggaagcagcccuauaauugugagugugggaaauccuucaauuauagaucaguccuugaccagcacaaaaggauccacacuggaaagaagccauaccgauguaaugagugugguaaggcuuuuaauaucagaucaaaucucaccaagcauaaaagaacccauacuggagaggaaucuuuaaaugugauauaugugggaaguuauaguggcacaucccagaagagaaccuaugagggagggaaugcccuggaugggggcaggaugaggaugccucuguagcaggcagagcuuaccaagucucuccgaacucaaauggaagaaauaccuuaugaauguaagaauguagggggucauggcuuguaauuuacacaguguaaaugaaaccauccuagaggauuaugaggaauccuuucuaugugauuuucaaucauagcaagcaagaaaggcuccagugucaagguaguucagcucuuacaggauauaaaacaguccauacuugagagaaaaacuuagaucugagugauggaaugugaagcaaaucuucaaaaucaguagacauuucuggacauaaaacacagaugaggaaagggcuucaauuagaaguuacguaaucaccaucagaaaguucauguuugguaaauucuguuacuagaaauguaggaaauucagguauagcuuugaaucccaauuacacauuggucagugggaaaacuaagggccuccaacaggcaaauucagggaggauagguuucagggaauauaaauuuauuuaauauuaguggucuuuaaguauaaacuugauguaauugguuugggagggggcagugaugaugacuucugaaacaaaauuuggauuuccuuuuaggaaaaguagaaagcauagacuuacaagucuaacaggagauaggagagagucacucauaaaaaaugcaaauugaugaacguacuauugugauacauuaguugaauggaugaaacuuuuuuaaaguuucagaugaacucccauaaugaaugaugaauuugugaugagggauaaccuggaagugguauucacacauuaugcuacaauaaaagguucuaccguggagaggauuuugacacauucaguaacuaauggaacacaccgucaacaugaauucgcaccuuacaugacagaagugauucagggauuccuaugaauagaaaugcugagaaggaacgcauuuuauugcagaagcuaaaaagcuaaaguaccagucaucuagagagaaggaaauuaauguuucuuaauaauccuguuaaauguuugauuguuuuuggaauguguuauuguaaagaugucaugcaggacauguauauguugucuguuguaaaauguuaacgaauacuuuguucagggcucacucucucuuugucaugaaagccagcuccuuguggcgagguaaaguggaauuccaauaaagaaauuccuuaaaucaaaacgggcugugaguuuagauggaggauacccaagagccauuugugugccagaucuuuguuggguaaguuauaccagauccaaaccagagaggguaguagacucaucccacagggcuagcagcucagcugguuucaccagaaguuagaaggugccucccuaggaggagcacaggauagauuuugaggggaccacaguggagccaugugaucgucguuacugggccagauccuaacucgggagcagguagguugugugagugaucagucaccacacacagcucugucaggaacauguagaauugaacauaaacuacugcuguguaugaagcuguuaacuagguaacucaaaggguaaaaauagacucuucugagaauugaguaaccugucugagaauacugugagugggccaaucagcaaaggcugaauuugaagucugguaucugguuucaaaacccauugucuuuacaagagaacaaucucagccauguaguuucccaucuccuucugggacuccuaucucuguagccagauaguuuccaugcucuuucuaggaguauauuuguuucacuuuguauccaaaccccuaccaguaaguuuugauggcugcgguggggaaggguggaguugagggaggaaagggagauggagcauuucuaccacugcuccacuuggacuguucugaucauacuugcucucuauccuccuuugcacaugacacuggcaagccugacccuauacacagacuuggacugauuuauucagcaaauacuugaggaucuacuaggcacugucccugucccagguacugggugggagaggauggcagcaggaguagauucugguagaugaggaugaauaaagggagaaaggcugugagcacaaccacccuaauggaugaauuaagacugcaggugcucagaggacagcgacuaggaccaaccaagagggaggaauuggugacaucugggcaggacguugaauuggguuuucugagaggaguaggaacuaggaugaccugaguaaaggcagcuacggaagugcccaggcauccuccagcaaggcuggucucuggcagggcugaugugugggcaggaaggagggugccauggaguacucguuccccguagucguggggacauggauugggcuucuuuuugcugaagaugagaccagcuuugguuguuuuuaaccugagguuuccaugugcuccucacacaggagagcucccguacuugagcuccagcugaaccuaaugcacugucuacuuuuggggagaugcaggcuaaauaacaaaggagaggauggccacagcucagguggggauucugagugccucagccccacuaagcaccagacaagcuccuacugcggcccccaucuacucgcaugcuccagaaaugggcccagguccucaaguguaccuacagccagauacaagccauucaggcugaucccagacaugguggggucucccuuguagcacagacccaaugaacuggugcggcugagccugcucagaccagggauggaacaugguuuaggcaccacccccgguuccuuccagagaacgauaugcaagugggaaaaauaaagggggagggaaaagcggggaggagaaagagaaaagaaaagccugaaaaaacagugaguauggaauagccuuccauaggagugcaugucucuauuagcaaauuugucugaaggugaaagccuggaaaauaauuucauguuuuguguaugaagacacugggcgugaaacgguacugaacaccaauccugcaaugcaggggaauuuuccuccgugggauucagaaaugagaggaucaccaccaggacaacaccugaagaugguguuagcugaaggcagacauuggggaccugaagucugucugcaucaagaccuugaguaauuggccacagcuguacccaaggaguuccugggcuggggagacccuucauuucucuucuccagcuucagcuaaaggccuagagacauggagaaggaagcagaauacaguacuucaauugucuuccuacugaggagccauucucauuuagaccuggcgguucucaggucuggauagugucauugugcgaaggaagccguuugcaugaaaccuguguagagucagugaaguauaguggccgaggacauggucuccacaaggaagccugaguucaaauaaggacuuucacuuauuuccagaugacuuuaggcaaguaacuaaacuuguguguccucacgugucuuuuuuuuuuuuuuuuuuuuuuuuuuuuuuuuuuuuaagacggucucguucugucgcccaggcuggagugcaggggcauuagcucacugcagucuccaccuccugagcucaagcaauucucaugccucagccuccagaguagcugggauuacaggcaugcgccaccaugccaggcuaacuuugguauuuuugguagagaaaggguuucaucauuguuggcugggcuggucuugaacuccugaccucaaguaaucugcccagccucagacucccaaggugcugagauuacaggccugaaccaccacaggcuaccauacugggcccucaccugucuuuuguaaagauaauaguagcaaccucagguuguaaugaggguuggaaacauuaauaguguuaagguccuuagaaggcugccuagaaugagaaguauuugcauaagaauguauggaauaagucugaagugugguggcccuguccaaagacucagcaucuagaugcuugggcaguggaggacaacucuuaccuggaagucaaggaaaucccucaaggaccacccccuacucagacaaaacuugagaagaaacaugagaaaaguuauuuuuuggauguuccugagugguaucuugcuucuaaguaagcaauccauugucucuaaacaaacauguuuugucuuugucgggcugcaaaagggcucagcaggaggagccuccagcugaggccaguaaccacacguuggggguugagggcugccucacgcuugccuuucuggccugggcagccugcucacucacaugguacacaucuuguuuccccuguguuuucccagcaauauucagaugugcuggagauuacuguaggaaggguuggugagagccagacuuuuaccaucuuaaccauggcuauuucuggugagugucccuuaagaucucagaggauaaguagugguccuggggugggcagggcaaagccccagagaggagcaggugaaguuccucuggucuugggugcaaaccauggggccauauuccauucagugcaauaauauggauuuauuuccuguucugucauuuucccaucuguaaaaugagggaaaagaccuguuuacaagauuauuuuaaggcuuaauaaaaaugcucuguacuuuauaaaaauuuuguacaaacguuguuaaauugacuaucuuuuuaaaaguugaaggagauaagaaugagagcaaaaguugaugaaacagcaaacacaacaaagaacaacaaagucaagguugcugcuuugaaaagacaaaauugguaaaccucugaugugauugagaaagaaaagcacaaauaaucaaagucaggaaugaaaauugggaaaucacaacagauuccauggcuuauuuagaaguauauuuuuuaacuuccaaacaugggaauuuccuaguuauauuuuuguuauuguuguuacaaaacaugguccaugugacugcuguccuuugaauuguguugagauuugcuuuauggcccagcauguguuuaaccuuagugaagauuugugggcacuugaaaagaaugcauguucugcagaugccgcaugcagucaucuacauaaagccauuagauuguaauacguuguucauaucuucucugcucuuaaugaaguuuuauuugcuucuauuaaugagacaauuguugaguuaucucuacuuagauauaguucugugaacuuugcuuuauauauuugaggccacacaaauauaaaauuguuauaugaauugaaauuuuaugaaguaaaccuuuuaucccuaguaaugccuuuuacuaaaagucucuuuuuuucugguauuaauaacaucagcuucuuuuuugguuaccguuauauggcauuucucuuucuuuacuuucacgcuuucuguauuuuuauguuuuagauguaccucuuggaaauagcauauaguuuguuuuaauccagucugauaacuuacuuuaacaggaucauuuagcccuuuaauuuauaguuaugaaugauucuauucauacucuauuuuuccaucuuuugguuuggaaguuauauacuuuuucucuucuuuuaguggccuaggaauuaaaagguggauucuugacuuaccaaagccuaauguuaauugauacuuuuaucuucguccuagacaaugcaaaguuccuagaauacuucuuaccuuccauccuauaugcuguuguuuugguuaauuuuaauuauauauacauauaaauguacauauauauuaaaauauguuauuauuuucuauaccaaacguuuaauuacuuuucuuuuuuuuuaaauuuauuuauuuauuuuuuuuuuuuggagacagucuugcuuugucacccaggcuggagugcaguggcaaaaucucggcucacugcaauggcuaccucccagauucaagcaauucuccuaccucagccuccccaguagcugggacuauaggcacacaccaccaugcccggcuaauuguuguauuuuuaguagagacggggguuucacuguguuggccaggcuggucuugaacuccugaccucaggugauccaccugccuuggccucccaaauugcuaggauuacaggcaugagccaccaugcccaaccuuuucauuuccuuucauucuucuccaccucugcaauuuuuuauuuggggacauuuuccuucucucuagaaaacuuucuuuagaauacucuguccuguuagagguaaaacuucacaauuuuuauuugccuaaaaauaacuucauucuuaaaaaugguuuuuugugggaauagaauucuagguuagaccucauguucuuuugucacauuggaugcauuaagccacugaagugugauuuccacucuggcuguucaucugccaguuuaauguauucuuuuuaaaauagcuucuuuuaagauuuuuuuaaucuucgguuuauuccaguuucacuguguuuuauuuugguguggauuuuuuauaagugauccuuuuuuguauacucugggcuuuuaaauuuguguauuuaucuuucaugaguuuugguaaauucucagccauugugugcucagauauuagcucuauaccauucuuuuuucauuuccuucuaggacuccaaauaaagccuucucacuguaucuccugugccucuuaagugcucguuuccauccuuuuguccccuacuccuuacccaggcuucauucuggaucuaauuuaccuuccaguucacuaaguuucucuuuagcuauguaaucuggcuuaaauauacccauugagugcucaauuuaaguuuuucuguuucucaguaauagacuuuucauuugcuuccuuuuuucuggagacggaguaucacucugucgcccaagguuggaguacaguggcaaaaucugggcucacagcaaccucugccuuccagguucaagcaauucuuacgccucccauguaacugggauuacaggugugcaccaccaugccuggcuaauuuuuguauuuuuaguagagagggguugugcuguguugccaggcuggucucaaacuccugaccucaagugaucugcccaccccagcuucccaaagcucuaggauuacaggcaugagccacagcacuggaccuucuuccuuuuucauaguaugccagauucucaaauguagcuuuauuuuccuugaacauaguagcauuuuuaguuuaaaagcugugucugauagcaucuguggcagugcuuucucugauguugacucugagugugucaccuauucucugcauuagauuucuuccaucugaacacuugagugguuucugauuuucagguuagaaucugacugauagacugcugucugcaugcucuuaaucugggccuuacaauuuucuacagaauccuuucacagcccacagcccacagccccucuuuguauuuuguuaacuuucaguaaaagggaacuugguucaagaacuguaaaaguuguugucugaacccaaaauucuaaagggaauccaaacugggaaagaaaaaauccucgccucaaguuccuagccuuaguaaaaaguauauauauauauauauauguguguauguauauauauauguguauguauauauauguauguauauauauauguguguguguguguguauauauauauggauauagcacacugccaugcuuuccauuuuguuucaguuggucucuuauccagcaaguucauuuucuuuccacaaaacaauaucugggauacaagagguuagcuauuugcuaauaguuaagacguuuuggggucauuucaauucaguauuuuuaauguuucauucagaagucauuugaauaacuaagaaguuauuucuuagacccuguccucagaauacaccauugcaacaaaaaacaaaaaaaccucagcacaaaucauggaguuccuagguuccagcguccuucuuuuucuggacgcuuuuuuccucuaaaaacaaagauugacucaagcauguaacaacagaaauacugugauagcaauacuaugcuaacauuuuuauuuauuccugugaucuuaacaccuuccuccccaaccccaacacacacacacacacacacacacacacacacaaauuguuuuagcuacuucuauuuuuuuuuugaggcagauucucgcucugucgcccaggcuagauagagugcaguggcgggaucuuggcucacugcaaccuccaccuccaggguucaagcgauucuccugccuuagccuccugaguagcugggauuacaggcgcccaccacaugcccggcucauuuuuguauuuuuaguagagaugggguuucacuguguuggccaggcuugucucgaacuccugaccuuaugauccaccugccucagccucccaaagugcugggauuacaggccugagccaccaugcccagccauuuuagcugcuucuaugggaagaguuacguuucccaguuugauucucaucucuacccacaccuagaauccugcaaguuaucuaguuuaucuugucuggaaacuggcugauugacauccaguggggcuuugaggggcaucuucaaagccuuccccauccccagcuccucaacucccucugaagcugacugccccuuuucacggccagugcauuuaggagaagccagggaucugccccugaacauaacuaggccuuggcuaagaccacuguccacugugcccaagcagucaggcacaugggacaguggacaaacaccauggcuagaacaucuucauggaacacgcccucaugaugcaauggccuuguggcacuuacuguggaggccuccaccuggggauccucagcucgccucucuggccuuccugacauucuuucuuuaggcagucccacaacuaguauguuaggugggcugggggcugguggaaagggaccacaagcauauacccauuguaagguuaguucuucauuaauuaaccagggauucaaaaucuuaccagaagcaaaaugguggguggggcagagaaaaaacaaauucagcacaucacugugaagcuguccuuggcgcugggaguucuuaaggggguaggaggcaagcagaucuggaacacuuauuuccugucaggacacaaccauuuuauuuuuuauuuauuguaacuuuuagguucaggaguacaugugcagguuuguuauguagguaaacugugucacagggauuugguguucaaauuguuucaucacccagguaauaagcauaguacccaauaggaauuuuuucugauacucuuccuccuccugcccuucacccucaaguaggccucagugucuguuuuuccccucuuuguauccauguguucucauuguuuagcucccacuuguaagugaaaacaugcgguauuugguuuuuccguugcagcauuaguucucuuaggauaauggccuccagcuccacucauguugcugcaaaggaugugaucuccuuuuuuauggcugcauaguauuccaugaacacaaccauuuuaaacuaagggauuaggugacuguuaugaaagaaacuaaguaauuugugcuuuaaggaauucauacaaacaggcugucaugguuccugaaccagccucaguaucaccagggcagcaugugagaggaaguugaggcaguaucuuggcacuguuuuuagccacugcucuauaccaggccuuuauaugagugcuuuugcuucuaaacauacgcuuuugguuuuuaacaaaaggaaccugacuguauauacaugauauuggcacauuugcauuuagacaguagcucaccuuucuguaaaaguccacauacaucuuucugcauucuuucuaaggguuuccuaguacacucauuguauaguuauaccauacuuuacuuaacccccucaugauaaauguuuuggugguuuccaguuuuuguuaguaucaacaguguugcaguaaaauacauuuuucucuccuguauguuauccuacaaauacauuucuaaaggcagaauugcugaguuaagauuugcuuuuaaauuuuugcuacauacuggaaaauugcucuccaaaaauauuguaacaauuuauacuuuugacaauaguguaugaaacuuuguuucuccacaccuucacaaacacuagguauuaucaacauuuuucaccuuuuaccaaacugaugguuaacaaaugcucuuuuuaaaaaaauuuuauuuugaaacaaucuaaacuugccaaagaaguauaguauaaaacuuuuuccuuccugaaccauuugagaauaagcuucugauaugaugccccaucaccucagaauacuuuugaguguguauuuccuacaagaaccuccuacaucaucagcauacaaccaugaaaauuagggacucaacaucaauucauuacuacuaccuaaugcucagaccccgugcaaguuucuuucauuguccuaauguccuuuagagcaaagauuucaguuuagaauugugcauugugaguguugcaucuuuuuagucuccuucaaucuagaauggugccucagcccuuccucaacuuucaugacuuuucaaaauugcccuacucaccucacuugggcagugacacccucacucccugcaugguccccucuucaccuugcuugggcacugagacccaugccaggccaugcuccaccaccacaugggccuccuugacucccuccucacccugcuugggcuccaacaccuagcuucaggacaaugaaguucuguccccccacaacagaaucccaucuuguuugguuuuguguaacgggagcugaauuguuaaggaagggaagggaauucuuuuuuucaucucuuaguagaaauuuaagauuuccuauacacagguccaguuaaguuuauuccuagcuucaauaaauguuuaaaggagagucaacauccucaacaacuuuacaucaagugcauuggcaaauguaagguuuuuuucuugagggaaacuuuaacagagcccaagaacaggaccuuguacuugaaggugcaucagcugaaacaggaggcucggaggagggcggcugucccuucucgugaacaucccuucaagagaagccagacauuugacagaaauugaaaaggagacuguuggagauuauauuucuucuugagggccuggaugcugguuuucaguuacguagucuucuccccaaggcaaauucaucccagaagagucuuguggggaaaauuccaguaaguugaacacuuaauuaucauaaauuucaaugggagaaauuguuauacauuccagagccuccgaauuaacauaccuuuaugcccaaauccuuuacaucccaauagauagacugaguuaaucucugcuaaaaguuaacucagggauuaggagcuucccuucaaugguuagccuaaaaaacagcugcuugguaccuggcugcuuuccccacccucacugccgacaucugucauucagcuucuuccuaccgagugugaggugccacacucuucaguugcugcucacagucaagccuuacagcucaaagcucagagaaguagaccuuuaaugcaaaacaaacccacaaaacagaagaaaugugauagauaaacacagugcuagugaugaugucacacgcagugaauaagccauuguaugaaaaagcagaaaagauggggaggacgcagguagagucacugcuguuggauucaucuucagagaugggccacacgguggucucguuucauggcccucagccacucaccaaugcuuugcaagcuguuucaugcuuacuaaauuaauucuucauccagcugauggccugaaauagagacugggauaagccugaguuagcagaagcuucauugcucugggaagcaggcgguagguggcagggcuaugucuguggacacugagggaccuggcucucagguggcuacacauguaucugcagaaaaauguggguuuuauagcuauucaaauucauuucuggagauucucauuugauagcacaggaauguuaugcaauauuaauaaguauagcuuuuuuaucaacuugaauaaaauguauucuuacaggaaauuaauugaaugcuguggcagucccuacuuacugccucugcaaagaguagcccauagaucugcaacccaccucuguugucacuauccagcccccguggcucuggaaugacaacacagaacgcuuuccaaggcagcauggcccuuaccucaguuuacauuuucacgacaagacugguuucgccauguaggcugcuuuguggcuugaccucugauguggguucacuugugcccccuaaaaauauauguucaaguccuaacccgcaguacauacaaaugugaccuuauuuggaaauugcaucuuuacaaagguaaucaaauuaagaugaggucacacuggauuugaggggcccugaaugcaaagacuuguccuuaugaggagugagagauugagagacccacaggggagaacacugugugaagacugagguagggauuagaguuguguuacuacaaggaaaagaaugucagggauugcugggagccaccggaagcugaaagaggcaagaaaagauuugccucuagagccuucagagggcaauggcccuacuaacaacuugauuucaggcuucugucuuccaagucugugagaaaauaaauuucuguuacuuaagcuucucaguuuguagaaugaauagucaugggucacuuaacguggauacguugugagaaaugcaucguuaggccguugugugaacaucauagagggcacacucacaaaccuagccaggagagccuacuacacagcuaggcugcacggcauggccuaaugcgccggggcugcaaaccaguacagcaugugacuguacucugaauacuguaggcaacuguaacacgguaaguauuuguguaucuaaccauagaaaagguaccguaaaaauaaugguguuauaauuguauggaguacugucagaaacgcagccugcugcugaccaaaaugucaugugguaugugacuccuuuguuacggcugcccuaggaaauuaauacaggcugcaagagccaaacaaccuuaauuaauuaauuaguuuuuuagaauuucaaauaaaguuucauacugcacuugaaauaguggugagaacauccauuugguaaugaaacugucacauaaaugaucggcucaguugacacuggcugaggaaaacugcacaagaaguuuauugucaaaaacauuuauuucuucaaguacaaauaguaaguauuaaccauuucggaugguuugcaugugcucgguuuuacuuauguuaacucauuuuuaccucacaacaguuaccgugguaagaaauuauuauccacauugauauguaaauaucaauccacagaggaagaaaauugcuuaagaccaaagucauaguuauuaaaugccagggucacaauauaccaucugcaagcuggagaaucagagaagccgguggcauggccugauccaaguuggaaggccugagaaacaaggaggcacaugguguaacuaaguucaaggcuaaaggcuugagagccccagagggccacuggugcaagugucagaguccaaaggccaaaggaccuagaguugugugguacaagggcaugagaagggugucacagcucuggaagagagaauucacccuucuuccaccuuuuuguuccaucugggcccucaggugauuggauagugccugccuacauugaggguugaucuucccuacucaguccacugagcagguauucucaagucuuuauccuugaacucaguuccaccaugugcuuguuucucaggccuuccaacuuagaccaagccaugcuaccauuucuuucuuagaguucugaaggcuggcaaguccaagaucaaggugcaggcagaucuggugucugaggaaagcccaccugcuucugguuugcagauggcagucuuugugugguagucuuacauggcagagagagagagcaagcuuuugugucucucuuuauaaugccacugccaugaucugaauguguccccugaaauucacucauaaaacagucuccuccaaaaacaugguccuucucagaaacagugcuuccccagccaucuaggcaucccucaauccugucaaguugacaccuaaaacuaucacagggacacucuacaaguaacugguaaacccaccagaagaucaggguccagaugcagaaagcaggugcugaugaguuuuuaaauaucuuggggucuccuagugggcugcuauagcaaguuaccauagacuggguggcuuaaacaacacacauuucuuucuuacuguucugaaggcuggcaaguccaagaucaaggugcaggcacaucuggugucugaugaggguccacccgcuuucugauuugcugaggacagucuucuugugguauucucacauggcagagagcaagcucuugugucucuuuuuauaaggccacugcgauggucugaaugugucucccaacauucauguguuagaaacuugguccccaccagcuauauggaggcugaggugggaggaucgcuugagcccaggaguuugaggcugcagugaucuaugaucaugccacuauacuccagccuaggcaacagaacaaggccccaucaaucagucagucaauacauaaauaagucuuuccaucuaucccuaaugcaacagcugugagagaacaaacaucuguucuauauaaauuacccagucucggguauucuauuauagcagcacaaaauggacuaagacagccacuaaucccacucaugagggcccuaccaucauggccuaauuaguuacuucccaaaguucccacuuccuguuaccaucacaaagggguuaggaucucagcauagaaacuuugggggcagacgagcauucaguccauaacauggagugucuuagcuuggguugcuauaacaaauaccaugccagcugggcgcaguggcucacgccuguaaucccagcacuuugggaggccgaggcgggcggaucaugaggucaggagaucgagaccauccuggcuaacacggugaaaccccaucucuauuaaaaauacaaaacuuagccaggugugguggcgcauaccuguaaucccagcuacucaggaggcugaggcaggagaaucgcuugaacccgggaggcagagguugcagugagccgagaucgugccacugcgcuccagccugggcaauagagcgagacuccaucucaaaaaaaaaaaaaaaauaccgugucauagagugguggagaaauuuauuucucaguucuggggguuagaagucugagaucguggugccagcauggucacguuauggugagggucaucuuacaaguugcagauggcugcccucuuacuguauccucauauggcagaaaaucagcaagcuagcucucuguucucuuuuuuuuuuuuuuuuuuugagacagaguuucaccguaucgcccaggcuggagugcaguggcgcagucucagcucacugaaagcucugccucccagguuuacaccauucuccugccucagccuccugaguagcugggacuacaggcacccgcugccacaccugguuaauuuuuuguauuuuaguggagaugggguuucaccguguuagccaggauggucucgaucucuugaccucgugauccgcccaccucagccucccaaagugcugggauuacaggugugagccaucucuguucucuuaggcagucauuccauucaugagggcuccacucucaugaccuaauuaccucccaaaggccccaccuccaaauagagaaauagauuucaacauuaauuuuggggugacaguccauucguaacggaaugaaccaggagacugcugaccagaacauggaaagugcagccuuguaaacaguccgugugcucaagccuggcugacugucagacacaacaaccaaacccucaccuugacccccacccccagccacacuggaaccugaacugagaggccacccuuucccugcaggaccagcuccuagaacagcgguucucaaacuugagcaagugucagaaucaccugaagggcuuuguuaaaacacaggcugcugggccccagaguuucugaugcaggaagucuggguggcugagaauuugcaugguuacaaguuccugggugaugcagauucugugugucuggagguaacauuuugagaacugcuguuucagaaguucuccacauuaaagucuaccaguccugacugguaccuaaggggucaugagguagucagugcacaagauagaaagugaaaacacugucuuagaauuuaaaacaauacuuccuaacaccaauagguagcuuuugauaaaggaauuaucaagcauggcuguauucauuucuuauugcugcuguaacagauuacuacaauuugguggcuuaaaacaauguaaauuuauuauccuagaguuuuggaaaucagaaauggaagcccaggcgcaguggcucaugccuguaaucucagaacuuugggagaccaaggcaggaggacugcuggggcacaggaguuucagaccagccugggcaacauagugaaaccccaucucuacaaaaaaugcaaaaauuagccaggcaugcuggugcaccccuguagucccggcuaccugggaggcugagguggaagguucacuugaguccaggaagguugaggcugcagugagccaugauuacgccacugcacuccagccugggugacagaacagacugucucaaagaaaaaaagaaauuagaagugaaucucacugggcuaaaaucaaggagccagcaagaguuguguuuuuuguuuuuuguuuugagauggagucucgcucuugucacccaggcuggagugcaauggugcgaucucagcucacugcaacgucugccucccagguucaagcgauucuggggaggggaggaggagggaagcaaggagagaggaacgcagggagcagagccugaccuggucacaggggucugggaaagacagaggcuuuguuagagccggcagcugagggccgaggccgagcagggguuaggccagcacaggacgaaaaggaagaaaguuccagguggagucugguggagaaagaccgaccuggaaggcaccagcaugugcacguggcaacugaggucgaggacgugccugagagagaggaggaaggugcccugcggaccggguagggugcggaggucgggaauggagaacggucguugggcagguccggguacccguagccagaaccacccgggugugcgcagcucggccaggccccgccucccggcguccccgcccccugcugggccucucuccgcagccgcgagacccgcgcuuggcgcauaggccgguucuaauuuacaagaacaccgcggccugaggccggagagucccuucaacccgggaggcggcggcugcagggagccgagacggcgccauugcccuccagccugggcaaaaagagcgaaacuccgucucaaaaaaaaaaaaacauggccgaaaccaggaagcugcgcgauggcgccacggccccucuucucccggccuguguccggaagguuucccuccgaggcgccccggcucccgcaagcggaggagagggcgggacgugccggggccggagcucagaggcccuggggccgcucugcucucccgccaucgcaagggcggcgcugaccugaggccuccccgcaaagguccccgaggcggcggcggcggcgggcugugagaaccgcagaagaacgcugggcgcgcagcgacccguccacccccgcgaggagagacuuccacagaggcagcguuuccacagcccaaagccacguuucuagggugaugcagccccaguaaguuccuggcggggaagcucacggcugucaaaagaacucuucgcuccagccggcgcacgaaggggaggagggcaggaggcugccgcccgcacaggucaucugaucacgucgcccgcccuagucugcuuuugugaaucuccacuuuguucaacccccacccgccgucucucccucccugcgccuucccucuaaccuuaaagacccagcuaccucuacgcaaaugguagcuaccucugcgcagguggaaguugaguucgguucacgcgggacccucuucccuguggcaagcugcugaaggagaccugcuguuacugcuuuagcugcuguucugcuuaaucucagacagcuggaagguaguauuccgcccucgcccagccacccgaguaaaugagaaugaugacugacugagacccugauggugguggcuuaggcuuaaucucagacagcuggaagguaguauuccgcccucacccagccacccgaguaaaugagaaugaugacugacugagacccugauggugguggcuuaggcaagaugaacgucugaaauggaggcccagggcugccacgauggcucuguagucaucagggagggagcuccuuuuaucuuguuaccuacuccccucuugugccccuuucuucccuugaucuaagaagguugcuccggaucucgccaucuggccugcguucaaucagcagaagcuuccuggaggagcaggaggaggcacugugcucgcaucacauaccaguggccagaaguuggcuucagggaagcucaggaaauaggaugcgagaagccaugagaccuccccaaacucugcaguaacagagucaacaagacaauggcuuaaagauggagagaccaguugaucggucacacaagcuguuccacgauaauucuugugucagaaggggaggcugacuaccaggaccacuggccccacuuccagccccuccauucugaguacacuucagagggcucuggcagggugagggggucuugguggugccacagagaguaaaggucuagcacacccauuguggagauauuucauggggacaacccagugacuucacuugaaguaaagugggauuuuccaaccuugagauucuuauuuucuuugguaugcguguggaagaaguaugaagguggggguugggagggagagcaaaugagcuguguguaugaggagcuggggccuggcucuugacaauaucacccacccccaccccaggcuuuccuuggggcagaaagacuauggccggggcuuucagugucggcuccgagguauagagguauaaccagugcuuuuggcuaagucacgucacugaugagcuucucuuuccaccuuggcaaaccaauucuucuguaaaauggucuucaaaguuucuuuuuuaaagcagagaaacuuauuuuucagauaaaaauuuagauagaacuaucgggggaacccgauaggggccagauaucgggggaacccacccccaauauuucaacauagguucuuucuauuuuccauaaauguuggccggcugagaaauaaagaguacaaagagcggaauuuuacagcugggccaccgggggugacaucacauauugguaggaccgugaugcucaccugagccguaaaaccagcagguuuuuauuaaggauuucaaaaggggagggaguguacgaacagggaguaggaacaaagaucauaugcuucaaagggcaaaaggcagaacaaagaucacaugcuucugaggaaacaggacaaagggcaaaaggcagaacaaagaucacaugccucugaggaaacaggacaaagggcaaaaggcagaacaaagaucacaugccucugaggaaacaggacaaagggcaaaaggcagaacaaagaucacaugcuucugaggaaacaggacaaggggcaaaaggcagaacuccugauaagggucuauguucaguggugcacguagugucuugauaaacaccuuaacagaaaacagggucuaagagcagagaaccggucugaccaaaaauuuaccaggauggaguuucccaauccuaauaaggcugaggguacugcaggagaccaggacguaucucaguccuuaucgcuaccgcauaggacagacacucccagagcagccauuuauagaccuacccccaggaaugcauuccuuucccagggucuuaauuauuaauauuccuugcuaggaaaagaauucagcaauaucuucccuacuugcacguccauuuauaggcucucugcaagaagaaaaauauggcucuuuuugccugaccccgcaggcagucagaccuuaugguugucuucccuuguucccuaaaaauugcuguuauucuguucuuuuucaaggugcacugauuucauauuguucaaacacacguuuuauaaucaauuuguacaguuaacacaauuaucauagugauccugaggugacauacaugcucagcuuaugaagauaacaggauuaagagauuaaaguaaagacaggcauaagaaauuauaaaagcauuauuugggaacugauaaauguccauauuaaaauaaaaucuucacaauuuauguucuucugccacagcuccagcugguccuuccauucggggucccugacuucccgcaacauagaacccucaaauagaugaagguggagcuucuuggguagagacuggaggauugggguguugcccaccgggccuuacggacucuccugagugaucugagucaccuccaaagagcuaggugucaacuccaaaacacccugugucccuuucuuccauuuaguaaucgaagccuuaccaccagagguuuggcagggcacguugaagggguggguugccccuccacaccuguggguguuucucguuagguggaacgagagacuuggaaaagaaaaagacacagagacaaaguauagagaaagaaauaagggggcccggggaaccagcguucagcauauggaggaucccgccagccucugaguucccuuaguauuuauugaucauuuguggguguuucuccgagagggggaugugucagggucacaagacaauagcggggagagagucagcagacaaacacgugaacaaaggucuuugcaucauagacaagguaaagaaucaagugcugugcuuuuagauaugcauacacauaaacaucucaaugcuuuacaaagcaguauugcugcccgcaugucccaccuccagcccuaaggcgguuuuucccuaucucaguagauggaacguaaauuggguuuuauaccgagacauuccauugcccagggacgggcaggagacagaugccuuccucuugucucaacugcaagaggcaugccuuccucuuauacuaauccuccucagcacagacccuuuacgggugucgggcugggggacggucaggucuuucccuucccaugaggccauauugcagacuaucacauggggagaaaccuuggacaauaccuggcuuuccucagcagaggucccugcggccuuccgcaguguuugugucccuggguacuugagauuagggaguggugaugacucuuaaggagcaugcugccuucaagcaucuguuuaacaaagcacacccugcacagcccuuaauccauuuaacccugaguugacacagcacacguuucagggagcacaggguuggggguaaggucacagauuaacagaaucucaaggcagaauuuuucuuaguacagaacagaauggagucuccuacgucuacuucuuucuauacagacacaguaacaaucugaucucucuuucuuuuccccacagcacgugcccagcuuccuuucaagucucuggccaaugcaaugugagcagaagugaaggggcaacuuucaggugaugacuuggaaaagaaagcuuaguccucugcuucuccugucacccgaaagagaaacagaggcuugucuuguugaagccaguguguuuggugucuuuuuguauaguggcuuagacaguggccuaacuagaagaccaaggcucaaaggaacacauuuugagcuucuccacaguuugagaaccucuacauuaccuacaccaagccuuccccagcacucaauuuauggaagaccauuucucuucucaugacacauguccucauguugcuuuggccuguuuuaaagcuuucucaacuccaucucaauaaagaaaucugcagcuuuguuggaugagaggaucuaaaaaguucguucuuccaaucgguuguaaauauagacacuaauuuauaaacugacacaggaacacacagcaaauuaguagaaaauccgauuccuguucccuuuucuccuugcauuguuuccugccaaugcucaccauuucuuuauccuuuccacucuuccuugcuccuccuucccuuuaauuuuucucuguugugccuaaauaagcuguccaugcauggcacuccaugggcucugauaacagacucaacaagacaaugacuuaaagauggagugaccagcugaucagucacacaaguuguuccaguguaauuauuuucacaggugucucaguuuggaugauaaauuauaugaacacucuacuuacagaacaaagaccuuuauuuaugucucucuugcuucaaaguccaaggugagcaugccugccuggcagcucugccucaauuccuuuuaaaucauuccuuugucauacuucagcacacugcugucaucuguaugguugagcuggacugcugccauguugagucaccagugacuuuuugauucuuuaauucccaguuugacuggcauuccucuguguguguguauuuaguucuaugcaguuuuaucacauguguaggcuuguguaaccacugccacagccaagauacagaacagccaaguuuguuuuuguucacugucaucucuccaaaaccuagugcaaugccuggcaaaaagacacucaguacauacuuguugaugggggaaugaaugaaugaauggugugcuaauugggguuuuaagaugcaaaacccaagcaguguaagugagguacauguggcggucuagagguaggaccagcaggauagcugugccgucuaucucugggccaggcaacugcugcaguccuaccauguccccagcagaugggcaggggaaaggcagggcccagucuuuacaggggcagguccuggaguugcacaccucacuuccccucauauccuacaggccagaacuuaggugcagguacacaccaagcugcauaggaggccgagguagaugguauuacuugccugcaauucuuccuucccucuuuucucuuacuaauguucaccaaaguggagaguacuuuuccacaacucaugcagggcuuuggccaauggaaugugggcagaagcgaguuuguuaguucugagcugaggccuuaggaggccucuugugucucugcucguccucuggcccuguugccaccccagguggucacugguccagaggaugagagacaagugaagcagcccugacucggcucacagcuugaagcagagcggccuccaccagccugcaagaaaaauaaaugacuuuuuugauaagccacugagaguuugagguugccuaccgugagcucagccuuaacugagugaguucuacuaguaacgaaggggagaaugaacauuuguggacuucgagcauucugcaguaugagaggggccccucucuggauggagcagggaagaccugaccuguagggacuccuuagggguccagagcaaagcccaggcggcuuaguuagacggcaugcucuccugggacucucaugggcagacagacuggagaucagcugaacuggggccagcuggaaacaccucugucuggagacaucuuggggauaaagggaaguuuggggugggaagaaugauaauggaaagcugcguccaaacaaauaaaacugucgcauuaacaaguugaagaagaguuuucccagugagucgagaacuggugcuaauaauagaagccucaaacagcugugcauuuugccauauuaaauaguucauuugugucugucuguugccagcacagcuguagagaaugaugcugcuccaguuugauccaauacaguauuuggaaugcauggaaaagaucacugaugccuuuaccugaugccuuaccucugaaggauauuucuccacauaaucggcccucgguuuugugcugaaugcagcuguugaaggaagcagcucucuguauuacuugcugauuauccugccaacaggaauuugggugugcggaaauggcaucaaauucuuuccacugggaaagugcuagcaacaaacaagagguuaaaaagcuuuugaaagcacagcaauuugggugugaauauccauucugagguggaugaauuaguuccugauaaaguauuggcugcuuauuugaaacugguugaggaaaagaaaacauggcuuuaaaaagcucuucaaauacaaauauauccucaauuuuaucugcuuuuuacugauauuuaucugucugccuucuauuaugaaaauuuucaacacugaaaaaugucaaaagaaaccacaaaugcuuuucaucuagauucaaugguuguuaacguuuuaccauauuugguuuuucuccucucucugucuccccacaaacacaugauacacaccauuuuugaaaauaaguugucaguauggcaucaugauccguaagugcuucaauaugaaucuccuaagaauaaagaaaaucuccuguauaaccgcaauaccacuaucauaccuaggaaacuuaacaaugauucuacaaucacaacuaauauccaagucauuuuaaaauuuuugcaauuguaccuuaaauguuuguaugcaguuucccccgagagcuaaucaaggcuuauggauuccaucuggaggcuaaucuggaaaaucucccccaccuuaacuucuguuugguuuugauuuacgacauugacuugaggaaucugggccagcugucuuagagaaggucacacaucccuggcuugcccgauuguuuccugaugguguccuuuaacuuuuacuuuuaagcccuuauaauggaaguuagguuuuagguuugaauaaacuuuuuucuuuuauuuauuuauuuauuuggcuauaaagaauacuuuacagguauuccaugaggagguccucacacuggguuuuugccagcagcgaugcucagggggaugaccuguugagaaaguaauuauuauauguccaugagaagguaccuuugccuggaacaucaacugaggcaaaguuuacaugcuauugcuuugcagggugggggugcaaugcugugaaaggggaaaaaugaauugagggggaaacuacaagauggucugcugcugaauuagccacugcuugauaaacagcacagcuggccgcuuggcuaugugagacaucuuuggaggugcuguguagcuccguugcaccucagaggaguccuacaaggcaaagcucacguggugguaaagcacuuguacuucaggauuguguugcuagcugccucgacacagccacugggaaagccaguucacccggggcuccugcuggaccugggcacaggaguugcugcagcuccugcccuggcagguggaaugacauggccuugccaaagacagcggugccugucauuauaggagguaaggugacaagguggaagcuggaacuuugcggccaucacuggagcugcuuuaccuaggaucaggguaguggguccccaggggcaggcagggucaaauggaugugcuggcuggguauaaauuggauccaacauuuuuuuccuuuuaaauuacugaaugauuugugggguguacuuugccccuguaggaauauucuauugcccugccacguuuauguaaugguuucaguauccauugauuauucuugccuguaccauuuauuacagcaggagaugcaagauaugaggguuaguuauguucguuaccacuagggugucaucguacgcuuuuucaggaacacaacuaggaugcuuuauuuacauauguaaugaauauauauauaauaaaaauauauauauaaugaaauaguaugaguuuguauugcuauugaaauuuaacauaaguguuuacauuauuuuuuuauauuuuaucuuuuuccucuuauacagaaaaauuccuaguuccuaauaauauugauauauagauauagucagaguaauauguucaaguuacccaaauuaaccuuuuuguuuauuguugguuuggaucaauuuuauauagaguuggucauuuauuucucuuaagguacaauuuuaaggcauuuuccuuuauaaauuacuuuuauuucugaauauauagagaauaaaugguucaaaaaucaacauuguguaaaaacauuugaucagagaagucucacgccugugcacauccccaccacccugccccagucucccuacaaggauaggucaucaaguugauucguuucugguuuuuccucuccuguguuucuuuuugcaaacaugagcaaguacauauauacauuuuaauuuauccuucuuucuuacacaaaauguggcgcacuauacacucuguucugucuugcuucucucucuuaauaauguauguucaaggcaucauuccacauugguucacagacaccuuaaauaccaauuuuuuuuuuuuagauggagucuugcuguguugcccaggcuggagugcaguggcacgaucucgguucacuacaaccuccaccuccuggguucaagcaauucuccugccucagcuucccgaguagcugggauuacaggugcccaccaccaugcccgacucauuuuuuguauuuuuaguagagacgggguuucaccauguuggucaggcuggucuugaacacccaccucaggugaucugcccgccucggccucccaaagugcugggauuacagguaagagccacugcgcccggcuuucaauaccaaaauuuaucaauuguuuaucauauguccaauguauuaggguaagcuagacaaugcucccguagcacaaaaaaaaaaaaaaaacaaaccucaaauuucaguggcuuuacaaauaaaaggccgaucgcuugcucacauaagguccuuuguggauuggacaacccuccucuaucuuguaauugcaucaccuacaacauguaucuauaugguggcuuauuggcuagagccgucacauggacucaaacugguggcaaauguaguguuauguucaugaagaggaaacugagaggggauuugguggguacuacuagcacuaucucagccacgcaaggcuuuauauaggccucacaacagcucuguaaaguagauaaucugauuguucccauuuuacagcuaagcacauugaggcuccaaguauucauaugccuuucagagucauaguguuccuguauaacaggguucauuucaaauguagguuucucugccuuuaaagccuguacuuauacccaauuccguggucagucauuauuguccacuaauaaagaauggcaaauccauuucauccacgcaugaaugcaaaucuccaacauaagagaucaguacaauugguacagaacaauaaauauuuagaguuaagauucauaagcuguuuucuacaaaaaagugcaagauuaaaauuaaaucccuggaccaaugaagacuaaaacauuacaggacacaauguuucaguaaauuggaaaauaaaacaguuuuauuuauaauuucugaaucaagagcuaauuguuauaggaauuuuuuaaagcucaaagugaaacuguaaacauuuuuucuuccucuuccuaaguaagagcaucauauacugagcacaugagagaaguuauaaaucuuucaaaaccauuuggggugguucugaggacuuacgucaaguaaucuucaaggauuucagucuucccuuuaaaggaagaaauaaacaaaaaaaucacauggccauuuggacagugccucuugcccaacauuaucacuuacugccuaagacuccaggcaacaauguguccaguguaugcuuuuagaaagugauuacaaccaacuaaaacugggaaccccaaauuaaaggaagcauugccgucuguaugcugggacuguagacucagugacaagguagggugguuccagaagagugauuuucccucaccugugagugugaaacuaacaccuggcugcugacccaacaucguuuucacaaagaacacccugggaguuucauuaucauaucaggugcuucaggcauucuggacugugacuacaguucaggaggaccaucagccaguguacacacacacacaaguuuuaugagacuaaauucaggcaauacacucugauccccacccuaccccacccgccuaccagacucuugccuuuccaucaaagcccacucucugccccacauaggccaggucuguccauccccucaggaucaggaccuuugggcuugguuuuuccuguuauucuucuuuuucccacccuacaccccaucccucaacagaaggucaguuauuguguggaauugcucgcacaccgauguuaucaugaagcgcugcacucuucccugccuuccuccuguucaggcuguuccuuuaaccuuuggcuagaggcaaggaugaacgucaccuccuggacaagacuucuccaagucuuuggcaaccaggaccgugggcugggcuccagggccuugcagggccuccuuccaaagaaccgagucuuucuucacugguucucuccucucucucucugccuggccacaaugccuucugaggccuuaucacccuuuguuaacacuugcucauccagacucuucugccagggccaucugggucuuuuaaauuggcauuagaguuuaaaaaaagucaaaucaaacugguauuuaacaaaaacauugcaggcgguggcucacgccuguaaucccagcacuuugggaggccgaggcgggcagaugacgaggucaggagaucgagacaauccugacaaacauggugaaaccccgucucuacuaaaaauacaaaaaauuagcugggcgcgcuggggggcaccuguagucccagcuacucgggaggcugaggcaggagaauggcgugaacccgggaggcggagcuugcagugagccgagaucgcaccacugcacuccagccugggccacagagcaacacuccaucucaaaauaaauaaauaaauaaaaauaaauaaaauaaaaaaauaaaaacaacaacaaaaaacuccuaaucauuguuaauguggaaaugguugccacuggaauaaauuugaaauuauguauuuaaaaaaaucuaaccaguauuuaaguucugcuaugugugccuaacacuguuaggagcacacaguuaagacacaaguucuugcauucaagaaucauauuggaagacaagauuuaaguaaaugaaagccauuuaacggugacccagaaaauaaaaugagucuggaaugauuaauaaaaucauauaaugacauuguguuuccucaucuguggaaucacagaggauuugaucagguuauccauaaaguucccucuuuuauuccaaauaaaugacacuagauauuucaaauuuuauuauuuuuuauauauaacauauaauuuguauuauacuauauaauauaauauaaaacauaauuauauaauauauuauauaauauagguaauuauaauauauaauuauaauauauaaaauauauauaauauauaauauauaauuauauuauauauuauauaauuauauacaauauauaauauaauauauaauuuauaauauauaauauaauaaaauaauaauauaaauuguuauauaauaaaauaauauaacaguacuaugugccagacaccauggcugacaacucuuccaacuuucauaaaaccaugagguggccauuauaaaucuuccauguggcagguggggaaacaggcacagagagguuaagaauuugcccgugggcacacagcauugugguacaguuggcauuugaacccaagggagauaaccagugugccauggcaucucuguguagcccuaaccucauucuuucccauacuuacuuuucaaaguguauuuccuugcuucuuuaaugggaaaacaauguauccuucuugggaugccuauuuuucucuuuuccauuaacccacaaacuuggccuucucaguucaaacuuguacaauuugcaaccaaguuucuaacauugucuuggcugggacucuucucuagggauuugguuuacuggaaucuacaaauuuuacuccgauuuuagccgaaaguccugucucauucacuguaucgcuuaucuuuuuaaauuuucucaaaacgugguaggcaaaaucuucaucuuguagcucgcuuuuuuucuaccccuuuuaacauuuugauuccacagccucccugggaggaccuccucauagugcuucacugaaaccugaguuucuuccauggcugcuccugucuacuucaucccugcagcugcugcacauccacccaaguccucucaagacacugcugugggacugagaaauaggaaaaggaggaaagccagggacagcugugccacagugaauuccaacguagggcaacgaaagcucauccugacagcguacugcacuuucgaggagcguggcauuugagcugggaauaaaguccgaggacaucaggaggugaagggagagcuaccgcccuggcugagagagggagaugagucuggggucugugugucccucaggccagccaucccugaccucuacccuggaacaaacugccugugguguucuguauagugccaaagcccagaaaacaacaaaucaugauuuuuuuacucagaauauucuccucaccuggguuccagcugaguagaucugagccauuucauguauuacauccaguuccucacugaaaugccaauuguuuuucacccacucgagaaggcaagucagcuugcugugcccacagacaugaccucaaauggguuugauuuauuuaggcaggucagucaucugaaaaggucagcccuuagcaguuccuaggaauuaaucaguggugugacacaacgcagcugugauugccacaaaccagcgacaacuggguaguggcaggcacgguacuaaauuauuaacccccagaaguuugugcccgcccccccuuuuuuuuaaacuugccuugaaugccaccuaaugagugcuugcuggggcgugaaacagucuugaaccuacauucuugcauuguuuuggaaggcguccuguguugauacugagugggggccucguacagaccacauuuugucacaaaauaagguagaaaagagugaaucauacaccuggaaaaagaucagagaacugugcuuugaaagauuaauagauguguuucccuuuuuaugacgaaugaagauuauuacugacaauuauuuaaaauguuucuaauaauuacaaugguuguucuaguuuaaaacucauuucacaaaagauaaagaauuauacaguucuaauuaagguuugggaguaauaguuaaaacugguuuuccccaaaguacuuuucaacuguuccugcacaaggagaugaguaaagaauuugcucagggucugugaugagcuggacccuggaaugaagaccagaauccaagcuccugaccucagacccagcuuagaugauaaggagcguaaauacucauacuggaguuugguuguucuugaagagagauuuaugauccccaaaccaggaguuccuuuuuccccugguugcuuucaagaccuuguggugacccaccuacucccaggaggcaauccugauuaauuuuacugccuccaaaccggucuuugugucagcacuucugaauugacuucagucuuuuguuucuuuguuauuucuuaagagugaauuuccuuucuccaugugaccugaaauaucuugaaggcaaaagacgcuucuauuuauaacugugcuuccuugaccuuccucucccacccuucucccuccauaccccucuuccugccucccugccgccccuccccuuccacacacaaguggaggcccagugcaggaaaaccucagccuccuggcgucaggaagguuucaaauucucacugguaauggacacacaccgucuggaggagcugggcugaaaaauuacuggccuggacaaaugcuccugauuuaaauguaaauucagacuuaaaaaauagaccuggugauauucagaacuuacaauaucguuuaaacagacuggcuuucucugugaagaucacucuuuaggagcccugaaaaggagaggccaggugggaaacgggaacuaugggaacugcuuccucagggaggggagugcagggcucuccaccaagugcccccuggaagcucaaugcccagcagcgccaggcgccuuccgauuguaucugcgaaccuaaagcccucagauguuuaugcagcucuuugcgguuuuaaaaggguucccacacacaugguuucaccugauccucaugagugccuugccaggggugaaggacagauuucauuauccucgcuuuaugaagaggaaacuggaucccuggaguccacggaaaugagaggagccaggaucugagcccacccauaaauauucauugaauugcacuaauauagaaauauaugauuauuuuaagguaaacagaauguuuguccuuaagaagcucauaucuaauuguggagaaauguucaaaaauuuuuuuuuuauuuauuuuugagauggugucuugcugugucacccaggcuggagugcaguggcacguacucgacucacugcaaccuccgccucccagguucaagcgauucuccugccucagccucccuacuagcugggauuacagguaugcgccaccacgcccggcugauuuuuguauuguuaguagagaugggguuuuaccauauuggccaggcuggucucaaacuucugaccucaggugauccgucugccucggccucccaaagugcugggauuacaggcaugagccaccgcacccggcuccaaaauaaacguaauuaaaauaaccauacaaggaauaaauaaggcaagaccagacauccuucauuguaaaaugaggcgagaaagugcugugauuuuuuaggggacuuagguaacuguuaccccaugauugaauggaacugaaauuucuguaucuuccaccccaacuccauuccauguuccugcugaauauucuggguuuugcuagaauuccuuaugacacauaaaaagucuucagcucuacgccuuaggcauggcgaugucuggguuugucacgucaucuucaguccuguauuuacagugcaacucagggccaaaacaaaaaagaauuuuuuuuuuuaauuuaaaaagucacagggaacaugaaaaaggggaagagggaaauuugucuucaguguugcaggaaaguccacccucuccuucuagggguggaacuuaguggaucuaaugaaucacacaugaaaagagacguaaaagaggaaggaguuucaggaggguauuggccaggucaaaggagaggguggaggaaaagagccacgaaauaaccgggagacaagcuuucggaggcuuuugacugacuggaugugggaauguuguggaagacuucuggccugccauuuccugagaacgggacugcugagagaggagcugggaggagcacugcaaauuucacuuuggacacgugagucagagguaucugugaggggacugaguugggagggcaagcagggaauuggacaugugggccuggagcacagagaagggacuugagcaugcauauuuggguguucccuccaaaacuuauguugaaacuuaauccccagaguggcagcauggagagguggggccuuuaagaggugauuggaucaugaaggcucuauucccacuaaugaauggauucaucaugggagaacuggcggcuuuauaagagaggaagagagaccugcgcuagcaccuuagcacgcucagucccccugccaugucaugcccugaaccccucaggacucugcagagaguuccuaccaucaagagggcucucaccaaaugcagccccucaacuuuggacuucucagccuccagagcuguaagaaauaaauucccuuuccuuauaaauuacccaguuucagauauuccuuguuuuuaauuuuuaauuuuuuuuuuuuuuugagacagagucucacucugucgccuaggcuggagugcaguggcgcgaucucagcucacugcaaccaccgcccccccggguucaagcgauucuccugccucagccucugggguagcugggauuacaggcaccugccaccacgccuggcuaauuuuuauauuuuuaguagggaugggguuucaccaucuuggucagguuggucuucaacuccugaccucaugacccacccgccucagccucccaaagugcugagauuacaagcgugagccacugcacccgaccccaguuucagauauucugucauaagcaauagaaacagacuaaguaucuuugacauggaguggauacuggaagccaugugacuucugugggaucaucucgaaagaaaguguaaaaugagaagacacaagggcccaggaaagagcccuagggaacuccgcauuuguacagcaagugguggguaaagagagaaaagggagaagccugcuaggaugcugaggaggagcagccagaggagggggaaccccagagagcgugcuggcgugggagucaagagaagugugucagaagaagggagcgguugacaaugucagaagcugccaagaggcacaauaagauugagggaacaagugagugugguuguuucuuuaugggccagaauuuuaaauaccaggaugaagggcaccuaacaaauagcaaauacacaaacuaacuuuuguaccuaccagacuucagacuaaaaucgguacaaagaauacucgccaggguaaggagaagcccaggaaauuacaagagauaucuaguuucugaaaugaauuacaaugaucaucugaacaaauagugugaaaaaauauacaccugaaaaaaugugugaaaauggccaacaaaacauugaaaaucaggguuacuggggaagacuuuuacugccaguuauuaaaauuuacuaucagcuguauugacuggaacagcugccagaauagguaauucaacagccaggaugggaagcccugauacauaaguuugguggggacuguagguagccccucuggcuaccuucuuucuaguugaauagguuacauaucuaacucccuugcaauuagguucaccuacucaggugcccuugaguuagacuugaaaggcagaagacagcagaggccauuuuacugcugcuucugauggagaugcgaggcuuccauaggaaagagggguccacugguauaaagagcccgacaaccauguucuccagauguucagucccucuuggccaccccacaccaaaugacaguccgcgagacucugcccauggagacuccaccugcugguccucuagguggaguaacugauaacaaaaaucucuagcuuacuccuaaguguuuauucugaaggcaguauguacagcaagaccagacuuuuggcccagcuagcggugacuacugcaaugucaaaagagcacauaaacagacuuaaaaagcaaaugacaaacugggaaaauugcuguaacauagguaacaaagggcugauauucuauaaagaguucuugcaaaugaauaagacaaagaugaauccaagugggcaaaagauaugcuguaggcaaucugcaaaagugaugcauaaaaacagguucaacauuacuagcaauuaguggaauaaaacuuaaaacaacaaugcaaaaccaucguucuaucauauuaacaaagaugacaaaaaauggugugacagugcaggguguggagaaaaguuggugucaaagcugugccaucuuucuguguaucuuucauaucaaacaaacgccuucaacaaugagcacaccuuucgacacgaguucccagacuuuauccuaaaaaaaaaaaaaaugacgugcacacagauuuagcuacaaguaauuuugcaaaagugaaaaguugaaaacaacccaaauguacaaaaauaggggagauaauuaugguacauuuguauaauaguaugccacuuggucauuaaaaaugccauagaaguauauuuuucauaaacuuauuucuagcugcugguuuuacaggugguuuuugcuuuuuuauuuuaucauuuauauuuuccuguaauuauugcauauuuuuuaauaauuuuuuaaaaccggcaauuauauggugaaaaggagagaagggcauuaguaaauucugaagcaacugaaauuaaauuguaauugcucauuaauaaauaaacaucauuacauacuaacauuuaccuuaaauaaacuagauuucauuuuucuacuaugggaggaaagaccuaaaauacaaauugacucgaauuauagaaaauaaaguuacaauucaggaauaucugucuuuggacugugaaauuuguaccuguuauguaugugugugugugugugccugugugugugugcguguguauaaaaaauauuuggaaagauauccacuaguuuaaaagugguuccuuucagcagggugggaugagagggggacaggagacaaauuuuuauuuacacaacucuguaugacuuguuauaacaagcacgaaaaaucgaaggucacuuaaguaaaaaugguuauaauuaugaaaauacuuagaaauauguaaagucucuaugguaugauuagaaaucauaaugcaaaaucuguauacugugcuuauaccuauguucauauauuuccaugugagagaagcccgaaggggaauacucugcggugaaaguagcuuuucaaguucauucauugguucauuuauuccacaaaugugugcugagcugcuaccaugggccagccaacuguugcagccaccgggauauagcaaucaaaaaucaaaugugccuccacucagggaacuuaaauucuaguagugggagacagacaauacaugguaaacccggcgaguauuucaggaaguggugagcguccugggaaaaguggagcaggccaagggagacuagcagugcucugggucaggggcagguuuaaacagguuggucaggaaaggccucacugaggugacaugggaggaaagauuugaaagagcugaaggguucaguccuggaaaugccuggaagggguguuuuacaaauagacaacagccggugcagaggccaaugcagcuaacagaggaaggggagagcaggucagacagcuaggcaggccaguggguuguccggcucugcagccauuguaaggacuuuggcguuuuauuucaaguaaacugaggagccgcugugcaguuuggagcacagaaacgacaggaucccuguggcugcuguacggaaacccagcgacugggaggguagggagggcagggagaccuagguguucaggugagggaugaagggggguguggacauguugagguguugcauccuagacacagauugaagguagggucaacaggauuucuagucagauuguguagagggggugagagagugaagcuggcucuucugguucuggccugaguaaauggagccgccauuaaugcccaugggaaagacaggugggcggagaagguuugaaggugggggaagaaagggucuuauuuucuucuuccuugcaauaauauaucccaagcaauauaauuaagcaauauguauuuuucccuuuaaggaaauuccaaaaauuauaucguuccaaauaaaaaaaucaucuccagaguccugacgcagcaaccauuacauucccaguaauggaaauguuaagucaguccgugcucuggagaaaucccacgacagaacacaggccaggagaccgggccuagauuccgguuuucgaaccgugggggcaaacacggaggcugcaaauccauccccaguccggcaagauucucgaacaugucgggagagggcugcauaggaacuucaaaaacgaguagcggcuccccuggauucagcgugagggggaaaccgcggggcagguucgaaacucaggaguccgacgucugaaggagcgggaggcugcuuccgaggagcccggggcacgacgggaagggccgcgccggccaggcagcccuccucccggcagccucgggcaggccguucacgcgccggcgacggcgggcccggccgcagguaccaacagcaccugucagagggcagcgcgggcgcacccugcaagggcccugccucgucaagagaggcagcgagaaacagcagcgaugaacgaaacaaaaccuuccuccaccacggcuacacagagcucgcguccgaggaagcgggaacacacaggccccggugcuuuccgaaaggcuucucgccaggacccgcgaccagcguggggcggagggggggggucacccuuuuugagaaaccaggucaagcaggccgucgcugggcgaccuuugggcggagggagagggcagggcugcaccgcacagguuccgccccuacuucagcguccucgccccucccaagcuccgcccagcaccccaagggccaacccccccgcgacgcaugcgugcuucuucccgcgcggcuccaccugccgcgcgcuuccgcugcuggccagucucuucugccccucccccuccuguacggccgcuacucugcgcccggcuuccuucucacaaccugguucugcccacaccuguucuucagcccugugaacaguggcuguagaacagucucaggcccugcagacccaccucccucgcucccgugguggcgguggugacgggcuggggacguuggguagaaaaaugggcgggauguggaacgcugcguugccggggcccacuuccggaggacgggcggaaguggcugcgguggauggugggaggggggaaggagugcgaggggagggccgggccgcugggggucgaggggguggggccugggccagcgcuggggaucgggccuggggccuggauugcgacccgcggcgggccgcggcuccuagccgagacggggcgggcgggaaccagguaacgacccggcgcaguuagagcgagggucguccgcagggcggacgggugggggucagaguccaggaagggucgcagugucacccucuucucuugugaacacggggcacgggguuccggggagaagggugggaggaguuaaauucuuggaggggguggaggucauguggacgccacgccccuacaggaaggaaaggagagagagaguguguguggauggauguguguugagagagagaauggauguguguguguuuacgaauaaacuuggaggggagggggcaacagggguggguuuucgggcugagaaaugggaacacuguggggcugcugcaagcaggacuugggccuuaaacauuccaggagaguguucucgggaguagccccgggaaggacuuuaacagagguugggaauuacaucucuggcacaguuuugcaagcagagggggagcuuaguuaaaggagcaaagaaugcaaguggaagaugccagcaucucggucuggaaaggauuuauuaacuaguugaagagggcugguggauuaaaacacucagcacccuaagaagcuugggagauucgauuauuauguugcgcuuuagacaggagggcaggagaaagggcguucuuuucucgauuucuuagaagagucuccgguuacuuuucuguggugagaacggguacgauccaucuuuuauccugaaucauguauguuuguacauacauauaauauguuuauauuauauguguuuauauauguaaacacuauugaugaggugacuguguucuggcgugugauacgugaguuaaguaggugcuuuguauaaccuugcggaguguuuaacgaagguguuuugaugauagagccuaguauggacucuuagguggggaguggaaacuagaagguuuuaggacucuauuuggguaucuagauuagagagcguuauaauguuuaaauguucugcagguuaacacagaaaucugccuccugggccaugccgcuucuaaggccuguuucuucucaugagccccagcacaagacagaugggccaguucucacaguggauaacuuccccugccugagcaagagaugggauaguaucugggaucuguccaucaccagacucugagcuuaauaaggcagcugaaugaagggagguaacggaccccugagaggggcacugaagucugcaguggggggggaggggccuggacacaccccuucccccccagacuccuccccgucagggucagcucagccauggacuuuggaccuggauaagaagagagaagcugcacuuugguggaucugauuugggauucucaguuuugaaaauggagugcugaauggggauuugaugaucuccuggagagcaacugagacaagagaagaaagguaaggcuccugucucauuucccacuuaaugucuugcugugccugugcagaagguguugagcuggcgaguucgcggaggcuacuauucaggaaaucuuauccagaugaguacacuggaagcuacaccucuccauuacucuguccagguauagacuuguucccaacuuccccuuacccaagcuggaugagugccuuguaagggauugugagcaauggcaguugugagguuaggccaaggagaacaugauaauaauugaagacuucugaagggagguuggauuagauuaccuuuaaaggcccuuccaacacugagauaauaggauuccaagucagucuggguuaagacuggaauggauuaccuaggcagaggcagcugcucuguuuuggggagcuaacugaaaaggacugcugguggggggagaaggcgggaauggucuagauaaccuccuaaguugucucccuuccuacuucuauaaggggagcuuagcccaugaaagcucgggaaaagagcagaggaacagaacacagguuugggggucaggaaggaguacuuguguucuagcuuugacuuuuugagucaguguacaacccuacacaggccauguucucuucaccuacaaaaugggggaaaacugacuuuccaggucccuuacaaguuguuacgaggagcaaaugaaacaaggauuuugaaaaguauccagggccguguacacaggaaacaauaacaucgauguugcucuacgugccuuaaaagcacagaaacaacucugagucaggaguucuguuuucuucuugaaauagugugcuggcaacagccuaagaagauguccuuagugaaaagccugccccugaauguguuucaucaucuuguugguaaacaguacuugggaucaucaaguuguagaacaggugaauagauccaaggagaacuuggauugaaggagucuugcagauacugcauuggcccuuauggcucuccaguccaauuucagugugccccuuugagguagcugauuaaagaggggguggaaggaugcuuaagccuugagggcaggugucuggcuaggcacuuuucuuggagugagugguggucuuuaccuuccugugccauaugcuaguuaucucucccgcuccuuaagaugacguuuuuuuccagacaucucuucgcccuuuguauuuucucaggcuguauucccuauaaaagcagcccuguuugucuuuaucuucucacuuccugucugcucccuccuucaauuccaauuuaccugugccaagaugccugcuuuucccagggacaacacacagcagaaaggagggguagagcacaguguugggaauuuugagagacaguaggguaugguggccugggcaaagggcaggaggccuggcuucuggcaugucucugccucucccuagcucaguaacaccuaggccucacauguuccuugaggaugggugacagugaggucaucugcaaacugaaaauccuguacuuaugccuuacuuuccauguuaaauuuuuuucuuccauccccuuccccagucuuuccuuuuuugccacaggaguuuuccucacucccuccagcggcuugagaggugggcaguggccuggguggagcugcugcucccgagcuguacuuucuccucuggucuggugccuggggcagccccuuugaggccaggcugcuccuuuauaaggugugggucucaagauggguguaccaccuuccccagcuucacccagcaaauuucuguugccagucuuugcuuagacacaggggucacagugaucccucggggauacgugaugccacggugccuccucagccaucucugguaucccagguaccagggaguugcguauuugcguaaugcuucuaucacgugauccagucaaucuguuuugucuguuuucccucaccacuuuguugugaggagaacagagcagggauucuuuucccaguuugaggggaagcuacggaagcccugagugggaaggguuugccuaaggguagagcgguaggcacugaaaucaccucccagugcugugcuguuuccacagcaucugaccugaccaggccaucuggguucugcugcaaaccuccagggagagaagcucugugcccugccagacagccucucugguagaacguuuccuccuuagagugagcaagcauuccucucccugaccuucccacccuccugcccugcaccugacccuuccaugagacagucccuucaagacaaccauuggcuuuuucacaugggcaccaggaugccaaggcauagcacucagcaggugucaggcuacuuagccaggagcagugauagacuuaaccagacugugugugcauuuuuuuuuugagacagagucuugcucugucgccaggcuggagugcaguggugcgaucucggcucacugaaaccuccaccuccuggguucaagcuauuccccugccucagccucccaaguagcugggacuacaggcacacgccaccacgcccggcuaauuuuuuguauuuuaguagagaugagguuucaccauguuggccaggauggucucaaucuccugaccuugugaucugucugccuuagcuucccaaagugcugggauuauaggcaugagccacggugcccggccguguguguauuuuaacucaauuaauuauuuauauccuucuuuauuccaaaaagaauuguagguggcuaaccaaaaguuacauuucacagacauuguuuagugauuauuauguuaaucuuuccucuuugaccuggaugagaugaauuucugggucuccauuguggggugagggagaggggcaagcagagauauuaggaggcagggagaagggaaacaaaacacugauuuaaaaaauuugcuuuuacuuuuuuuuuuugagauggaaucucacucugucacccaggcuggagugcaguggcauggucucugcucacugcaaccuccgcuucccagguucaagcaauucuccugccucagccucccgaguagcugggacuacaggugcaugccaccacacuuggcuaauuuuuguauuuuuaguagagacgauguuucacuauguuggccaggcuggucucaaacuccugaccucgugauccgccugcguuggucuccuaaagugcugggauuacaggcgugagccacugcgcccagccugcuuuuacuuuuacugauguuuucaagccaacauauguuuuaauuuaagggcaugaauucuuuccaaauuguaaaaagugucagggaucuugggcaugguuuaugggagggcaguuuccuggaacaguuuucacuuccuuuucaucuuuucaguucucuuuugucagugguggagugggcaggggagaguauuguuccucugccuaaucuugugacuguuuauccuccuggauaaucuggucuaaucuugugacuguuuauccuccuguuuuuuccuuuugcacauaauccaaucccaggcccacccccagaauccuggccccuuguuucuauccuucuuacuccagucacugcuccccauguaaccucuaucaagagcucagagccucuuuuccccaggucaguuuggcacucauuuacccugguuucuugccucucagaccaagugcuugcuuuugccuccaugaagcccauucugauucccuaaccaggcccuuucuuuuugggauggucucuugcaguccgggaauuucuccuuuuggaucuuccugugagccuugggauuucagccaagggugguagagauggggugugcguuacagugcacgaacagccgccauccuguuuccccuucaccugccuuagauggagaaguaucagggucaguggugggaaucugaucuucccccaccuuucagcacccccugaugucuguccuuucuccuggaaggugauuuuggcuccucaugucuuggaucuacaaaccaguguuucccagccuuuucacuuuuaggaaacacaauuguuuuuuccuuuacgccuugacaccuagugugagugugcagagcccccaggccccugacuccuccauuaggcaaacauagggcagaggugacagacacuggccucugacuggcauauccgccuggguucgaggcuccugccacagugcgcgcagucagcuaaaguggaagccacgggcuucccgcacaucgcacacugcacacggcggccucggugggccugcccuucucccacuccaccuccaggucugggcucuggccacuuaagcggaggcuucacggcagcgccugagaggagacagagcccucucaaagcacuggcgcuggaggaugugugcggggguguuggggggcgcacaggagugcccggucuaaaaccuggcuaugcuccccaccaggucugguggcuugcagcacguuugcacuuacccugagccucaaacuaguuaucuguagaauggggaugauaacgcucacuccgcagagcugcugaggcuugaaggacaggccgagggaggguuuggcccgugaggccccucaccaugccuggugaccccuuagcaguuuugauuuagguccucgccuccacgcaggggccugcgggugcgcgcggcccuuuguuucucuagaacccugcacgauucgugguuucauguagaaacaaguuagugagcagucagucaguaaccacaggccgcagaguuccgggcugcuccgugcucuggaacacgggggagggguugaugucaggggcguggguccugaucacauggcagcagcccuucuuggggaagucagcuacccagcagccuguaguccucggcuacccacccucaccgccuggggucccauggugagacagcugggugggcaucaggcuucugcagagggccaggccggagggagcugggcgagggaguggggcuggcuccuggcuugcaccggccucguggaauccaggccucagaccugaucgcuggcgaaacuggcucugugcgcuggagccccuggucuucugcgucuguccuccucccggccagacuuuacuccuggcucagcgacagguauuugcuauggaagagcugucccucccuccccucggugggccuggguccaccuccaccuccucuucagguccgcaccuuccuccccuuuaaaacaccagccgggcgcagacccguucuaggcuuuuccauggugcuuccgccaaagcuugugaccgaguccuucccgccuagggcuggugggccuccccugcugguaggucucucuucgcuuucuuuacucagaacugaagcucucauuccccacccaccaaggaaaaacaaaagggaagaagccacagcuggccccggcuugcuuuggcacagguguuuccccccggccccccgucgggcacccugguuccuguucugucccugccccacgcgacccuggggcucccacccgggcuccucagccuccccuggguugggguggggggacuggcucccagcccuuggccuaggguuuggugaacgccuuuccuggacugcgggcccacuucaggcgcggcuccaggcugggcagcugcgcuggagggccgagggcagggguggggucgggcguccacccucaggguugcgccagggagccggaaagccgacucccgaaguugggguccugggaaaacuuggguccuggguugacugagaagcggcggggaaaggaggcgggccaggaggagggggccuggcggacgccggccggggggcggggcgcggcggggcugucggucacgccccucaguccgccccgccccgccccgccugccggggaagggccacguugcccgcccggccguccggccccggcgcgccgcagaaagggcuggcgagucgaaaggcgaggcggccgcggcagcgcuugggacgcgccugggcaccgggcucgcucccugcgccccggagcaggccaaguucggggccaggacgucgggaggaccuggugaguagguguccggggacggaggucagaccgggggaggccucgcgggcgccgagagggagcccaagggacgucgggucgccccaaagccccggugcccaugagugcuagcgagagggggcuuggcuggggagcggcccgguccgacccggugccagcugcgcguuagucccuucccgagccgagagguuggaacuccgccuucugcuuucggaaucccgggccuccagcuguuagaggaagggcgggcuccgcggacuggggaggauguugugaaacucggccccgggcguccgugcgugcggggcagggagggggugggauuggggaguggccuuuccccccuaaccucacuccagcauccuuuccccaaguuaauagaggcugauucuccucagcagaaaggaaauguugauucaguguugaaauauauauauaauaaguuggcaagaaaacuuuucuuccuguuugcuaacguguguggaguagagagccccgggacgugcagugcccgcgucugauaaacucugaaguagagggacuguggcuggccggcucccugaaggcugaagcuucacuuugguuaacccuugcugcuguagugggucugccguuuuguuuuagaacaucacuggcugagauguugcccagcuuuauuuucagucauuuacgguauuuuuucaggccguguagccuuugcucuuacgugcucacaucauccaggaucugccuuccaucagcaaucacugcguccugguccuucccaauucuggggaccauugagcucacccauuucccugcuucugugucucauucucacuguuagaagcacugcgguaugccugaccucaguggccuguguuaacaagggaaacucauuacuguucggggcaguagggaaauugucacugucgucaguauccaggcagugggaccuugugaugaaccaaaucaacccugucaccuuauagaugagagaacuaagguacaagugggucaagugacuuguccaaaguugccuggcuugcuggcuggaucgccugaaucccaggccucaugccuuuuguggcacuuguauuuagcucuucuuuuccaggaugaauaaccugcaucccuucccuccuaggucuuauucucucaacucuugaauuauuuaguguaucuucucugacuaccuuucuuuuuuuuccguccugaaauuaugggccugguacaugauacaggaguccagccaaggucuaagaacgaacaugaaagcaguucaguuagaguuccauuaccugugacaugucuauauuuucuggaauuuuuacguagugcuuuuuaacuuuaagcaaagcagagauagaagggaaaaucuguuaccauuucuuccacuucuguacuuaauuuuacagcuaaauauaacuucucgcuuauugcucaugauuggaaguugacuaucugguguucacuugcuauuuaagaaacauuuuuugccagauaaaggaaauaggcuggagaacaccaugguaucagaguguuagaaaggaucucacagcuccuaggcaguccuucaaaugcuucagaaacugagugagccccauaggggcagguggcgccuacccagagccaccucgguuuuagcugaaggguuuuguacugaaaagacucacuucucaucucccaccauggugcagaugucuuuguaccuggugguguggauuggcugugucaccucccuaaaggaguugugaaaacucuagaaagucaaagccaguuuugagucugugccuugcaugccagucucauaaaugacaucauuaggaacucaggucaggauuaagggcaguuguucuauuuaaaaaggaagguguagcagauuguauuuucccucaagggccucacccguaaguauccccuuccacauguaguuauaguuugacauuguccacuucccaccuaguggugggguuuaugauucucuccccuugcaugucaauagggacuugugguucccuugaccagugaguaagacagaccugauccaaggcugaaucaggaacaggauacacuuucaccuggcuugcccgcuuucuuggaacacucaccuuuggaaugcagccaccacuuccaggacauuuccaggccacauagagggguucuagugagcacuccugcugauaaggucucagcugcugccaacaucauccuacagacaugugagagaaugugagagccucuaggggcaucuggcccucagcuuuugagucuuucagcaaggccucaggcauaguggagcagagacacgucaucuccucugugcugcacuguccacauuucugaccaauagaaacugugaggaguaagugauaacuauuguuuuaagccacuaaauaucgagguaauuuauuaugcaggaguagauaccuacuaaggaaggagacaugaguggagacagggccucaguguuuggacuuggagcugagcacagagggcagggagggcacuugcccugcuugucaagauuaucuagagucuguuucucucauugcuucagguacugauggcugcauaaugagucaccccagaacuuaguggcuuacaacaacagaaucauuuuauuaacaucucagcuaugugguucuugcuuguggucuuucacgccauugcagucagcuggggcugggauaaucuggagggcugucuccugugucuagcgguugaugcuggcugucagcugggaccuuagcugggguggucaguuggaauaccuauggggguccuguccauguagcaguguccuguccauauagcaggguccuaggagucagcaucuuaagaggaccagguggaaacuacugccuuuuaugaguuagucucacaagucacauagcaucucuucccagaaccaaagggagggaacauagacccucagcucuggaggcaggagugucuuuaucacuuguaagaagagcauauggaaugggauaugugcggucaucucuggaaaaugucacacuucacucucuugcugcugcguuggccaucuuucucccugauuucgguaauagugcaagcagucuuccauccagccacuugaaccucauacaugugccaagcacuguggugggcacagaggucauagagucuuuuuuccuaaggaggaaggugggagucaggucagcguggccacagauucuguuacagcguggagagagugcugugggaguguagucauagggaggccuggcucugucugugauguuacagaaggagucaccugaaguggccugaaaggauguguggguggcuggcagguggcgcugugggucaaauuccaggaugagggaccagcuggagcagagacacagcagcguccagguauaugcuuacuggggaaaaagcagccugcugaggccagagugcaggguccaugggguuagugguuggagguaagguugaaaagggauguuucagacagucugucugaagggcuuuggaugucaucauaaugaguuugaguuugaguuugugggcagugcagccucugaugguuuuuaaagcaaguuaaugucgugaccagguguacuugucaggaaggaugcgcuguugcuguugggaagguuugugagagggaagcaagauuagugacagguggaccagcugggaaacuacaucaagaguccagacuuaaaacaguguuuccuacgaaggaaugaguucagguuaaagggcuggagggcuugacaugggaugcuagcagucaaugaguaacuuuguacuuccauuuucauaguuuugaaguucuugguccuagauguauuucagaauugagaauuuuuuggauuuugaaaagaugaucuggugaauuuacucuguaguggaagaucagaagcagcauggcauaagccaccauguuuauuucuguagcaaaauguaugaauagccacagcaggagagagaaaagacuauaaauagccccauauuagaucagaucagauuuuaccaaaugaggcuggaugagguuuuacugccaauugaguuuagaaaacuucuguguuuuagugcuucuuggauuuggcaguuacaguugaggaacuguggauguuuuuagaucccaggcacaucugcugaauguugagagcccuagcacagcggcuuggcagugcugguggagccaaucccugucuucauguagcuugcagcugagggggccugagagaaguugagcaagugguugcgcuuguugcuguuggugaaggguagguggaccuuacauggucccaggcgucaaggaaggcaucuuggcagagacacgaaucagagugugccaggugaagaagauagggaagagcagagcuggcacaugggcacaugcaaagaccccgacgguaggcuuggcuguugggguaccagacgggagugugguagaguggagcaaagaaaauggggagaaaggagugaaauaacggccgauauuuacguugucaugccggcacuguucuaaacaccuaacauggcucaucucauccgaucuucacagcaacccaguuugagucucagaaauguggcaaaacguagggugaugccucugggcugucuggcuugccuuuguugcugcugcacucuccugaugguggccugagcagugcuuccuggagaagcaggucaccgcugcuggccaaggucugggcuugaucauccuuuugggcacagccaguugugagaggguguauggcuccugguucaugugugugcacacagcacuaacuuccaggcagagcugaggauccuaucccaggaacuacguggauaaacaguaggaaaauagcacuggggcccaggcugagccuaaggaggugggcuggaacuaggggugucauguccucuuauggcaacaggagcaaguuugaagcacagggcugugggguggagaacaagggcccagggauugauuaagguggaggccagggcuuggccggggcagcuuuuccugugggcucugcagccacuccaugugugugcagacuugccaaguaaaaacucagucagaagacugguuugcucugcauggcuuagaaggguggggcaggagguccuaagcaucagguagugggugugggccaccaaauucugaugucuggagaagaguaaaaaggcaucuaaagggugcagaaguuaucucaagggucccaggaggcuuugccauaagggccugcaggucauugaugagucagggacgggcuaucccucugggcccccccccccuuuuuuuuuuuuuuuuuuuuuuuggugggggauggagucuugcuucaucauccgggcuggaaggcaguggugccaucucagcucacugcaaccuccgccucccagguucaagggauucuccugucucagccuucugaguagcugggauuacaggcacgcaccaccacacccggcuaauuuuugaauuuuuauuuuaguagagaugggguuucgccauguuggccaggcuccugaccucaggugauccgccugccuuggcaucccaaagcgcugggauuacaggcuugagccaccaagcccaguggggccccacccuucuaagccaugcagagcagcacuucacugaauagaguucagucccucuucuccauccccauccuguuauauaaagucuuuuucuugcacagucauuuaggaggugggaaguugggagacagggaauccuggccauuagauuggagggaaaguuccaacauggacaacauccugaggggagagcgaagaagaaacugaaacucuucugggcccaguggcucacaccuguaaucccagcacuuugggaggcugaggaggguggaucacuugaggucaggaguucaacaccagccuggccaacauggugaaagcccgucucuauuaaaaauacaaaaauuagcugggcgugguggcaggcaccuguaaucccagauacucgggaggcugaggcaagagagucgcuugagccugggaggcagagguugcagugagcugagaucaugccacuguacuccagccugggcaacagacagagugagacucugucucaaaaaaaaagaaaaaaaacugaaacucuuuugugcaucacucuuuucuuccacauaaacuuucuuaaaaaucaaauauggggauauggcccacagcucugaguagcuucauccaucuguauggccccagcugggcacagcaguaaggccaacugaaacgacguuugcccugaauuucucggucacuugacaacauguaucuaauugauacauaauauuugagcccugauauaauagaauuuaauugcacaguuacauggaaacagacuugacguuucugagaagacugauguccuggcguggugggggugguugguuucuaggaagaagacaagugguugguggugaaugcuggcaggggcuggugaagucuccccaggagggagacagaauccaugucucuuuagaggcccuucaggaucagcccuuuuauaccagaucugcugguuugagagcccagagccucagagguuagaucugaggcccaagguuuuggccaggauuagagaguagccugugaggcagagggcaacuggcagagcuguugguguaagagggugcacgccugaagcuuugggguguaaaggguagaccagaggcaggacagucaaggaguuauggucuggaguggcagcuggcugggaauuggggaguguuucagauccuuucaaguaauguggucugguagagcuuggaggauuggugggaccaugccuuuuucucacugguuuguguccugguuccuucccagagccuggcagagagcaggugugugauacacgucgucaggugacugaccgaggaauucagggcaaacagaucaucucaauuugccuugcugaugugccagcugggauuacgcugauggaugaagcucuucagagcuaugggcaauaucuacauauuugauugucaagaaacuucguguggaaauagcuucaaacuuacacaaauugcaagaauaaaaaauaguauaaggauauucguacacacucucuuuacucagauucaccuguuaauauuuugcuccauuugcucucuaugugugcagaguauguuuuuguucugaaccauuugagaaguugcaucuauccugguccucuacuucucaauacuucaguguguauuaccuaagaauuggaauuaaucaguuaucacugauacuuuaaccuacuguccauauuccaccuuugucauuuuacccaauaacgucuuuuuaaaaaaaguuuuuugagguuucauugacauacaauugauaucaauaugugcaaagaacugcauauaaaguguacaauuugauaaguuuugacauauauguguguguguguauauauauauauauauauauaccuguaaaaguaucaccacaaucaagauaauaaacauauccacccuucuagaagcuuccuaaugccccuguguaguaacuacccuacugcccuucucugccuccauccccaggcaacaacugaucugcuuucuguaauauagauuaguuucuauuuucggcaguuuuaugucaauggaaucacaguguaugugcucuuuuuuguuuuucccaaaaagacccauauuguguaauuauuuggagauuguguuguguaugucagugguuuauucaguuuuauugcugaauauuauuccauucuaugaguaaaccacaauuuguuuaucuguauuucccuguugaugggccuuuggguuauuuccaguuuugagugauuaugaauaaaguuaccaucaacacuccuguguagguuuuuguagggacauggcugaaaguagaaagaaauggggcaugcaggagagacugggcuugguuauaacagccuguuaucccuggggaacuagcucacucaccagaggacguuaggaaggaucugccccugccccccuugugauccaaacaccuaccacuagaccccaccuccggcagcaccaccacacaggggaucaaaucccaacauguguuucagagaacaaaccauauucaagcuauagcauagcuacguaauuauuauaacacuauuaauaagaccaucuuugccuugggaauuuuaaguagcaccuuuauuacauauuagauuuuuuuguguaaugagucuguuucuggagcuuaaauucuauuucacuggauggucuguuuauuuauguaccaguaccacgcaguuguaauuauggagguuuuguaguaugccauauauauauauauauaauaaaaaaaaauuuuuuugagacagagucucacucucuugcccaggcuggagugcaauggcacaauccaaucacagcucacuacagccucagccucccagacucaggugaucccaucucagccuccugaguagcugggaccacaggugcgugccaccaugcccagcuuuuuuuuuuuuuuuuuuuaauuguuacuuguagagacagggucuccgugugcugcccaggcuauucuugaacuccugggcucaagugauccuccuguauuggccucccaaagugcugggauugcagguaggagcuacugcaucuggccaguaugcaguauuuucauaucugguagggcugagucccuccucacagcuuauuuuuauuguuuuccuaguuuuucaugugaacuuuacugucaguucgucuagcuccauaaaaagguauuuuuauugggauuuuugaugaugcugaaauguccugaccaagaacaagggauauucagauguucuuuugugucuuucaggaaugauaguuuuguucacauaaguuuugaauguuuaaguuuauuuaaguuuauuucuaaauauuuucucauuucucuggcuuuuguaaguaggguuuucucauccauguuuucuucucaugaguuauuuguggauaugaaggcuauccauuaguauauguugauuuuuauauuacacuuccuugcucaguucauuauugauucuuuuugaguuuuccaggcauauucucacaaguaaagauaauagaaauaguuugcuuccuuuccacuucugcuuugaauuuuuuuuucuugguucauuugcauuggcugcuuccuccagcaaaauguuaaauaacccuggagaugaugggcaacuucguuuugcuccugacauucguggggugccucuggugcuucccuguugguaagggguuaacuguagcccugaggugggacauuugauuuuaaaaaucagucaucuuggggcgcuuagguuagaggaaugguaggcagaugcugucacuccuugccccuccccuccuccuucccaccuggaggggaaaugaaaucugacagguagaaagaggggaguugggguucuuuuucucucucccuccaccagcaucacucucugccucucccucaaaaauacguuccugggucaggauauauguugacucccuagagagcucuggagucaaccuccuggccuuccuccacccucacucuuggccuuuuccugcccccauuuccucuaccuguggggcauggagccacgagccuuugugugacgguuugcuuucucucuccugucuuuaggugcauggcugccuccuaaucccauaguccagaggaggcaucccuaggacugcgggcaagggagccgggcaagcccagggcagccuugaaccguccccuggccugcccuccccggugggggccaggaugcugaagaagcagucugcagggcuugugcuguggggcgcuauccucuuuguggccuggaaugcccugcugcuccucuucuucuggacgcgcccagcaccuggcaggccacccucagucagcgcucucgauggcgaccccgccagccucacccgggaagugauucgccuggcccaagacgccgagguggagcuggagcggcagcgugggcugcugcagcagaucggggaugcccugucgagccagcgggggagggugcccaccgcggccccucccgcccagccgcgugugccugugacccccgcgccggcggugauucccauccuggucaucgccugugaccgcagcacuguucggcgcugccuggacaagcugcugcauuaucggcccucggcugagcucuuccccaucaucguuagccaggacugcgggcacgaggagacggcccaggccaucgccuccuacggcagcgcggucacgcacauccggcagcccgaccugagcagcauugcggugccgccggaccaccgcaaguuccagggcuacuacaagaucgcgcgccacuaccgcugggcgcugggccaggucuuccggcaguuucgcuuccccgcggccguggugguggaggaugaccuggagguggccccggacuucuucgaguacuuucgggccaccuauccgcugcugaaggccgaccccucccuguggugcgucucggccuggaaugacaacggcaaggagcagaugguggacgccagcaggccugagcugcucuaccgcaccgacuuuuucccuggccugggcuggcugcuguuggccgagcucugggcugagcuggagcccaaguggccaaaggccuucugggacgacuggaugcggcggccggagcagcggcaggggcgggccugcauacgcccugagaucucaagaacgaugaccuuuggccgcaagggugugagccacgggcaguucuuugaccagcaccucaaguuuaucaagcugaaccagcaguuugugcacuucacccagcuggaccugucuuaccugcagcgggaggccuaugaccgagauuuccucgcccgcgucuacggugcuccccagcugcagguggagaaagugaggaccaaugaccggaaggagcugggggaggugcgggugcaguauacgggcagggacagcuucaaggcuuucgccaaggcucugggugucauggaugaccuuaagucggggguuccgagagcuggcuaccgggguauugucaccuuccaguuccggggccgccguguccaccuggcgcccccacugacgugggagggcuaugauccuagcuggaauuagcaccugccuguccuuccugggccccuccuugccacaucaugagcugaggugggaccacaguccccaggcugcaucggccugccuguguuucccucuuaggugcauuuaucuuuuugauuuuuccgaguggcauuuaagugcacaaaugauaacaagaggauuauucucccguucucaagggagucagaucaggggaacuauucuaggguauguugcgggguauuaagcaggaaaccacugugugguggggggcacugggcuuguuggggccagaaauguccacguccugagcuuucuccuggagcaugugcagagaguuuggcaacguucgcucucuugaccagaccccuucucccugaccuggcucuuccagccagggcacgagcccuccuucuauaccugcuccccuucccccaguggggacugaguuaugggagaaggggacauauuuguggccaaaaugauacuaaccaaaggggcuuccuugucagggccugguggaguuggugggucaucggggcucacugccuccugcccuucucuccugucugacccccacuuagcccuucucuccuugcagccuagcaguuuauaguucugagauggaaaguugaagggggcaagcaagaccucuccucagcccaugcccagcugucaggagagaggugcagggaggaaggccuugugcugggacaaccucucucuugccuuaccucagagagggacuaugcccugaccccuccuuucugaaaaucagugcccucccuguugcucuaggaggcuccugcuggcuugguagaagacagaauucgaucugccugucccuuuuuccccugggguuugacacacaggcuccucucagcaugagguggagcagugaccagguggagcagugaccaggacgccucuggcccagugcugcccagccuccccgcccgcucccaggcgccccauguccucacaggccaggacgccauggcaggauggagaggacuugguggauuuuuguuucuugccugaccucaguuucaugaaagaaaguggaagcuacagaauuauuuucuaaaauaaaggcugaauugucugaaaaauauu

SEQ ID NO: 16555 - RNA, 1023 nt, Homo sapiens
gagcuauuacagaaaauuuuacugcucauuuuuucaccuccuacccugagucccugccccuccauaguacuuuccacagagcccccuucacguccuuguuucuuaguguauaaaugagaggauugagaauggggguaauuauaguauaaaaaagggcaacaaauuuucccucacgcucagaauaauuguggauggauuggagauauguguagauggcugagccauaaaaaaggaaaacuacuaggaggugggacccacaagucccaaaagccuuucugcgcccagccguugacuucacccucagcacugcaugagcaaugugcacauaggagccuagaauaagugcugcaggaacagccacgacuaugacucgggccacaaacaucuuggccucuguuccuucuguguccgcacaagccaacuucagaaauacaggcaucucacagaagaagugauucagucgauggccacagagaggcauggccauugcgagaccugucuggaucagagaguucacgaaacccgcaccccaggaggcgauagccagggucuggcagagaugggggugcaugauggccauguaguggaguggacgacagacagcagcauagcggucaaaggccaucaccaccaggagcacacacucuguggagcccagggcuagguagaugaagagcugagccacacacccuccacgggugauggugcgguccaccccgcaaagguugaucaggagcuggggcacggugcugguggugaagcagagguccaggagggacagaugagagagaaagaaguacauaggugugugcagccgaaggucuagccaggagagagcgaugaugaugguguugccaaagagaguuagggaguagaaaauaaaaauaaagacaaacaggaugggcuccaguugcggccaaucugagaaucccaccaaaaugaagccaucuucaaaacugguguugaaacuucccauggccuuuugccugucugaacagcagaaggaagugcaaugccuccuau

SEQ ID NO: 16556 - RNA, 938 nt, Homo sapiens
caugggaaguuucaacaccaguuuugaagauggcuucauuuuggugggauucucagauuggccgcaacuggagcccauccuguuugucuuuauuuuuauuuucuacucccuaacucucuuuggcaacaccaucaucaucgcucucuccuggcuagaccuucggcugcacacaccuauguacuucuuucucucucaucugucccuccuggaccucugcuucaccaccagcaccgugccccagcuccugaucaaccuuugcgggguggaccgcaccaucacccguggaggguguguggcucagcucuucaucuaccuagcccugggcuccacagagugugugcuccugguggugauggccuuugaccgcuaugcugcugucugucguccacuccacuacauggccaucaugcacccccaucucugccagacccuggcuaucgccuccuggggugcggguuucgugaacucucugauccagacaggucucgcaauggccaugccucucuguggccaucgacugaaucacuucuucugugagaugccuguauuucugaaguuggcuugugcggacacagaaggaacagaggccaagauguuuguggcccgagucauagucguggcuguuccugcagcacuuauucuaggcuccuaugugcacauugcucaugcagugcugagggugaagucaacggcugggcgcagaaaggcuuuugggacuugugggucccaccuccuaguaguuuuccuuuuuuauggcucagccaucuacacauaucuccaauccauccacaauuauucugagcgugagggaaaauuuguugcccuuuuuuauacuauaauuacccccauucucaauccucucauuuauacacuaagaaacaaggacgugaagggggcucuguggaaaguacuauggaggggcagggacucaggguagg

SEQ ID NO: 16557 - RNA, 938 nt, Homo sapiens
ccuacccugagucccugccccuccauaguacuuuccacagagcccccuucacguccuuguuucuuaguguauaaaugagaggauugagaauggggguaauuauaguauaaaaaagggcaacaaauuuucccucacgcucagaauaauuguggauggauuggagauauguguagauggcugagccauaaaaaaggaaaacuacuaggaggugggacccacaagucccaaaagccuuucugcgcccagccguugacuucacccucagcacugcaugagcaaugugcacauaggagccuagaauaagugcugcaggaacagccacgacuaugacucgggccacaaacaucuuggccucuguuccuucuguguccgcacaagccaacuucagaaauacaggcaucucacagaagaagugauucagucgauggccacagagaggcauggccauugcgagaccugucuggaucagagaguucacgaaacccgcaccccaggaggcgauagccagggucuggcagagaugggggugcaugauggccauguaguggaguggacgacagacagcagcauagcggucaaaggccaucaccaccaggagcacacacucuguggagcccagggcuagguagaugaagagcugagccacacacccuccacgggugauggugcgguccaccccgcaaagguugaucaggagcuggggcacggugcugguggugaagcagagguccaggagggacagaugagagagaaagaaguacauaggugugugcagccgaaggucuagccaggagagagcgaugaugaugguguugccaaagagaguuagggaguagaaaauaaaaauaaagacaaacaggaugggcuccaguugcggccaaucugagaaucccaccaaaaugaagccaucuucaaaacugguguugaaacuucccaug

SEQ ID NO: 16558 - RNA, 1416 nt, Homo sapiens
agcugcucuuaaccacguuuauugagaggggccgggggaaggggauggacgguccuccccgcggcgggguuuucagcccucgcgggugggcagcgucuuguccucagguguagaugcuccagucucggcucagccaaacacugucagggcccccuggaaagcagaagccgagcuugagugcccccagcccugccaccaagaacucaggcgggggcgcggcagcggccggcucuguggggagcgggagcggggcgguuccgcuggcgucuccgggggacgcgcacccgcgcggggccaucuccgccuuccccgccccugcagcucggaugcgccccacccaguucccacccggagacccgggcuucucccagggacagggcuuggaggggcaggacgggaaacagcccugacguagggccgggacaccucuggugcaguuuugaggcuggccgggaagggaugcccgcgcaggaagggcacccggggugcccacuuuaccagcagggccuucagggccuucacggcccccacggccuggggacccagcucagccacacacuucugggagcccucuaugaggugguucacggggaugcccaggcugcucagcaggagcuucagcggguugagggugccgaggggguuggccagggucccggccccggccuccgccgccgacuccagcgcagcgacaggcugggccacaggcuuggccgagcccacuaagaaagcagcagcugcaagcgaacagggaggggucaccgccugcgcgccgggguccccagaaggcagguccaggacgcgcccccgcgggaggcgcccaggaaccgucgcgcccugcccggcuccccgaccgccccucccuccugcgccgaggccugccaggugcgagcccccgggacacaggcgggucuggggaggcggccccgccaggagacgcugcagggucaccggaguggccugaggguggcggaaggaccggugaacucugugcaggguccgggacaggcccccaagggaggggacacucgcgcugcgccuugcaggaugaggagccggucuccagacggggggcagacggguguccccaggccaggggcggccuccaucccggcacgaggcuggagacagcccugagagggggaggccgcgggcugcaggcgcggggccccgggguggcggagcccucugggcgccgggcgaggcuggaaggaccugggauccacgaucggcgcaggcagcggcgggggcgcagcgggcgccgaggccucaggccccaccgugcgcgccaggagcccggggcgcucaccggagcugcaggacagggccacgcagagccccaggagggcggcgagcuucauggcgcgggggcucggggcgcgcggggaaccugcggcugcccgggcaaggccacga

SEQ ID NO: 16559 - RNA, 17473 nt, Homo sapiens
caugagaaugucuuguuuuuggaaagccuggucaugcaauuuagcagaagguuugcggugagguggaaggcauuuauuugcuuugucuugcuaacccucaaaaucaaagccugucccagccugacagcuuccagcagaaagugucagaaccagaggcccagccaaggcccaggcagggcaggcgguccuccugggcccuggcauuguucuuacacauggagggcauggccaucuucucuuucagggacaggcuggccugacauggaaggugaaacaaggcagcagccccugccuccaggagaacucugcagacugcagugccggggagcugagggguccugggaaggagcuauggagucccauccagcagguuacagccacauccucuaaaugggcgcaauuuguccugccaccuagaaaaaguucacauguggacagugagcagccaaggucucuucagagggaccccaggccagcugguccagcacaggcuaagcaagggacccccagagcacaggccucaagagaaggccucagcaggcccacugccgcuguccagcuuccucgggccacacaccccgucacaucugggucugagaggccuugcgggaagaccucaugggacgcaaggacucccugggcagagggugggccccugguccuggaggcacagaauccucgacccacacgacuaugugaccucuuuauaacuggggaagacuucgaugaugaugugugaucugggacuggcagguuauuaaucgagauacacuuguuaggagggacaggguuccccuaaggcacuuuuaaagauacucuguaagaaccauuaacaauaaacuuacugucaaucauuucucucuaugcaaacgucauugguuaaagugcugaugccauuuaauuagauuguuuacaaauuuaacaggauggcuacaaagagaucuuauuuuaaaagcagcugaugguuuggaaaugagagaacuacaguggugaagagaccaggaggcagcucucagugaaaccaacauugcggaugcccuucgugagccuucucagucccagcaggaagcccacaacacuggccuccccagccugccugcugacaacaccuaggcuuacuuuaucuaaaaucagaguguaccaggucuguagcagaaaauaaucaacuaaaugucagggaccuaugagucauuuaaaacaaaagagaaagugaaagccauuaggcaagcuaugugcugggcugcuaacguagccccugcagggaggggucaggagcgcgcugcagugagccuugggucucgcaggcccagcccugcugcaaggagccagggcacccaggaaacaucagcacacacacacacagggacccucccuucaugucacuuguuuugcugcccuaaauggcuucuugcacccuaaccccugauccuggaagaaggcagagaaacuggcccguacagagaccugcaauucuacgcaagcuuaacacaacuaugagacagaagaggggcacgcagaagaggugggcaaaaguggucacaacggcgggggaugcuuugaauacuggaugguguccagagccgcuccgaugucauaguucuuggucugcaggagccuggugagccagccgccuucaucagagaagcccauggacagcaucugggagagggacucaaucagccgcgggucagccucugccgaaacaguaaggaagccaugaggaguggugcugagcccugugagugacccgaaacacauacccugcugccuuggccagccaggaccagggucugccaguguccgagccugcccagagcucucguccucacaggccacaguggaccugcuuucccuguaaagggccaagcagucuuuuucacacugcucaacucugccacugcgacaccaggcagccaggugguguguaagcagaaccaucaauggacacugaaauaggcauuucaccugucacaucuuuugauuuuaaaauguaagaacaggccaguuagccaauuauuacacuccuccaugcaagagaugauggggcauugaaauagauugaagauggagagagaugaauggauacaagauacauuuuggagguagaaugaacaggacuuggaaauguauguggagaaggcaaaggaguuaaagaugauaucuggagcagcacaacucacaauugcaaagauguggaaccaaccuaacugcccaucaagcaaugaguggauaaagaaaaugugguauauauacaccauggaauacuacucagccacaaaaaggaacgaaauaauaccuuuugcagcaacuuggacggagcuggaggccauuauccuaaguaaaguaauucaggaauggauaccaaauaucauauguucucacuuaugaguagaugcuaagcuaugaugaugcaaagacauaagaaugauauagcuuucccucucccucuuucuccacggucucccucugaugccgagccaaagcuggacuguacugcugccaucucggcucacugcaaccucccugccugauucucuugccucagccugccgagugccugcgauugcaggugcgcgccgccacgacugacugguuuucguguuuuuuugguggagacgggguuucgcuguguuggccgggcuggucuccagcuccuaaccacgagugauccgccagccucggccucccgaggugccgggauugcagacggagucugguucacucagugcucaauggugcccaggcuggagugcaguggcgugaucucggcucgcuacaaccuccaccucccagcugccugccuuagccucccaaagugccgagauugcagccucugcccggccgccaccccgucugggaagugaggagcgucucugccuggccgcccaucgucuggaaugugaggagccccucugccuggcugcccagucuggaaagugaggagcgucucugcccggccacccaucgucugagauguggggagcgccucugccccgccgcccugucugggaugugaggagcgccucugccuggccgcgaccccauccgggaggugaggagcgucucugcccggccgccccgucugagaagugaggagacccuccgcccggcagccaccccguccgggaugugaggggcgccucugcccggccgccccuacugggaagugaggagccccucugcccggccaccaccccgucugggagguguacccaacagcucauugagaacgggccaugaugacaauggcggcuuuguggaauagaaagcggggaaagguggggaaaagauugagaaaucggaugguugccgugucuguguggaaagaaguagacaugggagacuuuucauuuuguucuguacuaagaaaaauucuuauccuguugaucugugaccuuacccccaaccccgugcucucugaaacaugugcuguguccacucaggguuaaauggauuaagggcggugcaagaugugcuuuguuaaacagaugcuugaaggcagcaugcuccuuaagagucaucaccacucccuaaucucaaguacccagggacacaaacgcugcggaaggccgcaggguccucugccuaggaaaaccagagaccuuuguucacuuguuuaucugcugaccuucccuccacuauuguccuaugacccugccaaaucccccucugcgagaaacacccaagaaugaucaauaaaaauaaauaaauaaauaaacaaaaauaagaacuacucuuggcccauaggccauagcucgccauccccugcccuaaggcagagaagacacacagcggcggcccacagcagguugugcacacggaccuugguuuacacacggcugccaugugacaaugaggaguuucugucagcuguccccaccccccacccccccacugcugccugccacaccauccacuucaacgguggcuucugccuggcuccuacagggaucuuggcuaugaccccccccccucucagaccagcacucccugaggcggcacuugagugugaguaguagggacacacccagugcugcccccucucugugucacaccugccuuaauuccuggucugcauguuaaguuuuagaaacuccuacaauuaauauuccuggcucuggaguuugccuaaagaaaaacauuuucagaacugcauuagcagagcuuacucgcuauugcucaggguacacauaauaggacaaaaccaacuccuaaccucccacaccuacagacagcccugcaguggagaacaucucauccuucuguuugugucgcugaaaucagaggagggcaggaugcucuaaagggaaagguaggaauauguacaaaaccucuugguucacuugccuggcgggagauguggguacaaggcagcuuccuucagcccugugggucccuccugggagggguccagagagcuuggcccuucggauucuggcaucuguagggacuggaguucaccuguagacggguccacuucuuuugaagacagauggguccagucaucaucuccuccugaacaguuauccgacuccaucuguuccuggaacaaaacucaccaugagcacacaggagacacgcgcaacaggccaagccugaccauggcccuggcuccuggcagacagucggggagcacgcaugcacacgugcaguuaaggcugcaggggucuagggggaacaguggccacucacaaagaccaaguaacuacaaaguucuagcagguucccagcgugacuuuaauggcacagacaucacugcagcagcagcagcucccucggguuuguaaguggggcugcagaggugcugaggaugaggcggaggugcaggccacagaucacuaggcuggccguggucccagguggcgggaggggcacaggcuugccucagggcgccccucggacuccaaggcgaucuuccucaucugcuccgccagagacugcguggcgcccucaacauucccacccggcuugcuggggucagagcagcagcugcuuggcugugagcugcucuucuccucugugcuggaacucucuggagagacgggggucaggcggcuucuuuucccuccgugcuccacaucgauaucaacuucaaugccuagaggcggaggaggaaagagcaagccgugaaguucccccaaggaugcaccugcaagcaggagcuuggccuguggagacuacagacucacgaagaucucaacguucaguccccacaagcagcuaagugucuggaugguggcacucagcguguggaugcaggugcuagguucuacccagcucgaccccgcaaucacacagccaguaugggaccagacgauacaaacccaugagucagaggcuucuccccauaucccagcuacaaaucucuguggcuucuggaaacauucuuggugggcccaugauacuggaccuuucucuuucuccaauucaguaaaacauuaaccucagcuagcaucuaaagucagcuucugagccagaaagucgaaagagaccuuuuuccuaaccaugcaggacacgggccacacggcagguggggccaggcccuaaguacagggagagccaauaccacauguggcaggcgcuuccagccacagugauggaaggccaugugccuccugacaccugcacacagaggcuuugugcgacgacacacacgcacaccucaacgccggagcucugcucugggagguggaugggccgugcaggcgcugcguagggcccaacgcuggccccacagggaaccugcacaccuccaggcucacgugacucaccagggacagaggggagaaucaccugcacuauuuuugaaauuaaaugugucaaaagucuccacacccacagcuuagagucaccaguugccaaaggcuguggugcacacucccugcccccaucccacuccccaaacucucccugugcccuuucagcucacgcugcucuugccugcugcuggaguucacaucugcgcacuuccuacucuggaccaguaccugccucuccuuccacuacccuuuccaagacgcaauuuuuuguuaaaagaacauucaguaggccgagcgcaguggcucacgccuguaaucccagcacuuugggaggccgaggcgggcggaucacgagaucaggagaucgagacuacccuggcuaauauggugaaaccccgucucuacuaaaaauacaaaaaaucagcugggcgugguggcaaucgccuguagucucaguuacucgggaggccgaggcagaagaaucgcuugaaccugggaggcggagguugcagugagccaaguuggcgccacugcacuccagccuggugacagagcaagacuccaucucaaaaaaaaaaaagaacauucaauguuucagcuaggaccucuaucuaaauguucuuugcugggucaaguagcagacuauuucuuuguaucgcuuuuuguuuuccuaccacugauaauggcuucucuuuuccuuuguuuuguagacagagucucgcucuguugcccaggcuggagcgcagugccgcaaucucucggcucacugcagccucugcccaccagguucaagugauucuccugccucagccucccgaguagcugggacuauaggcacgugccaccacgcccagcuaauuuuuauauuuuuaguagagacgggguuucaccauguuggccaggcuggucuugaacuccugaccucaggugaucugccugccuuggccucccaaagugcuuggauuacaggcaugagccacugcacccagccugccuucucuuugcauuugcuaacuuucccuauguucucccacagcaucuccauaguuuucuacaagggugaaguggaucagagaccccacugguucugguguuuuccauagagagugccgcuugcugugcagccuccuguuccagccaggacuggcagcucucugggcagaggcugcgcugugaugcugugacccccuuuacguucacccucuguccuguuaggucccccguuuccuaauaccucugugcuucauuuuggguuucucucuucaugugguucaaaccaagguuaaaauaauuaagacuguauaccagaaaguaacuuuguucugcccugauacuugaucguuuuagcuggguauagaauucuaggcuggaccaggcacagugacucaugcauguaauccuaacacuuugggagaacaacaugagaaaucucuugagcccaggaguucaaaaucggccugggcagcauggcaagaccccaucucuacaaaaaaauuuuaaaauagcugggcacggggcugggcacaguggcucaugccuguaaucccagcacuuugggagacgaaggcagguagaucaugaggucaggaguucaagaccagccuggccaagauggugaaaccccaucucuacuaaaaauauaaaaauuagccaggcaugguggcgggugccuguaaucccagcuacucgggaggcugaggcagaaaauugcuugaacccaggagguggaaacugcagugagcugagaucacgccgcugcacuccagccugggcgacagcgagacucugacucggggguggggaaagaaaaagaaaaaaaaaaauaucuaggcacaguggcacaugccuguagucccagcuacuggggaggcugaagcagaaggaucacuugagcccacgagaugaagacaacuguaccacugcucuccagcccagaugacagugagacccgguuucaaaaacaaaagaauucuaggccgaaaagccuuuuuaacugauuucuggagucaucaguuguuccauugucuccuagcuguucauguuuguuugcucuuuguauucccaaguauuuacaauaaccuagaguuuuagaagccccucuuucuuuauccucaggguucugacacuugacaaugauaagcuuugcuguggggucuuucucagucauugucagggccgcuuucaaucuagaagauaauggccucauugccaagaaacuaucuugcauuuuuguuuuuuguuuuguuuuguuuuguuuuguuugagacaaggucuguuucugucucccaggauggagugcagugguacaauccaggcucguugcacccucugccuuccaggcucaagccauccccaaccucagccucccacguagcuggggccauaaguacacaacuccaugccuggcuaauuuucauaguguuuguagacacgggaagugggggauggugucucccuauguugccaaggcuggucucaaacucgugagcucaagucaucugccugccuuggucucccaaaguguugggauuacaggcaugagccaccaugccuggugccaagaaacuaucuugcauucuauguucauuuccuccuuucaguuuucuauucuuucuggaauuccuacucauccuauauugggcuucuagacuuguuccuacauuaggaggagaggaaagauaaaaaaacuaucucuauuuugcuuuuggaauaucuccuugagacaauaguagaaucuaagccuucuuuugaaguuuuuuuucuauuuuuuaauuuuaagaacuuucuuauucuguucccuuuguuauccuuuuucuaguauccuguuccuuuuucaugcagacaaugcucuuuuguaucucacugaggacauuaacauucucuucccuuuaagaccuuuucucccaugugugggggcuuuccucagauggcuggugacccaggggucugaucccacugaagcacuaagguugacaggaagccuucuguggggccagcgccaucacuaacuuucccucugcagggugccugggggucuggcaggcaggagcuguaggacacuucucugggggcauucaaccucccucagcagggacuccccaccuccugccuggccagggaacugacugcugggcccauugcucauucgggaugcccaguuucaggcuggugccucacccuggccugucucuaguaucccaugcugaagcuucccugggucaggugcuccuggaauuaaacaugaggucuccuucaauuguuggcaagagccaucaucuggccaagugggcccugaagucucuagcugacacucccuagagguuuucaacccuccccccuuguuccugucccccgaucacucccaccucuugccuuuccugguaccugaacagauggucuuccuucucaccaggaugcccuguucuggcacagagauuucugaagcuucccucagcagguugccacccucccuccauguccaucuuccaaaaucugaucacaucuuugucuuuuccucuauuacuuucuuugucuaugguguuuucuuuuuuguguaagcccuuuccuguuauuucaauagaguuuaaggggggagcagagguaaaagcaggcuuaacuacaaguaccuccaucuguaauauuuaaauuauuuuucuccuuuauucuucccaacuugugauuaugaaaagguugaagcugccggguacaguggcucacgccuguaaucccagcauuuugggaggccaaggcgggcagaucaccugaggucgggaguucgagaccagccugaccaacacagagaaaccucgucucuacuaaaaauacaaaauuagccaggcgugauggugcaugccuguaaucccagcuacugggaaaggcugaggcaggagaaucgcuugaacccgggaggcagagguuguagugagccaagaucacaccauugcacuccagccuggacaacaagagcaaaagucugucucaaaaaaaaaaaaaaaaaaaaagauaagaaaaaaaaaagguugaaacaaacagaaaaguugaaaaguugaaagaauaguacaaucaauacccauaugcuuuguaaauggguaaugagacucgccuguaagcagaucagagaaauuauagaauuaggaucucuccaacuuggugaugaaagcgugagauuuucaggccuugucguaagacuggacaggcuacuuugucuacggaguagccauucuuguauuccuuuacuuucuuaagaaaugugcuuucacuuaaaaaaaagacuagacgaugcuccgugcccugcugccucacaaagccucugcgugucgguuuaucaaagaucccacgaccaggaggggcccuguggcuucggggccuguagccucccagccaggagcagccugggucucaguuguggcucccucagcagguucucagccccccaaccaaaaggccuuggcacuucacaugaaagcugccgcuuacccuacacacacugccaccgggaggcagcuguugacucguucguuccccuuugggcccugcucugggaacagucccuucuaggcaguuaaccugugagucauccagcuuauaguuccucauaaagaaagaaacuagcccuaacuuccacaacagucuaagccgcuccuccacuggcucuccucagcugaaaccacucagucuauuuuacugaaauauuccuuguuuguagagcuucaggcuccucccuaguucggagaaagcaauucuauccacuuuaagccuuuagcuuuuagugcucaaagacaucugagggccgggugcaguggcucacgccuguaaucccagcacuuggggaggcugaggcggguggaucacgaggucaggauaucgagaccauccuggccaacaaggugaaaccccgucucuacuaaaaauacaaaaaacuagccgggcgugguggugggcgccuguggucccagcuacucgggaggcugagacaggagaauggcgugaacccaggagccaagaucgugccacugcacuccagccugggcaacagagcgagacuccgucucagaaaaaaaaagacaucugagcaucugcaagauuauuccugucugugccaaguggggcguccaguucaguuccgagaugcugcaccagcacaggugggucuugagacagugugaccccaagcaccugggcagccucccagacaaaucccaggccccaccaacacucacucaccaggaucaaaaaagguaaggucuggggaucugcacuguuuuaaaagucucuaccugaaccuagacuugguuuugugacuucccgggaugucuccuuuguucuuugagugaaggacucuuguucauaucuccaaauucaccggcaaucucucagaccuuuacuacguccagagugaguggcaggauuuaggcacagccgaucucucaaucaugaccucgguguuccacuguuuacccuccuuggaaagcauuaagaauacugauucuuggccgggcucgguggcucacaccuguaaucccagcacuuugggaggccgaggcaggugucgagaucagccuggccaacacagugaaaccccgucucuacuaaaaauacaaaaaauagcuaggcguuguggugggcaccuauaaucccagcuacuugggaggcugaggcaggagaaucgcuugaaccuggaaggcagagguugcagugagccgagaucacaccacugcacuccagccuaggcgacaagggugaaagucugucucaaagaaaaaaaaaaaaaaacagacuagcgauucuucuuuccuauucucugacuucaccucuaaacucuaguacagaagccaugcguguuugggcuguuuaguucagaagcaaugccaagaugucacugccgccucaaaguggaaugagcaaggccaggcgcagugguucacaccuguaaucccagcacuuugggaggccaagacggguggaucaccugaggucagaaguucaagaccagccuggccaacguggcgaaaccccgucucuacuaaaaaaauacaaaacuuagcugggcgugguggcggguaccuguaaucccacuuacccaggaggcugaagcaggagaaucacuugaacccaggagggggagguugcagugagcagagauggcaccacugcacuccagccuccgugacagagcaagacuccaucucaaaaaaaaaaaaaaaucggaaugagcaaaguuggagcagauggcagucacgcccuguagccacaggaggcagcaggcaugguucggacgccccuccuagcagcauucuuucagacacugaacacaaccuuuggacaggcuggguggacacagccugccacugcagucacaaaaacaagcucacucgucuagcgagagaugcaggugucccagcgauccaucugccaucacagauccaccgucaucuugaacuagaaguuggcuucauucacugauucucacugccgcaugccuaacccugcagcacccacccgagacccuuagccagacgcaacaggcacuuucuaaagcccagcagggaggggucucagagccugagcucaugccuggggucagguggcaccuucacccaccccacagacccacugugcaaccugaggcaccagaaccgggugucacccagagcaccugccuccaccuucuccccgcucugaggcaggcccagcacucagaagcaccagaaagguuuggggguuguaaacuaaaagaaggaaaagauaaauagcaugucaacuaacuacuacccagguccucaaaaguccaaaucccaaggccuggcuuaggggaaauugcagacuauuguucauccaaaggagggcagucagaggugacaggcaagaccugcaaccacagucuggucacccucccucacugggauuaucccaaccaaaugccagcugauucgacuucacuccauguagaaagcucgagaauuuugucagggaauucaaccuugaguugcccgugguccagcacuacuaaagguugauuugaggcaacaaauccucaccagugucaagggcaugucaauuacccauuccuuugcaguauuccaggugaaaguuacauaaagugcaggcugaguuagggaagcacugggcaaggaggugcacucacccagagggcuaagggcagcugccacacucuccccaacguucuucaggaaauucacacucggauccuccgauggaccagaagcuuugauuuuuacaaagauaagauaaagauaucuuuaaugccuuggauaccugucacaguccugucaccuucuugccaaggucccuguguucccgggugaccuuuaacccggacaucuuguccagugacccacucagcaucccccucuccuuccucccacucugcacccccuggcccugcacagagagcaucuccacucucccgugccaucucccccucaucugugacccuggugcucagcaaccccacagaggcucaggcucaguacacugugaauauugaucaccuccuugaguaaauauguuauuuacucaaagucaagcaaacauccccaucuuugucccaaagggugaggugauucacaggacacaguaacauuaauaaaaucagaauccaaaaaucuagacuacaaagcuaacgguaagucuuucacuuauaacuauguuucaaaggacuucagcaacuuuggcucugaucuuccugacaaccaucacaaaagagaacaaagugcaucaaagaccccugggcuggaagggccucccugccugcaccucaggguaccuugagagggcagccuccugagguaggaagggcugugcagguaaauuuguggccucaggcacuuaggcaccucaguuuccccauuugggaaauggagagaauacaccccacuuugcaggguucuugugugauuguagggcaccaggaaggugggggguauccugaauucuugccuugcacacacgcuuugcacaagggcccugcacacaggcugccugacuacugucaccaaucagaagcagguuccaacacaagccucaccugauucugccguggggccagggcgggccuccccugcacgaggaggacgugggcuccaguuuccugguggacccauuucccauccuggccacccgaaguguccguguuucaccuuccggagccagcggcugugcgagaagcccugggggaggaauuagcagagcggcaggcagugagcgggucaagguuccugccacccugagcccaccccaggccugcacagagggccugcucaccucagacaggugcccgaaggggcuggggaaugcgagcuuggugugcccccggugcaagcccuuucccucgcagacgcuacacaagucguagucugggcagacgcugcacuuguagcggguuccuaccacaggcccauugcagccaucgcagaucacauuggggugcaccauguugcggggcgccuccugagcacacggugggcgguggucccgccggcacucuuuuuucucuacaggaaggguaaagagagccgcuagggugggacccccuaaaguccucccccucugucgucacuguggggcugucacugccagcaaggcccccggcccugcucuccagcauggaauccacacaaaauucagccacuuaggugagggcagcagagccaccaagaaccugcuaggagguucccagucccugugucuguuuggcccaggcagcagagcagcagcaaggagcccugucugcacagcuuuggccuugcccuucacccaagcgccacggcaccagaccccaucccuaacccaagcaccacggcaccagaccccaucccuagagugaacauggacuccucuuucucaggucaggcacagcacuuaaaaugucuuuuuuuuuuuuuuuuuuuuuuuuuuuuuuuuuuugucgccuaggcuggaguacagucaugugauuucggcucauggcaaccuccgcucuccagguuuaagugauucucgucucagccuccugaguagcugggacuagaagcauguaccaccacacccggcuaauuuuuguauuuuuaguagcgacaagguuucaccauguuggccaggcuguucuuaaacuccugaccucaggugaccugcccgccucggccucccaaagugcuggaauuacaggcgugagccacaccuggccuaugucucugucuuaaacagcccucaaauugcugaccccuucauugguggaacaucgagcccuguuuuuuacucagcagggaacugaguacaagcugagcuggcuucaggcagcccccagagcagccccuuaccuuuaauguagauucggaagaugucauccuucacguaggacauggccauugucaauuccucgucacuggaaaaggcaaccaaguccccguccucaucuagauuguuuaaaagacagcacgugagcacccagggguucucagcuggacauaagcugcuggaaugggcugaggcaaguaugaaagggacacucacagggcuauaaacaaacacaccuacuugagccacagagggcaggagugagaggcaagacuacccccuugcucuggcaccuccuggaaggugagugcuccgaccugggcccuggaccacagccacaugcagggggcggagggccugugcacaggggcagcagcuuuggcugcugcacuuauuuagccuugggccagcugccuuuucagaaacgugccaccucauuccccauccgaccaggcccauguccgucuucaacugugggagaucccugccugugaccugcuccugaggggcccagccccacaaaggccuuagacuucuaguggcuugggaguaaaggagaagacaagggcaucugccugcuuccuucccuaacaaagcugaaagacacguauuuguauguagucuccauuugugacagauacauaugagcugaaauggcuuuaaagcacagcugugcagaccaaaccacgccauccaccgagggcacaggugaggcacccaaagaugcaaacaacccaaaugucugucaacuaaugaacagguaaacaaaacauggccuguccacacaacagaauauuauuccuccaaaaaaaacuaguucugauaugugccacaacacugaacacauuacacuaagugaaagaaaccacuugcaagacuacauugucugauucuauuuacaugaaauguccaggauugcaagaugaauagauacagaaaggagguugcugggggcauguggauaagagggugauaaaagguauguauggcguuuauaaggugaugaaaagcucucacacugaauaugguccacaaaccuaugaaaauagugaaaaccacugacuuguacacuaaaugggugaacccuuauuucaguuacagcucaauaacaucacaauuuuuuuuuuuuuaagaauaggagagggccugguaugcuggcagcgcuccagagggagguccuagcacugcacccucccaggggccggccuuggccaccucccgcccuccuggccacaaccaccucccuaaccccacccccagcagccacuggucacaccagcgcagcaggaaacagggcuucugugccaacaccaacacuucugaagaacguucucguccacuugccaaugggaaaacaucuguacucgaccuggcucggagcguuccgccggcgauccgugcccuucucccaggcgcugucgcggcgcucgcgagucccccgcacccccgcgcuuguuuacccgcgucacucccuccccucgccggcgcucgcccggcuccuccagggcauuaucugaacccaccaccuggcgcagcaaggugucaguguaacccgagugcccgccugaccacccagugcccgcggagagccagagcguucgccccggcgcguccuugccaaaauccccaacagcgcgggggguggagcggggcgucugacgcccccaggcucgagcccccggccggcagggcuccaccgccccagggggccgacgcugagcagcgggucccggccuuggucaccacuccagucaccaggccggcucccauggccgaacuggggacccaugcaggccaccgccauccagggagcagccagcgcagacccccucacggcccgccaggcgucgccgagaagggagggggcagccaccccgcggcaggaggccguguccggccugcgucaccgcccccgccgcuccccggcccgcucaccgcgguagugcgccuggaagccgccaggccgcagcgcggggaacagggcggccacccggcucagcagccgcucgcagggucccggacccgccgcagccucggcuuccgccucaggcucggggcugcagcagaagcugaagcggcgaaucucgcgcgccgcguccuccuugcccagaagguaggccuucacggugagcgacgccauagcgagcggcgagcuggcggaaaacgggccgucccggucgcagccgccgcgcggcuuuuguagcgaacgcggaggccccgccccgccucgagaggggcggagucucucgcgcccuccccgcccccgccaccgucgucgcggcgcgagagccgcccugcagaggccccuucacuacucuccccuuccccgcuaccccucgcuccaggucucccggcccccucauugcugaccccucucuucauugccccggugcaccaaggaccccaggaaaccggcccug

SEQ ID NO: 16560 - RNA, 931 nt, Homo sapiens
ggcagcgggccaggcgcugcccaaagccugcccagaggcggcgcugggccagucccuuuauaauuugcgcccuuccugguuccacagaggauugaggaacgccugaaauuagaacgcaaaugggccgugcgugguggcucacgccuguaaucccagcacuuugugaggccgaggcgggcggaucacaaggucaggaguucgagaccagccuggccaauacggugaaaccucgugucuacuaaaaauacaaaaauuagccaggugugguggcggccgccuguagucccagcuacucgggaggcuggggcaggggaaucgcuugaacccgggaggcggagggugcagugagccgagauugcgccacugcacugcagccugggcaacagagcgagacuccgucucaaaaacaaacaaacaaaaaacaacaaaaaacaacaacaacaaaaaaacaaugaaggcgugggcccccaucaauaucgggcugggcugggcggggcgagguggccccuacaccaccgggggcagggcccguugcucccguuagcggcgcucucgggccgccccugccccgggaagccgguacgguucugggcuggucacugcucugcauccacgagcaucggcccugauaccgccuagaaaggcccaucguucccgccucccgggccccugcgcgccuccguccagaggcccagaggaagcuccugagcggggaagcgcccugggcggcagcgaaggcagcggucgcucccggcuucaaccgcccagucccccgcgccacccagagccccucacgcccgggaaagagccccgagaacgugcgaauggggucgggguccgcgcgcggaggagauguugcugagaaggguaccggggucccggagcgccgcccccgccgcccgccccccgccccggcugcggucgaccugca

SEQ ID NO: 16561 - RNA, 2642 nt, Homo sapiens
uccucccugcuggcuuggccuggcucccuggcucugugugguauggucacacccccgugcacccccuccacugagauggggcggggagagcaccgaggcugcucuuccucuccugggccguccucugagcagcagacggggcuaagcguuccccagcucgccuucacacacagcccgugccaccacaccgacgguaccaugaaggacgagguagcucuacuggcugcugucacccuccugggaguccugcugcaaggugggcugguuccuaucuaggaagagggugggccuuagaucccuacagcuugcccucugcccccuaggcccagguggagggcagagguggggacuccagcccaggcccaagcuggaagaggguggggacuuucagggaacuggggggcaccuggcugugagagcuguaggacuuggggguggcaagggugccaggacaaaugguaggauagccaugggcuuggggaagcugaucucugcucuuuccagcuguccccucucugggcgucccagcaagcggcccccauucccuggcucugcuucaaaggcaccuccauacugggaccacguggagcaggguagaggugggacuccuuccuccagcccccuaaaaagagccugcuuaaugccuuucucagacuggcccuaaaggacacauuccuuggccagauauccuugccaccuaagagacaccacuacuccacagugugugggcuaggauaaggcacagccuggggagggggcucugaaggggcugaacagacaggccagccugaccuccagcugcuccugcacugagcuggauggccacccugugacacccaucugcagagggcccagaaccaaaggugccagggcugcaggacucagggggagaugguccgacgggaggucuggggagggagcgcacagccagcacuggucuguguguggucuggccuggccucaccugaccaagagaagggcuccugcccacagagaaacuuuagggccagcccacccucugcaacuaccccagcccugggguccugggguuaggcuaggagagucccagcugcaaccuccugggagcaggagagaaggugucugucagauuuaggccugggaccggaaugcaggaacagagaaacugagguuuggaggcacagggacgcaggcuuuagugaucccggccugaggcagggucagagggcccugcuggugggcgcugguaggugggugaccagggacuguuagcuacagggagugugcuuccuugcaccugggaggaugcagccagcucugcccucagacucccgaggcacuuccuggccagggaccugaaagcugcauuugccuguguuuugagagugaaaugauucagaaacaaggacucaaguggucucucucgcggagcaggugucccugugccugaaucacucacccucccccauacacucacagguugggacagggccucucugcgccccaggcuucagcccugcccuccucgcugaaugucagggacacagggcaggccagggaugggugagacgagaggucuccucgggcggggagggggcgggguuccgccuuagggaggagaggacacggccaagugaagggccagauugcaggaucccucccacucccaucucuggggcuucggguguccagaccugacucccgcucccccuccucccccagccuacuucucccugcaggugaucucggcgcgcagggccuuccgcgugucgccgccgcucaccaccggcccacccgaguucgagcgcgucuaccgagcccagugaggcgcggcgggagggcgcggggcggggagcgagccccaggcggguccgggucgcaggaccaucccggccggcgcgcucaucccacccgcccaccgcagggugaacugcagcgaguacuucccgcuguuccucgccacgcucugggucgccggcaucuucuuucaugaaggucgggguguggggcaggggcgcacgcgcuggacccccgggacccgcgcagggcgcucaccaggcccgugcguaccucucgcaggggcggcggcccugugcggccuggucuaccuguucgcgcgccuccgcuacuuccagggcuacgcgcgcuccgcgcagcucaggugagggccgggcggggagcggggcggggccggggaaagaucgcgggcgggcggggcuccuggggagcgggaccgaagcugggggcgggcgacgggccggagcccagcgccuuuggggauucggugggcgagcccuggcggcggccagaggaaguccccguggggccaggguugcggcggggaagaagcgggccuccucgcgccaccuccccgcugaccgccgcccgcaggcuggcaccgcuguacgcgagcgcgcgcgcccucuggcugcugguggcgcuggcugcgcucggccugcucgcccacuuccucccggccgcgcugcgcgccgcgcuccucggacggcuccggacgcugcugccgugggccugagaccaaggcccccgggccgacggagccgggaaagaagagccggagccuccagcugccccggggaggggcgcucgcuuccgcauccuagucucuaucauuaaaguucuagugaccgagacccgggcugcgu

SEQ ID NO: 16562 - RNA, 2333 nt, Homo sapiens
uguaugaagacauauuugauuguuguuuucucuugauuuuaaaauaaaaccucaugagcccuaguaaaaagcuagaguaacgaauguuugaacuacugaugguguaucucaaugugcagccuccugccaccuccugcuuaaccuuuuagcaauuagagugcccauaucuagaguuccugauauccuuuggcaucacacuaucuaguuuuaguacuaacacuguuugauugcuccagucccucuacuccccuuugccuauuaguuuuaauaauggggcauaauuugucuugguuugguuuuguugaguaacucaguuuuaccuaaaggacuguuuuugguccggcgcggcggcucacgccuguaaucgcgguacuuuggcaggccgaggugggcggaucaccugaggucaggagugggagaccagccugaccgacauggagacaccccgucucuacuaaaaauacaaaauuagccgcgcgugguggcgcaugccuguaaucccagcuacuggagaggcugaggcaggagaaucgcuugagccuggaaggcggugguuguggugaaacgucguccuuugcauuuccaguucccucuaauggagcugcacucuugcaugcuuuugcucacaucuucuggacuuuuuuuuuaaguagugaguaauacugcacuuuugaaacuugcucgggcuuuuacaaauagguggaaacuaccagugauucggaauguugcaagaggaaacuaccagcucacuagacgauucugaccaauuauggggcuggauacaaggaauaaggucaaaguaaaacggcugacauuaaaauagcguggcuacuuagaguuuaucaaagucgaaauuuaaaaaauaauuuaaaaaaaaggucucuguacugccaggcgggcgacagggacuggccagcugcgccgcacucgccugccagauuccccuuuucucgggguagccggaagggccugccuucagcgggugcugugcaggaaaccaauagccgccucuuggacgggcuccugucagucacgcuuagcuccgcccccaggauuaaggcccgcccaggggcuucccuccgcccuucgcuugagaauuccuuuuaaauaccgcucuggcgcccgagcgcgccucuugcgugcucguccccacgcccucgggcggccgguucuuccuucucugauuggccagggccccugcucaucagucgugaugcacaaggucucuuaccgaggccccgccuucuuccgagaggcccgaaaacaauuuuaagauggcggccgcggcgguagcgcggaaaacaauggggccggggcgguggggagaggccgaggcuugagguaggcagcaagcgccggcugggggucgggccgagcggggcaggaggaaaacccgccgccgcgcgcgagcccgcuccgcugcccucgggggcauggcgcggccgugaggcggagagggguagccgcggggagcgaagcccgcagugccagccggccccgagaggcccggccccgggcccggcccgugcagcccgcggcccauggugcugcccaccugccccauggcggaguucgcgcugccgcggcacagcgcggucauggagcgccuucgccggcgcaucgagcugugccggcgccaccacagcaccugcgaggcccgcuacgaggccgugucgcccgagcgccuggagcuggagcgccaacacaccuucgcccugcaccagcgcugcauccaggccaaggccaagcgcgccgggaagcacaggcagccgcccgccgccacggccccggcgcccgccgccccggccccgcgccuggacgccgcugacggccccgagcacggccgcccggccacggugaguagggcgcgggaaggcgcuugucguggcggcagcccccucucccgaaaacgcuuccucugacgcggaucgggccgcugggagacuuccccaggcguccgcgacuccuggaucuggcuggagagaggguaacauggcagggagcugagagguugucaucuuugggaaguggcacgguggcguuacuuugggaaaacagcgccuugagggccuugcaggaggcccgaccugggaaggcuggcgaacgcuaaccggaggguuuuucuuccagacuugauuccgggauguugagaucuuuauucgaaauagacuagcauucgagucgccugugauggagggaguuccugcaccguaggccuggccucauuuauucugcaaauguuuauuggguccuugcccuuuacaagauccugugcugugagcaggaucagggcuuucauguggaaauaagucggccuuugguugaccaacuga

SEQ ID NO: 16563 - RNA, 2510 nt, Homo sapiens
cggcugaccggggugagcguaguggcccgcuggggaccauggccgcccugacagccacacccaccuggagcugacuugguucuggcuguugcugccacugugaaaucuguaucucucuccaucucugcucuacuauccccggccuugccagacaguguucuuuuucggaagaagucuagauuuuugcaugaaaaaaacucaaucuuuaaaggucgacucagaacauuuuaaggaggccuccacuuggucugaugcagucuugcuaauuaagaacuaaaggccuucugaccuucuuggugcucaugcuguacggcaucugaaugucucgaccgagucugagccgugcagcuguccuccaccugcgaaaguaaugagaauccuaucacgggacauaaggauaggucuaaacaggguccaugccaagaaaacaguggggugcucucccaggccucuccccuguccacuaacccuggccuugccggcugccuuccaggcucugggggaagagcuccugcauucuucccuggccaccuuggcuccagggcuccccagagagccucuucccuccccaaguaccugagaaagaugagagaggcacgugcucugcugggaagguccagugagcgguucaagggccuggaaucucccuacggccaagucuaaggguucugggauucugggcuuugugggcuuugcuugcuugcugggaaugggcuuucccugucccgcccugccccaccucgccucugucucucagaagcuccagaacccagcagugaccugcaaaauguggccucugaugggggcuuagggugggagauggggagagccuacauugucuuuugcuccuugaaaacuuuaauagcuccuauuuuccagagaauggugcuuugugagcaacaugcgaguaagagagaaauaggaggaagggggaguaggggcggaugggagaagaguggcucauuuuuaccucucacugccuugacauuuugugaacgugaagcuuaaacuuucugggcuuacaagacccaggggcacgucagcuccuuagaugggcucagccugacacauaauucuuaaaccuuuccuguuuaagaaacuucuagaggcuguguacucucaccaauccucuucgagaauuuguucauguguauuuccccauuauauggaugaggcucaggauaacagcauaguggcuaccuucuacugaguuuugaggugcuaauaaguauguuugucugaggcugcacauguggguggcucuguguguaugauccaagggacaaaaugacgauguaggaaccagcaagaacggaaucugggcugaugcuucagucuccaccugggugauggcuagccucccgcccuccaccaccgcaucccacacgugcugcgcacuguccccgugucuccuggagaaccaaacuggagaaaaccuuucugaguaucucucauaguaccccuuccuuaagaagaugugguuuagagcaugugugcaauccugccucuguaauuaggaaacggagcccgaggcuuuccauuguugguugaacccaggacagcuggugcuauucacaggcugaagaacugggcaguucuuacuugggucuguccuaggauguggaggaaguucaggacuaacgcuaggcagagaguaugacucgguuuacccagccuaggggccucuggaugggaacacuccauuccaagaucucagcagagcagggcuuccuggcuugaggcuggaagccuuugggaagaggcccagcugggacauucccugggcaccugucuuccgcugaagggagcaaggugcccucugggacugacagccaugacccucugugccauccucaauccuugagccauauaucaagaguccucuagagccggaugguccucaaaagucuguccaaggaaugccaacguucaccgggcucugagaaacgacgcaaaucucugagcuggggaccacuuggagaaccggcuuaguaacaguccugaucuucgcaagccagcuucuucugcaucugaggggcuccuggcgcccagaggaggcagacagaugucuucuagcugaguuucuaaccgcaugaugagacucagaccuuccgcugcacuagaaaaucugcaacagugucccugagucacuucuccuuagugggcagacucguguuagauuuguggaacccagcucucugauuuacuccuuuuggaaaacccauggaauuucauguauaaggcuuucauuuguauuuuaagguuuuucuguuuguuuugaguauauacauggugcucaauagcaacaucuuagcagaugaagcaguuuaugauuccacucccuccuguaugacagguagccacuauacugaaucaaggugcugaacucaaaucacaaaauucuggcuuaccgauacaacaaccaauacaucuuuguucuguaauguaaaauuugacuccuuacuuuuauaacuuauuaaaguuaaaaugucuguguuuuugcaaaucau

SEQ ID NO: 16564 - RNA, 2510 nt, Homo sapiens
augauuugcaaaaacacagacauuuuaacuuuaauaaguuauaaaaguaaggagucaaauuuuacauuacagaacaaagauguauugguuguuguaucgguaagccagaauuuugugauuugaguucagcaccuugauucaguauaguggcuaccugucauacaggagggaguggaaucauaaacugcuucaucugcuaagauguugcuauugagcaccauguauauacucaaaacaaacagaaaaaccuuaaaauacaaaugaaagccuuauacaugaaauuccauggguuuuccaaaaggaguaaaucagagagcuggguuccacaaaucuaacacgagucugcccacuaaggagaagugacucagggacacuguugcagauuuucuagugcagcggaaggucugagucucaucaugcgguuagaaacucagcuagaagacaucugucugccuccucugggcgccaggagccccucagaugcagaagaagcuggcuugcgaagaucaggacuguuacuaagccgguucuccaagugguccccagcucagagauuugcgucguuucucagagcccggugaacguuggcauuccuuggacagacuuuugaggaccauccggcucuagaggacucuugauauauggcucaaggauugaggauggcacagagggucauggcugucagucccagagggcaccuugcucccuucagcggaagacaggugcccagggaaugucccagcugggccucuucccaaaggcuuccagccucaagccaggaagcccugcucugcugagaucuuggaauggaguguucccauccagaggccccuaggcuggguaaaccgagucauacucucugccuagcguuaguccugaacuuccuccacauccuaggacagacccaaguaagaacugcccaguucuucagccugugaauagcaccagcuguccuggguucaaccaacaauggaaagccucgggcuccguuuccuaauuacagaggcaggauugcacacaugcucuaaaccacaucuucuuaaggaagggguacuaugagagauacucagaaagguuuucuccaguuugguucuccaggagacacggggacagugcgcagcacgugugggaugcggugguggagggcgggaggcuagccaucacccagguggagacugaagcaucagcccagauuccguucuugcugguuccuacaucgucauuuugucccuuggaucauacacacagagccacccacaugugcagccucagacaaacauacuuauuagcaccucaaaacucaguagaagguagccacuaugcuguuauccugagccucauccauauaauggggaaauacacaugaacaaauucucgaagaggauuggugagaguacacagccucuagaaguuucuuaaacaggaaagguuuaagaauuaugugucaggcugagcccaucuaaggagcugacgugccccugggucuuguaagcccagaaaguuuaagcuucacguucacaaaaugucaaggcagugagagguaaaaaugagccacucuucucccauccgccccuacucccccuuccuccuauuucucucuuacucgcauguugcucacaaagcaccauucucuggaaaauaggagcuauuaaaguuuucaaggagcaaaagacaauguaggcucuccccaucucccacccuaagcccccaucagaggccacauuuugcaggucacugcuggguucuggagcuucugagagacagaggcgagguggggcagggcgggacagggaaagcccauucccagcaagcaagcaaagcccacaaagcccagaaucccagaacccuuagacuuggccguagggagauuccaggcccuugaaccgcucacuggaccuucccagcagagcacgugccucucucaucuuucucagguacuuggggagggaagaggcucucuggggagcccuggagccaagguggccagggaagaaugcaggagcucuucccccagagccuggaaggcagccggcaaggccaggguuaguggacaggggagaggccugggagagcaccccacuguuuucuuggcauggacccuguuuagaccuauccuuaugucccgugauaggauucucauuacuuucgcagguggaggacagcugcacggcucagacucggucgagacauucagaugccguacagcaugagcaccaagaaggucagaaggccuuuaguucuuaauuagcaagacugcaucagaccaaguggaggccuccuuaaaauguucugagucgaccuuuaaagauugaguuuuuuucaugcaaaaaucuagacuucuuccgaaaaagaacacugucuggcaaggccggggauaguagagcagagauggagagagauacagauuucacaguggcagcaacagccagaaccaagucagcuccagguggguguggcugucagggcggccaugguccccagcgggccacuacgcucaccccggucagccg

SEQ ID NO: 16565 - RNA, 1251 nt, Homo sapiens
accaugaugagugugagccccuacugaagagccuucucacggccuccuggaccuccuuguucaucagacuguagaugaagggguuuagcauagaggucaccacaguguacaugaugguugcuaugguguccugggcugagaaggagucugggggucauaugcagauccccaggacaguuccauagaacagggugaccagagacaggugggagcuacauauggaacaugccuugcgccuucuuguaggagauggaauccggaggauggcugcagcaaugcggauguaggagaccaagaugagugcacagggagccaggaacaggaccacagcccccaggaacacaugcugauugucauguaugugagcaggcaaucuucaugagcagguaggcgucacgguagaagugugaaaucugggcggaggagcagaaggccagucugcucaugaugaccguguggaccagggagaugaggcuggagccugcucacgcuagcacggccagccccugacagagccgggggugaugauggagcaguacugcagggcgcugcagauggccacauagugguccagugccaugauggccagcagaaagguguccacguuggcaaaggagaugaggaaguacaucugagucaggcacuggggauaagagaucguccauaggccgggcgagguggcucacaccuguaaucccagcacuuugggaggccgaggcgggcagaucaugaggucaggagauggagaccauccuggcuaacacggugaaaccccgucucuacuaaaaauacaaaaaaaaaaaaaaaguuagccaggcacaguggcaggcaccuguagucccagcuacucaggaggcuguggcaggagaauggcgugaacccgggaggcggagcuugcagugagcugagauugggccacugcacuccagccugggugacagagcaagacagucucaaaaaaaaaaaaaagagaucaucccuguuccugccacaugguugaccaggagcuuggggaucagguuggugaugaagcagauguugacaaaggagagaugggugaagaaguacaugggggugugcaggcgaagguuggagccgaugcccaggaugauggguguguuuccagccucagugacuaagugcauacacaggaagagccagaagagggccugcugcuucccugagucacuggugaugccgagcaagaggaacucgccaacuccugucucauucucuuuaccccuggacauc

SEQ ID NO: 16566 - RNA, 15298 nt, Homo sapiens
auguuuauugaccauuuguuugcucuucaaugaaaugcccauuuguggucgggugcgguggcucacgccuguaaucccagcacuuugggaagccgaggugggcagaucacgaggucaggagaucgagaccauccuggcuaacacggugaaaccccaucucuacugaaaaauagaaaaaauuagccgggcgugguggcgggcaccuguagucccagcuacucgggaggcugaggcaggagaauggcgugaacccgggaggcggagcuugcagugagccgagauugcgccacugcacuccagccugggcgacagagacuccaucucaaagaaaaaaaaaaaaaaaugccuauuugugucuuuugugucuuuugcccauuuuuuuuuuauugaguuaccagugcuuaauuuuauuugugggaguuuugugucuguuuguaugugugugugucuguguguguguguauauaccaacacauacauaucuauuaugcuaaucccuugucuauuguguauuugugaauauguucauccaguuuauaaccugucuucacucccuuuacauauuuauaaaguuuuaaauuuuaacauugucaacucuuaucauuuuguuuuauagacgguguuuuucauauauuguuuaagauaucucucccuacuccaaguuauaaaauauauucauuuauguuuccucuuaagucuuuuaacauuuuguuuugacauauagguccuuaauccaucuggaguuuauuuuuguacacgaugugaaucaggaauccaauuacauccuuugugcaugucauacuacaguguuuuccuuuacuuuuuuuuguuuuuugagacggagucuugcucuguuuucaggaguaaaauguuggcucaaauuuuuuucuuauaccuuggguuuugguaacuggguccuacuaaccuuauagaauaaauugggaaauauuucuucuuuuucuuuuacauaaaauugggaugaucuguccuuugaagguaaaaacucaccuauaaagccaucugggccuuguguuuugugggaagauauuuaacugcugcuuuaacuucuuuaaaaguuauguuuuagugaguucaagaugcuauaacuauaacaaaauaccauagacuggguggguuauaaacagauuucucacuguucugaaggcugcaaaucuaagaucagggcaccagcaugguugggguucuggugagaguccucuuccggguugcugacagccagcuucucgcuguaccucauauugucgaaagggugagcacucccugggaucucuuuuagaaaaccauauucgcauucaugaaggcucuauucuugugaccuaauaaccuaaaggccccaccucuuaauaccaucacauuggagguuaggauuucaacacaugaauugggagagacacaaacauucaauucacugcaaguuacauaggguuuuuaacguuuucauauuuguucugccccuuuccucuccuucugggacagucauuugcauguugguaugcuuguguccuugggucuauaugacuguuuuucuuuucuuucuuuuuuuuuuuuuuuuuuuuuugagacggaguuucgcucugucacccaggcuggagugcaguggcgcgaucucgacucacugcaagcuccgccucccggguucaugccauucuccugccucagccucccgaguagcugggacuacaggcgcccgcuaccacgcccggcuaauuuuuguauuuuuuaguagagacgggguuucaccguguuagccaggauggucucgaucuccugaccucgugauccgcccgucucggccucccaaagugcugggauuacaggcgugagccaccgcgcccagacaugacuguuuuucuuuauuccuuuuucuuucuggucuucagacuggacaaucucaauugacuuuuuuuuuuuuuuucugagacggagucucgcucugucgcccaggcuggagugcaguggugugaucucggcucacugcaagcucugccucccggguucacgccauucuccugccucagccucccgaguagcugugauuacaggcgcccgccaugaugcccagcuaaucuuuuguauuuuuaguacagacgggguuucaccauguuagccaggauggucucgaucuccugaccucaugauccacccgccucagccucccaaagugcggggauuacaggugugagucaccgcggccggcugacuuuuuuuuuuuuuuucacugauucuuucaucugccggcuuaaaucugcuguugccaggugcaguggcucacgccuguaauuuccuagcacuuugggaggcugaggugggcggaucacuugaggucccggguuuaagaccagccuggccaacacagugaaacuccgucucuacuaaaaauacaaaaauuagccagaugugguggcaugcaccuauagucccagcuaguugggaggcugaagcaccagaaucgccugaaccugggaggcggcagcugcaguuugcugagaucgcaccacugcacuccauccugggugacagcgagacugucucaaaaaaaaaaaaaaaaucuguugagccucucuaguaaaugcuucauuucauuuauugugcuuaucaacuucaaauuuucugauugauuuuuaauaauuuaucuaucauuagacucuguuuugguaagacaucauuuucaugcuuugcuuucaauuuuuuaaguauaguuuccuuuaggucucuuaacauauuugguuuugggguuguuucuguuugcuuguuuggauacagggucucacucuguugcccaggcuggagucuuggcucacugcagcuucagccucuggagcucaagugauccuccugccucaccccgcaagcagcugggaguacacacaugugccaccacgccuggcuauuuuuauuuuuuguagagaugggguuucaccaugcugcccaggcuggucucgaacuccucaccuuaggcaacucacccaucuuggccucccaaagugcugggauuacaggcaugggccacugcacccagcuaacauguuuguaacaucugauuuaaagucuuuauccaguaaggucagugucagcuuccucgggcgcaguuugcauugauugcuuuuuuuccucccgugucugggccaugcuucuuugcauguuucagaauuuuguuaaaagcuggacauuuuaaguaacauaauguggcaacuguggaaaucauauucuccucccuccccauggugguuccuuuuucuuguuuaaugucuuuucugaacuaauuauguaaaguuguguucuuugucauguguggccacuauagucucugcuugauuagcuuagugguccucuaaccauuagaucuccuuaauugccuggaacccguaagucacucagccaagaguuuauaacugccuuagacuuuacuuccucauucugcagaggcucaagguagccaguggugagagcuuagggcuuucuagaucuuaccugagcaugcacacagcacugggcauaagcacaucccuaugcauaugaauggccuucuagacucccaggaguacgucacagccuuucaaagcccccuguagccaucucauaguaacagaaagcagaucaguggaugccuggguccaguaguagcgggacgguugcacaggaagugaugaaaauguucugcaacuucacugcgagggagguuacacagguacauacauuugucaccucacguugaacuuuauacuuuaaacacaguuuauauauaaauuauaccucaacaaagcugauguuuuuaaagauguaguuuaaaaacgaaacaaaaaacgugguuugcaggagacaccuugcucgugauccucuaaaacacaggucuccacucagauaccugcaggaugaggacagggugggcgagggaaaggagccagagcccuccaggggugugaagcagcuuuuccuggguggggcuuggcgugcugcgcucacucucccuggaggaggaagugccuaauccaguccucugggucugggcccaggagauggggccuuaaagccucucuugguaaagacuagcccugugggaacaaacaggacacccucuccucugauucuguaucuucuaggggcuccuacuguacuucagggauaccugaccugaguugcagucacauuagcuccuggaaagccaggacagcccauguugaaccccacuuacuacugcugaggacugugcgcccuaagggguuuggggccucugcucuugccacuggccuuggaacacguguggcaguucuucugccucacccucacucuggggcauggcccacucugccagggcaucugacauguucuuugucccuggcucaguuugggggcagcccaguguccugcgcuguggggcuggccguccugaaugucuuggagaaggagcagcuccaggaucaugccaccaguguaggcagcuuccugaugcagcuccucgggcagcaaaaaaucaaacaucccaucgucggggaugucaggugaggcucugggggcagcagucaccacccaccugccaaggcccagugugguaccauuuucuucaccuccuaacaaccugggauggugggguuauguccgcucucaagaggaacugagacacugagaggugcuauugcccaaaacggcucuccuggggaggagaaagcuaggacaugaccugaucccuagcuaccccugagccucucuccucuguccacaccaaagaucucucccagcccaguuauucccugaaacuauucucaccaccuucugaaggugccuccugcacucagcccccucaggaggcacagguaggagcccagaggcugaggccagcacccuggccccucaggccuggccuccugagaugucgucaccuucccuugcagggguguugggcucuucauugguguggaucugaucaaagaugaggccacaaggacaccagcaacugaagaggcugccuacuugguaucaagguauuuucuucuugaaacaaguugcuuccuggaguaggagacaccacagguaccucuuugcagggccaguggaaaggagccucaucuguacccccagcacucugggccacagacuugauugaaagagggcuggggcuggcgggugggggcaguuguugggggacagcugauccuaucagcugaggacagagauaagugguguuagcaguucuguacccagugccugacuacaaaggcugcagaugagacacaggcuauucccagaccagagcagcaccucugccuagaaugcccaagcuagcagggcacucagacccaggaaccccuaaugccaccuuggccuggagaagggaaacaccuucucuauucauaccagggagcuguggcagcacuagacucaggguucccaugccgcacgacaggugguugggauggacaagacuccugcuccuaagcugggucgggggugucucagaacucagacuccaccggucccaaugcccugguuugcuuguccuuucacuuggaccccaaguccucaggacuucuucuccuucuaguugaauuguuauucccuuuuaucuccauuccccaggccuaccccuucccccacgcccaccauggaaagcucuucugguauuugacguguccuuauucaaauugugagacacgcgugguauugauguaaaucucugugcuguauuugaacuuggccuuuccuggucccgccuucucucugcugucagucacauccccagcuuacuccuaccccccucccaggagccucagggauucggaauggucagguggcauggaaggaaacagaucccaaguucagcccgugucucacaauacccugggggugcuuuuccaguucagugaggaaauggguaagucaccugcaguuacccugcuagguggcaagagcuagaucuggccccagggccgucuaacuccaaaguccaagcccuguucuuucuggcguggccauggucagugccaggaagacugggacaggaaaaugaaaccagaaggcacacuccccacccccaagaaauaaaaauaacaagguuuacaaaagaaggggaacaaugaucaaagaauauaaacacaaucaugcagaccccucaucucagagaugagguuagacuguggacuaaaagugauuauuagcuacaaaugauguuaagauaaagccaucuuccuaagaauaauuggacauuuuaaacuggaauuguaagauaacccggaagacagggcaggaagaugccugaagcuggugaggggcacguggagcucauuacaccaacugcaauguuggacauucucuauauaaggaaacaauauacaucacguaaaccacacagaaaaccagagaaugcaggugacucuugcagucuggcguuucccuguggccauucauucuuggcuuggacuguggcuccaggguuaggugaggcaaggugccuguucuguggggcagcaggcucagggccaggugcagugcacuccaagcaggcugcugugggccagaugcacaggacucugggagaggugaccaguaaaaugaccuggcaggaacuggcccauggaaggcucugaggacaguguggcuggagcacuggacaugaggccaaggccaggcugaggaaggccuugaaggccaugugaagggguguccuguccucacaggcugaaggagaacuacguuuugcugagcacugauggcccugggaggaacauccugaaguuuaagcccccaaugugcuucagccuggacaaugcacggcaggugguggcaaagcuggaugccauucugacuggugagcuugaagccugagcuuggccauaucucuagaacucagccugaagccagcaacuagagccuccuagcauggaacagggaggggacaagaguccaagagcagaggcacauguccucuggacagggcagggagcaagagagggucuuucauggcccaaucugcuccuauuccugccuguaccuaagagagcuuccugggcugucaggagguggaaggugagccaccacccagccugccugagcaggcaucagauguaugcaggacaaagcaguacugggccugagaaacaggccauaagaacuacagugggaguugagaccccauuaccgccagccuaggauguagagauggcaggaguuucauucuguacaugagacaggucacacaaggcugcuggguggcugaaagauugguaccacugaggacugacggaacucaaaaugaaaacucuaccccacauuccccaucaccuaggauggucguggucaacccaggguucccccuaaauccacuuacaaggaaaucucauggcuguguugccauuuacagcucagugagacccuaaauaggcacaguugcaucucacaguagagaucacaacugccagccaagcaaccugugcccuccuaccucugggugaucacugcuacccacagguaugcuuaaucccagggcucuggagcugggggaggcccaucccugcuagacacaaauuggaagugguagggauaugaugaauaggaguguguuuguggagagcaaaggcuggccacagaacaggcuuagggauccuggacagagccuacaaaucucaggagaacugagggcuggcuuuguuuuucaggaaacugcugccaccccuuuggggaaugggacauggguguggauagccagagggcccaaucucuaaacuguccuccaguuuggacacugaagucaacagggcaucuucagcagagaaaggugacugagucggcauugcuuuguggucuuuuucagacauggaagagaaggugagaaguugugaaacgcugaggcuccagcccuaagccagcccugcucugccuaaguguacuccaggugagugggccuugcuucuuacucuugaagaugcacagcggguuccuuaccaucagcagcaagcagccucggcaagcugagccuuuuuuuaagacuuuuuuuuguucugacugaugcuccuucccaaagguuaguuucuucaacacuggaaauucuccaaugcuuagcuugcacuugauggcaggaacagcuauauccucccuugaaaccuauggggcuguauccacguggaaccccaacccacccuugccucuuguaaccaccuagucuuaugcccuaaauaccagaccuggaguugggcuccaauccagccaauaaacauccccugccagagcaggcuuuucuucaccagccaggaggagcacuauugugccccaauucagacggcccuggcacugcccuaguguguaaagaaucccauuuuuucauucaucagccaagaagguugguguuccaaggugucccaggaggggacaugccugcuggggauguaagcccucaucacugccccauccucacuccccauaggccucucauuccuuucuuugaaggggggcucagcccuaggcagggcaguccuuaaaggauacccccacaacugggccugcagcuggaagagccugcugcaggagaaagccccaaguccagggcaccuggcaccccccccccgccucccucgacccugagcaagaggucucacacagcauaucccacacucacccaggcuuggggguuuuuaaauuuuauuucaaaagcuuggauagcuucaauauccagguuguggcaaaaucaggacacguguaaaauaccuuacaauacauuagauucccaaaagguaccaaaaaguacaguaaaauuaacacuuccguuacaggaaauguaugacgcaaauaauauaaaauuaaaaggugaaaaaaaggugacacugguuuccuaagauacaauuuacucuuuacaaccaggguccacagguccaggcugcagagcggcagcaggaagcagagccucccaccugcuucugggggaccugguaauaaaaaucagcccaugauggcgcuauggccucucagacaccacacgcugccuaaacaccuagagcucuggaaauagucaacaggagagugauuuccaugggggaaauuuuaaauaagaugcacaugggacaggcaauagaaaguuugccaaguuaaauuugguacauaauuguguucacuccauauccaaacaaagcaugugugcgaucaguuggucgcuccugcugccgccucaguauggcuuguaguuauucugauggccaccacgucgcuggcucuugccguaguuuguacuacccugaccuagggacgagaacaaccauagcagcuacuauuuacaagcauuugcccugugccacgcgcuugauaugcaucuucccaggacccucaccagccgugacagcagagacugccuuccucauguuauuaagaccccgaagucuaaggcucaaaaucaaguagcucccauggcugagccaggccugucugacuccaaagccccugcugccaguggcuccuacacuguccugccuccccuggggacgaggggugagcggauggggccucccucucuccuacuuacuguagucguagccggggccguagccguaauagccauagggcgaguagucguagccgccauagccaggcccguagcccugcugguagccguagcccugguuccaguaguugccguagcccugauuccaacucugacucugaccuguggggggagcagggcacaggggcccguggaccauuuagcauacgcaggagcuaggauggaggaaauccugcccuuugggguggcaggguuacuguggcaacucaggcagaagccaaggggcugcuguucugguguauaagggcccugggcccaacccugcaucugagagacccaagcagaggaucagagaccaggaugcuaacuuuacuuggggcaaacaaggcagcucacucacucagucacucucugaucacucccacucuccuuggcagcuuagccuuuaaaaagaugcaguucaggcuuuggagucagaggggccugggauggaaggggauaaaugccuggcacagcucugcccuacccacccuucugccuaccugcucacagguguaccagacucaggacauccacaaagccaagacacccaucacauccccucccccagaguguaacacaaaugcucucucugcccugggcacccaagccauuccaaggggcagcagcaggcaacagccucaagcauacagcccugacccagagccguuccuauuccuguucguccccaaccucacacaaucugcccaccccugcugcacagcaccagagggagccccaagacaggcuuggaaggcuccauguaggcagggaaacaggaccuaucuucauccacguuccacucaccuccaccuccaccaccaccuccgcugccucgguucccucgguugcgguuuccacggcccccagagccauacugcugcugcugauagacuucuuugggcugggccaccuugaucucacacuaaaagucaagaggacaguggucaggccaguaggacaaacucagggcagugacugcccaaacaccuucacugcgacaaacaucaaaugguggaucagguccauuugcugagaaacaaaauaugcuaguaugggaggccaccuuugggcuaaagcucauggaaucccaacuaaaaccaaaggccuuccagcagagaacccuuccgacagaaugcacuugagaugggcaucucagccccagagcaacuccguaucuaauggaggcaggcaacugggccaacugcagcccaggggagcagaggacaggcugggaccaggcaccacaccuugguccugcugggcuagagggucagacaagacuucucagaugaggggccuuagacaaugagguuuuaacaucuuuuucucuuuacagaagaaacucaucucauccaaauacacgcuauugagaaggcgagccugaccucccucuuacagauaaagucagcuuucagaggcucagggugggggggccugcccgaggccauaaugcuacccacccccuccuccuaaccacuggucuguuggaauaacccagaugucugcauccccucaagucagucaauuuccuuucuguccacuggggguggaaugggguagggugggauacuuuaaagugcuccugcuuaaauaaauuagaccagaccaguguauuucuaaagaaaauccugacaugcacacccauuaaaaauaguacauuuuacagugucccagucauacuuuuaauuggcaaauuaaaauaaugcaaucugauauauucuauccuacuaaauuaaaaauacugaauauaaccaacuaaauauacuuacuccuaagacucacuaccaguaguuucacuuaaacucugccuuagaggcucuucccacccauuucccauuauggcacauagagaaaaaggccucuaucacuguccacuggaguaauaaccacugcuuccccuaacugccucaaagacugucauuuuauagaaaauuuaagacuauccuaauccacucuuuccaaacucccagccaggauagagacuuccaggaguuccaccugucccaccuuaucuggcugccaacuccugcucagaaacagaaccugccacacccugccacugcaggccgcacccucaacucccaacugccaacuugaagccugaacuacccuuucccugaccagaguucaggaggggaagagcuacaccucccugcacaugaauccacucauuugaaagcacaacugacccuggauuuaagcuggccaggacccugggagaucuuuggaaggauuuuugccuggguuuaggguuaacuuaaagaggugcccagaagaccaagugaggcaguucaugccuguaaucccaacacuuuacaaggccaaggcagaggauggcuugagcccaggcaacauggugagaccaggcuuuaaaaaaacauaugagccaggcauggugguacaugccuguggucccagcuacucgagaggcugagaugggaggauccgguccgcccaugaggucaagguugcagugagccaugauuguguuaccgcaccccagccuggacaacaaagcaagacucugucucaaagcaaaaaaaaaaaaaaaaaaaaaaaagugcucaaaguggauggaaguggacaaagacuugguuguagaaggagguagaaaggcucuggaauaagaaaaacuucaccacagaggagaaucagugaguugcagaaguucuaggaucuucugagaccuuaaacugcaggcuucauaccccuggacucaagaaucuagaacugucaccucuagcuuuaagugaggagcuaaagaggcuacucaaccugcucuauucacagaggccaccuucuccuaccucccucacauccuguguuguuuauuggcaguccucccagccugagaagucuuucaaggauuggaacacugccccaaucagggcagcauacgcuucagagaaauaguaaagucugaccaaccuggagagcuccugcaugaggcccaaccccuaacccaucccucuaagggccagcucuccagcagcacaggaggccaagcagagcugggaacaccuuaccuugcuuccacugacaguauggaacuuuuucuccagaaccuucuucacggguucuucuucuuuaaaggugauaaacacaaaaccucgucuuuuguucaacuuuggauccauuggcaauucaauggccucaaucugcaaaaagcauaggcaaacucaggcccaauaccucccuaccccagagcauauaggggacucacaggagaaaagaccccauugaagacagagggugaaaaauaagcccugccugggagggucuagccagccaaggauaccaaggaccagaaagaaggcagccuuaggggcagcugaugggcuauucccagagccacacucaccuccccaaacucgccaaaguacucccugaucuuuuccucaguggcuucaggauucagacccccaacgaagauuuucuucaccggguccuucuucauagccauggccuuuuuagggucaaugacacggccauccagccugugcuccuucuggucuaggaccuguuccaacagaaaggggucaggcugacucagcagcacgagccagacaaggcccuucucucuaagccauaaagacaccaguacagauacaaacauguguuucacccccuccaaauucuaccccagcuuaaccucccaacccaauuuucaucaaaccucaaguacagcugguuuaccucgacaccuagaaaacaguccucacacuuaagccuuugaucaugcucuuccugcccaagcagucccagcgugaggcccaucuccagaagcgaagcagcagggacucggagcauaggcugaagaugggccacaggggaaggaauccucccuccacucccuacuagcugugaccucuucuacuuacauuucugagccuuaggguuuugguuuuuguccuguaaaauggggcuaaaagccuaucauaccaaucauggacucucuuguaauccucccagauguuuagcgccguacccagaauaggcacauaaaagguaaugaaugucaacugucaucuucccgaaccacuccagcacauucucucacucccagcuuaaucuguauuuucauccccucaaaaaccggaacauaaccuccggcuuuggguuuugcccaaagcacuuaaaucacaugcagaccacacaaacuagucaugcuuuaagaaagguguccucuuagaauucaaaucguuuccacugagacugcugaaauccaguacccagcuuaccuucuccacacuggcugcaucuuugaacaggauaaacccaaacccucuugaccguccaguguugggauccauuuuuauuguacagucaacgaccucuccaaauuuaguaaaauagucuuuuaaaucuuuuuugcuaguaucccagcucaggccaccaacgaacauuuuucugaaaugguagggugagacacacggcaacaagucuuguaagcaagcugugauuuuggaaaggacuggcccuggcaaaguucucacgaagucuacagcuacccuuagagucugcaaggagcaccuuagaaagauguuaaaucuccacuacccuccaaauugaacucaaccaggacccuaacgaggcuuaacaaggcucugcagccccagccugugagaagcaaagaagggaccaccucaccagggguaugggaccuaaccacucauaacuggaaauucauguguucuacaaccauguagcaaagggccagcgucuccaccaacuccugagaacucguuucaaggaacucgauguuuccggggaccaagcccgcccaggguucagaccgugacuccgcccccgggagaggcggaggagggagguccgggccccggcucgcgccaacuccgcccacgcagccgccggcgcggcccaagacgccgccgggccccggguccgagcgcuuucccucuuccgggccauccgcccgccccugcgccggcuccggcccuggcccuggcccuggcagcgcgcgagcggccccggggcggcgccaaagucgacccaacaaacucccgcaaacuccagcgcgaguggcagcgccaggcccggcccgcgaacgcagcggcgacaguccgcgggccgcaccagccccgacccgggccaggccgccgccccuccccccgccgcguggcgccaacaaaaggcggccccggaacaaaggcggcgcccccguccgcccgcggccgcaccuaccccgcguccuccucguucuugcuggcguugaucuggucgcccucggcgccguucugauucccgcucgggggcgccgcggucgcgccuccagcccccgccgcggcgcccgugccagccccggccggcgacucgccuucggggacggccucauguccguucucgguggcgcccgucgucuccaugggcugcuccucgcccgcuuccgacaugcuaggccgaggcgcggcggcuccugcaaccagcggcgacagcgcgucaggccggcgcggcucccgccagagcucccgcccgccggccgccgcucaccucgccgccgaugacgccgcggggcccgcucguccccacccgcaggggaaggcgccgcaggcucggccgcacucaagcucgcgcugcugaggccucgccccagucagcccacggagcugcuccaacugugucuccuccuccuuggccgccgccgcacgggaacccaccgaccaacagccaagcuccgucccgcgcggugccgccgccugacaaugccgacucguggcgcccuuuauaaugccg

SEQ ID NO: 16567 - RNA, 2449 nt, Homo sapiens
accaaucauggacucucuuguaauccucccagauguuuagcgccguacccagaauaggcacauaaaagguaaugaaugucaacugucaucuucccgaaccacuccagcacauucucucacucccagcuuaaucuguauuuucauccccucaaaaaccggaacauaaccuccggcuuuggguuuugcccaaagcacuuaaaucacaugcagaccacacaaacuagucaugcuuuaagaaagguguccucuuagaauucaaaucguuuccacugagacugcugaaauccaguacccagcuuaccuucuccacacuggcugcaucuuugaacaggauaaacccaaacccucuugaccguccaguguugggauccauuuuuauuguacagucaacgaccucuccaaauuuaguaaaauagucuuuuaaaucuuuuuugcuaguaucccagcucaggccaccaacgaacauuuuucugaaaugguagggugagacacacggcaacaagucuuguaagcaagcugugauuuuggaaaggacuggcccuggcaaaguucucacgaagucuacagcuacccuuagagucugcaaggagcaccuuagaaagauguuaaaucuccacuacccuccaaauugaacucaaccaggacccuaacgaggcuuaacaaggcucugcagccccagccugugagaagcaaagaagggaccaccucaccagggguaugggaccuaaccacucauaacuggaaauucauguguucuacaaccauguagcaaagggccagcgucuccaccaacuccugagaacucguuucaaggaacucgauguuuccggggaccaagcccgcccaggguucagaccgugacuccgcccccgggagaggcggaggagggagguccgggccccggcucgcgccaacuccgcccacgcagccgccggcgcggcccaagacgccgccgggccccggguccgagcgcuuucccucuuccgggccauccgcccgccccugcgccggcuccggcccuggcccuggcccuggcagcgcgcgagcggccccggggcggcgccaaagucgacccaacaaacucccgcaaacuccagcgcgaguggcagcgccaggcccggcccgcgaacgcagcggcgacaguccgcgggccgcaccagccccgacccgggccaggccgccgccccuccccccgccgcguggcgccaacaaaaggcggccccggaacaaaggcggcgcccccguccgcccgcggccgcaccuaccccgcguccuccucguucuugcuggcguugaucuggucgcccucggcgccguucugauucccgcucgggggcgccgcggucgcgccuccagcccccgccgcggcgcccgugccagccccggccggcgacucgccuucggggacggccucauguccguucucgguggcgcccgucgucuccaugggcugcuccucgcccgcuuccgacaugcuaggccgaggcgcggcggcuccugcaaccagcggcgacagcgcgucaggccggcgcggcucccgccagagcucccgcccgccggccgccgcucaccucgccgccgaugacgccgcggggcccgcucguccccacccgcaggggaaggcgccgcaggcucggccgcacucaagcucgcgcugcugaggccucgccccagucagcccacggagcugcuccaacugugucuccuccuccuuggccgccgccgcacgggaacccaccgaccaacagccaagcuccgucccgcgcggugccgccgccugacaaugccgacucguggcgcccuuuauaaugccggagccgggugccacaucgcaacaaacugcacacucauuggcugcucaaguccgucacucaaccuagcuucagcgucccauuggccgccacggcgcgcgcgcucuagaccugggcgggcuuuguccucauuuuagaacgcgcgcgaguccggccgcuacggagggcucccgaagccgggcgggacggcgccggguccagggcggcgggcagcuacagcacaucggugggagggccuaaucggauuguaagcucgucgaggccgcuggucucuugcucucgaggacuccaucccagcauuggcagccuccgccuccccaugucccaaaagaggaaacugggcuggagaaaguuucgcagcccaaggacgcguggcuggaaguggcagaacccgggcuuccgagguugggcgagugggguccuccaaggcccucagcacgggucggagggauugggacugaacccgccaucccccuggaccuuggugcccuccaagccccgcgcucgcgcccuguccgucgccucccccagagaugcucugcagggacgaugagaccuugguguuccccgguucucuguccccuggcaccaccugaacgauugacaucgcauuuguacuuuuguuuacuuaaauuuuu

SEQ ID NO: 16568 - RNA, 9288 nt, Homo sapiens
gcucccaacacacaugcccaguggccaugcagacaggcgcagggcacacccucccacugaccacuggccaugggaggagcuacugcccaggucaacagccucaaucccgaccauccaucauccucuggucacaggcucagcguauucugagccucugguagaaaacaugguuuuauucugggggaggccaguguucccaccccagccuccuucccuggaggaaggccccagcccaggucuccagccucucucccucugaccugcccuucgggaccuuggggcuggugaucccccagccuccuucucugggccacauccacuccaggaagcagggcugggcccugccuaggugcuccucugccaggagggccuuguccuggcuccugccaaggcacccuacccagcccacggccccacuggaucccuccucuccuugcgccuccccagccccgggcuggccucugcagguuccaccccaaccagugcaagggaaggcugagccggccgucucagggcaccuucugacaguguugcugcugucagcucgcucugcuggccucagaucuuggaggacucgagccggggacuccaggguguggggggcucccgcagugcccgcaguuccugcuccagugccugguugcggcgguacauguccauguacccucccuggaucucccgcugguagcgcagcacgcgcuccuucuccuccugccaaguccgccgcuccugcucaaagcgcagcgccugcuccuggccccgaagucgcuccugcagcagcucagcccgcagcugcucagcacugucucuggccucgcugccuccugccuccccuagcaggccccugcucuugcagucaucagucucacagcugccuggggcuuccucccgaggggccugcuccugcaggcugcgcacagccucgcgcagccggaccagcucugcguccugagccugggcuugugcccggcugccccgaaguugugucuucagacugaagaucuccgccagcuucugggccaguuccgccugggcuucacgcagcugcugcuucaagaggcuaaucucugcugucuucuggcacaccugggggauggggaggacgcaagcaaaguaggguguggggagccgguuugggagggggcaggcagaagaagggaccggcaauggagaugggagagucucggagcccugugucaucucucaccucccaucgggcuuccuccucuggucgugcacuggggucagccucugggagggugccgggggcccgaggcuccggagccaggcccugcugagcccgcagcuccuugcgcaggcgccgcugcuccugcugagccauaaacagcugcagcuggagguugcgcucgcugcgcucagccuucugggucaccucgugcagccgcuccacauacaggcgcuucagcucagccagccacagccgcuggcgcuccuccagcaccugucaaggggaagagaugcauccaccguggcccugcccccuagaggcgacucagagcuccaccugauacuccagccacugaucauauccugugccccuacaccacaggacccagccacacaugcgcuuuaacccgggaugcccuccagggugagguguccccaucacauggcccucccagggagccucucuccuucccacacaacucccaggcaaggacccccagugacaugacauccccaccaccugggaugcagaggaaggaagccaagccagcucccccuuucuugcucucuuguguccacggccacgugggugaacuggcuggggccccucucucuggccuguaccccagugcugaggcacagaacaggacuccagggcaggggcucccucaccugcgugaagggguuggagccguccucaucgccaaggccccucuugagcuccucacaggucucgggcagcacggcucccauuuccucggcagaggagcaggagaacucguaggggggugguggcucgggcaggcagcucagcacagcugguggcccagccuccuuggguccuugagaggcccgguccagggagcccccgaggugguuaagguggccaagggaggagcugaaggggcuagggccaguaccaggacugcgaccaaaacuacccccacuggaggagucggacaggcugggcucgggcucagggccgcccucaucuaggcugagggcgugcagcagcugugcccgggccuggcuggcccggggcccggggcucaggggcggguggcaggccagcgugugcaggcugccauugcugcgccacagcuucuggccuuugugggacgccagacuuugcauggauaggaagccuuucccguugcccgccguaggcuugaacacugaggggcgaaugcggcacugccaggaagagagggcagagagggcaggugugagaccugggcagcugccugcucuaccuccugaugcucucacagccccugagggauccucuuugagaccgcggggcacgugccaccaggaggcagugaacaaaccucaggccagcccauagcacgauuuucguaucucagcaugccccguccccaccccaucccaacaucagggucuccaaggagaccccacccuccccacaccuuguaaggggcaugggcaaaggugcaccuugucaaagcgaccccguucuggcagcgaggucuugcugaagucacccgcgcgagaauguucccgguaguagaggguggcauagucggcaggcucguuccgaggggcccgcuugguguucuuggugcucuugcuguccuucuuggggaggugcagguagcugaggaacucacgcuggcccaagcccuuccggaggagcccaucaggcuggcgggagccccgagacccggcaagugccgcccgcagcucuucaggggagaaguccugccguuccaacaggcugcccacgcugcccauggcaaugccagcagggccuggggcuguggccaugaaguuucaacaggguacaggcagcugcuucugggaauugggaggcuccauuaggggcaggugagcacuggcugcccaacuucccuggggccugaaaacaagguacuugcucccuguagcuccccacaaccuugcccaggcccagguaaggcagauguggguccaagagagaaccccgggacaggaucccuagacuggcaagagaaagaaguacaagccccaaagccaccugcccaucugucacuugcuggacugagucuaaggaagagcaauggugccccagccgagcaccgaagggccagcuccaccucggggccugugugggauucagaaguaccgggaggggauaggccuggaagcagcaggacaggagccguccucccagcacugggcccgcacagggcuaaggaagacaaacuuggccgggcgcgguggcucacgccuguaaucccagcacuuugggaggcuaaggcaggcagaucacaaggucaggaaacgcagaccauccuggcuaacacugugaaaccccaucucuacuaaaaauacaaaaacuagccgggcaugguggugggcgccuguagucccagcuacucgggaggcugaggcuggagaauggcaugaaccugggaggcagagcuugcagugagccgagaucgcaccacugcacuccagcaugggcgacagagggagacuccaucucaaaaaaaaaaaaaaaagaaaacucagccuggcugaaccugaccuugcuuacccuccugccauguuccccaccaaaucugugggguggggagaaggcacagagacccaaggccagugagacccuccuucccaugggagagggguaaccccugcaggcccucuuccugcaaagggcaaagcuccccaagggaaacaucuggcaugggggggaggguugggggcuacagugggagggauacaaacaggaagggcccaaaaggaggaaggaugacgugaacaauggccacaguuuccgggacagguguucccgucugggcagugguggguggaggagggaaggggcagcuggacucacuccagccccuguauaugcucuuauuccaaagcccaccacccggcagggugggucccaaauccuaacccuggcggaaccaaucggugugugaccccggccaagccacuaaccucagugagccuggacuuccgcacacacacccuggcgacaauaacacuuaucacugggaugcugggaggauggggugggauaacaugacagagcacccaguucagggccugggccacagccagggucaacaggcuggcuggagccgagcucagccaggcacacaaacaucaccaagggacuaggcugacggaccaccuuccaccugugcugggccacacacucuggaggcagggcugguaccuaguccccuggggauccucugcacagcccagugcccagcauggagcgggcgugcagaaaggucuggccgagugaacaaaugccaccuucucugccucccaccccugagcagcugcucccauucucgaacagaagcccagcaggccagcugcagcuguggguccccuacuaccacccaugcuuccgggcacccacuccugcccccgaacaauggucguuaggagguuccaucuuccucaaccauuuccagguuuuguguuuguggaagacaaagcucuccgggagggggaccugccccaaccccacagccucaccucacccugugcaaaaaugaccucagcucucccccaaccaacccccaaacccaggauggggcgaauccggguuugcacaccccacccagcccagccccugagaacgcacguugcaggcuacauaggagaugcauccagguaaggaaucacaggggauggguuccuacagcgacuuggcccugcauacggguccugcugaguccugugacagaguuauugucccuucuuuuuuuuuuuuuuuuuuuuugagacagggucuugcucuucacucugucacccaggcuggacuacaguagugcaaccauggcccacugcagccucgaacuccuaggaucaagccaucuucccacuucagccuccugaguagcuaaaaacacaggugcgugacacugugcccagcuauugacccuucuuaaaggucaguggggcucagaaaggugaagugacuugcccaaggucguagcuggucauggcugcccaaugucuagugggaccuaggauuggucccuacagccaaaaguauuagaauggaagcauccugccuccucaucugauaccuccuugccacgacaagcccauccagccagagaugugguuuguccacaagcacgcucaacuccuguugcugcuucuuggggaggggacagcagagaccugcucuccagccugcccucacucucuccaggggaccccagacacaaaugcuccgccuuuugccaugccucaguuucugcaucucugaagcgggaaagggccaggcaugguggcucacaccuguaaucccagcacuuugggaggcugaggcaggaggaucacuugaccccaggaguuugaaaccacccuuagcaacauagcgagaccccaucucuauuuauuuuuaaaaaggaaaaaaaaaugaagugggaaagaccccgccugcccggcuuuccucaaaggauuacugacagucagagauggaggggaaagggcuuaugaaauguaagcccuguguggcccugggggcggggacguuggcagcagugccaaauacgcccaccucaccccaaaugcacaccgccucagcuuccggugggcagaugcucacuuccugucucgaggagauaaccgacccccagguuccccacgaggcaucgcagguccagggaaagucccugagcuagagguagccaccggccgcaacagcgcauacaaccacacacgccacggugugccacaugucagccccacccagcagcacagagagcccauguuagaggacacggugcagacggucacguccagcagcaaacacaaucauacagcugugcacaaggucacccacaggacacacugacaaagcaggagcagcccaguggcaugaugaccuaguguccuucccagcccccaggcuagugaaggagcagcagacagccccuucccuuugucucuccuuaggccccccaccguccccacugugccccuccuggcugacugacuggauuaucagcucccccagcagggcgggggcccccagcuuucaggacacuccucccugcguaugucacagaguggggacagucucuuuuccuaaagggguccauccuaccuccacccccucccccaacacauacauuccuuccuuccuguugcuuggaagcccagggauugccugcuccgggcagggcagcugggcagggcagcugugcaggcggaggggauuuggugggggaggagggagggaggacagcaagugccuugcagccucacuggaacaucagagcaaaaagccggggacccugcacgggucguggagagaaggguaggggacaagccaagugccugggcuucccugagcugggagcggcaaacccccagccacacagcuggcuagauuugggcugggacauucaagccacauucuccacagguccuggcuagccccaguaaggccucuucacuccugcuccccgccaccaguccccucaccccucuccaguccccaagauuagcaggcagcacuggaaucucugaacacggagaggaauugcuuucggaccaauccuugguggagauggaagacacagcugcccuggccaggaagcaaagaaggagaggacgcgcuuucuuugaggggggcgucccagagccuguuggugcccuuuugggucacgccaaagggcacuaucacauccucacaagacacacaggagaugaguucugucaucccccacuucacaagaggaaacugagguucagaaagugaaguaacacgccuaaggucacguucagccgcaggggagaaagcacacaggcuccaggauuagaaguccucucggaucccaccuugcaucuccucuggggugggacauuccaguccccacaugggcaggagugcugccugcccuggcuacagucagccccuccugagcccuggccccagggaaaggucccaccaccugcugggggaucagcucugcuaaggggcgugucugcagcugccccuaaggaaugggacuggaaugucccagcuccaaaagggggggguaguaggcaaggggggcccagagaggggcugggagaggcuggcccaccccauccccucugugacagacacuugaggcagagacaggggcuaaagccugcggaaguggugcuuaguaucaccauauagugcuucacggcugcaccgcagucuacaguuuuuucucagcccuucuauuucauuaucucauuucaucuccacaauagccucgugggggcaaacaggacaguaauuacccucacgccauuuuacagaucgggaaacugaggccucggaaggcgaggugaguuauccaagaucccacagugagaagcaaucucaacucccugggcaagguccuuucuaccucagcagguuguccuaagccaggggucacggguuccccuccaugggcacacacugcuguguauguauugcauauaugucugcccagcccuccaugccuguuucucccaaggacacuugcaaccaggcugcccuagacugcgguccaccaggccuggaaucccuccugcugccccccaggucaggaagaaauagaggaaaccugccucauggggacuccgagucgcuaugcuagcucuagaggcgguggcagaggcaggcuggccgcauucauucacagucuggcacaugcacaccacacgcugccagccgguagagaagcccugccugggagggcccugggaggaggcugauaaccgcgcccaggauggccuccugcguccgcucccucccgaggacagccaggcccaaucuguuccuaugugguuggggucgggggguggcccagugggaggcaacgggucucaguucucuuucuggauacagccagggcccugauuucggcuuguccccaggccagcccucacuugggccaaaggcuguggccgggacuggaccgggugcucuggcggucaagaccuaggaauguccccuacccgcagacccgcagcugcagccugguggaccggcaggggguugggggauaaaggaggugugggaggaagcgagagaucucauggggaagucagaggggcaaacgagguugcauccccacggaauuugugucaggaaagcaggggugaaggcgaggguuccccaaagcugcgggaggucccggagcuaccuggggggcggggugggaggcgcgucuccuccuggccccucccugaggccugccgggagcggcugggccggggggcggaggccgaggucagacgccggcgccaaggacgccugccccacccagccguggcgcaggggucccgcgcgcugcucccuggaaagcgcguuugcagggguuggggagagcaagguagccugccgccugccccuccagcggagcaucggggucgguccccgauccggugccucggugaccgggagcaggggacaccugggcgcacgccgcaccuugccacccccgcccaucucucagacgggagccucggccagcgggacagcagcuuugccaaggacgcccgaaaacaagaccuuggcgacccgccccaccccuccccaccccccgaguccagcccggguccccagccccucgcgcgccccacuuaccaugguggcgacgcgcucgccggcccgcggcuccgcagcccuugcgcgucgcagcucccccgcgcggauuugaacccuccugcaaggcgucggcucgggccgggacugcgugccgggucggagcggcggagcggcaggcgccgggaaaacgcgggcgggcgccggcgccggagccggauuggcgagggagggacgcgcuccgcggcgcucgaucgccugccccaaaggcggagggaaaacccggccugacucaccggcgcgcggcaagcccacagcccggccccggcccccggauguggggggcggggccgccuacccgcgagccaaccugggccccgcccggccccgaccgcgcccccggcccugacccgcagaggcgccgcacggcgguggcgggcgaaaccuggaccggcugcgccucgcgucgcugccuccuugagcgccccggcucguucccgaggggugggcagccccgagcgcggcccacgccccagagagcg

SEQ ID NO: 16569 - RNA, 9288 nt, Homo sapiens
cgcucucuggggcgugggccgcgcucggggcugcccaccccucgggaacgagccggggcgcucaaggaggcagcgacgcgaggcgcagccgguccagguuucgcccgccaccgccgugcggcgccucugcgggucagggccgggggcgcggucggggccgggcggggcccagguuggcucgcggguaggcggccccgccccccacauccgggggccggggccgggcugugggcuugccgcgcgccggugagucaggccggguuuucccuccgccuuuggggcaggcgaucgagcgccgcggagcgcgucccucccucgccaauccggcuccggcgccggcgcccgcccgcguuuucccggcgccugccgcuccgccgcuccgacccggcacgcagucccggcccgagccgacgccuugcaggaggguucaaauccgcgcgggggagcugcgacgcgcaagggcugcggagccgcgggccggcgagcgcgucgccaccaugguaaguggggcgcgcgaggggcuggggacccgggcuggacucgggggguggggagggguggggcgggucgccaaggucuuguuuucgggcguccuuggcaaagcugcugucccgcuggccgaggcucccgucugagagaugggcggggguggcaaggugcggcgugcgcccagguguccccugcucccggucaccgaggcaccggaucggggaccgaccccgaugcuccgcuggaggggcaggcggcaggcuaccuugcucuccccaaccccugcaaacgcgcuuuccagggagcagcgcgcgggaccccugcgccacggcuggguggggcaggcguccuuggcgccggcgucugaccucggccuccgccccccggcccagccgcucccggcaggccucagggaggggccaggaggagacgcgccucccaccccgccccccagguagcuccgggaccucccgcagcuuuggggaacccucgccuucaccccugcuuuccugacacaaauuccguggggaugcaaccucguuugccccucugacuuccccaugagaucucucgcuuccucccacaccuccuuuaucccccaacccccugccgguccaccaggcugcagcugcgggucugcggguaggggacauuccuaggucuugaccgccagagcacccgguccagucccggccacagccuuuggcccaagugagggcuggccuggggacaagccgaaaucagggcccuggcuguauccagaaagagaacugagacccguugccucccacugggccaccccccgaccccaaccacauaggaacagauugggccuggcuguccucgggagggagcggacgcaggaggccauccugggcgcgguuaucagccuccucccagggcccucccaggcagggcuucucuaccggcuggcagcguguggugugcaugugccagacugugaaugaaugcggccagccugccucugccaccgccucuagagcuagcauagcgacucggaguccccaugaggcagguuuccucuauuucuuccugaccuggggggcagcaggagggauuccaggccugguggaccgcagucuagggcagccugguugcaaguguccuugggagaaacaggcauggagggcugggcagacauauaugcaauacauacacagcagugugugcccauggaggggaacccgugaccccuggcuuaggacaaccugcugagguagaaaggaccuugcccagggaguugagauugcuucucacugugggaucuuggauaacucaccucgccuuccgaggccucaguuucccgaucuguaaaauggcgugaggguaauuacuguccuguuugcccccacgaggcuauuguggagaugaaaugagauaaugaaauagaagggcugagaaaaaacuguagacugcggugcagccgugaagcacuauauggugauacuaagcaccacuuccgcaggcuuuagccccugucucugccucaagugucugucacagaggggauggggugggccagccucucccagccccucucugggccccccuugccuacuaccccccccuuuuggagcugggacauuccagucccauuccuuaggggcagcugcagacacgccccuuagcagagcugaucccccagcagguggugggaccuuucccuggggccagggcucaggaggggcugacuguagccagggcaggcagcacuccugcccauguggggacuggaaugucccaccccagaggagaugcaaggugggauccgagaggacuucuaauccuggagccugugugcuuucuccccugcggcugaacgugaccuuaggcguguuacuucacuuucugaaccucaguuuccucuugugaagugggggaugacagaacucaucuccugugugucuugugaggaugugauagugcccuuuggcgugacccaaaagggcaccaacaggcucugggacgccccccucaaagaaagcgcguccucuccuucuuugcuuccuggccagggcagcugugucuuccaucuccaccaaggauugguccgaaagcaauuccucuccguguucagagauuccagugcugccugcuaaucuuggggacuggagaggggugaggggacugguggcggggagcaggagugaagaggccuuacuggggcuagccaggaccuguggagaauguggcuugaaugucccagcccaaaucuagccagcuguguggcuggggguuugccgcucccagcucagggaagcccaggcacuuggcuuguccccuacccuucucuccacgacccgugcaggguccccggcuuuuugcucugauguuccagugaggcugcaaggcacuugcuguccucccucccuccucccccaccaaauccccuccgccugcacagcugcccugcccagcugcccugcccggagcaggcaaucccugggcuuccaagcaacaggaaggaaggaauguauguguugggggaggggguggagguaggauggaccccuuuaggaaaagagacuguccccacucugugacauacgcagggaggaguguccugaaagcugggggcccccgcccugcugggggagcugauaauccagucagucagccaggaggggcacaguggggacgguggggggccuaaggagagacaaagggaaggggcugucugcugcuccuucacuagccugggggcugggaaggacacuaggucaucaugccacugggcugcuccugcuuugucaguguguccugugggugaccuugugcacagcuguaugauuguguuugcugcuggacgugaccgucugcaccguguccucuaacaugggcucucugugcugcuggguggggcugacauguggcacaccguggcgugugugguuguaugcgcuguugcggccgguggcuaccucuagcucagggacuuucccuggaccugcgaugccucguggggaaccugggggucgguuaucuccucgagacaggaagugagcaucugcccaccggaagcugaggcggugugcauuuggggugaggugggcguauuuggcacugcugccaacguccccgcccccagggccacacagggcuuacauuucauaagcccuuuccccuccaucucugacugucaguaauccuuugaggaaagccgggcaggcggggucuuucccacuucauuuuuuuuuccuuuuuaaaaauaaauagagauggggucucgcuauguugcuaagggugguuucaaacuccuggggucaagugauccuccugccucagccucccaaagugcugggauuacaggugugagccaccaugccuggcccuuucccgcuucagagaugcagaaacugaggcauggcaaaaggcggagcauuugugucugggguccccuggagagagugagggcaggcuggagagcaggucucugcuguccccuccccaagaagcagcaacaggaguugagcgugcuuguggacaaaccacaucucuggcuggaugggcuugucguggcaaggagguaucagaugaggaggcaggaugcuuccauucuaauacuuuuggcuguagggaccaauccuaggucccacuagacauugggcagccaugaccagcuacgaccuugggcaagucacuucaccuuucugagccccacugaccuuuaagaagggucaauagcugggcacagugucacgcaccuguguuuuuagcuacucaggaggcugaagugggaagauggcuugauccuaggaguucgaggcugcagugggccaugguugcacuacuguaguccagccugggugacagagugaagagcaagacccugucucaaaaaaaaaaaaaaaaaaaaagaagggacaauaacucugucacaggacucagcaggacccguaugcagggccaagucgcuguaggaacccauccccugugauuccuuaccuggaugcaucuccuauguagccugcaacgugcguucucaggggcugggcuggguggggugugcaaacccggauucgccccauccuggguuuggggguugguugggggagagcugaggucauuuuugcacagggugaggugaggcugugggguuggggcaggucccccucccggagagcuuugucuuccacaaacacaaaaccuggaaaugguugaggaagauggaaccuccuaacgaccauuguucgggggcaggagugggugcccggaagcaugggugguaguaggggacccacagcugcagcuggccugcugggcuucuguucgagaaugggagcagcugcucaggggugggaggcagagaagguggcauuuguucacucggccagaccuuucugcacgcccgcuccaugcugggcacugggcugugcagaggauccccaggggacuagguaccagcccugccuccagaguguguggcccagcacagguggaaggugguccgucagccuagucccuuggugauguuugugugccuggcugagcucggcuccagccagccuguugacccuggcuguggcccaggcccugaacugggugcucugucauguuaucccaccccauccucccagcaucccagugauaaguguuauugucgccagggugugugugcggaaguccaggcucacugagguuaguggcuuggccggggucacacaccgauugguuccgccaggguuaggauuugggacccacccugccggguggugggcuuuggaauaagagcauauacaggggcuggagugaguccagcugccccuucccuccuccacccaccacugcccagacgggaacaccugucccggaaacuguggccauuguucacgucauccuuccuccuuuugggcccuuccuguuuguaucccucccacuguagcccccaacccucccccccaugccagauguuucccuuggggagcuuugcccuuugcaggaagagggccugcagggguuaccccucucccaugggaaggagggucucacuggccuugggucucugugccuucuccccaccccacagauuugguggggaacauggcaggaggguaagcaaggucagguucagccaggcugaguuuucuuuuuuuuuuuuuuuugagauggagucucccucugucgcccaugcuggagugcaguggugcgaucucggcucacugcaagcucugccucccagguucaugccauucuccagccucagccucccgaguagcugggacuacaggcgcccaccaccaugcccggcuaguuuuuguauuuuuaguagagaugggguuucacaguguuagccaggauggucugcguuuccugaccuugugaucugccugccuuagccucccaaagugcugggauuacaggcgugagccaccgcgcccggccaaguuugucuuccuuagcccugugcgggcccagugcugggaggacggcuccuguccugcugcuuccaggccuauccccucccgguacuucugaaucccacacaggccccgagguggagcuggcccuucggugcucggcuggggcaccauugcucuuccuuagacucaguccagcaagugacagaugggcagguggcuuuggggcuuguacuucuuucucuugccagucuagggauccugucccgggguucucucuuggacccacaucugccuuaccugggccugggcaagguuguggggagcuacagggagcaaguaccuuguuuucaggccccagggaaguugggcagccagugcucaccugccccuaauggagccucccaauucccagaagcagcugccuguacccuguugaaacuucauggccacagccccaggcccugcuggcauugccaugggcagcgugggcagccuguuggaacggcaggacuucuccccugaagagcugcgggcggcacuugccgggucucggggcucccgccagccugaugggcuccuccggaagggcuugggccagcgugaguuccucagcuaccugcaccuccccaagaaggacagcaagagcaccaagaacaccaagcgggccccucggaacgagccugccgacuaugccacccucuacuaccgggaacauucucgcgcgggugacuucagcaagaccucgcugccagaacggggucgcuuugacaaggugcaccuuugcccaugccccuuacaagguguggggaggguggggucuccuuggagacccugauguugggaugggguggggacggggcaugcugagauacgaaaaucgugcuaugggcuggccugagguuuguucacugccuccugguggcacgugccccgcggucucaaagaggaucccucaggggcugugagagcaucaggagguagagcaggcagcugcccaggucucacaccugcccucucugcccucucuuccuggcagugccgcauucgccccucaguguucaagccuacggcgggcaacgggaaaggcuuccuauccaugcaaagucuggcgucccacaaaggccagaagcuguggcgcagcaauggcagccugcacacgcuggccugccacccgccccugagccccgggccccgggccagccaggcccgggcacagcugcugcacgcccucagccuagaugagggcggcccugagcccgagcccagccuguccgacuccuccaguggggguaguuuuggucgcaguccugguacuggcccuagccccuucagcuccucccuuggccaccuuaaccaccucgggggcucccuggaccgggccucucaaggacccaaggaggcugggccaccagcugugcugagcugccugcccgagccaccaccccccuacgaguucuccugcuccucugccgaggaaaugggagccgugcugcccgagaccugugaggagcucaagaggggccuuggcgaugaggacggcuccaaccccuucacgcaggugagggagccccugcccuggaguccuguucugugccucagcacugggguacaggccagagagaggggccccagccaguucacccacguggccguggacacaagagagcaagaaagggggagcuggcuuggcuuccuuccucugcaucccaggugguggggaugucaugucacuggggguccuugccugggaguugugugggaaggagagaggcucccugggagggccaugugauggggacaccucacccuggagggcaucccggguuaaagcgcauguguggcuggguccugugguguaggggcacaggauaugaucaguggcuggaguaucagguggagcucugagucgccucuagggggcagggccacgguggaugcaucucuuccccuugacaggugcuggaggagcgccagcggcuguggcuggcugagcugaagcgccuguauguggagcggcugcacgaggugacccagaaggcugagcgcagcgagcgcaaccuccagcugcagcuguuuauggcucagcaggagcagcggcgccugcgcaaggagcugcgggcucagcagggccuggcuccggagccucgggcccccggcacccucccagaggcugaccccagugcacgaccagaggaggaagcccgaugggaggugagagaugacacagggcuccgagacucucccaucuccauugccggucccuucuucugccugcccccucccaaaccggcuccccacacccuacuuugcuugcguccuccccaucccccaggugugccagaagacagcagagauuagccucuugaagcagcagcugcgugaagcccaggcggaacuggcccagaagcuggcggagaucuucagucugaagacacaacuucggggcagccgggcacaagcccaggcucaggacgcagagcugguccggcugcgcgaggcugugcgcagccugcaggagcaggccccucgggaggaagccccaggcagcugugagacugaugacugcaagagcaggggccugcuaggggaggcaggaggcagcgaggccagagacagugcugagcagcugcgggcugagcugcugcaggagcgacuucggggccaggagcaggcgcugcgcuuugagcaggagcggcggacuuggcaggaggagaaggagcgcgugcugcgcuaccagcgggagauccagggaggguacauggacauguaccgccgcaaccaggcacuggagcaggaacugcgggcacugcgggagccccccacacccuggaguccccggcucgaguccuccaagaucugaggccagcagagcgagcugacagcagcaacacugucagaaggugcccugagacggccggcucagccuucccuugcacugguugggguggaaccugcagaggccagcccggggcuggggaggcgcaaggagaggagggauccaguggggccgugggcuggguagggugccuuggcaggagccaggacaaggcccuccuggcagaggagcaccuaggcagggcccagcccugcuuccuggaguggauguggcccagagaaggaggcugggggaucaccagccccaaggucccgaagggcaggucagagggagagaggcuggagaccugggcuggggccuuccuccagggaaggaggcuggggugggaacacuggccucccccagaauaaaaccauguuuucuaccagaggcucagaauacgcugagccugugaccagaggaugauggauggucgggauugaggcuguugaccugggcaguagcuccucccauggccaguggucagugggagggugugcccugcgccugucugcauggccacugggcauguguguugggagc

SEQ ID NO: 16570 - RNA, 1193 nt, Homo sapiens
ugucagucuauaaaaggaaguaggaacugucccuggcuuucaggcuccaacauccucccccugucaagauguggcaccucaaacuuugugcaguccucaugaucuuccuguugcuguugggccagguaaggagggaaggauacuuauguguguguguggaguguggagaugauaguggugguggaacuugaaagcuagauucaguccugaggaaugguuccucuguucugagucuacagcaucugcggaauggaaugaucacucuuccaaggugugcagcagggugucaacacuuucauaucugaaugucuuugcccuuacagauagauggcuccccaauaccagaagugaguucggcaaagagaaggccacggagaaugaccccauuuuggagagggguuucccucaggccuauuggagccuccugccgggaugauucugaguguaucacaaggcuaugcagguacucccugaaccugggagcaggguugggccagagagcccugggaagcugggcagaggagugacaaggggacacaugaaccuaagaauaaagcugggauggaggaguucuagacugagacugggagcuccauggaaaaucccuuaggaguuaggagccaagaacagcucuauguggguaccaugaaagaguggugccuuuccauucuucagucuuuccugagacuggacagaucaagcaaagaggaaggaaaugcagcauagguggcccuggucauuccuagacccagucuuaaaaaacuacccuuucuuuuccccuagaaaaagacgcuguuccuuaaguguggcccaggaaugauguacauaccagggaaagaaaggacagcagucaccuccgacaaugcuccguucuauggaauauugauuaacugcauuuuggcuggagacacccaagugaagcaaucuuguauuuuuaauauuuaaaggcagauguacgcuuuaaauuggucuccauuucuucuuagaauguugauauauggauaagcauaacuaaacuugucaauuuagaguuuauuuuucuauggauacuauuaaaugucucaaauugaaauuuuagcagucuggaauucaagcuuuugagggaaagaaggauucauuuuguauacuaaagaaaaaaacagcauugcccaauaauguguuaacuucucaaucuggaaaguguagugagagcu

SEQ ID NO: 16571 - RNA, 3258 nt, Homo sapiens
cuaagaggacgagcccaagacuguaagacucagccuuuuccccguauccugccucacaauguaguuuaucuuuuagguuuuguuuugaagucucgcucugucacccaggcuggagugcaguggcacaaucuuggcucacugcaaccuccaccucccagguucaagcguuucugccucagccuccugaguagcugggauuauaggcgugugccaccacacucagcuaauuuuuauauuuuuaguagagacaggguuucaccauguuggccaggcuggucucaaacuccugaccucaagugauccauccacuucagccucccaaagugcugggauuacaggugugagccacuguauccggccauguuuugaaguaucuuaacuuuugauucuuaaaaggcaauagcaguaauuaggauaauaaagauacagucuggccaggcacgguggcucacaccuguaaucccagcacuuugggaggucgaggcagguggaucacgaggucaagagaucaagaccauccuggccaacauggugaaacuccgucucuacuaaaaaaaaaaauaaaaauacaaaaauuagcuggguguguugguaugcgccuguagucccagcuauuugggaggcugaggcaggagaaucacuugagcccgggaagcggagguugcaguaagcugagauugcgccacuaaacuccagccuggugacagagcaagacucccaucucaaaaaaaaaaaaaaaaaaacacagucugacccagaaucaaaguugcugcuagcaggaagaguccuuagaagaguuucuaaaaacggaucucagaucccauagcauauacuguacugacugagcuaugacaacucaucauauuccacauaccugcuaccacaggugagauccaugucccgaagcuuagagagaagccucucuaaggaacuagaggcauaaaacugccaaccacaccuacccccaccaucucucggugggcgaagggaaaaugguaucuuuaauaccaaaaagauaauuuaaaggcuuuagaucagggguaaacuuuauucauaaagggccagaguaaaucuuugaggcuuuaugaaccacauaugguugaaaacauuguuggccuccuggcacagaaacagaaaacugcuguggaggcuaagagaucaccucauccguuuuauagcugauauccccucaggcuaaggccugccuuaggaggaaaggcaguagagcaagcuuguccaaccgcaguccugggcagcaagcagcccaggauggcuuugaauccgacccaacaaaaauuuguaaacuuucuaaaacgcugaggguuuuuuuugccauuuuuuaaagcuuaucagcuauuguaauguuagcguauuuuauguguggcccagggaagcuaaaagauuggacaccccugcaauagagcauaguuuuaagagcaucacuuuagugcaagacuccaccauucacugcuguauaauuucuggcaaauuacuuaaucucucugugcccauuuccucaucugccaaaugaggauacguuaaaggugcuugugagguuuaacaguucauuuguguagcuaagaagaguauuugaggcccagagcaccauggcuuacgccuguaaucccagcacuuugggaggcugaggcgcacagaucaucugaggucaggaguuccagaccagccuggccaacauggugaaaccugucucuacuaaaaauacaaaaaauuagccaggugugguguccugcaccuguaaucccagcuacucggaggcugagacaggagaaucguuugaacccaggaggcacagauggcagugagccgagaucacaccacugcacuccagccugggugagagagcaagacuccaucucaaaaaauaaaaaauaaaagcgucccugacacauacuaauuacaauauaguuaguagacuuuauuguugcuaugggagcagagggccaagaaccagcacucgccauagcccaugucacccacaaaugguuagaugcaggaguaccugcagcuacuuucuuguagauaauggaacaaagggggagcccugcucuuucaccaaaacccgagaccaggcaaaacuucaagacucaugcugaggaggggcgcuucaugaacuugaauauuaguggucacacaggauucuacucacaaaaauguaauaucacaacagugcagaccauaggaaguuuauugugucuuugagacacuacaaugcagacuccucuuccagagaaaggucuuucagagacagggaaccgucauccggaugcguugcucauuugucauuuucauaggcagcuggauucuuccucuuggaucucucgaacucuucagucccccauguguagauaagauaaaacacuacaaacucuuuaaaaauuaagagaguaaacagagagcacacauauaagacauauagaagaaaaaaaaaggucucaguccucuugucuucuuuaaagcauacacuucaguaguucuuagcauauccaaggccaugcaacuaucaucacuaucugcugcacguuuaacacaaagcauuucaccacugguaagaacuaaauaaaggugaccucagaggaacaugcuggaaucacccgagugaccuugggccagucauuucaguucuguagcucaguuuuccccguguaagauggggaggauaauaugaccagcuuaagggcggucaggaauauucaaugagaaagguguguacggcaaguuacagagcgccugcccggccgccagcgcucagaggggaggcgcagugacugcugcugcugcugggguccagccucccgcucccgcgggcccaaggcacucacgcggcaccacgcgaaagaaagacucccgaaugcggcgcagaacauuggggauuccuuuagugaagacgugcggauaggcgcgcugcucgaacggugacaagcuguagcugaucacaugccgcauccgcgucagauucccaaacucgcggcccauuguggcggcggcccugcaggaccgaggguggacaggcgcuuggcucgcuuucgcgaagcgccgcaguccccgcggggguccauccccaaccccagacuccugccccugcacuccuuauccuuucccagcccagcggggcgccccuagccucccaggguccacgaacacugcacaaccagaccccacucacgcacagggcucagcucgcccuccacagucaccgauccgguugacucguucgucauuuccggcaagguuggaagc

SEQ ID NO: 16572 - RNA, 549 nt, Homo sapiens
ugcccccgcgaugcagagggaaccggagcagaaauucccgccgccccccgcccgccccagaauuaaaggcgcagcgcuccagcucuggucucgguugcuagguggguguguucccuagggacgccgcgguccgccaaggaggaauggauuuuuauuccuuuaauaaacauuuaaccacugcaaaacaccaagcgaugauuucagaacaaucuuuuuuuuuuaaaggucgucaauaccacuccaguuuuuuuuuuuuuuuacuguguuucaugcaggaaaacggcuucaugagauuuacagcaaaaccaauucacucugcgcggcaaugcacguuacucuagguuuagagagacguuuucaaaagcaauuuucucaugguaagagaauacauuuucacguagaauuugggguauaaaaccacaggaaacauaaacauaacaggaaaacauagaggaaaacauaaagaaggaaaaaaaaucacuugaaaucaccauuaacauuuugaaauauccucucccugucucccauguguguauguauguuuaugcu

SEQ ID NO: 16573 - RNA, 511 nt, Homo sapiens
uucuucuucuucuuuuuuuuuuuuuaaguaguuagcauuuaaugaaacucccuccaugcggcuucaagccaccaggacacaggcccccccaacacucuuaaucuucuccucagcucuucugcugaagaauuuggccugcacggugacagccugcuuggggagcuuucccuuucccagaacuuuguaguagccagaucgcaccacaucaaugaugggagcagccccagucuuguuuuuagcagcauucacccgugucuguucacugaccaaaguccacaauuugucaagguugacaguugggcagaagcucugguuccucuuuaagugguaaugcuucauaccaacuuucccaaaguagccugggugguauuugucgaaguugauccgguggugaugcagaccaccagcauuaccgcggccgccggggugcuuccggugcuugccuaugcggccguggcgguggcucacguggccccuaaguuuccgggucuuccucagucuggauggcaug

SEQ ID NO: 16574 - RNA, 36622 nt, Homo sapiens
agagacacucaguggggucgaaugaggguuuuguucccauaguagaggcuugaacacauuuacaggccaaugggaaagauccaguugagagcggguaguugagccuucaggagagaaaagggauguuccauggggcaaacuccugagaagggggaggagauggaaggaagcuucuguggauguagcagaugcaggaggguuuguguaguuuuagccgggcucgagccgguggcugacgcaggcaggaacaauggcucacccauguuuuauguguauuuccgugugcgugcuccugcuuuccccaggucugggccgccugccuggcccgugugccguagggaauauccacacugggccugggcggaggcugggcaucucccgcucugggcuugcucccugaugagauucucagaccgugcuuccccucauucaugagaggaagguucacagagcaggcgugggaaccugccuggccgccagggccuccucccgcucaggcugagguuugcugcaucucuguccuuauucccuuccagacuggauuggcugaaccagguguccacucuuuuuggcccauggcauaaagaaggguuugggcaacccagugugccccagguuguuaccgcccccccgccuccgcccccacccagccuuugaugggcccccuucucaucaauccaucaccccugcacaugccaccaggacugccuggaccagagcccgggacucucugaaacccacugagagcucggcccugggaaugggccucccaaucucggucuccagggggugggccccaggucccuagucuuccucagggucuucuccacuguucugccuccucuccugauacccaguuccuagccggggugaccccagccucccguaacagccuccuugugguggugcugggaagaaggggcccguguacccggcagggccccccaggcaaugggcaugagcgcaggcagggaaauccgucagccuccagggacgcucucccuacagccccggcgaggggaucgggucguggcgaccucuccagacgcccaggggcugggcaggagggcgggccaaggcccgcaggugggggcgccaaagccaggcgggcgcggaguacgugcggugggcugcgggcggcaugaagggcgcgggcggccagcuccggcuccggcuccggcuccggcucccgcgaggccggguagccugggcguucccaggggucgcagaggacggcgaaccccggcggagccaccggagcuggggaccaggacgcaggcaggcguguggagcgugagguggggacguggcggcggcucaagugggcggagccccggcagcggcccgaggcggagucgccaagggaggaggcgccgagcugaccgggcgacgccgcgggagguucuggaaacgccgggagcugcgaguguccaggugagcgccccgcccgcucagccgccagaucaaccuuagcgcuggggcgcgggcuggggucgccaggcggugcguucugcccgcgcggggcugagaguuaggggccggggccggauccggggccgggggucgcgccgcuagccgccagcagcgcaguccgggccgccacccugcacccuccgcccuguuucugcacccgucuggguucuugugccgccgcccgcaagccuucccgagcucaggguggugaggucagcggcgcccuucgugcaguucccucggcugucgggcggggcugggaacuuggccgcucuucccugucaggcucccgggaaguggcggccugaccccgggcugccggcuguugggagcgggggcgcggcguccgccuggcccugaggggccucuucauauuggcuaagcccguucugcacccucccaagggcugggaguccuaggucuuguccgggcaggguccagcuuggagcccauuagaugggccauuggaucagaaagucuuuucucccccagacauccuuguggaaccagcguuguuuuuccuuggcagcugcggagacccgugauaauucguuaacuaauucaacaaacgggacccuucugugugccagaaaccgcaagcaguugcuaacccagugggacaggcggauuggaagagcgggaagguccuggcccagagcaguguggugagcgcugugcuggaagggaaugcgggcaguggguacuugguagagcacugacugccuccggccagaggacuucccggaggaggugacccaugagcuggaguggucagaggaaggcuggcaaaagggcaucguggacagaggaacagccuaugugagugggagcagagaccuuggccaaugccauuccuuauggccuuguaguggaagcaaggugauggggaaggaacacuguaggggauagcuguccacggacgcugucuacaagacccuggagugagauaacgugccugguacugugcccugcauguguaagaugcccaguugaccuucgcagcaggagccuggaucagggcacuuccugccucagguauugcuggacagcccaggugggucccuggccuuuguauucuauuugacuuuaagauggugcaggagaauacaaaaaacuauccgggcaugguggcgcgcgccuguagucccagcuacucgggaggcuaaggcaggagaaucgcuugaaccugggaggcagagguugcagugagccaagaucgugccacugcacuccagccugggagacagagcgagacuccaucuuaaaaaaaaaauaaaaaagagagauggugcaggagagcauugggaucccucccaagacugugacuguugucuuuugcuguagagugacacccgagauuugugcuucuugauaauagacuaccuggggccucacagccccagcccucuuguaggaaauccuguccuaggagcaagggcuggaguccguuacguuguagcuuggggcauucuuaaaugucccagacuuuguggagauccauuguccaccuaagaauuuauaggauguuuuuggggucugcugcuuguucucagccugugucucaucugacauuagguuccauaauuuagucucuguuaaaugaacuaggauuuccuuuggcuuguacuuaaacugccccugagguguccaaggugcagccucucacugugguucugggccucagcgcccagucucucugguugcuucuccccacucacagaauguuuggucuuugaauucuuuucuuuuagggccuccuuguucuuacacagccgaguguccacuguguggcccagccaaugaagccacguagcaaggauggagugaguuggcugggggccucaucccaaagaugcugucauacuggaucacccuaguucucugagagcucagcaggcagacuuggugacagcuuagcugaggcauugucuguggcaugugauaggcccuuguauccugucgaaagcucugcauugggguacucuagacagugcuuacuuagucaccgguuuagacuggccccagcugaucucaguucaucccuugagugccuucugccuguuuggcuucugacuggagcgugccuggggcuagaaugagggacgagagagaggagguggccgaggcacuauucuugccuguggguagcucguacucugagauugcugcuucauauuggcagcuggccaugugccaggggaggagcccggcugugagugcucaucaaaggaagagacuacgugggugcagcucugaggaaugagucgguugagggaaucuagggucuccucauuuccuaagaaggccucccuuuuucacucugcccucccacauccuugggagggucugagacuggaagcaaggccuuggcugauguguggccacgcuggcugauagugugcagagggcuaggaggugugucccuggcuccuggggucugucaagaguuuacuauuaugcagauggaaguuggcaggaaaagcugugaugcaaguacaugcaagcccagcagagugcuggagugagaguuaaacuucgggaaaguugcucacaucuagcaauuuggacauuugaaguuccuuaggguaagacaucagccuguccuagagcaaagagggcuggaagguccuguggucugugggcuuuguguuacggacauggaaugagagauagaaagacaguuuuuuuuuuuuuuuuuuuuccucagagcagaggagaaugaaaagucuggaugauuuacuggagcccuagaagagaguucuuguucagcuggugucauugcagggcagaggauuaaguguuuggguagagugcucuccagcucagauggaaucuaucugagccugguaacaggccagcaucugcucuggaccuuucaggaagugcuugcuuagaguguggccuguuuuguaccuggcacucugagggccaggguguaguggagauccucaggccuggguacuuguaggagccuggaaugagcaggucagaggcauauaaguacaugaguuccuagaguauugguccaaucccccgccuuuugcuagagaacauugcuugaugagcuuuagagccagugauugaccaguuccaggguuauccccugaugaucaauguacuacauuauaccugauuccagucucuccugaauuaaauguuucauuucuuguggugcuccuggaacauggagaucgcccaauuucugccuuguuugcaucuucacuguucccuagucuggaccuucuuucucacccaggaaucagcugacuugggcugggcagcuggcugccucagguccacugauguuucucuggugcccuugguacuaaugauugacauaaauuaugccuagugcagggcuaccugccaacaucugucaucacauucaguccuccaacagcccuaugagauauagguccuaguauugucucuauuauauacauggggaaacugaggaauccuauaacuuguccaaggucacaaagccgggaagugguauagaauugggguuuaacucuuaguaugucugacccuagggcaggugugccuguccauuugacuguacugccuugcccugagcuggacuggcugguuauuugugagugcugucaugucuaagguaggagugacugcccaucugaacuuaagggaccauguugcuguuuucuggguccauguugcguuccucccucuggugagauccagccaggcgugucauggaccugcuuuaugaaccuuugguguaacccaugauaaaguccuuaaccugggcaggcauguucuuccugggcaaaguguggcuucccuguuugggaguccauugcacuuuaagguaacagauuauugaguaggacuggauagcugcaauaucuagcagaguguguuuuggguuugacucuugguucugucauugauuugcugucagaugucagauauguaggaaaccuucucucagccucagcuguuugucauuuguaucuaucuuauaucugaaauggagguaguuaucuagcuuagaagguuugggugagaauuagauaguagaaaugaaagauuuuuggaaacaaauagugcuuaucucagacuauguucccaggaaacagccugagacagagcuuaaguacuuaaugcuuuauuggaagguguaauugcagggcagccagggugagggaaaacaaaagugaggugcaggccugugcgauggcucaugccuauaaucccagcacuuugggaggucgagauggauggauugccugaggucaggaguuuaagaccagcuggccaauauggugaaaccccaucucuacuaaaaauacaaaaauuagcugggcaugguggcacacaccuguaguccaagcuacucaggaggcugaggcaggagaaucccuugaaccugggaaguggagguugcauugagccaauauugugccacugcacuccagccugggcgacagagcgagacugucucaaaaaaacaaaagaaaaaagugagguauaaaggaggaugggaggugguguuuuagcaagcuggcuacucugcacagagauguacuugguuacccuaugagggcccuuugguagccacuggggaggccagucugguacuucaacagagucuggagauagugagaggagccagagauucuggcgugggccuggauagucuccuccacugggcugaggcaaaguaaauacccugggaccugggagaugggugagaccaagagguugcaaggugggacguaagaugcauccaauauagugguauauggauuuuauccucaaguguaguucccuuuuguggguuagucucauccagacugccaagucucugccaagacuaugacugaaaacccaacuuggcuuuugcaugucaguuuuaacagccuucucugcuacuucauugucuaguuacugaagcaagacuuugugguggugaugguacccagguggggaaguggaagucaaccacuauucauguaccagacugagaaaguauguggauagauacagauaaacaucuuggcuuuauuagguucuucgugaaggagaauauuuuuucacauaaaguaguuguugaagauacgaaaccuggcauggugagaugaggcuagagagggcaguagggccuggucacacacucaaaaggacccuuugggcuaaagaguuugaacuuuaucuugacggcaguagagagccaaaggagggcuuugauaaaccaugcuggcuacuuuguagagcagaggugggaggaaggccagaugacauguggagaggccaguguagugggggccaggaugccuguaggggaaguuagggguggcucagaucagggugaugacugaggcuaaggagaguaggguaccccccauacuugccuagggugccguggcagcagcuuauaggccugaauggacauccaugugcuuugguggcagggucuccuggagccucuggauccucuuaggcugaacacacagguccuuucagcccuguuauccuagaguuggaggcagcggggagccguguccaguuagguuuucccccuucacagaaggcaggcagguucuuguucagugccaagcaagaccaguuuguucucagcaagcucauguucugucucuaggcuguuaaauacauuguuaaaacucaggcuguugcauuuggguugcagcugggagcuuggcagagauucugccugaugagguaaggagagaagcuaaggacgcugcugguuugcagcuggaaacaucuuuucauggccauuuggccagauuguaaaugucuuuuccaaaguucagguuuggugggaccucugguuguaugucuuggaauugcccuguguuuagaaacagugccagucgccugaugggugaaucacuguugcugggauguuggcagguuuugcaggacuuuccuguggggguccaaacacuagggcuggcagggcccguuuggagucuguuugagaagggccugcuuuguuuucuuuacauuuuaagcauaugauaaaauaauuuuaaaaauugcuauagaauuucuuguagaaagauuagagaaacaagcauaaaaauaaaaagaaauuauuucaccaagauauagccagauguaugacucuuuucuugcaucucucuauauacacauauacauuaauuuuuccuuacaaaaauggaauuauagagugcauauuauuggggcccacuuuucucacuuaacaguaugcuuagaucucuucauguugauauauaguauucauuuuuaauauacuccauaaaaacucauuguauagaagaaauguaaaaucuucuauuguuguaguuuccuaauuugaacaagucuguggugaaguauuuuuuguuguguuccugguaugggacagacauuguucuaaacucuggggaugcagcacagauaaaacucaguauugguuuucugcucaagaugucacuuuguuuuucauaaaaguggguuugacauuguucaccuccagacuuauuccaguuggauucugaggguuucugggagggcuuuuagcagcacuggacacuuuguaggggcacucagcagguacacauacuuucaccuacucugucuuaagcaagcugugggcauaguuaugagauggguuggagguuggccuuucccacauuguggggcacagucccucucggaugcugccuccucccaaucugacucuaauuagaggacuuuuuguacagagccuuuugaguuaaggggcccaggcuugggagaaaugggguagggcuccagaguaccccugccagagaugucaguguugaugugguagucugggagcugcugcuuggaggugcccagcucuccaggcuagcagaguuaguuauccccuucucccaccagagcaagacuuugcaggcucuugguagguaagucaucuguaauuaccugugauucuuugaggcucugcccaaaccccaucugugauucuuugaggcucugcccaaacccuaucugugauucuuugaggcucugccuccaggcugagauucaagaaugggcucagucuaagccagaucgcacauuccagagaaaucacagcugguauucauguaaugaagaaaccuggcuuucccugaguguugugagguaugaaccguagaugauaggagcagaaugauuugaaaggaauggacagacuuccucccuggaauuuaucuggccucuaaaaagguaugcaacugcaacuggagacacaccuggguagagaugcuggguuccccacuuccaaccaugucugguuuggaaccugccugggcccuguucucccaccaccccagcucugaggagcagucagcuggucccuuucugaucacagauacauccucccagcucuauguuuucacuguccccucccuacauacauacagaaggugcugagccugagccagucaagccuuuugaggaacaagaaacagacacccaaucccuuagguauaaggggcuuguguaagcaagagagaagccuucugaaauccugggauagagaagacaguauaguaaggccuuggagcagaccuguggcuagaaccaggagggccuggacucugccucagggcaagcccaggcuuacucacuuucucuugaugacuugcucucuucugcugcucuaacucccuaauggaccccuuagcacaauacgcccuacccugcagcagguuccagguuggaagauaauuguccugugugucuugggacccccacaccuagacuaugacaggaagacugucagcucugcagacauuuggcauaggcaugaacacauggcgccauucacuuaugcuuuccuucugauagaggauccauuugcagaugggaguugugguuggccuucucugagccuaaccuggaaucucaauggauuaggauuucuucugaaagaguaagaugaggaauggugggugugcugugugucuaaucaaguauggcgggcaaaaaacugaugaacuggcauuaucuuagacuuagaauucugucagauaaggcuuauguuuuuuugggaaagcauuuguauuuccuuuguuuugcuugcuuugucuuagugaauuuccauuugagcacuccaguggggugcucaaaagcagggcaggaagaagaccggcagagcugggguacagaugggugcuaauccuccagcacagucuaggcugcauggcugagcugggagacgguaucggaggcuucuguuguggacugagguuuacugccagugggguuugucucagguugugccuauuucugggcugaugagaagacaguagcuggccccuuucccaugucagcagcccagccugagguuuuggccaugugugccauauucauuuuuguauccugagugccuagaucagugccuggcaucugcaggucuucaguaaauauuugugaaugaauggugacgggccagugagaacagugucugccaaggagccuuacuacaggaagaacacugucuaccuaggagacugucuccucugacugcucuuucucuggcaggugcagacugacaaggguuaguuuuauuccucuucuggcuggccaucuguuguacaccuuaguuuggguguugguacucuggaggauauugugucaaauuaucuuucuguuauugucucucauguacuguugccuccuugugggcagggacugguuccccaaaaccuggcacuguccuggcauauguguuggaagguaagauagaaacaaacagcagucugugaaauaagaaggagugggccagaaucuuggacugacagaccauuggaacccgagcugacuguaccccacugcgauuccgccuucucaugguacaggugguugcugggaguugagaggaugggcucucuccgcagggcacgugacuucccagagcagggaccagaauugagcacacaucacuggcugcacgcucuuuguucuuucugcuguuuguccuuuuuagcuucugugugcuaggccaggauuuugauauguuugauuaucugcauauguguguacaugccuaugugucuccucaccuaaauuagucuuuuucacuuuguugauccagugauugucauugaaugccuuucagacacuucccucugugaccaugaaacucugggugucugcauugcugauggccugguuugguguccugagcugugugcaggccgaauucuucaccucuauugguacgugccaacaggacugucgucucccugacaccuuggcucacaugccacggaugucucuggcugcagccuguucucauuuagagugggauagccuuaacuacugguuuuggccaguucugaggagaguggaacuggcagaguugcuguuuuccccuauaagaucccaaugaucuggauguucagggagccagaugucugaauugggucuuucuuccugggaagugcaggcugcacuugggcucucuggucuuuuugaccaccuugcccauggaccagagagugguucugagcagcaaauccuuuguauccugaggaucaagcuuuuccuauccuuccgaccuaaaguucagagcuuuuuauccuguggugagcccccaggauauccaugccccagugucaugaccagcuauguaacagucggagaaugagauuuagggcugcuucuugagugacauccagugcacuuaucucaaacauccccuuggugccucugccucuuucuuccugaaguugcgagauagagccccaugagugccuaggcccccuuuaacuccaaguccccauaauccucagagagcugacauguucuuaucccaggggacuugcuucugugcugguauucugugccccaaggaaggaggcuggacaucccucaucuguuucucacuggugucuuucuucucucccuugcagggcacaugacugaccugauuuaugcagagaaagagcuggugcagucucugaaagaguacauccuuguggaggaagccaagcuuuccaagauuaagagguguccuaaguccccaaccauccuuaguuggccuuccuucccuucugccccucaaggaacaaggaagccauccagggugccuauaagaggaaaccuuugagagggugauguggggcuggccugguuacuucaugccagugcuugagaggagcuaaguacaugggcuaaggagucacuguuuauuuucuauuuaagaccuuuucccuuacauugggggucccagcuguuaucuagauuaaggggcuagaaguaucuguggggaguuacuguauucauuuuucauugccucuugaugaaaagggccccagaaccuggcaccagggaauucucacuaggaaaauugucacaggucaagaccuauguggguggacgcauuagucuuccuuuuccucugguuccacagcugggccaacaaaauggaagccuugacuagcaagucagcugcugaugcugagggcuaccuggcucacccugugaaugccuacaaacuggugaagcggcuaaacacagacuggccugcgcuggaggaccuuguccugcaggacucagcugcaggugagggacggugagcaggugcuugagugagcccauauguuugugugcucaugccuggguuguugugucugagccugucuugggucuggguguuggugggcaaguacauuguggaaacaggacccugcuggucucauggcucucucccuucucuguggggaccuggaaguuggcuggccuugguuuuuaacauguaaugauguucaguucuuuuuuuagcgucuuuuuuuuagugucugucuuuucuuauuuuuugcuaaugacauuuuuccaauuauacuuuagugauacauguuuauagaaaagucggaaaacacaaaaacaagagaauuauaauucuuaauccaguugcccaguggugagcauuauuaaaauuguaguuuuucuaccuaugcauauacauuuaaaaaauggaacuauacauacauaccagggcaugcaaacucaguugcuuggagggacaaugaauuuacaagugucaagugggcuggaugguggggccagggcaaguuggggagcauaggucugaucuaaauucauuccuauucauauguuuuacaaacaaagcauaucuguugguagauuugugacagaagaaaaaauucugugaauuucucagcuucuuuauaugccauucaauguucuucugcaacaugauuuuaauggcuggauggugauuaccugucagauggugauaaucugucauacugauaauacugucaaaugggucaagucauuggauaugggauuuuuucugaauuaucagcaccuuuuuacauauuucuugguguauacuucugauuacuuuuuuaggguaaguuccuagaagugauauuaccgaugagagugugaacuuuuuaaaagcuuuaaacuauacuuggugcuuuuauugugauaauacuuuuuaugcccuaauacuuuucugucaauaagaagagaugguacggugggccuggaggugggcucuccuaacuccuagcccuggguuuaguccccuggacucacugacuuuuuuuuuuuuuuuuuuuuuuuuugagacugagucucacucugucaccaggcuggaguguaguggcgggaucucggcucacugcaaccucugccuccggguucaagcaauucuucugccucagccuccugacuagcugggacuauaggcacaugccaccaugcccagcuaauuuuuuuuugguauuuuuaguagagacaggguuucaccauguuggcuaggauguucuugaucucuugaccucgugauccacccaucuccaccucccaaagugcugggauuacaggugugagccaccaugcccgcugccuuuuuuuuuuuuuuuuuuuuuuuuuuuaaagggacagggucucacuauauuagccuagacuggagugcaguggcuauucacaggugcgauuguagcacacugcaaccuuggacuccuggccucacgugauccuccugccucagccuccugaguagcugggacuauaggcacagugccauuguacccagcucuucacugccucuuuucccugagcugugagugcugauuaacuucagacuagcugucucucuggcugagacauuuuagcccauguggccagacuggguugggccugggggcaggguggccucuggagagggauuggugagcucagccaggcuggagcugugcccagugagcucacugccuccagaaaccacggcugccuuucccagacucccgccucuccgccugggccugcagcucgggacaggcuguucugccugcacggcaggagacuaagccuacccagaugaccuccucucuccaaucuuguucuccacacccuacacucccaccaucaucugguuccuuuggaaaaccuuaugauuaccuggaaggagauagggcaggcccagagaauaauugguuguuuucaucucugacuuugaguucuugccccugaaacgagcagggcaugcugacaguguggcuuuuccuggcagcauguuccccuacucccaccccaccagauucuaaacucuuuagagucccugaccauguagcuaugaagacaaggaaggcaggguuacagcuucuuggucccuguccccaguuauggcugaaguggauguuuaggucugaagucauagguggcaguggauacagcuacucuugggaagagguuggggaaggaauggccuuguuguuccccucucacuucucagcuuagaggcagaauugaaggcccuaagucagccugggaaggcuuggcucccaccugggauuguaggagguacacaucuuacuuuacagcuagggcuuggagucccagaaaagccuccuuggaguacuucuguggucaaaagcucucccacgcuucaggcuguggucuugagcaccauaacuggagagcccaugcccugaacucauugaaggucugaguggugggaguacagaggagaacaggcccaccguggucucuuaggggacggaccuugcuggguuggugcaaccccaccuugguccuuggccugucuaggugguccuucagcugucaaccuagggggagggggaugacuuccaggacuuucaucaucaccuuucuggaugauaagugccaguggucaguaaugaguggccagcucggcuucauuaguuaacugucauugucccuuggacuccucaacuugaaaugugugcuggaagucuguguuuaccugacuagcccaauuacccuggaucaagguuuuccaugggauuuauuuuccacugagugguugacaguucuuccugaguccucucccgugcucuucucaguuacccucucuauccucuguuucuucugucuccaccagcucugacugaaugauuuggagccaagacuucuggacuccuaaauauuaaccaauauggggggcugcuucuacuuaguuccaaagagcaacacaggcaguagguauggugaggaguaagaaaggaaaaguccccauagacuggagucaucagggacaacuuccugguggaagggggcaacagccuuugagggagggggcggggaaauuucacuagccagagacccucuuuguggcugccucucuggucccaaguggaauucugccccuggaucaaggguaaucucuuguucugacucucauuuggaagguuuuaucgccaaccucucugugcagcggcaguucuuccccacugaugaggacgagauaggagcugccaaagcccugaugagacuucaggacacauacaggcuggacccaggcacaauuuccagaggggaacuuccagguaacucaccacuccaggcguugccugucccgcaugugucucuuuaguggcgggacagguuggagccaccaccaacuuguggccuuuaaccucgggugcaccucuggugcaccucuuggcucaccaguuugugcuggacucccucucccaugacagguuucucccucagccccugcccugccaccucccuccauguauuagccaaggcccucuccucuugcaucucagagaaagccaaaguugcugcucaggaacccccuccacgucuguccccagagcaccacacagaucugcauucagaccugcuucuugucucccacccuccaaugucuuuucaucuaaggcugaucugggcuuacuaucccccugucuugaguccucuuaguuacagucucugcuccuauacauucugucuccaccucucuggguucuacccuugagcucccauauaggcucuauucuugcucaucuuaacacuugccucccucgguaucugagagucuuucgagucuuugcugcugauucaucucuucuccccuccugguuaggcuacuggauagaguaaucuacacucuguccauuuuccugguucccauauacuccugaacucacaguaucuggccuuuuuccccacugucacugaugcuguucuuacaaggucaucaguggccgcuuggcugguaaacccagcgaacaagguucacacauaauguucuuuaacuucccagcagcauuugacagauagauugccucauucuuugugauguucucuccuccuuugaauucuggcauacugauaucugcuucucuuuuagccucucuggucauuuucucucaaguggccccucucccacugacuucccaguguuaguguuuauaagaagauguuuugagggcugcuggagacaaguaaccccagcgauucacugugugaggcucaugcagacccagcuuauuccagcuccagaaccucagcugcccccuuuagacuccauuagagagagggcaguucagggcaccugcaagaucuguucacucuguagccuugagauugguugcuuggaggagggaaccauacccuggcguugaccucucacguucacucagcaaacccaugaguguccugaauaggguuauggggcagaaaggaauuacucccuaggacuccauccuuaccucaucuucucccugagcaccuuccccaggugagcacagccauuuccaucaccugagguggaugacauccagaucuguguuucuugccaaggcuugucucccgagcuucuaaccaguguagacggaugccuuugggacaucuguacuugaaugucccauggacuucucgaacuucauguguccugaacugaaauccucaucuccuuguaaacacuuuaccuucccccucauccuucuaucucagcaaaaaggaccuccauccucuggcugccuaagccagaagccuaaggccuauggauucuaccuccuucucucaugucuuccgugcuuauccccugacuccagccucacagcuacuuuuuucucaauuugauuaucaaaauaccauucugacuugucuccuaccuccagcuuacugcuuaagaccauccuccauguggucuuaagcacacauuuguucacaugaguuccugauuacugugcuuaauuuccaaagcuaaacccaaacuccuccuguguguggucuuugggguccugcaugacuccauuuuccuggcuuccuugcccauuguacucagcuuucccuaucacucagcucuuuugucucaaccccucuauaggaauaccuuuacccaugucagcuaggcuacuccaugucugauugccuaucagcacucagcucagcugucacucucccaaaugcucuccagggaguagacauucgaguuggcucuggggaggaugcugagugccagggagccauucuuagcauucuuggcaucugggagacauguugauaauagcuacuggucauuagcauccuggggagcauaggagacaucuucauaugucaucuuauugaauucuugccacaagcucuuuaaaauugaugauauuaucuuuauuuagagauaaggggacugagacuuagauaugguaacuugucuauagucacacagcugguuggcgcccuagugaggccaacacaaaccuaguuuaguucagcuccagagccccagcucagucagcuauguuacucugccccagcaauguagguuccugggccugcagagccagaggagaccuguggagaaggaaaaggggcuccaggagccccccagucccuggccuaccuagggacuucaucuuguguuuacuguccccaacuuccuauuccucguuauugguuccugagccaccgggguuagcagacccuggucucugaagcauuuagccuacuguguagugguuucauuccaggcagaaagagccuucucugaguucuuuugugucagccaugcccagguugcuguuaauggggcuguggggagucuuccuugcuuuccagggagagucacagcccccacuuccccuccaugguaucugcuuucucauuauucucugaggaaccacacacauagucuuucccaucuugagcucacccuaaauccugcaucucccuauagcugcuucuucauauuggcuugaaacuaucuucauggucacuuuccagcacucccucuacagcagaugaccuuuggucauaagacccacugaacugauacucagcaaggucccugccacuuaacagccaaagcuggcacugcaaccuuggcucuuggccucccuuggugucucucacaccacucccgcucccucuguuucuccuaucuuuaguucauucucaggguuauucauugucuguucuuucuggguaggugcucccuggagcucuggccuuagucaucuucuccauucuuuccucagaguuccugcaagcuauuuuccucacccauggcuugguugccaccuaaauuuauguuuuuuauauucagcuaauuuuuccauccucuagacucauauggcaaacugcccaccagacaucuucuucucugugguccacaggaccuucccacuguccucaacaaugcuuccugguggguuucuggggcucccccuaaaaaggccccuucccacuugggagauggggaaucugaggcuaagagguggcugugaaccccaguccagggcagggcugggccaucugucugugcucacugugucaguggcccuuuaggauaugcagucuaaauguccgauggaguucugcuuggugaugcccccuauccaguggcucaggcuuuccuugaagugggaaucucuuucccuaauccagaggcucuuuggagccugacaauuuacuuccccugcuguaggaaccaaguaccaggcaaugcugaguguggaugacugcuuugggaugggccgcucggccuacaaugaaggggacuauuaucauacgguguuguggauggagcaggugcuaaagcagcuugaugccggggaggaggccaccacaaccaagucacaggugcuggacuaccucagcuaugcugucuuccaguugggugaucugcaccgugcccuggagcucacccgccgccugcucucccuugguaaggagauucuaggggaagguaagaugggaauggagaguggcagaggaacugcacugugcuggcaucugccugaccccucuccugggacugagucaguuuacccugucacuuggccagugacuaaugccuuacugacuuuaggaccaguccagcuucuuacuagcuccuuacccaccucaauccuggccuuagguuugcgcagucgcugauagauacgcucaggccuguggcacuugugggccuuuuuaauaaggacucuguuaugguguaucugucaccaugcaggacuacacaggguggaaccuuuacuacaucaggagcagcucaggagucagguuguacuuuaggauuguuacagugacaaacaguagcggugcuauuagaggccugaggucuaauaguaggacuucauauggcauugauacuuugugugccuugugcuguuggacugaagaaggccaaaagcacugugccuuuaaaacucaucuaccuuuuuuuuuuuuuuuuuuugagacagagucucacucauccagccuggagagcaguggcacgaucucagcucacuguaaccuccgccucccggguugaugagauuuuccugccucagccucccagguggcugggauuacagaggcacaugccccauguuguauuuucuuuaguagagaugagguuuuaccauguuggucaggcuggucucgaacucgugaccucacgugauccacccgccucggccucccaaagugcugggauugcagguaugagccaccgcaccuggccucuguugguuuuccaguuacgaccagcguacucugguuagaugcuguggaagguagaaugcagcaugcaggugagcugcugggagagaaacccuuacagaauaauuucucuaaaugaccuaacagauguuugugguuuccuuuuccuucucauuccuugcauuuucuagacccaagccacgaacgagcuggagggaaucugcgguacuuugagcaguuauuggaggaagagagagaaaaaacguuaacaaaucagacagaagcugagcuagcaaccccagaaggcaucuaugagaggccuguggacuaccugccugagagggauguuuacgagagccucugucguggggagggugucaaacuggugagaugugugagggggcuagggugccaaagcuguggaccuggacucuggcucugggcaggcagauuuggggaagguguucuuuauucuguagguacuuuucucaguauaucccccaguuuuucauggcaucuccugaggcugacauguggauauucucugagguguaggaaaggagacucucuccccucgugccccagguagaguguugcuccucuaaguuaccagugagcucgccuccuuaccccaauaugucccacuuuuugcuucacucacuguugggaagaaaacaauggguggacguaccucaggccccaaaagaagucaugguauaaguggagaguaagucucugugguaaagacaccagcguguacuagagcuugguaucgagccuuugagagcccugggauccuagugcuuccugaggaggcccaggugugacaggcucugagccuuuuccaugccccugucugcauggcuucuacuggcuccuccaccaagaaagguuucuccccugucccagcccuucagaccuacucaagucuucacgaaaagggucaggaauuacuuucugccaugggacuugaggaugugaggugauuuugggagagaagaaaaauugcaugauuugugggguguuauuucaugccaguuaagcugaaggggcucuccucuccucuccccuccccccauuccccccucuccuccccucccccccuccccucccccuccccucccccuccccucccccuucuccuccucucuccuccccucccucccucccuuccuuucuuccuuccuuuuucuucucuuuuuccuguuuccucuuuuuccuuuucuuuucuuucuuucgucucacccugucgcccaggcuggugugcagugguauaaucauagcucacugcagcuuugaccucccagccuugagcaauccuccugccucagucuccugaguagcugggacuacagguaugcaccaucaugccuggcuaauuuuuuagagacaggucuaugucaucuaggcuggucccaaacuccuggucucaagcuauccuuuggccccccagaguucucggauuacaggcaugagccacugugcaugcccaccugcugggacuuuuguuuucuucugugguguggugggagggagcagcugcuggccaugaggugaguccagugucugcagacagccagacugggaccgaggauuaggacucacucagcucagggccuguuacucugugcuuuccagacaccccguagacagaagaggcuuuucuguagguaccaccauggcaacagggccccacagcugcucauugcccccuucaaagaggaggacgagugggacagcccgcacaucgucagguacuacgaugucaugucugaugaggaaaucgagaggaucaaggagaucgcaaaaccuaaaguaggugucacuguagguccuucucgggucacugaagggggaagguccuuuuucucaucccuagcacuaugggugguugguuugcccaucuagccacccuuuauccauaucuagcaugggccuaccguggggauacagagaugcuucagacucagccugaccuugugaguucaugguccaguggaagaagaacaggguaaccaauguggacagccaagugcuaucauagaaggucacgcugggaacagggcaggucuacacuggugugucaguucaccugguugggagacuggugcgugggugaguuuuuuggaaauguuccauaggaugcuaugaagcuggguccuguggagcuccugauuaggacuguaaaugaggugaaugacuuagaggagaauguauaucuuuauaauauugggucuucucauccaagggcaugacaggucucuccauaucuuuuuaaguuuucuucauauaagccuugaacauuucuuaaguuuauuccuugguaguuucuuuguuacuguuaauuuacuuuauuucuucauuauuauuuuuaacugguuacauuauuuuauuaguuuacuauuauaugccaaacuauugauuuuacaaauacauuucauaguaagagcuaauguuuacugaauucuuaacuguggcaggaacuucuaagugcuuaacauauauauuaaguguuaugucacaguuaugaacagcugcucauaaugaugucacugucucuguuuuaccuaugaaaaagcaaacucauacagauugcagcuagugguugaauuuacuuauuucuuuuuugguuuuuagcugauuucucuuugguugccuggauagcauuaacaccuggaaauaaggaaaauuuuauuuucuccugauacuuguaguuccuuuguuuuuauaaccuuauugaauugcccagaacuucuagagcauaauuacguagaauaggcauccuugucucauuccugaauuuccuggaaauuccuaugguauuuuacugcuaagaaugcaguuggcuguugguuuuguauauaugccauguuuuaaaauuauucuucuguuucuaguucauaaaagauuuguuccccauuugacaucuuucaaagagaccuauuugcugccauaucccaucacugaugauugggagggaggauuuagcucgauucucuauugcucugcuccuaauagaauuguaggggccgaggugaccaggaggcccgacacucauggagagaccugaaauagguuccuauccuggccccuggaccucaucuuggaacagcuuuggcuugagguacuaggacaucuagggcuuugagucagugguuggcaucaucgauguggcugaggaagggggcuagccagauauauggagaauggggacuaggacuccccuuucuacucagcuccagaguccuccaggaaagaaaacuacuuuguugguugugccaggauuuccugagagauuucuuacccguucuucaguuccagacacugagaacauuucucugugcaugugugcauauguguacacauguguguggcuggccagaggguaguguuaggaaaagauauauuugaauagaagccaugcaaagagccaaacaagguuggcaaacauguuuggcucuuaacauggcuucuauucaaagauaagcugaccccuccuuuccggagacugugagggacagaugcuauucuggcuuugaaguagagccaaugagcuuaacuuggccuguggggaaugccuggcagcugucuguggggucucuggccugcuuucaaaauagcccugugcuuccccuggggcagagcacagcugcucagagccucuuugugggugucaggccaaugcugaggcacagauguuuggauggggucuggcuguggcugcaguuuucagggagggacugacaugagcugaagcucaggaagggccaugaguaggagcuugggagccgucuguccugcuugugcuggccaucuuaccagaucaugccauagcagcacaguguccaaguugguccaucucacccccuuacuagccuucugguccaucuacuccucuccaucccuucugccaccaccuggcccgggccaccaucaucucuugcccugaccucugucguggccucacuagccucccaguccccacucuggccccucauuagucaacucuccaugagguauucacagugauccauuuuacauucacauuuugagugucccuccccugcauaaagccuuccccauuucucguuggccacaagguugcaucuaguuccuagccccugcuugucucuucagccuguucucucuuacuacuucccauaaccuuuaauccacaccuacugcaacacccauuuucauucccaggccucuggauugcugcucuuucccuguuccuguaauguuccucuacuuggauaacucauguuaacccuucaggccucagcuagguggucuccuccccuaggaagcuauucuugacacuauacccugagcuuccacaggaugguaaguucacccaugcugugcugcaguuaccugacugguuuucugcuuuccccacuugacugaguuguaagagugcaggggccaugucucaguuaccuagcauagugccaggcacaaaguaggcacucaucaauauuuauugaaaucaaggggaaguguguuggggugggaguaccugggccuauggccccacccaugugaggucaugaggacaguccacagcugaagcacauggaccuuugccauguuggcuggcucugggcggcgagucccccuugggguuucacuaagccuaacuguggaggcugggggagaugaaguagaugcagggagugcauguguaguguguaccuguaugaguggguggcuuccaggcagugguucacuuauuuuaacuuacagaaucuuuuccugguuuuaucaucugacuuguaaggaucccaagggagcgaaaacugugccaucugucuuugcuucuugaggcugugggaacccagugugagguggugcagcaggagaguguuuggauggguuucuuggcagaggagcccacugagguucggaaggaugguggaacuugacucaauugagagaaguacauaaggcggaggcucaggcaugguggcacagucugaaaauggugggaguagcuaagcucaggcaggcugugcucaggcaggggugguaugugggccuggcaaggaaaggggcuagucaggcagaugcauggguagacaaggcaggcauaauucugcaggcaaagcggaccuggggaggagaagggaugagcagugaccgagcagggcaauagccaggaacugauugcggauugggaauguggaggccucagacucuugcccucaacuggccugcaggaucuuggggccuuggcuagagccauuggcugcaaagcuuccuccacuagcauggcaguaaaucuggucccagugcucucugggaaaauauucaaggcaaaacaaacaaacaaacaaaucaagucuucccucuccuccuuccuucuagcuugcacgagccaccguucgugaucccaagacaggaguccucacugucgccagcuaccggguuuccaaaagguaagcaaagagcagggguucguagcugcucaagccccaacuucaggacuucucagugccuacccuagggauggguggcuugccuuuuccugccugcuggcaccuccucacccccuugcagcaggcauccuguacugccuguucaugcuggcccugacucuggggacagaguucaggaccucauggaagccugcccuuccgucuucuuuucucugcccuuuucuuuuugcccagcuccuggcuagaggaagaugaugacccuguuguggcccgaguaaaucgucggaugcagcauaucacaggguuaacaguaaagacugcagaauuguuacagguacagauaguaccugggacuguaggaguugggaaguggguauuuguggcuagauggucucacaggguguccagaacugggccaagaggcccaacuguaugacuacugccugaugcuaugaauauggagugaucucauuuuaggaaaccagaauuaaucaugccugcuggcuuucaacaauuaguguucaacaaauaucuauugagcaucugcugugugcccaagugugcugcaagcuagggaucagggguaguuaugguagguucguucaugucuucuugacaacagaagcucaaauccugaauggucucagggacaucucuaagagagcuaaaaaugacuucagaggccaugguucugugucauaaucaaauacauuugaaggucaaaguauucuguguguuuucuccugcugaaccacaacugaaguugcuccaaaagcagcagcaggggacuucccaugagggacugccaagauggggucaguugagaauucaaagaaagcggcacuaaaccccugggucuucaguccacagcauuuauuagggaacuugcagagugggcugcagcaauccucaaaauggacagcaagagacaagaauuguuuuaccuaaguauuuccacagugagggagucagaguguggaguuuauuugaggguuuagggaauuugguucagggcuggggcuaguuucuuucaguguuaugggcaacaaccuaaacaccuucaucagugccugggaauguugaagacuccagcuuguguuccagccugaagggaaaaaccugcagcuggcugggucacagagcugucaagggagucugauuuucagucagaacaaagaaagaaaggcggggugggucugggggaccuuacacugugauauguagguggaagugagaggccuggacugguuaagcuggugcagguggaauguucuuguccaaguacucccacugggacccuggcuuccugccuuuauucagaggugauuuugaagaaauguggcagcacccugcugaaagguuuuggguaaagcuccuuauuaaaguauccucuuggguaaagcuuaguaaaguguccucuuggguauugaguccaaaucagcacuggcuauguucccuuauaaauauuggaacuucuguguucuguuguaaaauugaugaccugagacaccaucagagaaguuucacuggcaucuuucuagaggccucugggucucucuguuuggccaaaguuucuguauacuuaaagauagcagccuuuaccuuuaggauuggcauuugggucugaucuaccauagaucucauuagaauauugauuaaagaucauuuggaaaagauuuuuugaacuuuugcuuggacacgccuaagcaaaucagccuucuuuuuguuguuuuuucuguguagcugcaucagcaauuggaaaaucaauuuugaaggucaucuuuauggauuggugugaagucuaccagaguuuuaaaaagcauacugauuaccuugcaaauaguacugugaaauuuuaauuuuuuuuucaguucagcucaacuuaguguuuuguaauuuuuaaauaaauucugcagauaagcacauccauggaggacuucugccucaucucccacuugcugcguauguguaagagcaccaccauuucaagagugauaggcacucuugaugugcuagaugagucccuguuggcauugucuugauucauaucuucuuggagcagguuuuuguuuuuguuuuuaaagacaucugccacugcuuccucuguguuagagccagucuucaggacuuucaugguccugaucaaagaccacagucugcuuggcugauuucauacccuggaccaagaggcugaguagacaggaccuguggcucuguugcuuuccuggcuagcugugcggcuguacucacuguaucccugucuuacacucacccguggaagauagcagcuucuugccuauggacugacuucucugcuacaauucagccuuuaucuugucuggccucucauuguguuguagcucaauugucuggggcccgaaugccagaccucuugguagaggggcucuuauaguuaaggaucuucuggaaauucagaccacagcugccaagugguugagaugccauuuuuguuuguauucuucuccuaggaacugucucgacauuuccuuugccagucagugguauugaaggcuuugauccuucauggucuggggaacaggaaccuggguuucagcauguaucccuaagugcuuacuccauaugaaaugcuugugguaugauacaugccuaggcaccagcaacagcccucacaccagguccuuuaggaaaugcugcaggccucuggaaaggagcugguucuucuaucuguugacauucuuucagcuguagcucacauguuugcuguagaucauuugaaggaaaaagguaauugaggcuuucuggugaauuggaugagggcuuaucugauagagaggaagagaugcuacaccucuaggauucuaaagauugaagacuuuggcugcaugaugucucagccucaccagaaaagugauuucugaccuuuuuaauuuugccuuuacucuguccuuagcauuguaaauacccacaucuuucaaauaacugaccccacucuuacaauaguaagucuaaagauuuaagugaauaccuccucacaugaaucggucuugacguacaguuucuuguuauuaaaggcgugagccuggggacuugaguaugccuggauagggaaucuuacugcugcaaaucuagaugguccuaugcauuuuguacuuauuugggaacuguauuaaagaaaguagguacgguggcuucagaaccauaaucaaauauaauucuccaaaccuaaaagaugagccagcucucgcaaugcagcuucuuucacugccugggauuuguaaauuuaagcaauccauuuaacaaguggaaguauuggaaaaugcagucauacuuugcagcuccagcaacaagcacuaauugaauuuuccugaguguaccugcacagcagucacaguuguguuuaaaauuuucuuccaugccaggugucguggcuuacaucuguaacucaguacuuggggagaccaaggcaggaggauugcucgaagccaggaguuugagaccagucugggcaacauagugagacucugucucuacccccacuccccccaaaaaaaaggagagagaaaaaaauuuucuucaagcucuugacuacaaaaagagauaugcuuucucagcugcucuggcacuucucuccuuagaugcaucuccagccuuagggccaccugcugaaccaggcuuccuugugcuguugacaggauuuccagguauuuuugguacaggaaucuuaaaggcugaagcaauggaugacaacauguuuucauccaugcuuuguauuaaaauuuuuauuuuuguagacauggaaaaugauacugccaacauuuugugcucuaauaagaggauuucaucucuuauaaaguccacugucccuuucuuucuugcauuucuuuuuuuguguguaugugaaacagggucucacucuguugcccaggcuggagugcaguggcacagucauagcucagugcaaccuugaacuccugugcucaagcaauccuccugccucagcuuccugaguagcugggacuacaggugcacgccacugugcccagcuaauuuuuucauuaguagagacagauggggucuugcuauguugcccaggcuggucucaaacuucugagcucaagcaguccucucacuucagccucccaaagugcugggauuacaggcgugagccaacacgccuggcuucugucccacguuuuuauaggucucuguuauugcuaguuuuguagcaucucucaccugacuguugggauugcagaaaaggauauacaaaaaauaccaacuuucugagaacuuauggccuagccccagagguuuuuauguuuucagugagacacaauagccaacuguucccagauggacauugguggugcuacuugauccaucagcuuccaugucagauucugugcuucaucuuuaaccuugucucucauucugucuacugacgcugagacaauaauugugauuuaggacuucccauugugcugauaagcuguccacaaaggcauuuacaauuucuaauccaauuuaugacaccugguaguugcucagauguuacuucagguccagggucacacugggguugcugauguagcacgguaauucuugacugccuggcagcuggccacccauguugugcuguuucacuccaugcaguagaccacugugggagucugccccacucagucucaccaggaauagcagaggugguaggaacagugccaggugcugaguaccuccaaaacuaguuuaaaaaagaaaauccucgucuuaaauuuguuacucacuuuccucuggauuacuuucuuaauaugucccaaacaaacuggguccaggccagggcccgccucaagcaguguucccuuugcugcugucugaguguccaugaagggcuggugcuuuuccucagugaucauaugcaguucacccaucuuguuuuguuugggaaaccacauuugugccgcagccuuacucuuggacagaacuguagacuuguuugugauguuugcucugccugugcugccagggcaugguugucuuccaccuuagagaggcugcucuugggaguucugguuguuuucaggccugggaagaugguaucccuagagugauuggcugcuacagagcuguucaugcugcuuacaaggucuaaugcuguuauuucccacagguugcaaauuauggagugggaggacaguaugaaccgcacuucgacuucucuaggguaaggccuaaaucacaggugcuuucaaagggcccugcucuagcugauuugagaaggguggagcuucuaggagcauuucagccuccacaucaguacccccaccccuuguccucccuccaccucugcaucaccaggggaaacucuucguuacuggugaaucccaaaucuggaaccaaggguccugcagaaugcaguggagccuggcugucuccccuguagauguggggcguucguccccugcccuaauucugucacccuuugcccugauucuaaagcaaagagccucacuaggucuuugugaaaacuguucuugucccuuuuccucuuccccgucuacuccaugcccuagccagaauuuacuuugcagcuuuggcacauauuccaggcugauuuauggaacacacacuuauuacuuuucccugacccuuuugguccuagucuugugggugguggaugaagccuguuguaaacuugggugaaaguuguugucuguugcagcgaccuuuugacagcggccucaaaacagaggggaauagguuagcgacguuucuuaacuacguaaguacuggguccaggcccaccuguucauucucacuuaauuuuguagaaugaugagcgagauacuuucaagcauuuagggacggggaaucguguggcuacuuucuuaaacuacgugaguaugaugugugcugaugagcccuaaggggacccuggguccagagggcugccuuauaucccacccccaucagggcugaucucaucugcuguuaaguaauggucagguccuucuggcucucagcacccuucuuggcugcaguagggagaguuggccucuguuucuauucauuuuccccacugccaccagcaggacuuuaacauuccuggcuccuauuuuuuuccccaguguuuaaaauugugauaaaacagacauaacauaaaacuuaccaucuuaaccauuuuuuaaauguacgguucagugguauuaaauacauucauagugcgcaagcaucaccaccauucauuuccaucuauuuucaucaucuaaaacugaaacucuacccauuaagcaauaauuccagauuccccuccugcagcuccuggcagccaccauucugcuuucugucgcugugauuuugguuacuuaaauaaauggaaucaaaguauuaacacuugucuuuuuguguggcuggugcauaauguccucaagguuuauccauguuguagcauauucuggcuucuucuucuucuuuuuuuuuuuuuuuuuuuuuuuggagauggagucuugcucugucacccagacuggagugcaguggugggaucucggcucacugcaaccucagccucccagguucgagugauucucauaccucagccuuccaagcagcugggauuauaggcgcuagccacaacgccuggcuaauuuuuguauuuuuaguagagauaggguuucaccauguuggccaggcuggucucaaacucccgaccucaggugauccgccccccucggccucccaaagugcugggauuacaggcgugagccacugcgcccugccauucugguuccuuuuugaugggcccagugcuagucuggacuuuugggaugggugcccuggaggguucccuccuuggcaucagagugaggagauagccuuagcucucucuagaugagagcugccuuuguguucuccaaggcuuaauggccugauucccaccucuugccucuguuuuauccauagguuguaggguuuaucuuucacaugaggagcaguuuccucuccccucugcugagagccagcucuaaagaggcauagaggcaguaaaguaacuuggagacagaagccuguguccauuuuuucccuuuaugcuuuuauugugugguuauuacaugcuggggauugugcuguguacaugcuggugagcagaacauauguggucucucuugugcuugagguccaauaugagagacuuauuuuaaacaucagagagauucuucuuuaucuuuuuuuuuuuuuuuuuuugagacagacucucccucuguugcccaggcuggagugcaguggcgcuaucucagcuuacugcaaacucugccucccagguucaagcgauucuccugccucagccucccaaguagcugggauuauaggcgugcaccaccaugcccagcuaauuuuuguauuuuuaguagagaugagguuucaccaucuuggccagacuggucucaagcuccugaccucaagugauccacccgccuuggccucccaaagugcuggcauuacaggcgugagccaccaugcccagccuaaacaucagagagauuauuauguaguuauggagacaggugcugugaaccccaggcuugggguucaguggaggccucucuuuggaaguaacauaucaguugagacuuaaaaguugaguggaaauuagcugguagaacaugguuucuggcagaagagagaguguauguaguccuguaagagaaaaggaacuugggauguuggaaagguagaaaaaggcuggugugucuggagagaggcuagugagacugacagggccuugggguucuagaaaagaaucugaguuugauccacagggcugugagaagccaucagagcuuuugucuuauucauuuaccauaugucugucaaguacccuucagugagucugguauguguccuguggaaauauuuuuuaccuccaauuuuuauuaaauuauggacaaaaaaaguaagagagccagaugggaaagaaguagugcuuuggccaugagucaaggcaugcucugugggcaugaguacagccuugcuaguguggaacuuguguucaauguaguuuaaggccuuaccauaggagaaagcagggccucuagagacacagugccccacccuuccacucaguuggccccaggaaggguggcuacucugggaaggugaaggucugacuagagcagcaaacuacuagagccagagaaacagagcugcaguggggacugcacaugguguuggaaacaguacagagcuccuggucagggcacuuugcagaguacaguggcuuaggcaaggccaaggcuagauggggauucaaaggguggggucagaacaggcauuuucugaguacagacucagauuauuuucauccagggacagcccggaugugggucuccugugggccucaacucuugaacacucaugacauggagacuguucuaaugaaucacacugguuaaguaggcaugggaagagccuuucuuggcuaaagggcuggccauggagcagacaccaaguagugucacucaugcugagaggagggcaaucuauauaccuugucauguccuuuguggcucaauugcucugagagccuuggguaggagggucaagcucuaugucuuauauuuccagaugagugauguagaagcugguggugccaccgucuucccugaucugggggcugcaauuuggccuaagaagguaaguucugauucuugugggucagagguugaagcaaggcucagacuuuacuuuguccaugucccccaguaccauuaccuggccugccugauugucacugugaugugccuuagcccaccuggggucugaccugguagcccagcuucucccugugaagaaaggacagggagggaagucccuucaggggcgggugaguucccagacuucuaccucagaaagguaggugcuuucugggaaaugucucuguugcuggagucccagagcccuauccccuguccaugggaaaaugaggguguuucugcucagggcagagcuucugugaugcuugcagucaggucccugagcacagucucuuaagaauguguucugaaaggccaucucuuucccaggguacagcuguguucugguacaaccucuugcggagcggggaaggugacuaccgaacaagacaugcugccugcccugugcuugugggcugcaaguggggugagugucuuaagggguaguguugguguugguggccucagcuugggcuuugcuuauuggccuuagauucugagcugggaggcaacugcugccaaauuugcugagacugucucccuucuuagguuuuuuucugcuguuauuaccauccagccauguaauguccaugcagcugguaaaugccaaggcagcugguuggaaacacucagagauacacaggaagcugaagaaggccugaggacgaauagcugcauaagcaccauagguccaggacccucuggcaaggcuucugagggagcagaguggagagcuggaagcagugaggggaaagagugucucaggcaaacaaggcccauauggauggaggcacaggcuaaaaccagcauacgggugugggggcuggcucccuugucacuugaagaaagggaggccuguggcacaggggccagaagaugaggcuggaggcugggaccaaacugcagaggcucaagcuugagccuuauccugggagcaguuguggugagccucggagaggcucaaaccaggauaugacaggaaguguuuguaaggagaugaguguguagcccccuuggagaguuuugaagauaaauagugauagguuugcagauaauuaagcaaauggaaaagaaaacaaggcaguugcugaauucaggggaaaaaaaguuguacaagaaaggaaauguaaguauaaucuacuagauggcucagguguaacacaugauauaauuauguacacacugaguauuacuuuaacuaaaacuuaugauuuaccuguacuggaaaggugggaggggaugaguuuguguuuuagggguagaauaaaagaauuccaaaguugaaagucaaggaauagaacuauaagcaucuuaucuagaaaaaugagguuaaauaucagaagaaacagcuagaggaguuuaauguucccugggaguggagauuagggaugggaaggagaggcuuaggaggagugcuauuuaucauuauaagccuugcgacaauuuuauuuuuuucaaugaaguacauguuauuacuuuauauuuuaaaagcucugugacuucaguagugcauugaaauaaaauuuuuauucauuaugagagagucugugaggaacagaaucaugguuccuguguguuugaagauauggcguggggugauagugcuggcagcagcucuguugcucuugugcccauggcauacagacuggaucugcugguccacggcuccugagguuaauguccaagcccucugcaaugcugacagucuuccucauccucacacccuaccucucaguuucuaccugccaccucccaguaauauuaggccucuugaguccccaacacacgucaggguggcuucugccuugauuacuuucucauccuguugucacuccugggacccucuuggugagagaaccaucuggguaugcccaucuucuucccaggauaacuucuauguagcuuuauauucuagcccuaggauuuccucuucccucuaagagcaagaaacaugugugcagguugccaugggaauagagccaaagggcaucaaaggucaugggcaugaaagggcaugauuagaugcccuugggugcuauucccauggcaaccugcacacauguaucuugucccacuggcagaauuucauacaauuaucuguuuacaugugucuuccuuaccaauucuucagcaaauugaggccugagaucaugucuugucuuauuugugucugauuccagggcacagugcagggggucaucaugaaggagucauucauucaggcuacuaaacugaccaauaggauuguaacaugcuugcuuucuuuucacagucuccaauaagugguuccaugaacgaggacaggaguucuugagaccuuguggaucaacagaaguugacugacauccuuuucuguccuuccccuuccugguccuucagcccaugucaacgugacagacaccuuuguauguuccuuuguauguuccuaucaggcugauuuuuggagaaaugaauguuugucuggagcagagggagaccauacuagggcgacuccugugugacugaagucccagcccuuccauucagccugugccaucccuggccccaaggcuaggaucaaaguggcugcagcagaguuagcugucuagcgccuagcaaggugccuuuguaccucagguguuuuaggugugagauguuucagugaaccaaaguucugauaccuuguuuacauguuuguuuuuauggcauuucuaucuauuguggcuuuaccaaaaaauaaaaugucccuaccagaagccuuaaagagccuua

SEQ ID NO: 16575 - RNA, 2578 nt, Homo sapiens
aguuguucagagucuaguuuauucucacacaucccuaggaaccaguuuaaaacucgagguacaaaugaacaugcuccccaccccacucugaguuuuuugcagaagcagcaggacauggcuccucugcuaaaauaaauacaguucacacuccaggcaauaaauaaauaaauacauacauacauaaauaaauagucucaaugggauaaaaaugagaacacaaccgcacaaggccaaaugggagcugcacauuucagaaauuagauaauuaacaauucaucugaugccgcaggaaaaggugaaaugcuucugguccuggaaugugugagagaugacccagagguuucagaaguucugcuguuuuugaugucccgaggcucuguggugagaaggcccagagaacgagcuggacguuggacucaaaagaucgcgaggcucaaagucgucuguugagccugcgcauucucaaggguuuucagauagaacgucaguuuccuccggaauucauuccagucaccguccuugauauggauuggaugucgcuauaaagaaaccaagaagguggcauuaggugaguccaggcuguaauggugaugaccagcugaggagcaagccaugacgggcaucuugggggacagcuuaccgugggugcggccguggccaggggcagacauggcaggagauucuguggaaagagaccaaagcagauggucagagauucccuuggaaagggagugggcccugcucuccuccccagaggcagggcagggccaacacagggaucccaaacccucaacagcuucacauacuuuaagaaugcucucaauugcugaugcguucuguaaacucuugacagcccuguugaaugccuccagguuuggccuucgaagguuauuuuccuaacggggcagagaauacacuuaagggggaaagguuacagaguaucccucccacaagcagguggaagucacccccacaguuucccaagcccacuguuggggacauccucggguucccuccuagucccguucuugccucaggugggucccugcccaagggcacaggccuagaagugaguggcaggcaggaccugguuuccucaagcccccagucucuggcuccauuugagcuacauaaagggccuaggugggcugggcgcaguggcucaagccuguaaucccagcacuuugggaggccgaggcaggcagauaaccugaggucgaguucaagaccagccugaccaauauggugaaaccccgucucuacuaaaaauacaaaaaugggagugguggugcaugccuguaauccuagcuacuugggaggcugagacaggagaauugcuugaacucaggaggcagagguagcagugagcugagaucgugccacugcacuccagccugggcaacagagugagacucuugucucaaaaaaaaaaaaaaaaauggguggggaggggguaccuagguggaucuuucugcacuugggggaaaaaauaucuccaaaaagaagcucuacaaaagacaggggguuuuccaagggaaguauuuguagcucagaggcugauaacaguguucaugcccugacugaauuaaagucuccuagaaaucaagaagaaaaucacagagaccccagcauggaaaugggugcagcaugugagcugugagugccccaaacacagauggcccaggaacucagcaaaggcuuccacuucuuguuugacccaagaaaugucaugcaaaggugagacagaacaacugcaaccaacuggaaccaugaaaaauaacuguaaaugauaaugccacagccaaugaggguggaaaacacaaacucaauuuuuuaagggaaaaagaagcuggcacaucugagggggaaauuucugucugucaguccagagucugcccuaccaaacacugaccuuaaggcccuugguauuccucaccuagaacugccuuuucauuuucuaauuuaaaagucauuuucauuauuauagccauggcuguggccauguauugaacucuuaagugccagaugcugggccagaacaugcacauugugccauuugauugucauaacaaucccacugagauaggugcuauuaacccuauuuuacagaugaagaaagcaaggcuagguaagauggaaugacauggcugaagucacccaggcaggaaguggaucgggauccacgggcugagcucuuaccaucagaaugucuuggucuuccccauugagguuguugaaguccugugggggugaagggagagaaaggcccaugaggccuuuuggccuuaggcagccaccaccccucacugcugcaggccagucuuauccaagcuacucaccagcaaaggcaaagguggcugcuuuaaguguguuauaauuucaucgaucauguuagagcaguuaacccagcuugucuucaagggcguugucugggucaugggagcuuggaguccggggcggaccaggaguuggagcaggagcaggacgggcaggcggcucauguuuggaucggcaggaggcacucugucuuguucugguccuucguggggcucugaagaguuggcaacagccucccgcc

SEQ ID NO: 16576 - RNA, 8820 nt, Homo sapiens
auuuuaaacccucaauuuccagaggaccaucgccagguguuuuuaaaaccucgauaggaauaagaaaugcuucccagaauggagacuuccaucaguucuagggagcuauuagcccccuugcccuggcuguaauggagaccgcugugucugccuccuuucgcacuuuggagccaaaagaggaagggaccgccucccacguccacagggaccugacuuccaccucucugcccagauuugcuuaugucacugucgccccgggacggggagguggggagcugagggcaagucgcgcccgccccugaaaucccagccgccuagcgauuggcugcaagggucucggcuuggccgcggauuggucacacccgagggcuugaaagguggcugggagcgccggacaccucagacggacgguggccagggaucaggcagcggcucaggcgacccugagugugcccccaccccgccauggcccggcugcugcaggcguccugccugcuuucccugcuccuggccggcuucgucucgcagagccggggacaagagaagucgaaggugagugagccuccgggccgggggccgggagaaaaaaccuagccccucgguguccagcgcucagugcaaugcaccccuuuucccaggcuccccgccagaugggcaauccccaggugcgagagaccuccugaaccccuuuugccgcccccuccgccgccgggaccccgcccccgaccgucgucgucucguaguuccaucuguuggagagccgagaccuggugcuucaggcgggcagaaugacuaagggaggaaggucucucuccccgagcucgcacuuucuccccacugccaccucgagggucgccuugcuacaucuaugucaccuccgugccugagcugcuccccuucaguagggccuaagagggagggcgucacagaaaaaaaugcccagcgucugggugggcugugcaaguucccagggagagagacaaggagaaaggagagaggcagcugggugguccugguccugaagaacugcuguggggggcucuucuaccccaagaaugauacaggcagguagaaauggccacuuggauucagggcauugguagaagaggcagagaucugugcuagaaagagcucuggagugacagugcagaacacucaggacccugaguccuuaccugcuccuggacccccguuucuccaucugcaggggagaguuugggggugggagugcauggggcacaaugaagcugagggccucagaggggaugcuuggagaagcugaaaaauccacaagcuguucucugaaauuuccuccccuggggcagccucacuacccaggacccacuguccucauuagccugaggaaaccugguaguuggagaaagcuggggacugcuaauucagaagaagagguagaauucucuagagccucagucuauuuccagcagguguguggcccacaccuggaguggggauacugaggccaggagugggaugacccagcaugcuuaucuccuuugacaguauguacuggggugggcucuguagaccucuccucuacccagggagugggaguggguggggaaggaggcagaagccagguguagggauagacucaaagcgagcgauuucugucuccaacuucccaacaugcauaacucacauuuuugcaagcucugagcuuuuguuucuaaaauccucugggucuucacuuuaauuaaguucuuaugagucuaggauuccguuuccaaaauucuguccacuucucaggaagcccauuggaagcacaggguuccuuccauguuacucaccccuuuucgguccucagccuaaauccgauuaaucagccucuccuuggagucagucuaaauggaugugaagccacuucguccaaguccccuccuuuuuauccaucccuguucauaauccccaacucagaaggcauuuuccaggucaggaaugggaucgauuuucaacauugagguuuggggugggccauagacaggccagcaccguggagucagucccaaccuucaguuuuggaaaggucaaagaagauacaauugggcccugccucaagaaggcuaguggggagaacguggacuccaugaauaacucaucauagcugugucuucucugcagcacucuggggaaggauaaauggacucagagagaauaggauggggauggucuagaaaaguuuuagggugaggugugaucauaucacauacaaccagucaggacuugcuggcuaaugaaagccugggcaugcccaucucugcucccaaguucuuagaguucagaugucuuagcucuggguuaggacccaaccacucaccuuacccccaaccccaggguaaagagauaggguuauggggcauguggagaauggaauggacgaaaggugacucagccccagagagguguuuuccuccuaccaauugaaagggagaugcuagggaagagaccagguccuccucuucuugcugcgucaccuccccaguccaacuucaggcugcccacgcuccuugucucuacaaaaggacugcagaagccggaaagagugacaacugcugacgugcacgggauccuaguaacugcugguuucuaggugacuaaaccuggcagagagaaucauggaaccacaggcugacagaguuaaagggcccuuaagacagcccugaaccugacuccaucuuacaauggaggagcuggagccccagcaaagggggucacauggcaucagagacacagcaaagcccagcacucaggucuccugacucccagaccacuucucacagcaucauauugauaggaguaauaagacgggagaggagaaagacacaagaccagcagccccagccagccagaguccuggcugagucccaucauccaacucucaagccauuggaacccucuucucuugcccggcugugggaggauucaggcacccucauggccucuccccuuaucuccucuggccacuguuucagaugcggugcucugggauuccacgugcccagagaagggaagggggcucauagaggacugaguugcagugaucaguggugagcacagccguggcucuccacccaugggccaccuucugacccccacuaucccuugacaugagauuucguuccaagagacuccaggccuguuuugcucugccagcagauucccacaaccauuuugggcagcagcaugcuuaucucccuggacauaugcccagacaguguaagugacuugcucagggccacacagccagcaaaaaauagaaccuaaugaaauaggguucuccuugccacacccccaagcugaaacugugcccagaagcugguccuucuguuuacaaguucccauuauuaggacaaccuguaaucuuuuuuuccuccaugucucagaguucauuuuuggaucauggcagaguuaaaaaaguggagaggcuauagacaugccuggcuuucuggccacuagaucuuuguggcggucuaggguguauuuguugugccccaguuugucugcauuuuaaggcggaacuggcccuggcugggaacgaggagguccaggagcaguaggaauguugaucuuaggucuugggccugccuccagcacccaccaaaagucaccggauguggaauauuagacucauguaaagcaggaaguuugcaccagagccaagaagagagcuugcagcugccagggaauggccuggcggaggaagcgcagccucgcccagcucagcagaccugcuucaugacagaggcagcucuucugcacucuacuggggccacgcccugccagcauauaucacucccuucaccuggucaggcccagguaccuugccucaacagcaaguucuccagaauugaggggaagagagggagugaauuugcuucucuaacuccagccaccugucucugcccucuccuggucuauaaugcuacuuugcauuccauuuguuuauugucugcccaccucucaaaggauaucagggccacaaaggaccuuaaagaccaccuuauacaaugguuucaagguuucuccuuucccaucacgaccagcccaccugccaaauugugucaaugaugcaaugacauccuuucaagaauagucucagaauuuuguugucugugucacgggcagaguaggcucauaggccacauccuacuagccagcagugaccccaauccccucucucccacugaucaugauccuaucaagccaucaugguugaccugguuggagaguugguucaguucaagguucucauuuuauaaaugaggaaacucagguccgaagaaaagaaagggccaguccaagaccacacagggaguuaauggcaaagggacauggagcccaggucucccagcccacaguccacugcacucugucccuccuuguccuggaggcugacugugagcagcagcuggggagggaggaaggcauaagggucaucaccagccugcucagacccggaacauuaacacaugcagguacuguugcuuuucccuaccucaccacagcccuuucccccaugccuggcucucaguccugcuucccuauuugguaacaacagcuucaucuuuccuguccugcagauugggagccucugaaucaccauguccauacggccucuuccuccuuucuguucaguuuuuccuucacacuggccuaguucagguucucauccucaauugccuggauuauuccaacagccacccaaccagucuccaucagcccgucuaggaacccagucaucagcuuuagggcagucucccugagagcccaguaaauguucugaaauugacaugugauguggaaguaauuagcaaaauaagucauucuccaggguuccauagcacucacuuauuaagugcuuaauauuaauaagugcuuauuaggugcuuaauauuaauaagugcuuuuuaagcacuuaauauuaaguacccgaaaagcacuuauuaagugcuuucauaaucauuaucuuaaacaaggaauuaggagacgucagugcuaguccaguuccaauucucggugauuacuuugagaaagucacucucucuguugggaucuuucauucuuuugaaaacggagauguccaaguuccuuuccagcucuaacugcuccuuuuauggccuguguuccagauggacugccaugguggcauaaguggcaccauuuacgaguacggagcccucaccauugauggggaggaguacauccccuucaagcaguaugcuggcaaauacguccucuuugucaacguggccagcuacugaggccugacgggccaguacauugguaagagcccacccuuccucccugcuuuauuuggggcuguauggcauauuucaaucacaggagcuuuucuggugcaugggggaaagggugauggcaaucacgagaguccaagccccuuuucucagcuccacuguguuccgugguuuugugaagaugauuauauaagccugaggucugauugccuuuggacauguucuaggagauuccuaguuauccuucuucaucucugggcaccucaacaacccuaaaggcagagggauagagauuagguuugugcuuagagcucccuuuggcuggagcaugagaugguaacugaagcuccaucuugcugagaauaucuuauuuucccucagccccaucugcuuuggugcuucucuuggcagcucucuggaaagcaggcaauugccucgaggccccagaguguaugcgugguguagcgggaugaaggagcaggcuacacuucuaaugcccauucuaaaauaaacuuugaagaugaucuaguuuagccuuccccucuucucaaucuacacaugggaaaccaagacucagagcgaagauacaacuuaaacagggucacaaagcuauuagcgguggaauggggcauuuggcgcagguuucaugaucuccugauaugcuuacuccuuucucccuagcugggguagaauacagaggcuaggggaacaggcaaccaaaggcaagcgacagcacccaggggaaaacgcuuuggggcugagcagucuacuggcagggggucagggaggcaagggcaauuugacccuccaugcucugccuggcaaucacaggcgaauucccggaagugaaaggacggcggucacguggcccaguggcugugagugcuuuuucugggaugcuucucucuagccuuggaacagagcagagugcguuugggcaagagaugggcugggugcugcugcaaaagagaccaggggacacugaggaaacuggggagcugggccagggccucaucuguguuccugauuugccaaagauuaugggaggguuguaaccucaccccaaagaaguucucugccuuguauccagggauggauaguucuugcuccagaaaacucaauccugaggguucugaaugagugcucuagcuggcccagguggagggccuuggcaaugggcaggugacugacagcugacuugaggaaggguauuauucuuguccuccaaaccuccaauccauccagauuagagucaagaggauaggaccugagucccagcauugcugugaacucacuggugauccugcgcaagucccucccuuucucgggccucaguaguuccagcggcacagcgggugagccgggggagugguguggaugagacagggcuccucgccaggauacucccacaucugcucuuucucuuuggcccagaacugaaugcacuacaggaagagcuugcaccauucggucuggucauucugggcuuucccugcaaccaauuuggaaaacaggaaccaggagagaacucagagauccuuccuacccucaagugaguacucacucagcauccugagaaagcuccucucacauggcccacaucuuguuaucaaccccaaaucaugguggacauuuaucggccaccaagaacuacucuccucuucuaggauccccaguggaaugagggaagggaagggacaagagagggagaaggacagggacaacugguugugaugugcauccgcagggagcaccaagguugagggacacugaaaagggaccaggcuagaaaggaagaccguggacucacauuaugccuaugcccacugcacauucacuggcuccugcugcccacugcagaauaaauccagacucccaacacccucuccccuguucugucccuuccucucauuucugagcccugugcccaccuccuugggacccaccuaagaacauuucucaacagguauguccgaccagguggaggcuuugucccuaauuuccagcucuuugagaaaggggaugucaauggagagaaagagcagaaauucuacacuuuccuaaagguaagugagcugccaccugugcuggcuggggcugcagccccuccuggcuccagcccacagcgucagggcccaugccaccuccccugcuccugggcucuuggggaauuucuuggcaccugacuauuguuccaacuagagggcucugcagacccugacuagggucucauuggcccauuuuacagaaaggcccagaaggacccagagugaacauacuaagggucucacaaucuucuagagccacagcuggcgcuggcagucuucuaacucccaaacuggggcucuuuucucagggccaggcuauuccccaggaaggccugggaaggaagagggucagggggccucaagcaagguugacacuccucuuaucccugcucuagaacuccuguccucccaccucggagcuccuggguacaucugaccgccucuucugggaacccaugaagguucacgacauccgcuggaacuuugagaaguuccugguggggccagaugguauacccaucaugcgcuggcaccaccggaccacggucagcaacgucaagauggacauccuguccuacaugaggcggcaggcagcccugggggucaagaggaaguaacugaaggccgucucaucccauguccaccauguaggggagggacuuuguucaggaagaaauccgugucuccaaccacacuaucuacccaucacagaccccuuuccuaucacucaaggccccagccuggcacaaauggaugcauacaguucuguguacugccaggcaugugggugugggugcauguggguguuuacacacaugccuacagguaugcgugauugugugugugugcauggguguacagccacgugucuaccuaugugucuuucugggaauguguaccaucugugugccugcagcuguguagugcuggacagugacaacccuuucucuccaguucuccacuccaaugauaauaguucacuuacaccuaaacccaaaggaaaaaccagcucuagguccaauuguucugcucuaacugauaccucaaccuuggggccagcaucucccacugccuccaaauauuaguaacuaugacugacguccccagaaguuucugggucuaccacacuccccaaccccccacuccuacuuccugaagggcccucccaaggcuacauccccaccccacaguucucccugagagagaucaaccucccugagaucaaccaaggcagaugugacagcaagggccacggaccccauggcagggguggcgucuucaugagggaggggcccaaagcccuugugggcggaccuccccugagccugucugaggggccagcccuuagugcauucaggcuaaggccccugggcagggaugccaccccugcuccuucggaggacgugcccucaccccucacugguccacuggcuugagacucaccccgucugcccaguaaaagccuuucugcagcagcugagccuacuguguguggu

SEQ ID NO: 16577 - RNA, 57218 nt, Homo sapiens
guugaucuucuucaacuuggauuuauguccaugauucgugcaaauagcuauccagggauggacagccacccuaaucugggcuucuggcaccacaggccuccagcuaugggguccagggucugaaccucagggccuggcagcuucaggcuggcgccccucggcggacguggcuggcauggccuucucccaucugugauggcuucagcaaggcuacugugaguggugguggagagggccccagagccagaauauccaucauucucuucuguucuggagacaaacccacacuucccacagcuccucacagagggguaggggugugcguggggcagguccugcuacagagcuugaagcaaaaauuaaacacacacacaaauuggucauggcaacuagagggccugaaaccacuuccgggagguuuugaaggaagggggucuuggcugccucccacucuuaggauugcugcuccuggaggcuucugcaacggauggugggucaaagccggaugaggccucucuccacucagcagcagggaaggaguuuuucccagucacucccagcagaguacaaaugaaagccuucuggguggagccuccccaguccuguaaacagcucaguucagggacugguguacaagcuggccacccaucucagccucucauccagcugaggcucuggccacaccgugcaaguggcuucuaguuucuuggcaaucugagaucagcuggcucugcaagaugaagguggagccaaaugacacaaucuggucucacugaggccccucacggucauuuuuuggagacucuaaauaaacaaaaauuuugaggacuucaugauuaugugguagagcgaguuucaaagucucuuauggaaugcagugcaggaacagugaaaauaacagcuaggguuacugggugcuaccaagugccagggcuaaguaccuuaaguacgcuggucauguaaucuucacccagcccuaugaagaaggcagguuauuaucccauuguaaaagagggaacugggacacuaagagguuuuaaaugacuugcucauaguuccagguccaggaaauaguggggcuaggauuugaacccaaucucaaauccuggagcaguucuggggagggagccccucccauuauaccaaucucuaccacucaucaaagcagccuccaaggggcuccacugaacuuguaggguucuucagggaaaaacagaaaaugacugagcagcccaaucccuucuuccaaucaccaaauccuccaaacugcaaccccuccaagguguccgucccauggccucuacucacacaccugcaaagggacacucgccaccucccagagcuggcuccauuucugcacaacugugucccuuagaaagaaaguuccucuucauguugcgauggacuuggccucccugucauucccacccacuaguuauaauucuguucccagaagucccacaggcgagguggugccuugugccccaugagagcucuacagggagcaauggcagucgcuaaggucccaaucuuuucacgaguggacacagcuccaggcucuucagccuuucaugguggacaccauggucaggggagcuuuucaaacagaaauauggucaugccacucugcuuuaaaaauguccagugacuacacauuaugcugaggauaagacccaggccucccaccaugcuccgcaggccugcacggucaggacccggcuacguccugaacccugcguugccccucucuuucccuaccuuguucuuggcuccagccacgcuggucuucccuccgauccucaaaucagcuccccuacuuccccuccucccaccacggccucugcauuugucauguucucugcaaaagcauccuccaccccuaccucuccaccuagcuagugucacucauucugagagucucaacucaaaugcugcccccccggucuaggucggcuuccucugcuaucugcucccacagaaaccggcucuucuuccuuuagggcacuugagugcagccuguuugugugguguuuguuuauucauuucugccucccucauuagacauuacgcuguauaagggcaaggacuguaucugcuucuguucucuaggcauccauagcaccuagcacaaugccuggcauuagauaaugcacuagaaugaaugguuucagccccccucacucugugguugccauuacucuccauucaacacuguuuuggaaagcugggccucuccuccaccaagagcagaaacuaacgacaucacccccaaacucaggcaaugcuggcagauaagauauuaucucccccagggaggaccaagacucaguauuaggggcucaccugguucuguaggccuggcugugggaggguccaucacuugggagcucugauuuggauuucgaaccccuccacaggguagacgccagguguauuccggcugcgacaaaacuggugcuuaauaaucaauaaucacacccaaaaauuacaauagcaccuacugugccaggacaauacuaaaucuguauuagucaaguauaauugaaucuuuauaacaacccaggcuggcacucccauuucacagguaaggaaucugaggcucagaggggauaacuugcugaaggucaucuagcaaggagaauggcuaagcuuggauuugaauccaggucuuuguaaauccagagccaaucucuuaagcgccauacuauauacucugguguuuaaagauguguaccaagaagggucauaugggagaagcugaaaaagaggccagccaggagguuucuguaaugguccaggggagagcugggaugccuaagguggggcuguggcagaggacuggggaaaaugggacaagugacagcagaucuuuggaagaagaaugauaagaagggaaaagaggccaggcgcaguggcucacgccuguaauccuagcacuuugggaggccaaggcggguggaucaccugaggucaggaguucaagaccagccuggccaauauggagaaaccccgucucuaccaaaaauacaaaaaauuaccgggcgugguggugcaugccuguaaucccagcuacuugggaggcuaaggcaggagaauagcuugaaccugggaggcagagguugcaaugagccgagaucguaucacugcacuccagcaugggcaaaaaagagugaaauuccaucucaaaaaaaaaaaaaaaaaaggaaaagaaaauaaaaaaagagaggagagaagaagaggaggggaggggagaggagcggaggggaggggaggggagaggaaaggaaaggaaagagagagaaacauggugaggcucuggaaccuaguuacacguggaaguuauaagaaaaagcaaacccaaacucugauacccauggccuggggccuggagggaguccuccuucccacccugcacucuuacucagccuucuccguccuagaccagugacccugaacagcuguggggcagcccugcgggacuguggccagaucccugccccuggguagcagcccagagccaggcccuggacacccaccugccaccacggugcuguuuaguucagaaggaugcaguuucugaaccccucacuuaaccuuccucucuggaaggugucuggggcagccucugugugugcccuggagcaagggagggacacagacucaccagauggaagaggcgcgaguuggggagugggggcgggugcuccauggccauggggggagggggguagcggaucugggaccaguccucgaagccaugguguggcaccauggcuggcaugggcggguaggcguagggguaggccccgcagagauguucuggguggggcuccacaugguaacgcucuccugaggccugcaagaaaggcugacgucuggcuuuggccugcaacaggcugcaaaggacacccaucucaucacccucuaaauagaauguuagcucucugaaggcuagcaggcuggguaccaaaggcugguauguggucaugaaaggcugcuacauggguacagaaaucuggauacaugggcauagaaggcuggauauaugagcauggaaggcugcaugggcauggaaggcuggguacacaugcauggaagguugugacaugggcacagaaggcugguacaugggcacggaaggcugguacaugggcauggaaggcuaguacaugggcacggaaggcugguacaugggcacggaaggcugguacaugggcacagaaggcuaguacaugggcauggaaagcugguacaugggcauggaaggcugguacauggacacggaaggcugguacaugggcacggaaagcuaguacaugggcacagaaggcugcuacaugggcagugaaggcugguacaugggcacagaaggcuagguacaugggcagugaaggcugguacauagacacggaaggcugguacaugggcacggaaggcuagaacaugggcacagaaggcugguacaugggcacggaaggcuggguacaugggcacggaaggcugggcacaugggcauggaaggcugggcacaugggcacagaaggcucauacaugggcacggaaggcuggguaaauggacacagaaggcugggcacaugggcacggaaggcugauacauggaaacggaaggcugagcacaugggcauggaaggcugguacauggacacggaaggcugguacaugggcauggaaggcugggcaugggcacaaaaggcugggcaugggcacaaaaggcugguacaugggcacggagggcuggaacaugggcauagaaaguuggauacaugggcacggaaggcucauacacggccaaagaaggcuagucacaugggcacggaagguugcuaccuggacacagaaugucaacagugaugacagcuaauacauugugggcacugccucuguaccaauacugcucuaaggcuuuuccuguauuacucaucaguuaguuagcagaggauguccccacgcccgagcacacacugugcauccaucaggcuagcuccaugaggaagguaagaggaugucagugcugcuaccucccucaagccuccucaccuuugcuuuccucuucugcugucugagggcuucucuugccuucuccucaucuuugaaugcuuuuagcugagagaagaagggagggagaaaagacugucggcacaggugguuucuggccaggccuggauccagggccuaaccagccacgaggacugaccggcugaugcuucccucugggccaccaugcgugggccagccccgggaaagggcccugagggcggagcacagcccaggcuguugcugcaggccaccugcuugucacaguggucugugcacaggucaagaggguucacgugaaccucgcugcuucucugcuaacaucuuuuaguuccacucugggagaguaaagcccagaacugacuguggaaagucagagguagagauaucuuagaguaaaacucguaauuguacaaagaaagagucagagaggggaagggccuugccgagcucaaauaugauugcagagcuggagagaagcagugaggguccugacauccagccucaccagggcccuccaauccaugcccccucuccccacgaggacaggccaguugcccuuccuggguccagucacucuuaccugggcauuugacagggugaccugggccugcagcuucuccacuugcuucuucagcucuuccuucuccucauucaugcgcucacgaucacugcgcucccucuggaaguccuccucgaagaucuucaccugguguggagggagggugaagagagggagggggaugguccugaguggggauuucuccucaggcccagacucccaugccuccugcuggggucacagauggcagagcugggggucgccauggggagugggacagcuacaccuccagccuccaccuuaacuucaaacagaguaguucugugucccucuaucuuacauucugggcuucaagcuaggacuuuauuugaacaaaggauauaugguuuuaaaaaaacguugaaagccaucaaccagugcaauccuuucacuccgcugagacccacaggggcagugaucacagaaccagagugugguguagaccagaguuuggaucugcugguucugagggcagagacccuacaaacuccgcuagggcuccagggugcccuggcagagguggguuggguggggccugccucugucucuuagccuguaguuucacauccuuagugcagaucagcugagacacuggcuagguucaaggcaguuuaggaggauuaaauagcacagagacaaugggagagccacaaccuuuucgcuuucuuucaccccaauccuucugugucccucagggcuaguaggucuuuaauaccauuuuaguaccugccaaucuccuuuaaauaaaggagaaaagaacuccaguucagagucuucauuuggcaagaguauccggcuagaguuuaauaacauuguucuguuuuuauuguuuauugcguacaguuacuuucuacuugugacaaauaauaaaugguuuuuuccaauuacagcagugauauaaagcucccuuuuaaauucauuuauuuagaauuuauuuuuuaaauacuagguaaauaauagcacguguggggcauagagauggcuaaaucauaaaggugguagaggaacgacuuaagcuaggguuauggugcuggaaaggauaaaccuagagccaguggggggcccuggccaauggccagaaaguggauuacuaauuacagguuccaugugauuccaagccgucugggcccucaggaaagcuccagcucccacagagcaccucccaccugauuuccucccggaagccucaccugcuguuucagcaacucauucugcgugaccagcuccuguuuccuuaggagggccccugcuccuucugggcucccaaaugcuguugguggagaugauggcgggguuuggaugcucagugcuuccuccagggccuggaaucaggaaaagaugggaccaucagcaggaaccccuggaaaucagggcccuuuggaggggucauccucagggaacuccuuccuaauaauaaucauacuaauaauagccaccacuaccaguccuauuuaauaaaugcugcccuauuuauuugcauucuacacauaucauuucauuggaucuucugcacagugccaugaagaaaagacuaugaucaucauccucauuuuacagaugugaaaacugaggcucagagaccugaaggggcuuguccaaggucaaggucacacagcuaguaaguggcagagcacagauucaagcccagcacaugcuccuacccagcaggcuaaacugggguugucaugcagaaggggaaaccuccccuucccugaacauguguggcucaauucuuagcacccagaccuagaaggaagauuaaguccuccgggggaagcuucagucuccccaacaacugcccugcccugagauucuucacuuucagcaacccauucccauccaaaccaccccuuccauccucaacacuuauguacauagagaagacuggauuuaauuucugcuuaguuaauauuuucccuuucuaacacugaaaaugggcugaaauaucaucaaauaacauuuugaaaauaaaaaaauacucuuaaucuaucauguucacaauagauuauauaaacagugugcccacaucuucuuaaagguuucaguuaaccguguuuccccuuuaacucuguuaacauguuacucagaacucuggaacaugucucaagacugggcacccuggacuuuggccccaggacagcaucgcccaugggccucccuggaccgaggggagauagagaccuggcccaacuuggacucgggcuuccaccuggucuccucagcuccccuagacacgcaaagaaacugcaggaccgagaguaaauucaggaugcuccgaggggaaguuauggcuccacuuuaucuuccuacuccaccccacuuuuaaaugaaaagacugagguccagcgacagggagaugccuaggucaugagcaaagaaggccacaugcccugcauuacucauccacauggugucugucccuggcucugccaagaaaaccuccaaggucaucuuuaugaucagcaacauggacaauucucugccuggauuuagagccccaagucccccagcucaggacagaucgcguuucuuucucuggaaacaggucaagggccccagacuuggcauaaucaguguuuacaaaacaccaaaaccaaaaagaaaggguuuccccagcaggccuaggaaugcucaacucaugccagaguccacugucaccagggucaggaggcagagggaaaggaaaaacaauuagcacgaaacgaaaagcugagccaugaacuuaacuccuccaggcccucagagaauguuuccuuucaaagcucccuccugucagcuugcaucuuugaaaugugcuggaaagcaggcagaacuagagccguucccaccagggcucggauggcaaaacugaacuggagaggcuggagaggcuaagcugggacuagaccacuccgcuuggcucagaccagaggguuucugguuuccucagccucuacccugggggccccaucucccuggaucccacugcacaagggcgggccccucagcccgugcuccuccacucccaucaguguuugcugaacaugugcuugaugccaggcgcuguacaaggcgcccaggguauacaccuuggugaaaguaugcaccucccaccaccagaugggaagacagaauuaaauaagugaugacgagccaugagaaggagugucagagaaguugcugguaccucaggagcauagaccagggcaaccugaaugagauucugggaaggcuuugcugagcaagugaggguaaaacaaacccugacaagcagggugggcaggugaggcacaaggggaagagugcaccuccagagggaagggugacacaggcuaauucaagggcugagucacucccagugugggaggcaauggcagagcaggcgggaaacaggaugccagcucacugacuggggguuacccuuccuaagcugaaugguugggggugccagugauggggugggcauugcagcuggacucaagggagcccagccaagggacccgggccaaggcacccaccuuguugagccgcuggaucuccuuuuccugguacucacgcugucgggugagugggcucagcugauccugcagguacuugaccuuuuggcgcagcuccuuggccucugcugucagcugcuccuugucggucugcagggaauacaagguugguaagcuggcuaggauggccucuccaggaggccucggauucucuguccugccuggcccagcccuuacguucuccccuggccaucacuucacaaugcucacaugcaaagcaccuggggucgguacaguaauguccauccgguccugcccucaauuauuaugugucaauuuaaaauaauaauuaaaaaaagaaaaagcaguagcucaguugaguaaaagacccuggauuccgacaccaguucauccacuaagcagcugagaccccuggcacugccacagcccucucuugucuaagcuuaccuaccugucacagguacgggguuccuaacgugagucacacagagaccucaggaggccugugagccccaaaacugaaugcgaaauuuuguuguguguaaucugcuagaaagaaaagccauaguucugaccagauucacaugggggucuuccgugauccacagaaagcgauaaacuacggauaaucccuaacagacacugcagcucauacagccuuggagccuagaggagagaugacacgcccagagagaacugugacauaaggcagagagugcuccuccagaaagaaacaaaauacuguggggcuaaaagaaagaucaccacagcugagggaaggcuuccaggaggcgguuccauacccucuacggaaccagcagggcuucgccacagccagccaagacugggauggccuuuagacagcaucaagccccagcccuguaauacgaugggaaacaaauguccagagaggggaagugacguacccaaggccacacagugagcuggggcuagaacccagguuuccuauucccuugcucucucuccuuccaugucaaaggagguguugaaacuaggggauggcagcacagugcaguggaaagaccaggcacauccccaaauaaacuauauauuccuauguguacauauaugcgagaaaggucuggaaacagaugcaccaaaaugguaacagugguucccucuagggagggccugggaucauggcagugggagguaguccagggaaacuuucacuuuguagcauguggacauuucauaacuguguauucacagcaugugauuaagagaccagucgcagggguuaguuuucacccagcccugugugaccuuuagucaguacggacugcagagggcaggcuuggucagaccucccugggaauuguucuggacuccccaucaagaggcucccggaugggcaugggcuuuaccgaaauucauccuuaucuacagggccacgccuugucaugaaacguccuaccuucccuguagcugacagggaagagcccucacauuccagggauuugucucaccuaccacugugagcaagggagaggggccaaagagccaggaugucuggcugcgagucaccagguaugacugugcacucauaaggaaagacagaaguguucucccuaccacaccuccaagguaagggggugucacagacguaggcugacugcucaaauaaggccccuggugucccaugcugacgggaggaacugugaaaggcaauccagguugaaaauguccauuuuuaagcuaggcaaaagaccaugcccaguucccaugaaggggaaaacauggugacauaaauaaaaucucccaagagucuggcagucaaguggccuuuccucuuuaagcugcuccaagguccugaugggccuuggcuggucucauucauacauaugacugggcagauacuacuacuucaggggaccuguuguuuccccccaagaaagaaucuggucucacuuaugcccacucucugaucucuguaacuucuucuucguaguacuuuuuuuuuuuuuuuuugagacagggucucauucuguugcccaagcuggaguguagugacacaaucucagcucacugcaaccuccgccucccggguucaagcgauucucgugccucagucuaccgaguagcugggacuacagacaugcgccaccacucccaguuaauauuuguauuuuuauuagagacgggguuucaccauguuggccaggcuggucucaagcuccugaucucaagugauccgcccaccuuggccucccaaaaugcuguguuuacaggcaugagccaccaugccuggccauacauuuuucuuuuagagaaacaggguuucacucuguuguccagucuggagugcaguggcacaaucacagcucacugaagcuuccaacuccugggcucaagcaauccucccacauuagccugaguagcuaggucuacaggugcacacugccacacccagugaauuuuuuaauuuuuguagagacaagguguggcuaugucacugagguuggucucaaacuccuggccucaagcaauccucccaccucggcaucccaaagugccaggaucauaggcacaagccacccaacccggccuucucugcaacacuuaacacacuuuuacuuuauuugcuucuguaauuaguugucuggcaccucuuucccagcgagggcaggguugagcuguuccuguggacucuaugccaaagcacaaugccugagacaggcucugaagacaaaugccgggaugaauggauaaaugaagcucugucucauguuguagccccuccccaacaaaucaccaucacuaugcugaacacuuggcagcaucccaccccaccaagugccauacagcaggccugcuuggaucuuuuuuuuuuuuuuuuuuagcaagaguuucacucuuguuccccaggcuggagugcgauggugcaaucuugacucacugcaaccuccgccucccagguucaagcaauucuccugccucagcuaccugaguagcuggaauuacaggugccugcugccacaccuggcuaaguuuuguauuuuuaguagagaugggauuucaucauguuggccacgcugaucuugaacuccugaccucagguaauccacccgucucggccuccccaguugcuaggauugugagccaucgugcccggccaccugcuuagaucuuuuauauggugugcuucccuguacaguuccccauucccuacaauuuuaauggaacaaaaaguucugaauaaaaacaagaaaaugugaaaagcuguaguuaauguaacuuucucaauuuucagaugggaaacugcagugcagggaaggaacgugccuguguuuuuggucaccuagcucuuucgcacuagacccccgggucuccugacuccugccccuggcuuguuugcuccacagaacucuccgcuaauguggaggggaacugacucugcagggaccagcagucacacuugccuccuccauuucaaucuuggacuuggccaggaggagcuugcggucaaagucacgcugcuucugcucccgcucggccuccaggucagucaccugcuucugcaaaucagccagcuucugacgcagcucagugaucuggguucagaggcagagaggagugugugaggcaaggauguagagcacuugcaggaugugggcagggccuggcugccccugggcccuccaacacugcccccaacuucuccucugggccauacuggggcucagcguggccacuccccaagguucaaagcugcuaaagaggcagcgagaugaagaccaggcaugcccugugggcguggccaggaaccccacauuaccuucugcucauacugcugcuucauggaccggaaaugcuggucccacugcuuguucacuuccagcagcuguggggagagacuggaguuagcaggagaugagcagagaaggaacaaggagagccaucuccugccccauguacaccagcgucccaaggugugcucggugugugugaauaguggcuacagacacugucuccaucccucagcucucgaaaacucaauguugcucaaagccauccaccuucauccacugcugcauuuuaccuugccaggaaagcaagauuaacacuaagacauggaaacuacauaguuuuggugaauaauuauggaacacacacaccucuuuggagggcagucugggauuauguauugaaauuucacauuuucaucaacuuuaacccaauaauuccacucugaagaauuuaaccaauagaaacacuuacacaagugugcaaauauauauacacaaggcuaaucaucucagcaauaccuguauuacaaaaaaauccagaggccaaucuaagcacagaagauagguuaaagaaacgauaguauaaacagacaaugugcagcuguuaagaaaauaagaaaauaggccgccaggcacaguggcucaugccuauaauuccagcacucugggaggccaaggugggccaauugcuugaguucaggaguuugagaccagccuggagaauauggcaaaaccccaucucuacaaaaaauacaaaauuuagccgggcaugguggcacgcaucuauagucucaacuacucaggaggcugagaugggaggaucaccugaacuuaggagguggaggcugcaguaagccgagaucauggcacugcacucuagccugggcaaccaaagugagacccuaucuuaaaaaaaaaaaagaaaagaaaaaaagaaaacagaaaauaaagcaccuaacacacuuccucaguuugaagaugacacuauccaccauacucuugauauaacaauuccucagggaagaaaaacaacccuacaucaucaacuaaauaaaacaaaaggaguauuggcccugccccuuaagauaugucauaaggauccacaccaauuucaaaaacauugcauaugauaaaaaaaauuacaaagaauuaaaggaauauagcauauguuauagauaugaauagauacucucaaaggcaguuaauuuuuuuuuuggaggcaggccuaggcuggagugcagugguaugaucauggcucacugcagccuccugagcucaagugauccucccaccucagcucccccaaguagccgagacuacagguguguacuaccacacccagcuaauuuauuuuuuguagagacagggucuugcuauguugcccaggcuggucucaaacuccugguugcaaguaaucuuccugcaucagccucccaaagugcugggauuacaggugugagccaccacgccugacccaguuaauuuuuuaaaaaagaaaagaaaaaauaaucuguaaagcaguguguguauauacauauauauacacacacguauauguauaauuuuauucuacuuugaaaaaaacugagggauauucaacaaacuguaaucaguugugguuuucucuaggaggugguauucuugaucuuuuuguaaugagcauuauaucacuuuugaaaucagaaaaaaagacgcuuauaacaauacaaaaagaaaucuaaaacuaauaugcacaucaagaagcuuucaaaugugcgggaggacaaggggaggcaggcucaggguucuagagaagcaccugggcuguguggagaggggcuagacggaacagacagaacaagugucuaccaaaaaggagcugcacuucgaccucgggucuggaaagacuggacuagacugggggugugaggagggggaggaacacaugugagauccaugggaagaggcggaauggacugcagcacagggacucugcugcguggcuucucucuuggcagcagagggaaacuaagagccucuuacgaacuggcuccugcaccuuagugggacugggggacauuuaaacuaccuaaagaccuggccaucgccuuaauggaguuuaggaauccacucaguauucuguggcaggcuucggcugcuggcugguccuuuucauucuugccuaagaaaauucuugaaaugggagucucaaaauaucugcaaaguagcuacaccaauagagguagguagcuauuuuuuuuuuugagauggggucuugcucuguugcccaggcuggcacgcgguggcacggucucggaucacugcaaccucagccucccggguucaaguaauucucccugccucagucugagugggugggauuacaggcaugugccaccaugcccgcuaauuuuuuguauuuuuaguaggcacaggguuucgccauguuggccagguuggucccgaaccucugaccucaggugauccacccgccucagccucccaaagugcugggauuacaggcaugagccaccgcacccagccaagguagcuuuuaacguuaaaaauuuugacaguaaauuuauggagccuccaggcuagugggaagcggccuuaaucccuuccuuccaugauggguccucccuaaagcaucucucaagggucccuccacuccucaucggugaugcuaaaacuugccuaacuuaucacaaccucuuuccaccauccaaggucuaccauaggagccugccuaaacuguagccccaacaauuuuaggccaugccccacaugccaccuccucagagugaccacuguaggcaaagggacugaucaagagaggacaguccagggcaaggagucagaccucauccaugggcaggcaggucaguggucaccaugccaacuccucauggugaccugggaccugccagagccaggaggccagggcaagccuuugugcugcuggucccgggagguaagagggauccucccacuacugccaccucggccaccuaccucacugcgcugcugcuccagcaucuucaccuucuucucggcugcgcccaaggccaccaccucugggaccuuaccugccgucacacuagccuggggagaagcacagaggagccuucaccaaaaccucaauacaaauuaucucacccagucucggugcuccucuaagaccccucacccaaguggccccagcccucugucucccuauuccucccacccagcaggacaccacuaaccaucccagucaugacuacguccccuucuagaagucuacaagaugaugauucccccucccugacucaggguggcugccaggcccucuccccuucccuucuccccucccuacggucauucucccuguuuagguacaaccucuaagguacuaccagccacucuccucacucccuacacacaucagccaaaaaacucucuggccuggaagguaagacauuugagauguagauacagacagauauagauauagauauacucauucuauaaaacauauauguuuuauaaaacuuuuacaaaaguugaaguuauauaaaauguuuauuuaaaaacauuuuuagaaagaugcagaaauaaagaucuguguaauacacauagauguuucccagcucuguccucuguaaggggcuaaagcagagacauccagcagcacugagcaaaccuagugcucaguugguuucuaaauaccauuuucuuuuuauuaaaaagaaacagggcugcuuugaggggcuggagcagauaaaauauaaggugaguuugaugcaucuuauagugauggaaaguaaggaagugcucaaaugaauaauacuaauaacaauaauaauaaaagagcaugucaaaagggcacaagagacaaccugaaaaaaacaucuauggccaaaacgggaacacuuugaacagcaaaauacaucacaauaguauuggauuauaagucacaguaugaaauaaauacucuugaguucauacugauagaacaaaauagcugaaucaauaaauaaaugggggagaagggacagcucuuccuuacaaaagaauucugauuaauaaguguaggaagaaugaggaaaauaugaaaucaccauuccauuacuacaguaauaacugcugcagguggagauccaccaauggucacuaaaaucagugagugaaaguuuaagaaaaaauagaguauuugcauagucucuaaguuucuccucaaaaauaaacacuuauuaauuacaaagggaaaauuggucacuugauugcagaaacuugaaagacagcacuuggccaagugaugaagguuaacaguaguaaaacacugacaucauguaccccuggucugcuggacugagaaauauucugcacacucugauguacacagaacgucaccuccgugagauucuugccaaaacacguaaccucaaucuccucaugagauccaaucacuugugaggccucaaucgugacagcaaauaagucuauacugaaaaacauucuacaaauaacuggccaguacaacucaaaaguuucaaggucaugaaaagcaaggaacagcuaggaacugucacagacuagaggaaaaugagggagaagagacaacugaaugcaaugugggaucccagacuccaugcuggcacacgacaggacaugagugcaaaucuggugaaaucugaauaaagucuguaguuuacuaaguaguacaugccauuaauuccuaguuuugaucauuuaaccuggguucuauaagauguugccguuaggggaaguaaaggaaggggauaggggaacucucuagacuauuuuugcaacucuucuguaagucuaguuauaccaaaauaaaaagguuuaaagguuaaaaaaaaaaauagcaagugcuggggugaaacagcagacaaggccaguaguccggagggugugugucgacucuaucuccaagccccucugugauggacaccaagacccucgucuucucugggcuucaaugcgaugagaagcucaaacagaagaaggucugcaggccccauccggacuucugacauugucugccaucauccuggagucagauucucucuauucucagcguucucuuuccagcguucucuuucccuccacacugcacccccaaguggcuucagguagggcugggugcagagcuugcccccuacaggcucaggccuguaagcacaccauagcaccaaggagcaaggugagggggagcccuccaaggaaggucacccccuuugagaaaggggacagacaggccugcccacuugaaaucugcggcaucuuggaugggagcugugcuuagcaaaaaggucaacaaguuaccggggaaggaggaagaggguggauuccaggcucuaggguggugcacccugaaccuccgcgagggagagaggaguccacguggagucagcagagcuggcugcuggccccaaaucuccccuaaagagcaacagcuaacguucacuguuuacgacgcuaaaccuacuuuacaagcauugcaucacugaauccucacaaccaccccuugaggcagguguuacuaucuucauuuuacagaggaaacugaggccuaggagucuuaugugacuuacccaagguugcagugcugguaaaagguggagcuaguauuccaccugcaugcaauuccaaggcacacucgucgccccucuguaacacaugccucuaaugagacaggugacccuggggcacaagggcaagucgcucccacucucaggaagggcaggaagagcaucuggcucggggcauucaaggaagacgaguggagauuaaagggcacaggaaaaguaaagagaccuguccagggaauuccacaccugaggcagcucagagaacccaagggagaacagccgagucuacaagucccuuccacaagagggcagacaaggccggaucugauuuggggaauaaagggaagaaaagaggaucuccaugggcugggauucggaacaccagggaagagcagacuuucaccauuuaucagcauguuucccuggccguacccuacaucugccugauagcaggucacacagaaauccugauuauaugauguuacuugaccucuccaaaccuauggccauagcuauagaauggaauacuagucccagccuugccuacucuauagguagagaugaggcccaaauaagaaaauagauuugcauguccuggguaaacucuacauugucacacaguaauaaggaauuaagccauuacgguaauugcuacuauugcauagguguaggguggguuaaagacauugagcccuacuguucagcuauuaaaccccauuaaagggugaaguaaaaacacguugguaaagaguugggacucagcucugcagcaaggggaaugguaacgacugggcaaggggugcagagucugcuccugcuugggaccuggauguggccagugcugggacuagaggauaggggagugggccagcccugcagcaucaccagaccacacagacacuagccaacacccuccccucuccacuuuagaggcuccagagacacaaucccaggagcuuagcagaauccaagggagcuugcucaaccaaccuaauucugccaggaauaucaaagauguuaaacugacuuuugggaaccacucucuaagacagaccuugacaaacuggaauguguuuacggaaugcacccagacugagcaaacgacucaacaccaccuucuaugagcaauggcugaaggaacuggagcuauuuagccaggagaagagaaggcuuaugaggcccaugaagccacagugacuaccagcagccucuaagcauggaggucaggccaaguaaagaaaaaaacacguaacagcuagaaccuucuaccacuggcacuggcugcaggagggaggaggcucacugucacuggaggugguaagcagaggcugaguaccugcaaccaaggaugcuacagaaggaauuucugaccacauaccugcugcuguccagccacugccuucuugccugucccuuccaucuucggugagccuggccgcccagacgcacccucuuuguugccauugcucaucaacaacuucuugagcuccaaauuuuccucccugggauggagguaaacagagaaaucacaaugcugacccugaguuaagaaaccuacagggcuccuuaaugcucacuaucgcaugaguugcagcugagccccagggaguacugcaggauccugaaaccugcccuccuggaaaaccaaaaagggcaucuucagcuaccuugcucucaaucuguggaggucucugauugucaauggcaggguuuccccagcuguggaauuucuaugcacacaagaccuuccggauauauccaaacacugcauuaaauaacccuggaucacauucuagugagaaagugacacccuuuccaauuaucuucacauuucuuguguagaccacggagacggugcgagcuuggugcuaacaggcccugggcaccucucuaguuacucgccaguuucccucguuaacacagaaggugcaggcugcaggcccagagccuucaaugugcaaugauccuuagccugaauuuauuaacauccuuucacuuucauuguauuuagaguuaucuucuauuuaucacagguaaugcuguuuuccauuuacucuaguuaaaguugccuuuauaauuuuaaguaaaaagaugaaucaaauuaaaguaaaauucuaaguaacuaauaaggcaggugauagaggagaucauaaaauuagugauguggauucaggucugacuaaaauguuucuucuuucuuuuuuuugagauagggucucguucugucacccaggcuggaguacaguggcccaaucucggcucaccacagccucgacugcuccuacucaaguaauccucccaccucagccacccccaaccucccccaccacacacccccacccucuugaguagcugggacuacaggcacaccaccacacccagcuaauuuuuuugguauuuuuuguuggggcugggggagggguggugauguauuucaccaggcuggucucaaacucauggacucaaagcaauccucccgccuuaacgucccaaagugcugggauuacaggugugagccacaacgcccaaccaccacuucuuuauguucuauuugccagcugaguuuccgcuugaaaaaccaauaaguaaaaugacuuucccaaggucauacagcagagacuugcauucuugccuucuaauccgugacuuuuuuccccagcuucaguuucugaauccauggauggggucacuagggcuauaaaaaccccaaaagugcauccuuggccauccaaaagcaaauaaauuacacacugauucaaaauagccaguggcucaguaguuaaacauuacuucuguggccauacuuacaaaguuuauauuccuucucuuucuguugauucuaauaagaaacaggagaggagggaaaaacagaguggcaaguccugucugugacacgggccuuuccuaugugccugagcccagcugguacccaccagaugacucaucacccaaacuguccaggaccacagugcaggcaggaauuguggccacucacaggauggagagcaaggaggcccaaguuccuguuguaagacuccaaucaagucccugccucucccugggccucaguuuccccucugcacagugagaggucugucugcaugaucuccaagggcuugucaagcucugacagucaagaucaguguuucccaaggcgugauccugugccuaccucguucauaaucacagagacuccuggugaaaugcaggcuccuaggucuugccuaagaccugucaauucagaaucuugcaaaggaaggaagggaaggcguauaaacuuguaaugccuuucccugacccucaacccucaguuaagucuaagcccccuaguccagugggggagcucucauguucucaggaagacagagcagguugggauggugaccagcaggaggcagcaaaguccugaguccucuggacagccaguucaccguuaacaggggagagaggcaagugcuggaggaggaaggaaguacaaucuaugcugaccuucuucugaagcucucaaggcacucuauacaccucccaagguggcaaaagggccagagagaaaauaccaaaagagccaaggagaaggaucaagagacguaaccuccaaauagggcucugggcacagggccucagagccacgguccucaacccagaaaucagugcugcacaccagccccuccuccugcagcccccacuccucaccccuucucugaggggccugaacuuaccgcagccucucggcagccugaucccgcuguuccaggcccuuauccaacuuggccuucagagccucguucuccuuccgaagcugcucacacagggucuguggggcaggggaacagacagggugagggaaaggaggggccccucccaggugcaggcugagcuagaggaugguggggggccuguagccaccccagggcccaacuccuuauccccuuugccuggccucaccccaucccucucuaaggagcuaagccacuuggccacccacguguccucucccuugggagccaacuacggagaagccugaccaaguaucagccauggggccuucugcuccuccaagacagacagcuccaucccuucuccuucaucccugcucccacugccgggaccccuauuccccaccagccucccccagcugacuucuacccuucuuugaagucuuaguuuaaaucccaucuccucagagaaguccucccugacuccccgauccagcuacauuaggcuaacuccguuauccuugcucacagccccccgcuuuuacgcuucucagcaccuguggcagauaaagcuaaagaacuguucgugcugcuguuuucuuaauaucuacccccuuaccccuaauuaauuccugagcucccggagggcugggaccccuaaccauccucuuguucacugccagauccccagcccccagcucaaaguuuguggaaggaacaacaugacugaacagccaaaugagcaaauggacaaaugagcaggcgaguccuaggggggcugaaaggcacaccaauuugcaggugugagaggugcccaguguugccaaggggaaaaccagaagacaaggcauucagucgggaccucacuaugcccucacgcccucacaauguggcugugacacuugguuccuccucuacaaaagaaagacaacuguuucucuuuuuuuuuuuuuuuuuuuuuuuuuuaagacagagucucacucuguugcccaggcuggacugcaguagcaugaucucagcucacugcaaccuccaccucccagguucaagagauucuccugccucagccuccugaguagcuggaacuacaggugugugccaccaugccuggcuaauuuuuguauuuucaguacagacgggguuucaccauguuggccaggcugguaucaaacuccugaccucaagugauccaccugccucagucucccaaagugcugggauuacaggcaugagccaccacaccuagcccagggacaacuguuucuucucugccuccucuauagggcugcugagagggacagaugagacagugagaguggaaguguccaugaaccaucagucacuugcuuaugugcggggacucauauuggaagcucugugaacugggggcauggaagaggggucgccagacucaggaccucacaggcuggggggaagggaaggugcugacuagcaaugcuagcauacagugucagcacagaguuguucaaucuuuccacagauccucacugagcaccucaccugugccagguacauugcucgguguuucuccauauacugccucacuggugccucacaacuuccucaaagcuaaguaacucaucucuauguuaaagguagggaaaccagguaaaaugauacagucuaacaggugcacagcugcuaagacucaucacuggcggggaguaaaacuccaauuggcagaccccacacuggugucucuuuccccugugaugaaagaucagagaagggagagagauggugcccaaaggaggggacagccuuugagcugggccaggaccagggccauucacuaaacagccaucugcugccuuccaccucccaggccuguugcagguggaugcaaccaugugacuaguucuggccaacaaaagagguguagaagggacaagcaucacuccuggacuggccuacgcacaauucuccagucucuuuuuccugguagcaggggcugauguggaugccucguauucuaaagggcaccggaaaguugggccccugucucccugggacucuaaggaacuguguagagcagaaacaaaccccugccacacagaauaggagggaaaacuuuuguuguguaacccagggagauuucagaguuguuucauuucugacucacaaaggagacucuugggaaggcugaauggaggacacagccuucaacuggagguggcuggacaaugagggagaugaggcuuagcaaacagagaaccagcugggcaugguggcucacaccaguaaucccagcacuuugggaggcugaggcaggaggaucacuugagcccaggaguucaacaccagucugggcaacauggcaaaacccugucucuacuaaaaauaccaaaaaauuggccaggcauaagggcgcaugcauguagucucagcuauucagggaacugaggugggagaacugagcccaggaggucaaggcuguagugagcuguggucgcaccacugcacuccagccuggguggcggagcaagacccugucccccaacaccccuuaaaaaaaagaaaucaaaaaauuauuguuaugaguccauucaaugccuagcagagagccuuaugcuauaccugaccuugaauauguuuguuuagugaaccaagaaacacaucagugaaugaaugaggaggaacuggaucaauacaccuccacccaggcaguaaaaauacccaagaugccaugucucugggcgaggccuccagggaacagaauggccugcuccuagucccuaagggaaggccaggacaaggccucacuugcuguccuacccuugcagucuagagagcuguuuccuuggagucucugggccaaugcccugggugcaaaccggccaauggauagaaucaucagaggucacaaagaucaucaccuuccauccaaggugcuacgagagcuaugaguucauuugaucauuuauuauuuuguccuuucauucauucaccaaguguguaugaagugccacgaacugggacgcaacagugaauacaacagacauggugccugccccccucaagcuuaccuucuagcagagaguauaagaaaaaaaagaguauaagaaaaaauguauuaaauaaaauuauuacaaacuaugauaagagcuaagaaggaaauaaacaaggaggggacugaaauaaaaaauaacagagguuggcaggaccccuuuuaaggggccuaggaucuauccccaucucaaagcugaaaaguggaugcgcaaagugcucucaccccaggcaccuuccuacccugcccacagccuaggcacugugccaggcucaccuugccaggguucagccuggauaccuugaagccucacugacaucuuaaagggguucccuucucucagccuggcucuccaggccucugccucucguucagccucaccucccaacacaccccuccccuccaggugggaugggcauccuccgugcuccucuacccccacaccucuccucauacugcaucuccaaccugauugcccuucaugcccucggcaaccaaggucacgcaagggggacucccccuucugccaucagcggggcacuugagugccugcugacaugaaugagaccacagaucagagaauggccugggaggagagucugcagggaguaaggaggcuucaagucauggcucugucacuaagguggcgggcacucagaucacgagcagucccucagaagccuccguuuugccaucuuuagaauggucaccaauuauaacugaacacuuccccgcugcuaaagcccacaaggcuaagacccccugcccaguguggaugcccgucaugaacuccgaauggggaccucucuuccagcauggacuagguucuggacugcacugggugcuucauguacauggccucauuuaaugcagcaaucuaaccauggaggcacuucuagcucauguuacugauaggaacauugggggauagagaggauaagugacuuguccaaggucauacagcaauaaagggucacuacuggaaccaaggaccauauaacuccaaggucuggccuggccuagcaaggaaaucuguccauuccccacagcacagggaggcuuucaaaaggaauucaauaggggaggcagguugggaugguggucaagaguaugggcuuuggaaugcgagagaucgagguuccaaucccuacuucaccauuuaccagcugggugaccuugggcaaaaaaagggcugcuuccccaccugugaaguggugauaaugagggugccuacccuggggggaaagaggcauuaugaaaggaguugaccuuuguucccucccuucccaucccccaacccugcacaugagaaauaaaggcagggcugcuggggguauccccaaccaugacacucgcauugcccaucccguauuuccccauuuccuuccucuuccucaucccuccccacaacuuccuuauccuguucaucacccugaacaaaaagcccgaagucugcccacaacacagccuucagaaguccccaugguaccaguggauucccaggagcaggaaggugggaagagcucggggggaagcacgccugccugucucgggcugcccuccccacgcgccucaccugcagaauggaggugcgcugcucauucuugugcaccuuggaugccagucgguugaacuccagggccaugcggcccaggugggugaagagcuggccgugguccggcuccucggcacacacacucagcguggucuccaggcgcugcaggugcagcaucagguugccguccucacggggcagggggcccagcgccuggagagggaaagggcacacggcccacucuucaccaaggccugaguaggcgccgccaguccauucucccucugcuuccucauuucucaugacucaguuucccccugugaccccagcucagccccgggaaauucuccaguuaugcagguucccugucuggggcugacucacagggcagaacccaggacucacaggccacugguggcuccacagcagcggggccaccauccucccacacacugggccuugcagagugccugacaguaagucacuugucugcuggaccucagcauccucaucuaccaaauguccgcacaacccuucccucccuucaaccucacaggguucuuaggaggaugaauugaccccugacaguaacaagcccagaaaagggacaucacugcacagucagcccuccauauccauggguuccgcauccauggauucaaccaacugcagaucaaaaaucuucuaaaaaaacaaacuggccgggcgcgauggcucacgccuguaaucccaccacuuugggaggcugagcgggcagaucacaaggucaggagaucaagacggccugaguggugaaacccugucucuacuaaaaauacaaaaauuagcugggcaugguggcacgugccuguaaucccagcuacuugggaggcugaggcaggagaacuauuugaaccagggagucggagguugcagugagcagagaucgcaccacagcacuccagccugggcaacagagcaagauuccgucccaaaacaaacaaacaaaaaacuguauugaacauguacagaauuuuuuucuugucauuauucccuaaacaauacaguauaccaaaauuuagcauuuacauuguauuagguaucguaaguaaucuagagaugauuuaaaguauauaggaggauguguauagguuauagggaacuacuacgccauuuuacaucagggacuugagcauccauggauuuuggguauccucagggaguucuggaaccacucucccauguuuaccaagggacaucugcauauacguccugcaaccuccgccuccuggguucaagcgauucuccugccucaggcuccugaggagcugggauuacaggugugcaccacuacaccaagcuaauuuuuguauuuuuaguugagacgggguuucaccacaauggccaggcuggucuugaacuccugaccucaggugauccacccaccucggccucccaaaguacugagauuacaggcguaagccaccaugccuggccuacacaugugucuucuggggaauggcccaagcauucaucagcuucugaggacccaagacucaaaacaguuuaaggaaccacagcuuuagcuauuucagaaagucccaaacuaguacaguauguaagaaauaaagcacaccgugggccagauaguugacucuuucucucuagucuaucuggaauacuccuaccaaagacauugccuuuguuacaccaauuccacucccaaggaccugcaguguuacccuacugcagacggcacugggcccagcuccccugcugggcaucuaaggcccuacagccgcaggucccauccacagcagcauccaguugggcuccccacuuuacccugccugaacccacacacaccaggucuggugucucugcauguguccucucuguguccucucugccucugcaaguucugcucauccuucccacccuguccacggcucagcuccuccagcagccucccggaaacaguuaugggaaucacaggacagcagagcuacagggagccucagagaucaggccgggaaaccaagcuauggggaggaggaacuugcccaaaguugcccuguaagucaguggcagagguauaacgagaacugagguuuccugacucgccauccagugcucugcugcacugaccucccacuucucugaacucuggaggaauggcaaugacuauaaccccaacuuggcauucccugaacaccuguguaauggcgucagugugccgcauucuaacaagaggaaaugcugcuguuucaacucugcauccauucccccacugccucuuuccacaaaggagcugagguggcagaugcugcucuauuuaaggcucaugcgaugcuucccaugccugcgacuucuccagacuacaagcuucagagcacagggaggcuguguugucuuggcucaaguggcucagcagagacaggcacacuguagagcuaaugaggaacuuacuacgucaguuaaaguuaucgguccaaagucagagugaaacacuuucugagcaggggaucuugccuccauggccagcaucucagagcccucagggacagaacaggacaaggggacagaagguuccaggcgacagaacauaaagagccuuuccaauacucagagcugccugaggcaguggugagccucucaacacugaaggcaugcuaguuagccagacagccaccugagggggcccugcacugggcacugacagguacauggggcaaccagugaacacaagcauauuugucagccaaaccuuugugaagggaggcagcagggaucaauauaucagugaagggcuagagcaccuauugcucgcauaacaacaauuaaagaaaaaaacuuaaaagugggaaggaagggagaauggagaagguagaaauuuaagucguuuaaagaaucuuccagacuuuucacaaugguucuucaauaagucugccauuuuaagaaagaacagaaggagauauaguuaggaaaaaggcagccaguguuguaagguguggaaugaggaugcugggcagacgcuccagagcuguacgagagacagagagagagagagagagagagagagagagagagagagagagagagagagugugugugugugugugugugugugugugugugugugugcgcgcgcgcgcgcgcaugcguguaaguggaaaguugaaccuccuuccugugugcuccaagagucugcacaaagagcaaaucaccugucuuacagggcccugggccuuccugacccuucuuucucccccgggguuggaagcccacagacccaaagggcugagucauagugugcggaggugccuggccccuggcagaaggcaacagggcuggcaaagagcccaggcuuucacaacggucgggugcccgugugcuccaagucggggaagucacuagcccaggaauuugcauaugugagcgagaagcacccuuugcuccugccccucguguauccccaagugacuccaggguaccuaagggaucugaacagguucugugccucucacaugguagcaagugacaggacacaaagagggcagcaggucaagcccgggguccugcccguccacucaccaucgcauuggcauggcugcugcucucuggugaauucugcuccucaggagugaccacuucaaauucagaggaggugcccugugcagaaaggaaguuaggugcugcccgagagaaaaacagcucaccccuccucugcggcccuguggcugagagcagcaagggggacaaaaucucuucccauuuugaguacacagggaccguuacauaucaucucacaugagaucacaaagcaggauucucgacaagccugucauagcccucugcauaaugugaggucauauccccucgauggccaauccucuuuuguagaagggagaugugggacuagcugaccuugaaccagcagcacuguaggauugcauuuuuuaaggccguguacuuuuuaaaugcuuucaugagcuccauuauuucucagggugacccauggagugggucagaagguuauauccucuuuggaaagaugaggaaacuacaguauacaguugguuaaugcaaaagcagggauugaacccaagacugcagauccagcauuccugccacggccccagagcugucucuuaggcccagacgucucugaucgguuucccagaacacagauggcagcuguuacggccaccaccaagcauguccugugcuggccuucccaagccaguccuggagaucccagaggagugaacugaucugagaaaagucccagagaugauucaccaaauuuggagacuauuucaggauucaaccaaauccacgguggccaagaaaucccagauuuuuucacaucuuuccgucauuccuaguagaauuacuggucauucaaccaaccaagaagccaauggcccaccugaaccagccauuagcucugggaucugggauuuccaugucccguuaaaccuggucugcagccucccuucaucccagaaaggggcaggauagaugagaggagucagugcucagcuuccagcugacccucauggccaccaagaacucaccucuggcucuuggcccugcccuagaaagucucccuccuccaucuacauuuuccccauuacccguguaaccucagaacagguccuucuuucccugcaccugaucuguaggauaaggaugcugaacuaugcaaucccuuguaggauaccaagcaaaacuucuccagccaaaucuguagauuuuuuuuuuuuuuuaugagagggucugacucugucacccaggcuggagugugguggcaucaacauggcucacugcagccuugaccuccugggcucaagcgacccuucugccucagccagccucccaaguagcuggaaccacagacauacaccaucacaccugacuacuuuuuuucuuagagagauggagucucacuauccugcccaggcuggucucaaacuccuggguucaagcaauccuccugccucagccuccccaagugcugggauuauaggcaugagccacugcgcccagccuguagaagauaguuucugagcccucuuugagaaugugagcuccaugucacaucugucuguuuuccuagcacugugcacacucagugauacuuaacaguauacaacuuaguaagugagaagaauuccuuguacauaccagggucuuccugguaaguuuuaacuaugaccuucauuucaaaauggggaggcugaggccccagagaguuugcgauggacuugcccaauaucacccagcgagacggaacacaguuucuugaccucaacccucuuucuucauguucuuguaucugucaguaggacuugagguccauccaggcaaccuccacccaugacuccaaauaaaacuuacacuggauggaggcuucuggacuggugcuggcuugucacuggggcaugcaggggcugugggagaugcugugacauuugaguccuuuccuggagaaucaagaaagcacagaugaacugacugggaaggggagaagcccagguaccacccucucaaggacagcccuugacaaaaggguucucagacaggauuccccacucgagugugggagaaugggagguggucucaucagggccagguagucugagaaaauggccugcccuggagugacggggcagagccugagcagagagaccaugcucccugggcuuacugggaaaaucccaaguuggcugcugcuccuugcugcccugaacaggccucaaugauaaagacaaugauuuacaauuugaaaagucuuuauguaucuauuaucccagccauucucauaaaagccccauauccccauuuuaaaggucaggacacugaggcuugggaaggucaucaacuugcccacagccacauagccagcaacugcaaacucaggacugagacuuggcccucccucccugacuuccugcaguccuugcugcagggagcuccuugaagguagcuucauuucucacucugagaguggaccuggcaccaaucaggaacucaggaacauugcugaauagacaagcagaggcuggaaaugcccacugacugcagcacaguggacucugagaccaucacuuuccuccauuuguccauucagcaaaugcaaccaccagccaauagaaggcugucacauuggccugggccagauaccauacaguagagcugcagcaggaggcaucugaguccagcugaggugcggaucauuuccauccuggucccagaccuuacccuggacuuggagacaugccagaguaaugcacacucuguacgcauggugaugccucuaccauacaugggacuucaaccccgagccacagucacccuguccuuuaaugggcagcacacguaaccuuacaucugaaauacgcugcagcaggcuaacaggcaagcccagcuucuucccugggccucagcuucccuaauuguaaaauggacgcgcagggcacgaccagggagcuuccaacucauaugccagcuccaagugacagggaguagcugcuuggagugcgaugccuggcacacaguagcugcucauuaaauauuaaauaugcugauaaagaccccaaggccacaggacugcaauguagucaacuguuguaucuauuacucaugucugcuggggccucaggagugcugagucacuggcuauuuuuaacaagauuguuuugaagucccuuccaaaucugaccuucugggggauguggcagccaaaacaugaauggaaggguagccugugaccuaaggauaaacgagagaauguggguuuuggcauaagaagggaguucacugugaaggauuugggcaguuugggguacagggagagucagagguacccagacuccucuuauaccugugagcucagccagggggucgaaggagcccaaggagggagaagguggugggagcagcucguuguccuucacuagcuccucugccuucugccggagccuggucgcuuccaucugggacucuuccaaaagcuccccuagaguuauuggggaagaggaagcaaaagcauuuacucggcucagugugcugcuucuccccgucccaggccccuaaccgugcugccgccuggcuucugaggcuccaggcccuggacuucacucccaccguugcucugugggccaagugggacaaacuccaugcugguccaccauaagaaacaggcuagagcaaggacgagggcccagcaaucgggggacacaggagcggaaggaaucuaugagaaacuccucggcucccccaacccccagcauucucuuucugccccacucccuucacacccagccagggcacuccacagaaagccaggggcucccccacccuacgggcuacccacagccugagccaccagggcaaagggcugccugcagggcggagaccuuggauaauuccaaccagcccucuaggccuccauuuuccuucuccuacaaguggagauggggaaaccacuccucccuccccagucggccaucccaagcaaggaucugccaagcaaggagaaagcauuuuaaaaaucagggggcuaugcuccccucuaaaacaugagacuagagaagggcacggcaaggcaaaggaagaguuucaggaguguggaagaaagagagcccccucuggauggggaaaucaaugaaagccuugucuggaggagaagggggcacagcaacugggugcugaugcacagggcccgucggucguguggagggaggugggguuguucuaaaguggggauggcuugagcaagagccaggagaagagaacugagggaccuaccaccuccuugcuucaagccaagcucugcucccugcuccaacaccuaggaacgcgugccccaguugccuggucaugcuggcucuccccaucucucgugccccagaaagaggagaccacucuaguuccauggccauuaacugggccuuccagcccccuuucccuuagcccacgccucccucuuggaccugaguccugucauccugguuuccgggugcugaggaaucaggguugggaauacugucaccaugcuacauggugcauagagacagcugugaggcaggagccagcgcugggccaggagggacaggggaugacuugggcagaggcauaugccagcuucauucuccacugcuaguagagggacuggcaucacagucugcagggaggggcgcucgcagggaggggacagggucugcuuuaccuaacaucuuuaucccuugcauuuuuuccuucagccgggaauucuccuucacuaggcgcucaaaagcugcggaugccucuccugagggcacgcugcccccagggucguagauccgguacgguccucucccuuccaugaggguagcucagccccugccguggugcccgccuggcuguaaggacaacagcagcauaucagcaggcuggccaggccaugggggcauccuuugcagagaagcucuagucugucaaugccccagaaggcagucccccacuuuaagcuggucugaccauauuauaguaaagcaggacagucaccuccuuuuaucuggacgcucugccucuauuaauacaaccuuagaauggcauuaguuucucuuagcagccucaaugcacuguuggcuuguuuggaacaggaguccaaauaaacaguagggugcaaugugggauacaagaaagaaccuggacuuggaaaaaaaaaaaucugaguucauguccugucugugagguccagaagaacaggaaucccauauguuuuacccaucauugcauccucagagccuaccacaguauuagcuaugaauuuugcccaauaaacacuuacucaauuaauggucuaggcauuaauuuacuaugggauuaugggcagucccuuccccucucugagggagggaaaugaaagucuuaaguuaauuuaguaaucuuuaaagugaaaugcuuguacccuaagggauaagcaagucaacccaguccaaaguuccauuuauauguguaucaucuucuuuaaaaaaagaaaagaaaaaaacacccugacuaauauuuaauacacugucacccuccuccgugagucucauaucauauauggucugucccuugcaguucuaaggaacagaagaauuuuucaucaaaccacugucuauuugagcaccaagguuuuuuuuuaguaaucuguucaguuucaucugcuuuaugucacugaaaccaguuggaaaggugauuuuagaauccuaacucuguggcuuaguagagaagcucucuguccauucacucauccauucaacaauuacuuauugagcaucgacuccgugcuaggcaccagucugggugcugaggaauuaucagcaaauaaaacagacaaaaauccuucauggagcuuauagucuaggggugaaagcagaggaggaugguggggaacacaauauuucagguaaucaaaaagucuaugcacaaaaggccccaagcauaaggagcuauuuuagccaagaccugaaagaggugagggaacuagccaugaagacaucugaaggaagaacauucuuugcagagagaacaguaagggcagaggcccuaaggcugaaacaccgagccagccuccagcccuccaaauagcucuccagcaugaaagggccaaggccuucacuggggaccucagaaggguuugggggcucggcaccuuccucccaaggucaccacccccaagacaaaaacuguuucaucaggaauccucaaagacccucccaaguccacacaccaugcuccguggguccuuggcgcugccaggugacuacgaccauaccacccugcucccagaauguaaaugaaagaucagagugagaaaggauuaacagcaacaccaccaugcuugaaucgccuccuugucaggcacugcauuaaauguuucagauauacaaucuuggaggagcugcacaguaacucuaacaugcauacuaaucucaucugcauuuuacaagggagaaacugaggcucagggcgguuaaguaacucagccacgaugacccggccgcaauaagagccaagaugcaaagucagcccugccugcugugacucugacccccaccauacucacacagccaggacacagagccagaggggcagacagggaguucaaaucucuuuguagggcagcaccaugcuaucaggucaccucugggcaguuucccuugcccugcagcauaagaaccaauaaggacuuguccaagagcguccauaggauggaaugggccagaaagaaaaacaaaguucugaugagaaggaccccuucucccaaagacugacagauacaagaugaauacaccgugugggaggcacccacgcccugcugagccugcgaggcaaaggacagcuacccacacucccaucacaagucaucacccggcuuaggggugacuuguuuuuaaccugaaaggucaguguucuacagcauagcacaaagugcagauguuuccaccgaacuaagaaacagugugggggcugcacuuagcacuggaacuggcacauaguaaaguacucaaaaauguuggcagacauuggggguccuuccccucugcuugccucuguccucacgaggcuugccaccugguacagcaugugucugacuggugcgggcauugcccaucuggcugggaacuuccugaggcaggagcguacuuugcacaucuuuguauuccugucgggagcacaggagggugggccuuccuugagagcugcuuggaguucaagaacagugaaacagagggcuacaaggggccuggagccaccuugcaugacaaaggcagcaguguccugguucuuguccaccauuaugcauucacccuaaauggaacucacagucaacaccacaugaaggcauggggaauuucuuacucaaugucugccuuguccuguagauuagaggcugcaugaggacagggagcaaguccauccugugugccaggguaucuucagaguggcccagaguagggccucgguaaaccuugaauucagagaagucagacugaagggaacaagcccuugaccccgaccccgccuccugcaaggccauguccaacaucccagagaaagccuaacccugacccacugaccagacgcacuuggacgcccagacacuucuagaauccaggcugggccagccaugcucccucagagaggcccagauguaaggcgaagggacaaagcaggaugcaggaugugggaacugaaacccaccccacguccuccaaaacacgcaacacucaguuucucuuggcgcuggggagucaacgggaaagggguucaugggaaacaaaaagugggcagacagagcuaugcuccccuacuuuagccucagggggcagagcuuggggagaaagaaaggcagugggcagaggagacgcaggagaaauauccuauugugggaaaacccucucuggagaucagaggagccaccccuggagggccuggacuucuggaggaaagaaagacaaagagggaaacagggaauuuccaaguucugcugaccucaugcccagauggucagcggcagucccuggaugaccacugggcagacgggaacucucccucugaucaaugagguuuuuauaacuucucccagagagaggacucauucucaggaugacagagcuggaggggacucuccaagggcaaugaggcgaauccugcauuaucaggugggagagagaugcacccagaaacacucaauggaugaggggcugcauucgaacaugacgauggcaugcacuccccucugcuguccacaaaccacgaggauguuuucaaaggggaaaaggaagcacugaccacuccccuccauguggcaguaucuggaguucagagcccaggaguccucgggcaugagcucaucugauucucacucacggcacaggcagugcagcaaggcaaggcccugagcagggaaggccaaggucacaaaggagucaggauggagcugggaccagaagaucccugcucucccuccaggcugcccacagcccauccuccauuucccuuccugcccagcaaucccauggcacaccacaggcccccaccacaucuucucagagucucuuuccaccuggccugguuccacaaacuacaaaucagcaggugcuccaccagcagugggacuccagccccgcuugcccaaaccagaaacagcuggugguauagaagcagccagcgcagacuuucuuccaaaacaagaccucagccagcggggccuccacagccugccccagaggggcccuggggcugcccgcuggaaccagaaaggcccaguuugggggcagaaaggggcccagacagacggcaggucaggcaacaaccacagaccgugaagauggaagugaugcugcugaaaccgaaggagccacccacuagcaggcaagcacuuguggguggcagggaggcaguaguccccagggcucaacucucagccuuaccccagaaagagagggguaugauaaagacuacauucagaauuaaauuuacauucuagcuuuugcucugaaaugcuuuggucugucagauuaucuucccauuagcaguguucugguggcuggguagggggguggucccagaccccccaaaugauauucacuugcauagccacuaacauuugcaaaauacuucauagugucccaagcauuguuuuuccaucugauuaucacaacagcccugggaagaaggcagggcugauaccugccugauggauaaggaaacugaaguccagcuuggggacuuaaucagcccaauuuaaugccuuuggucacuggcugcauccuggggccagcuaucccugcaacccuggagcaggugaugcccucccuggcccagagggaaaaguguaagcaaaucucugguacagggagguggaaggucaucgaggccaacaucuaccuccccagcagaggugagggcugccagggaugcuggcaggugggcuggcagaggggguauagggaaggggucuccaggaaagacggcacagaacagaacgucagagaggucuauucuagugucuacucugcuguguauggaaccaugggcucauucccucacaugcaaggggaggagcaugggccacacagaaaccgggugauggcuaaagcuggccucaggaucaagaagacccaagucucaggagcuagcagcaagcugaggaaagagagagagccagcaccauggaaacaucgcugccuuggaggcaggaagaaagguccacacagggaaagugcucaaggccaaccuugcgaacacgaggccugagagggggccucaccugcacuagccucagcucuguccacccugugggcugugaaacccuggagcagccacucaccuuuccugagccucaggugccucaucuguaaagcaggaguaauaauagaaccuaccugauagaagaucaaagaaauuaaaugaaacaauauguguauaguuggaagggaauucucacuuucuacuuuaggcaauacuuccugauuaucugauuuaacaagaaacacaucuuuguuuuauaauaagauuuccaaaauaauaagaguauacaguaacuagcucagcauuugacacacagcaggugcuuaauaaaaggcugaggcaaccccacaacugugcccagcuuaucuaagggccaaggcuuuccccauuuguucucuccuuuaaugggauuuuaggcucuuccgucagcucaguaagcuagguucuggccuccacuuauucucuagugaccugcauaucaccauuuaacugugguuaagcagggugccuggacacaccauagcuagugaacauguagcuauaagaagcccuugaaccacgaugccacacucaccaacaacugggaaucugagccucauuuccucugcuguaaagggcaauauccugcaauuccacccaaggaugaaaggaagugagaugccaugauaucacauugcagacauaaacaaaaaacuguccacauauuuguguuaugaugaccuccaguccuccccaaccaauuuccaggcuggggaaacugcagccucagguccauccaucaaaggccggguuggauuuuucaggcagugaaacuacucuguucaauacuguaaugguggacaccugccauuccacauuuguccaaacccauagaacauacaccaccaagagggaacacugauguaaaccauggacuccgggugacaguggugucaauguagauucaucaacuguaaaaaaucuaccacucugguggaggauguugauaaugggggaagcuaugccuguuagggguggggggggcgcaguauauguaaaaucucuguaccuucuucucaauuuugcugugaaccuaaaacugcucuauaaaaaauaaggucuuuaauuuaaaagagaaaaggaccaggcugggcucuccugauggcugucagguucacacaugagugaggacacagcacauacuugagacaguguguauucaaggaccgcacccuggcauccucaccaacaaggagcccagacuuaacuccuccauccuugcaaucaacugagcaacaaugaggcugcagacacagagucucauauaguaacagcuggggcgccagaacugugggaucuagucaagguacacuagggcgaacaucuuaacccucacuaggccucaguuaccuaaaaagagggagcugcaaaaauaguaauaacaugggggguugugcgggauaaucauuaaggccccuuccaguucuaacauuucaggaucugaaauuuauuagcacuacuuucuuuaaccuucuaaccuuaagaaggcuccaauccccagcuccaaucccuucuaaggcccagguggauuucccuaacccaucaguccucccauaagagcuuucauaggugcuauccccuccccgagggcagucagagacccucagcugacauccgcagcccugugccagguccuccccuccugccuaacuuguaccaggcucuggccaagccugaucuguguuccucaacauggcacacaucuucccauguccuucauccuccccucccgagucacccacaaagaaggccccacugucuccacucagccuccgaggcccagauuacacaccacccgcuaaacaccugagccagaauucacacugcaaaagaggacuggagagcaccuaacuaagcuggagagagggugacaguucguuaggcgcuaccguaugccaggugcugggccgcaucaugacgcacaugaccucauuuucuucuugccacacagauauggaaauuaucauccacacuuuccagcaaggaaaccagucgacgcagcuacauggaugaggaagcagacucagagaaguuaagucauuugccugagaauacacagcugguuagugguagaacaaauaaugcagccucaaucugucagauuccaacaucagugcccuuuccacugcucuacacugccuggagaggcggcaggcugaagcucagaggugggaaaccagaccuacuuuccaguucuccagaacgugccccaaguuccuagccccugccuuuauaugucucuagcuuuauaugcaaccagguggcaaucugccccacaucaccugcagucaacaggguuuagaaucucaggcuggaagggagcucagaggacauuccauccugugcuuacccaguccucugaggagcccagggacuccagcuggccaacuuuagcaauccagaucucaccaacuuccuccccaaaacaauuccuggggcagccagcacuggcuacaguuaggcugcucccaguucuguuuccacuggcccuucucuccccucugugguccccuggaauaaggaacaagaugcccaucuucagcaugacagccagcccugaggacauuuggaaccugcagccuucucuauacuguuccacauagggacugcccccccuccagucccccaccaacccucuaccccacacuaucucuaguugguucuagcacuggacccaacauuccaggcaugguuugccugaccaaaugcaggcuuucaccuccacccuuuuagguaguauauuccuauugagggagccuggguauacauuugcuuuucuuacagcugagucaccuacugaagaauguccuuucucaaugacaacaaccugcauguaugccuaacuggugagaacaaaguucucauguagaaacgugugcuugagggcugggugcgguggcucaugccuguaauuccagcacuuugggaggccgaggugggcggaucaccugaggucaggaguucgagaucagccuggccaacauggcaaaacccagucucuacuaaaaauacaaaaauuagccaggugugguggcgggugccuguagucccagcuacuggggaggcugagguaggagaaucgcuugaacuugggagguggagauugcaguaagccgagaucacgccacagcacuccagccugggagacagagugggacuccaucucaaaagaaaaaaaaaaaaaaaaagggguguuugaggaggugugaguuaccuaagggggcagaaguaacugauugauucaguaauacccuaucuaggaaucuagagaucuuugcaucaguacacagaagcuggacaaaaauaugcacugccacaugcuuuguaauagacauuuuugcuauucuugaauguccaucaagaagggacugguuaaacaaaccaccauucauucgauggaauacuauacagccaucaaaaagaaugggguagauugcuuggcaaugauacagaaagaugcccauaaaauacaaagcaaagugcagauuuauauguguaacaggaugcuauuuuuuucaaaaacacauuguguguguguguguauacauacggaaucuuaaaugugcauagaaaaaggccuggaagcccagugcuuugggaggccaaggugggaggauugcuugaggccagggguucaagaccagccugggcaaaaagcaagaauagauucucuauuaaaaaaaaacuuuuuuacauuagcagagcaugguggcacaugccuggagucccagcuacucggaaaguugaggugggaggaucacuugagcccagcaguucaggcuacagugagcuaugaucaugccacugaacuccagccugagugacagacuaauacucugucucuuaaaaaaaagaaaagaagaaaagaaaaaagucucaaaggauacauaccaaacugcuacuaguagacugcucuacagaaggaccucgguaaggaacuaaaaccaaaagaaacuuuuauuuuaccuaugcuauuuuaacucuuuacaugggaaaucuaguccuguucuuauacaauuauaaaauuaguuuuuaaauacaguagggacagaggaaggggaaaggaaggagagagaagacaacugucauuuuuuacauuauaucuuuuguacugcuugaguuuugggggguuuuuccccaauaaucaugugcuauuugguaauuuuuuuuaaagggaaauuuuaaaauauuuuucuaaaaaauuuaagugagcugagugcaguggugcaugccuguagucccagcuacuccagagacagacgcaggaggauggccugaaaccagaguuuaucuaacccuguaacuccccugccuccaagagguaagaugccaauuuuggggaauuccucuuauacaaaauaugguggaaagaggguuucacagauucaaauccuggcuaugaucccuucucgaaugacccuggguaggccucacuuuccuuguuucucccuauggaaauguuaugaggaccaaguaggaaccauagaguucucuguaaaccuuaaaaugcuacccagacaggagcaguaauggcugccaaggagcuaggaaggaaaaggggcuggacaggggcugagguacucagaugaaagccaaagaugccuuguguuaacaacaaaaagcugaaagcuaccuaaaaugaagagaaaaaugaauaaauacauuguggcaauuuccuaucaggaaauacuauacagcagugaaaaaagaaugagccacagcuggagauacgaacaugaaugaaucugggucucacucuguugcccaggcuggagugcaguggcaugaucucaguucacugcaacuuccaccucccagcccaagucauccucccaccuuagccucucaaguagcuggaacuacaggcaugcgccaccacacccagcuaauuuuuguauuguuugcagagauggguuuuggccauguugcccaagcuggucucaaacuccugggcucaagagauccaccugccugcucugccucccaaagugccaguaaggcaugagucaccacgcucagccuaaauaacauuuuuaaacauaaaaaaauacuauguauuauuuagggaugcacacauuaaaaaaaaaacuuuaaagaaaugcaagaaaaaaaccccacuaaauucagaacacuuguuucuuguugguggcugaugaaggagaaauuucaacugauuggaaauguguuauuucuuaaaccagaugagugagcauguaggugccugcguguuacccucgguaucugagagacuccuucaauuuuucuuuuuucuuuuuacuguauuguuugcuuuuuuucugcuucaacuuuuauuuuagauucgggggguacaugugcagguuugcuaccuggguauacugcgugauuuggguaggggugaucccaucaccuggguacugagcauaguucccaacaguuuuucaacucugccucccucccuccccacucuagcaguccccagugucuacuguugccaucuuuauguccaugaggaccugauauuuagcuccacuuauaagugagaaaaugcagcauuugguuuucuguuccuguguuaaugugcuuaggacaauauuuucuaaaagucuauguugccaguuuccugaggaccagaucacgcaggaguugcaccugcagagacagaagugggcuggagagggaccagggcuccuaagucugcugcugaagcugacuauagcgaaggcaaaggacaaguggccugaaggccaacagagagccuggccaaugcucugcccaguggguggagacugagccaaaggcccuugacucauagggcagucccauaccugcccuggccucucagcaugacuccuuggugacacaacucccacagcacccacacaccuacacccaccuaccccacacacacaccccugccugggcugcccgguuuguccacuguguaggugcucaaggacgcagagcuccugccucucaaggaacagccucagggugaggucccugggagagaagaguucagcucugcccagagcagcccucagacaaacagccagcugcugcucaccagucauccauuccaaucugaagagugacuguccugggccagucaugggaaaaucaucaagaacuucccacaauggucaugguggccgccaaggucuuucucuggggguugggagcugugcucccccacaaaacaaggggacccagcugcccugugccuuccuguggcaacucucuggaggaugccuggauacccucccuacagacggccagggauaggaggggcaggcacugcaggcaugugggggcauagcagcaagaaucuaggagggcaggcacagcaaggccuggcccagagggaaaccaggagcugccagagccaaagagagggugacccaaucauugguuguuauagaguuuuuaagacuuggaagagaaugcccugagaugccagagagugaaacauuuucauucuaaagcugggaaaccaaagucggcaaaggcgaacagacgugcccacagccacaugggacagcaguggcacagaagaaaugcacaccucguccucugguggccacugugcacucucuuaccacaccaugcuacugcucaaccucucccccucccucacaguggucagguaagcaaugagggaaaaugauggaggugagaaaggaagaacccgggcugaugugggcccacaaaagaaagaagucuggaauaacacuggaaggggcugccuacgagguggaaagcgcccugaucccaggggucggggucacgcagaggggcacuggggcuguugagggaaugcaagccaggugucuucaaagccccacccacaucugaguuuccgccacuccaaacagggacagauguuugagacaaagcaaaggacaacucauccagaggggacacagcauggaccacaaguggcagaggguugaaggcaagugucuuagucugcuuucugcaacuauucuguugaauaucacagacuggguaauuuauaaagaacaaguuuauuuggcucaugguucuggaugaugagaaauccaagugcaugacaccaccaucugacaagggucaugccaagguggaagacagaaggagaaaaugagugauugaaauagagaguguauuagccaaacuggccccuuuuauaacuaaccucccgucccccuaccccgugauagugacauuaaucuauuuaugagggcagagcugacaauccauucaugaagcagagggauuacguuuccaagauaugaacuuuugggggacacauucaaaccuuagcagcaaguuauccagagcacagaaaaucaaaccagucucaucaucuucuacuggaauccugucaauagccucaugauuagcaucauuaacgauaauagcagcgacccuguaccaagcgcuuaccacacugguggcccgugcugagugcuugccacacacuaucccauuaauucccaccauucuaggagguagcauugacgucauacagagcugacaggugaggaugcagaggcccagagugacagacacggcaccuacccaggucugccaagcacugaaucaugugcucuucaccaggggugcucaaggagcagcccggaccagcggcacuggcaccaccaccauccacuggaucggaugcucuggaguugcagcccagcaaucuguguuuaacaaccacccucuaccuccauccccaggauugugaugcaugcucauguuugugaaccaacugcucugaccauuucccaaugcugcuaaggagaaaaaucaacauuucuaugucugguaucaaaaucuuuuagggucuuucccaggccaacuggucaauucucccaaccgaggagaggcugauuccaguuauugugacuagucuacuaaguuccagaagagacccagguuccacucugcacuuugucauuuuuuuagggucugaccuugaagucacuucccuccagaagaccccuccaaccaucuggugcccccaaauuacucugcacuccaguuauaccuaugccaauccgacucauuuggcacuuacuggcacacaaugccuuucaggucacacucauagcacaucuccccauuugaccaaaaguuccuggaaggcaaagccagcuccuuacgcaccugugcaucaagaacacugcauggcacugggcacaggagucaucaggaaaugaugcuugggagagcgcuaggagagcacucugguucuccuccugccuucucaucucuaggccuuaauuuccucauuugugaaaugugccauuauucuacucauucacugaacaaacucagaagagccauccaccaggcacucuucucccgcuacagaaauacacucgagaggacuaaggaggucccugcucacccccuucuauucuaggaaaagagaaagacaguaaacaaauaaacacuaaaaauaacaauuugccagacacuaaguucuauacauaugcuuucucauucgcaaauaagauucuuucauagcaugauacacguaugagaaaaauaaaauaguaacgugacagaaagugaaaaaaggggcugcuuugcauaaaaagaucagggaaggccccucugaggagcugacauuugagcugagacuugaucgauaaggaaaaaccagccaugggaaaaacggggaaagauguccugggcagagggaacagcauguaugaaagccuaaggaugagaacaagcuuggcuugcuggagggggaaaagcaggccagcauggugugaccaaaucacagcggguacaggaguaaaacaguaaccaguggguuggagagagaggcagacaaacaaccuccuacaacgcugccucucucaaaucaggucggccugacccaaccaggacauccgggccccaagucacaggcagcacuggggguaaggguaugacucagaccccacagcuuccuggggccccgaaaaaacugguggggguauccaggggcaggcaucaaccuucagcaugagugccaugccauacccauggaacacccaaggcugggagacaaacgugguuacauaagcguguagaacacugcacacucccagcggcagcuuccagaggggcaugaucacgugcuuccaugaagugccagucccugaucacauuauuuucccgggacacagccaggacagcagccuuggucaggggaaagggaacaggguccaggauucaagcguugcuagucuugggaaagccuuaaccuucucugggccucaguuuccucaucugaaaauuaagaguuguuagaaagauuaagugaggccgggcggggcggcucacaccugugaucccagcacuuuaggaggcugagacgggcggaucacuugaggucaggaguuugagaccagccuggccaacauggugaaacugucucuacucaaaauacaaaaaaauuagccggggaugguggcgagugccuguaaucccagcuacucgggaggcugagguaggagaaucgcuugaaccugggaggcaaguugccgugagccgagaucgugccacugcacuccagccuggguaacagagugagacucugucucaaaaaaaaaaaaaagauuaaaugagauacggaauguaagcacugugccuggcacauaguaagcuauuagcauuaucaguuuuuucacugccucaguuucuucuguugcaaaacagagaccaccacggggaugcugaguuuguacuaauauucuacccuccuaauacaauucuacccuccuuugucaaggauuuuuuuaaaacauucugaguccccuuuucugaccucucaucagaugccgaauuccccucuaucacaccccauuguuuggaaaaugaguaagugcugauuaaaucccauuuugaccguacugugagaaaaaaaugaugcauuaggaaucuacacauuucccugcacugucauucugcaaggggguggggaaggacguugcugauucuucugcaucauccacaaaagucccucccucccccuaccaaaacacaaucucucacccagucgcacaaaauucccaucugcuccuguacgcacaaugaauguacaaugcacacgugcacacaaauguccuacaguggaaagcucagccuucauacuccauccccagaagcacuccuggaaacucauccauccugcacaugcacacaaaugccuccaacaaugugcauacaaaauauguucaacagaaauaguauaguaggaacucuggagccaaaugccugaguucauaucugacuuugcaacucacagcugugugaccucaagcuccaaguaccucgguuuccuaaaguauaaaauggagauaauaacaauauuaauguuuaggauggaagugacaauuaaaugagucuaauacacguacagcguuaagaucagcacuuggaaagcgcccaauaaaaauuauuauuuuccuccucgugacauauguacacugcuuccacaacuugauacgaaaacuccugacgccgcguaggcaacucgucuccacaggauagacacccaaagggccgcagcgccgcccgcacccggagggucugcgcucucuacaaccgccccacgccguucccaggcgugcuaccccgcgcagugcgcacgcgcgccccccaccaggcccagcgccaagcagggaguagcggcucagcccggcuuggccgcuggcggagacgccccgggaccccgcgcgccgggccugggugcacaagccaccuuccccagcucgcuccccgccgccaccgaggcucuggacgaucugggccuggccucccuuccuccccuccauccccgcuccgggccggccggcuuacccgaggacggggagcuuggggacacagcgccccgcuugcugcguccagccccgaauccagggacggggcagcggcccgggcaaggcuccggccccccguagcacuccuagggcuccuggacgggggcagggcacccgggccgaggacgaggaagugccgggggccuggccgggccgccccaccccugggaaaguccccggagacuggcaggccacucgcccaaucgcgccgcgcgcuccgggcgggcccgcggccgccuggggugggaccgagcgagguaaacaccggcugccugcgguuccgggggcccgcggugucucucgucccuucggcggccuuccccucuaggagcgacuucccuggggccaccgucccgggccugcgcggcgccuugccgcacucccagcgccggaagccccugucgaaggccuggggccaccuugaaagccggaauuucagagcggaggcgagccacagagaccacccagccccuuccuugugccgaggggaacacaggccagaacagggaggggaccugccaaaaggcacguaagcauuuggcccuaagccagagcuggagcucaggcccccagaguuccguccagggcacuccaggacucuucuuaacaaagcuauagaaauuccgagcugaaaagacccauaaagacucuaccgcgaacauuuuuugcuccagacauuguaaaggauucccagacaucguaaacgcuuugcuccagacauuguagaugcuuugcgugcauuauuuucuucgcacaaucacgcuagggagguggguuuuacuaccuuuucuuaaauaauauuugagucacaaaaagguuagaugaccucaguaaggggcugaaucaagauucaaacccgggugggcaaauccagaggccgccuuccacccuaccuacuuauaugugggcuagauaaucccaacagacugggauuuccuagaccgguaaggaacauaaacuugcuuuaaggguaggaaagcuuuuuaaaagcuuauccuuuuauuuuuaaaaagaaagaaagcuaaauuuuaauuccaaaaaguggaaggucuaaccuuggaauaaagaacagcucuuuaaacuaaauauagcuuuaugaaaaaccuauugcaaaagacccauuucacugguacuguugaaaacuuagucauugacaggcccucauccucaaaaagaauuaggggaaaggauuuggggaacuguuuaauacacacccucauuuuacagaagagagacccaucaaucaacugugacuucgcaauaauacacacacagauacuugcccaaauuauauaccuaaucuggggauucuccuauaaggcuuuguaaccuccuaggguuccuucaguuaauucaacgguguuaucagaucuucaaaacgauauucauucuaguuuaauuaugaaaagaauuacacuuaugccuugauucagaagggagggagggaggaagcgaugcaaacuccaaagcaccacugagucucaccacugggggauccuacagagaaacugggaauccuggcccugguuuacauagcagcucccaggcaucgucuccacccaucagguccgcaccugccaguuuucuuccugcucuuugugccuguacuucccaauucucuuccugcagggcucucuuccuauucccaacccacaucuucuccacccccacccucuacccacugaaaacuaaaaucuaccuaaaaauggcuggucucuaauuacuugcauuuuguuuccacacuauuucagcuguuuuuauagcaugucuggccuuagccgggcagacaguuucauuucucaaaguguccgcugggaauucucaagcuugacauaaaaaaauggcacucagucaucuuuuugucugauuuccuaguucuggauccuuuuucuuaacaguuccaauuugugagaaaacucauuuauuuauaaagucgugacugcccccaccucuuccauucuuugaagucuugguuugucuucaggacauuccacccuguuagagaccauggagcccauagauaacaaaccccuauuugacagauagguaaacugaguccucugucuagaaaaggacuuacucuaggccacacacauugagugacacaaccagggccuuggaauccagggccuuggcucccaguccugugugcuugguccacuguaccaaguugucuuuacaaugacaugauuuuucucacugccuugcagaaaacaccacugucauaaacacaggcuaugaauugagcuaaugggauuccaaucccugcucagccacuuacuaccuggguggccccucuaagccucaggcuucugucuggaaaaugggggauaauauaccuauuccucaugugaaucaugaggauaaauuggacaaugcaaauaaagcccaaggcucagcacacaguaggcauucaagaaaugauaguggugucuagaugugggcugcaugcauuggguagaacuuggcucuuaaacucagcaaugcaaccucaccaggcgccaucccaccauacacauccucugugagacccuagccucuaggagcauggcaggaaugggagacaggcccccuagccuggcacugccugcuacccuguggucuggaaggggauuuccaagucaagaagcugggccugacgcugggagcugagugacucaggcaggugcaaccucuuguucuuccagaguaaugacaagcacucgcacaaagccacacccagaaggagaaucaaacugccuuuguuuuguuuuguuuuauuugguuuuguuuuaaagcacgcaacuucucgaucuccuuucugcuacucccuccuccaccaccccuacugagguagcuacagagucagacccaaauacacauuugaagguaauaaaaaacauaugaaaaauccaucuauaaccaacuuaacucuagagcaaguuccagaagagggguggaggcugcauaauaaaagcauuaaaagguaacauguauggaguauuugcugugugcuaucuccgcgcuuuuauucauaauuugccucccaaccagcuuaugaggucggcaccauuaucauccacauuucacagaugaaacugaagcuuugagguauuagaugacuugcccaaggucuuacagcacagcaaguaaccggagcuugaagauccaggcucuuaaacgcuuaacacucuuaagcaucaugcuccaaagucuugccagcuagcaagacauagaacucagagugccaggcuugaagggucuuuagaaaugaucaacccaggcagggcaugccguggcucacgccuguaaucccaacacucugggaggcugaggcggguggaucaccugaggucaggaguucaagaccagccuggccaacauggugaaaccccgucucuacuaaaaauacaaauauuagccaggugugguggugggcgccuguaaucccagcuacucaggaggcugaggcaggagaaucacuugaacccaggagguggagguugcaaugagccaagaucgcgccauugcacuccagccuggggacaagagcaagacuucgucucaaaaaaaaaaaaaaagaaagaaagaaaugaucaacccagucuuuucauuguagggcuggagccacaccaagggccagagagcggcagggacuugcgggaggucuuacguugaguuugugauucauacauaggacagaacccaaguauccuucucccagcacagugcuguuuccacauaccccacugauaggaaauggagcaucuaaaucaaacaagaacauuccucauugcauuaggagaaugagugaaucagggccuuggcuaggggagaauggaacucgggagcagcuaaugaacuaggaaaagagcagcccugggucccuuccuuagauccauaaccugaggcaaucucaggaguguaagacccuccaguggauucuagguacuuuuuggugcuggguguauguguauguuaaagagagauuuuggugauaguuaaaugagaaugcauaucaagcacaugauauugacuaaaauuguucuaggcaauuguggcaguuuuugguaaaaaguaaauaaaugagcaggguccauggucccagcuucucuccucagccuaagaagacauuuuuaauucucucuauccagcucccaaauaccugcaugaggagguaguuguaucuucagagguuuucacagucauucagcaccuuaaggugaaugaaaccauuucauacccacaacuugcccauuucccaagagaccgucacgcagaggauaagguguggguucuggccucugggcuuaaaucacagcccugccacuuacaacucugugccuugguuucuuuaucaaugacaugaaggcuguaacugugcccaauucagaggguggugacaaucaaaugccacaaggcuuggccucagugaaagguagcgaugaucauuaugaucaucaauucuaugaggcagcagggauugcuucucuccuuuuuccaggaggaccccaaggccuggagcuggggagcagcuugcccuagacaucagacugucuucugaggagcugggccuggaaggcauugcugcugacuuuucuccaggcucuuuccccuuuucuuccuucucuaucccaacuauuuucccugugucccugggcuggccuguuacacuucaguuucuagggcaccacuggaggagaggaaagggcaaagugacacugggggaaauucccagccucgucacauacguggccuagccaggccccucccacaguuccuaggagcccugggucuccccacuccagcgucucucccccuggccucuccgucuccaggucagggugucaagcuggaucugggcuugcauccaggguugccccuugucauccuccuggaagugggaacaggucagccaggcccagcccggcccagccucucaggaaguuagacccacaaaaccggagcauuuccuaaucccgggaagcccuaacagggcccugagagcaauccucuuucagucccacccaccuuccucccuguccucucccacacccucuucuucuauggccccuccccgcucucccuccauuccucuguagccuagaagccaccgucagacuuggccucuguuccuugccucuucuagccagggacuucccuaggcugugaaaagaugccuggggaggggaugaagagggccguuuggaugaacuggccuuucuucaucauuccugguuccagaguuuccucauucuuaugguaacauuuauggaccacugaggauacaggaguggaccaaucagacccgcuuccugcucucucagagcucacagacucucaggagccauauggggcuauuuaaauaaguagaauuaaacuaaaauuaaauagaauuuuaguccagauuuucuaagugaucaaagaggaagcugcgucagcugugucugccugcccuuggcccacucccugugcccugggcucucuguuacagguuccaccacaaaagaguccagcggcccuagaagcagagcaggcaggagagaagcaagagauccuuuugcuccaguguuaaggagggucucagccuccacuauguuccccuggaggcagcgccgauucuuggccucuuccuaucuagcuguagacuucuaaagugcccaacacacacuuguacccucuccaucaaaaauucacuguacacacagauacacacacaaauacacacagucaccaacuuacacccacacagaaagacacauacacgcuucagggaucugacacaacacaggcacacauucucacacacacaaacacccacauccauauucacacuugcauaccucccuuuucuugagggaauaagacaaaaauaggcuuugcuuuucccuuuggaaaagcuaguaacaacuagagagaaaaagacuggccaagaaggcaaggccagaagaagaggggcaggaagaaggaacgagaugggggagagaagacaguggagaaggaggcugggugaggagcaggggcugggagcccaagaccugggugggaagagcaagcuaggcugagagcagcagacccuggcuggcaggacaugggaggccagguggcucuuggcacagagcugagggugucugcuugccccagcacccuugugcgguggguccuuuccccuguccuggcccaccggcccccaucuagucacucaccuggggaagggcaggagaauacgagggugugugcaccaggggcggcugucccuaugaaggcuccucggcucacugug

SEQ ID NO: 16578 - RNA, 16282 nt, Homo sapiens
ccaacuccgccuacgccccagagagggaaggccuugacaccuacgcuagagagacaggcuccaaugaaaagagcgagggggcggagccgggaggaaucgguccaauucucggccgggaagucucuggccgggacggggcagggcgaaccugccagugacuggacucagcuucuuugcguaaccaauacuggaaggcauuuaaaggcaccucugccgccacagaccuugcaguuaacuccgcccugacccacccuucccgaugcagucccugaugcaggcuccccuccugaucgcccugggcuugcuucucgcggccccugcgcaagcccaccugaaaaaggugagugcacccucuuuuaagagucuguuugcagccuccuggcccagcuacgggugugcgggucuggcugagauauggggguggccacuccguucucuagaauugguucucugcacuagagccuuccaaaguaacuaauuaugggauucuggucuguacaaugaggguggccucuaaagacuuguucugcuccaggcccuuuuuggagagauuaaucucacgucugcacucuccugcccucccuccaagcgccggagugaaaaugcagacagccuuaaaacuaaggcauugcccccagagauucaguccuguuaacccugcaccuuacuccugacccccacuccuuaugucccccaugauaaggccugcugccucaucucuuccccugcucgaaugcccugaggucuuccugagaguugggaggguuugagagcuuuuccaggccagaggauccagauuugcccaucuggugacaaauacccaggccugugaccccgcugcccuugguuaugagccacugagacaacaguccccguacccuccaagcuuccuccuucacuucucauugacaccgcuucuuccuucacuucucauucacaccgugcugcagaucccugggaaagggaaguucuguaaucccuucaccugaaaaagccucguuccuggcuuauugcagcuagcccaaugucuuucagauucaaucuauguuguugcaaaugacaagauguucccccuuuuaaaggcugaauaguauucuguuguguauauaugccacauuuucuuuaugcauucaauuugauggauaauuucuucaucaagugucuguugauggauaauuucuuuauccaucaagugucuguugauggacacuuagguuauuuccauaucuuagcuauugugaguaaugcugcaaugaauaugggagugcagauagcccuucgaaauguugauuucaguuccuuuggauauauacccagaagugggauaauggcucauaugguaguucuguuuuauuaucucauuuauaugcggauucuaaccaaguugaacuuacagaaguugagaguagagguggggucucacucugucacccaggcuggagugcaguggggcgauuguagcucacugcagccuuaaacuccugggcucaagcaguccucccaccucagucuccugaguagcugggacugcaggugugggccaccaaguucugcuaaggaauaggcuuugagauuuauugcacaccagggugacuaucgucaguaauguauuauauacagaagcuccuuaacuuuccaugagguuauguucugauaaacccaucauaaguugaaaaugcauuuaauacagcuaaccugagaaucauagccuagccuaccuuaaacaugccuagccuaccuuaaacaugcccagaacauuuacauuagccuacaguugggcaauaucaucuaacacaaagccuauuucauaauaaaguguugaaugucucaugugauuuacugaagacuguacugaaagugaaaaacaguauggauacuaaaaguacaguuucuacugaauauuuaucacuuaggcacgauuguaaaguugaaaaaugguaugucaaaccauuguaagucaggaacugugugcauuucaaaacaacuaagagaauacauuucacauugcaguguaccccauaaauguauacaacuaugguuugucaauuuaaaaaaaacccaagaccaggugcgguggugcacaccuguaaucccaggacuuugggaggcugagguggacagauugcuugagcucaggaguucaagaccagccugggcaacauggugaagccccaucucugcaaaaauacaaaaauuagcugggcgugguggugugcgccaguauucccagcuacuugagaggcuaaggugagaggcccagcuacgccugaaccugggaggucauggcuacagcugagauugcaccacugcauuccagccugggugacagagugagacccuaucucacaaaaaaaccccaaaaacaaaaacccgauuccauugccucuuggcugcuagcuguggucaagacaucacacauuucugguagcaaagggauagguccaacccugauccccucccuucuaccaucuuggaaguguuugagagugaggaacagugcuguguaggggaaagcgggugauacugaaagcagggaggcuuggcuucugaucauuccccugucucaauccauggauuuccugagucuuguucuccucaucuguaagaugggugugauggugccaacgugcaucucggggaguugucggugaagggaaaugcauucauugauggaaaauuucuaaaaucagaaacaaauaaagccauauaaaucugugggcuuggccucacucugcccccgaggcagaaagucuguuuugcuuguugaaugaaggaacguggaccuuuugacuucauuugccuggagaauuuauaccuuguuccugaauguuggcugagaaugcuucucuuggcuccagggcuggccgcuaugagguggagucuggcuagaggcugcuagcucacccuacaaacuuguuguauaugcuguggguauggaugccaucucagacuaggucuuagauuggcaguuuugaagaggcccugagacauuauaaaggucacucaaaaucacacagcaccuacaucuucuuggggcucaugugauucagagcccugaccuugagucccugggccagauaaagauggggguggggggugacagugaaugaacaucaggaaaccugaauuucaguuccucuucuagcauaacugaucuugugacuacaggcugugauggguguuagauaacaggggaggauaucuagccccaugcuagucauauaguaggugcuuaauagacucuauagugcuguauaguggcugucauuuguuguacccauacuaugugcuauguacugggcuaugugcuuuuuuccuaaaaaaaaauuuggaauaauuuuagguuuauagaauaguugcagcagggcguggugguucaccccuauaauccagcacugugggagaccaaggcaggcaaaucacuugaggccaggaguuugagaccaaccugaaccuggccaacauggugaaacccuguccauacuaaaaauacaaaaauuagccaggcaugguggcguacaccuguagucccagcuacuugggaggcugaggcaggagaaaucacuugaaccuaggaggcagagguugcagugagcugagaucacgcugcugcacuccagccuggaugacagagugagacucugucucaagaaaaaaaaaaaaaaaagaaaaguuacagagauaauauagaguuucuauauacuccugacucaguuuucccuguuagcaucuuauauguacauaucuccaacacuaagaaaccaacauuaguacauuacuguuaacugaauucuagacuuuauuuggauuucaccaguuuucccauuaaugcccucuuucugagccaggauccaauccaggguacugcacugccauuguugucaugacacauauaauuguaguccccccucuccuccagccuaugacagcuucuuagucuuuccuuguuuauucaugagcuuggcagucuugaggaguugugcccugugcuuucuguauacaaacaucuuacccucacaauagcccugugagaagauaucauuauguccacauaauaaaugaggaaauuuugaaccccuaggggguuaacuuacccauggucuuagcuaguaagacuggcugagcuggguuuuaacucauaccuguaguacccauaucucugccuccagagcugugccuuuccccuccgucuuguaccaccccuucccacuaguuggccuaggcuggaauggcagauaucuggugaccagccuggccuuggugggcacugcuaauccauuacaccucccuucccugaugagccuggacucagcagcagaauuugucacuacagagacagcuagccgggcauuacccucaggaagccaucuuguuacgucucccccagggccuggggaaagaagagcuuaggagaggggaagggauucuucuccgguagguacucuggauacccuacccccacccccagcccagaaucaauucucuguguggaucaggcugccuuagaaucuaugaaaacagccccacccagaaaacuaguccugcuccuauguugcccuccagccugacucuuaauuccaggcaaucuuucccuugaccacuuucagucuguucacaaccacaaaucacaguguaguacuguccuucagugggguuccacugccccuauaguaaaugcaaccucccgauuauagcuugugggguccugcauuaaaugacccugcuaccccuccaaccucaucugggucccucaucuacuacauuuagcccauggccuucucccagugccuggagcagccaagcuucuuugugccucggggccuuugccugaguucccucggccugcacuuacaugucugacuccgcauccugcaagagcccggcuuaaguaucacuuccccaccacccuauguaagugaguccuuuguugcugucagcauuaccuucugcucuuuuccuuuguggcacucacaaaucauagugggugauauuuauuugcauuagacgguaagcuccucaaggcagggcaggagccaggucugauuguuuaccacucuugccacagcacuuagcccagggccuaucaucauugcuccauaaauauuuguggaaugaauguugaaggaaacauuuaguggcaacuauccuguccugccuuucuuagucaugacaugaccuuucauuccaagggguaggaacccauuccuaaaagcucagguaaaggggaaguuuauuacagagcugcaagacaucccauggagcugccggcaggaagcggaggcuaggacgcuaauggcuccuuuagugagccggcucccguguugugccuggcauuggguuaugagcuuuacauacacgcucucgcccuugcaacauccuggagaggaagguagaaaugccuccaguuaaaagauguggaaauuuagacuccaaaggggaaacuggccuauaaaaucacaugguaaguguggcagagcuaugauuuccacccagggcuguuuggcuaaagcugucauucacccaugucucuccaaagccaugcccuucacugcuacuccauacugcuuuuauagauagggaagugggacuugaucuguucccuuuuccacagaccaacagagcccuuagcccuuagcccuaacuucugcuuggucauggaucacagaucuagauggucuggccucaacccaaaacuuaggauccagugacagcacaaaacccccauauccccagccuuuuauaccuuaauuccaaaauugggcagagagaaucugucagccuagcugggguuaggugaucccucuugaaagagucagugaugggaguguugaaggugggcaucagcuugggggugugggacuggcagguuuucucucugagacaggguguggauggagggcaugccaacagucucucauagguggccuccagggggcugggagaggugagagugggugggcagagagucuucacagugugggagguguucaagaucaucagacagggucuguuggagugcggagugguggucacaugcagucacaugcagauguaguggugguggaaucaggagaccugggggauguggaggaggaacaggagcagcucagcacagggguggugagugauccaagugggcauguggcaugagaagagggaugggaagaagacacugguuaggacuggggaaguccacuggggauuauucaucagcaagugauccacuggggaucuuuucaugaguguccuauuccuuucugaguuaaucaccugccccuugagagugggauuucagaugcuguuagauuucccauuguguuuuguguuucccauuguuccuggcucuggguugggcacggggugugacaugaacaagguccugggugugggcugcagaggugaauccuccaggagcuugcccucugcugggauuccaaggcuggcuggagaggagugggcagcagggaggugggaagucagagaaggugcccaccaaaggccaauuaggucagucuccuguuuggaaguuccaggucuaucauauccugccuuauaguuuacaauacacuuuugggagauuaugucuuuugagucuuuuaguuuaguccugccuauaaaaugaguaggauaaguguuaucccagcuucauagguauggagucucauagaugaggcucagggacgggggugccucacccaaggucacucugccaggagcucauuuuuccugugaucugugauaguuucuuuugucaaccuuuuucuucuucuccuuccuugcugccugauuguccccagccaucccagcucaguagcuuuuccugggauaacugugaugaagggaaggacccugcggugaucagaagccugacucuggagccugaccccaucaucguuccuggaaaugugacccucagugucaugggcagcaccagugucccccugaguucuccucugaaggugagccuggggguggguggagaaggggaggugcgagggucuggccagcagggguacuggggcauguaugcuuggggaacugugaagaauuucagaauccuggauucccagagaauaguacaggacauguagauucagacacucuuucacagguucauggaaucucaggaucauaagauugaaaggaaucucugaugucagcgccagcaacuuccuggugagggcaggagugacggauaccuugcaccuggcagaagcguccuggccuucucugggccugguggccaacugcucauuauugucugacagcucugguuggccaauuugguuuuguuguuaauuauaaaauugauauaccaauuagccaguaauauauagucacuuuagaaaacacaaguggucaaaaaauaaauaaaauaggccaggugugguggcucaugccuguaaucccaacacuuugggaggcugagguggguggaucuuuugaggucaggaguuugagaccagccuggccaacauagugaaaccccaucucuacuaaaaguacaaaaauuagcugggcgugguggcaugugccuguaauccuagcuacucaggaggcugagguaggagaauugcuggaacccaagaggcagagguugcagaaagccaggaucgcaccacugcacuccagccugggugacagagugaaacucugucccaaaauaaauaaauaaauaaaauaaaucacuugaaaucucacuaccuagugauaagggauaagcacuuuuaacaucuuauaggauauucuuugcaacuuucccccauacaauuacauacauaacacacauauuuauuuuuaauggauauguaugauaauaggcagugcucauuguaaauguccuccaguaaucuaaauccuagagauagucaguguuugcucuuuauauaucccaucagaauuuuuauguguuuguaaauauauacacacuuauacucaugggauuauaugauaugugcuauuauacuugcuauuuuuuuugccucauacuauauguccauaucuuuccaaggauuagguggcucuacuuauucaauuuuuuuuuauccaaucauuauuuuauuauuuuaauguauuguaauuuuagagacagugugucacucuguugcucaggcuggagugcaguagugugaucauggcuuacugcagccuugaccuccugggcuuaagggauccucccaccucagccuccugaguagcugggaccacagguucaugucaccaugcuuaccuaauuuuuuuauuuuuuauggagacggagccucccuguguugcccaggcuggucucaaacuccugaguucaagcaauccuccugccucagacucucaaaauguugggauuauaggcgugagccaccuugcucagcccacccaaucauuuuuaauggcagaaauauucugauguggaucuuucauaauuuauauaacaagucuauuguugaacauuuaguuuguuuccaggguaguuuuuauuuguuuguuuguuuauuuguuuguuuugagacagguucuuacucuguugccuaggcuggagugcaguagcgcaaucucagcucccugcaaccuccacuucccggguucaagcgauucuccugucucagccucccaaagugcugggauuacaggcaccugccauugcgccccacuaauuuuuguauuuuuaguagagaugggguuucaccauguuggccaggcuggucuugaacuccugaccucaggcaaugugccugccucggccucccaaagugcugggauuacagacaccugccaccaugcccagcuacuuuuuguauuuuuaguagagaugggguuucaccauguuauccaggcuggucuugaacuccugaccucaggcaauccaccugccucagccucccaaagugcugggauuauaggcuugagccacuguaccuggccagaggguuuuuuuuguuuguuuguuuuuuguuuugcuguaguaaccaccuuuguagaaauuauucuuauaguacaucuuuuuauaauuuucugauucucuagauacacacuuuuuaggucuuuugauacauuuugccaaagugccucccaauguuugaauaaaccugcaucauuccuagugagcguagaugucuauucauaaguuuauuugccuuuuguauuuacuuugggaauaaccuguuuguuuccauccauugacuauuuuagggguguauguuuuuauauuuucuuagaaaacaaugaagacuuuucauauauccauugcaacaccauuuaauaugguccuuuccucucuagcuaaaauugcuaccuuuauaugaugcuccucuaugcccuucagucuguuccugauccagaucuauucuaguaccaguuuuguguuaauuauuuagaagauuccugauuuggauucuguguuucuaucauuauccuuagaccugucuuaaucacagcuccuacguuaugggcuuuccuugagcaauaccugaguuagaaaaucauguggaaagugcuuugcacagggccuggcacccaggacaugcucaguacauuuuauaucuugugaacauuucgauuaguaucugucuuauccugcagucucuugacccagacacaaguccuggauauguggcagcuuucagcuccccugcaccuccuaccaagccuuuuccuagcagagucauuguguuuccauuacuguuccucaagugauagggggucaagcccuguacccuuggaucugggccaagggauggaaucauucccuauguauggacacuggacuguuucucugccagggucacacacauuuauuugugugcucccucugcugaucuggagugugggcucuccugguaggccguccgccaugcucccucugcugccaucaccaugcagccacugguguuuccagggagggggcuaugcagcugacuuggaaacaagaagcuggcaaacccgcucuucugcccucagccugcuuuuccuggcuucuucacaaaccauuaagauggguuuuacucccuauucuccuuuuccauugcuuuauuaccuuucauaaauuugggccuacauaaucuccucugucuuuacugucacuugugcuuaggaaaaauuagccucagauccccucugcuccuucuuuuuccccaauuucuuuuuuuuuuuuuuuuuuuuugagauggaguuucacucuguugccuagacuggaguguagucgcgcgaucauggcucauugcaaccucugccucccgguuucaagggauucuccugcgucagccuccagaguagcugggauuauaggcgugcacuuuuuuaguagagaugggguuuugucacauuggccaggcuggucucaaacuccugaccucaggugaucugcccaccuuggccucccaaagugcugggauuacaggcgugagccaccaggcccggcucccaauauuucucguauauauauauauauuuauuuauuuauuugguucaguucuuuuuucaggauaugugcauaucaacuauuagaugaaagcucuucugaccacuugcuagggagaagagccgaugagggacaaagggucucaggaaagguugcaacuugacccaggucacaaagcuaguuguuagcauggacaaggcugguauguuuaucuugggguuugguuccugagcuuuuacuggcagggagguagacuuggugcuugguguauuugcaggggaggggagaggagugcugcagauucaguuccagaacucuccccuugcccagcagaccugcuuaugagagcugcccagaacuaagcucuggaugagccuggagcacucuugggguccauggggcuucaaccccuuguuacacugaggcccagaggagagugacugcccaaacccaagaaagcaacugccauccucucuuucucugaucuugcuguagugaaauuucuuuaaucaaaagucaaaucugggaccuggcuggauuugacuccagcugcaauuuuuaaaaguuaaaugucccggauuccauggccguggguaagacuggggccugcucaggagcucccuuuucucuuuugacuugcuccaugggaucuggcauaguuaauaacucccaaugcccagcccucccucaaguuccagccugugggacccugguuuucccauccucaagaacuguaaauugucacuguauuugucauauguacuuauuccagccuuucaggccugguaacuuggcucccccagcacccaaagucauauacaugccugggcucauuacuccacccugcuuccuuuucugagucauaguagcaaauagauugagaauaagaaaugagccaucauuuguaauuuccaaaugguagguguggcugcugccuuagaacccucuguugacuucaguucaguacacuucuugugucgugcugguccugugcugggggcaggaguagagaugagggagccacuaccucuucugguagaugcagcccuacagguuccagccuggugggaggagcccuggcaggacuugucccccuacuggccuccuccacuguguguucucacucagggcauaacuggcucaaacauuuucauuaggguauuggcgacacaaggagagaguauuggcuaaggaaaaaggcagggcagaagucauggaggaggaagcuuuugauuucaggcacugugcaaagugcugguauuucccucucaaugggaccugugagagagguaggcacucuaaaauaucccacuuuugaagaugaggcgaggcuggauacagugcuucaugccuguaaucccaggaccuugggaggccgaggcggguggaucauuugaagucaggaguuugagaccagccugaccaacauggugaaaccccaucucuacuaaaaauacaaaaacauuagccaggcgugguagcucaugccuguaaucucagcuacucaggaggcuaagacaggagaaucgcuugaacgcaggaagcagaguuuguagugagccaaaaucacaccacuauacuccagccuaggugacagagugagacucugucucaaaaaaaaaaaaagaaggugagggaauggccacugagagagauuaaguaacucacccaagggcacaauaaaacuaggaaguggcagaacuagcauuccaaccuaggcccucugacuuuuccuaggcagcgggguagaagcagguuugaugagagagaggagggcugagagggugcuguguggccagugguggagauaauggguaugucuuaggagcagaugaggccagugagaggagcaauuagaauuuguccacucagaccacaggaugugcuaacuucuuuguucuuucugggccuggaggaaggcagcuaauaucucgacaucuggggcaucuggaagacuugaguccguggccugggaaccagccugagcccagcagccucuuaggacauaagugcccauccaggauuuaaucucuuagaaacagagccccaaauaaagugagccuagaggcugggauuccuagaaugcuagaaugucagagcugaaagggauccuaaaaaugugauuuccugccauaacacgcacaaggaaucagauauuugagaaagcuaauuuccuggugcucuuuccugagaguuuucccuugauaccuuuggugggugauggacaugguucuaaagccaacucauuuggcacuagaggcaacuaacacauggugacuguucagcgcgugcccggcacaacugggauguccaccaugaaauuugggccacuuccuccuggucagcuucagccuccaaaacgggagcaaagucaugacaguauggaggugugaaguguguucuagagcuucucacccagcccuacuccaggcacaagagucuuuuguagcuuucccggcugagucagggagcccguacuccuugaggcagcuccaucuguuguaaccuagcuaugauuuuauaccagucucaaggugaucuuucuauacauuccuauuguucuuaauucugucuucuguggcuguacggagaaaaugugacccaagagcagccaguuggguucauuuugguaaccagcucaucaguugguaguaacuaccugaaguccuaugcagaaaaggauuuuggggccacgacugggcucagaaggaaagcccaggaaacaaugccacaguuaaccaauuagcaguuagaugacaagugcauuucaaugcaaguguuagagccaaucaauggguagugacuaccuaaagaauucuaagacuauggacugagcaugauggcucacgccuguaaucccagcacuuugggagguggagguggaaggauugcuugaggccaggaguuccagaccagccugggcaacaaagugagaccccaucucuacaaaaaauacaaaauuagcugggugugguggcaugugccugucuguguuucccaccuacaugggaggcugaggcaggaggaucgucugagcccaggaguuugaggcugcagugagugcagugagccaugauacaaaaaaaaaaaaaaagaauucuaagucuauguauaguucaguguagggggaaaauucacauuugauuauuaaugucugccaugggcacaauaauacacuauacucacacaugggccacaauguugccauuccuagaacagacuaucucuaagaucucauccaguuaaaaauucuaugauuaaaauauauugcugcuuuuuugaagacagaagagcugguauguuugcccuggaauuuacacuuauaaccuuuuucaaaccuuuguuuuauuuuuuuuuaccagguggauuuaguuuuggagaaggagguggcuggccucuggaucaagaucccaugcacagacuacauuggcagcuguaccuuugaacacuucugugaugugcuugacauguuaauuccuacuggggagcccugcccagagccccugcguaccuaugggcuuccuugccacugucccuucaaagaaguaaguacuuagggaggagagagcguuaccccuguggcuaaagagaugggguuuggagagaagggucuuugcauucuccuucugcagaucugcaugucucuggauuuguaagccagugugaccuaucaggaaucacuuaucuuccgggagccucaguuauccaucuacgaaaugggagacuugaacuuagaugugaucuucagggcccuuuauccauaauaauccaugcucuacagugcuauggccgucucucaucuugugcggcuguuuugagaaugggaagaggggugguaguucauggcugcaauccuagcaguggcucuaggagaaagaccccaucaguaggcucccacugacuggcgguccacuggcuuucccgcagggaaccuacucacugcccaagagcgaauucguugugccugaccuggagcugcccaguuggcucaccaccgggaacuaccgcauagagagcguccugagcagcagugggaagcgucugggcugcaucaagaucgcugccucucuaaagggcauauaacauggcaucugccacagcagaauggagcggugugaggaaggucccuuuuccucuguuuuguguuugccaaggccaaacucccacucucugccccccuuuaauccccuuucuacagugaguccacuacccucacugaaaaucauuuuguaccacuuacauuuuaggcuggggcaagcagcccugaccuaagggagaaugaguuggacaguucuugauagcccagggcaucugcugggcugaccacguuacucauccccguuaacauucucucuaaagagccucguucauuuccaaagcaguuaaggaaugggaaccagaguguuuuaggaccugaagaaucuuuaugacucucucucuuucacucuuuuuuuuuuuugucacuaaguuaaaagcgaagugagaguauuaacguuuuuguucuccuccggcccccuguuacaaugaaggggcaaaaguauuugcucuuagucuauuccucccuuaacuucugugacuaauuuuuauuuccuuucuagauuugcccaauuaauacuagggugcaguguauccuggagagguagggugugugggggaggaaucccuugggggagauauuaggagugcucuguuguuuacaaacucagguacccgcagggccuagcaagagacuuaaaugacugauaagaaccgugagaaacauguugcuuccaggcuugauuucgauuuuucgcuuuuuuuuuuuuugagacagaaucucacuuugucaccaggcuggagugcaguggugcaaucucaccucacugcaaccuccgccuccuggguucaagcaauucuccugccucagccucccaaguagcuuggacuacaggcccugccaccacgcccggcuaauuuguguauuuuuaguagagaugggguuucaccauguuggccaggauggucucgaucucuugaccucgugaucuguccaccuuggccuugcaaagcgcuggauuacaggcaugagccacuacacccagccgauuuuuccuuuuugauuaaagaugcuauuacaauguaaauauuucuuacacagaaagucacagcacaugugcccauugauacaaggcugcugaggccuggucuccaguuggaaauauaauuaaggguggcaaggacuggagucaguuggagagugcauagccagucugugaagacaacugccagauacuggcaauacuccagccuggugacagagugagacucugucucaaaaaaaaaguuucaauguuuacuccuagagaagccaaaaauccagauuuguauaugaaaucuuaccauuuuaaaagauuggcagcuaauuauuuuuuuaaaaagcugugcagugugaugugucccaaacggacuggcucauggguggccacgucacaaccucugaucucagaccgugcaugccuuguccucuuaagacaacuccuguggcaccguuucucccuccacagggccaaagccauaguguccggucccaaggacaaggcucuuccagugcuaggagagguaugagcagccucucaccugugagcuguggggaucacaaggcugccugccucagucuuggaguccuguugggugaaugaggcagaugggaaagagccucaccagcagcugcuuuuggagcagggguccaaggaagagaggguggccucgacaucaaacugccuggauuuuucuaccacccuguuacaucauaacaacuucugaaacacacaccagcccugaguucugggcucauuugaagccuggaauagcaauaaaucuuuuuaacuugcg

SEQ ID NO: 16579 - RNA, 25041 nt, Homo sapiens
uggguaauuccuugcagucuccaggccucacuugcccucugaacaagaaagaggcuguucugggucaucccuccaggccuguccagcccuggcacucugugagucgguuuaggcagcagccccggaacagaugaggcaggcaggguugggacguuuggucaggacagcccaccgcaaaaagaggaggaaagaaaugaaagacagagacagcuuuggcuaugggagaaggaggaggccgggggaaggaggagacaggaggaggagggaccacgggguggaggggagauagacccagcccagagcucugagugguuuccuguugccugucucuaaaccccuccacauucccgcgguccuucagacugcccggagagcgcgcucugccugccgccugccugccugccacugagguaugugugacccccgcccagccuuucccuucuauaguugcaccaaccccgacacccccguucacgccgucagcucgugugcaagggagggaagcucugcugaggaugcgccucuccucccggcuccaucacggcuccccuuaagagcauggcccucgguccugucugccuguugcuuuucagaagguggacucacuguguaacuuugucuucccuuacagguuuacagaaaauaaucucacuaugucuucgggggagcauuuucucacucucuguuuuucucugugucugucucugguuucagaggcugccugccuguccucuuugcucccuuugcaaauguggcagccuccuccuuuccugggaaucugaucccaucacagcugccacagggaccuggccagcaaccggagucuguccuccagaucucggucagggguucuguuuuccaaaagggacuuugcacgaacaaucaguugaucucugaaaggcaaagggggaggcuucaccauuaauccacaccucugggaagccuucuguuuuccucuaauucuccucacucccaaacaccaccuuccguccccccaauacacaaauuucagcaccauucugccugaaauggcaccaucacaaccucagucuuggguuagguguuguuccuguccugaguuccuugggaugguaaacacaggcaguagcccuuaguuuaucuagaucugaaaacccagacaucagauaucgucaaccaagacauggguguaaugggagguggagugugcugggggagauauucucagaagggggaaagggggaagggaagagggagagaauuccaggguccccuuccguaauccacccaagacuaguguccagccugucagggugucaguucuucuucagacaaauccacuaccuuucuucgccgccacuggcuccgugaacuggcugucaaguggacuuccuuagggaaagggacuccaaggacuccaagggaaggggggcacugggaugaguuaugucuuccaggauucccagucugcccaaaagggaacagagaggcaugcauuuuccucaggaaaggacagcauuuuuuucauuagagaaaauguuuucucuaguaaugcuuuagaguuaaauuucuauacgccccaagugcuggugguuuagugagaagcaaagcagaaguaggacacaggcuucgggcaugcauuuuaugugugaucuuagguaagugucuccccuggauuuagugccccaucuguaaugaaagaaggcugaaacugaaggcucuuuggggugcuuuguguccucuaaaauauucaaaggaagauuucuuaaccagggucuauggaguggucuuugaaugggccucaagccaucucuaagccccuaaaaauuguaugcacugugugugugugugugugugugugugugugugugugagagagagagggagagagagagagagagaggaugaauauggguggucacagcuuucagcuuuaagauauucucaaauggauuagagggcaugacguggggauggagugaggacugguaacaaauguguguauuugcuggaggaugaagccuucugaaaagggagugguugaggaaagagagaguuaacucucagcuaucagcugccacaucgacauagccuagagcaaagagggggagggaggagaagaaggggguugccuggagaaggaaucaacuuuugaaacuuucuccaagucccacccaccagaaggcucuucucugccugacucacucuccgaggaaugcgaguugccacgguaaccuuuuuuucagggucucugccugcuggcuggaggggacccuugaaacccucuaagaacaucagucugaacguaccccacccccaaauucaaggccugcagcaaauucuaggcccugcccuugugaucucucaggauuccggggaagccuugggccaugauaaucuccuugcaaggguguuugaagaccuggguuuuagcucuggcugugcccugaagguaccauuugaccuugaacuaauacuucuuucugggccccauucccucuacaguuaaagaacaguaacagcagccaccucuaggggguagauaguguguagaagaaaugggauaaugcacagggaagcacuuugcgaauuguggcauucccucauaaugcaaaggguuuuagaacugauggauuaaaggcauccaaagaccuagugaaaucauucucagcuuuuuuuuuuuuuuuuuuuccuggcagcuccaucaucuugggguuuguauagaacuuuccuuuacuagaaguacugacaggaaaaauuuuaaaaucauaauauuguuuaucuucauuuugauuuggggaacuucuuguguauuucccaagacuguugugcccucuauguaggaaaagcauuggccaagggugaaaaaaaaaaaaaaaaguguguucuaacucccagugccugacauugggaaagacacuuccucucuugaggcugcaguuucccaaacuguuaaauagaguuucuaagcuagaugauuucccaggcacccuucuaacucugaaguccuauaaaccuaaaucccagauaccgcuuuuauucaaaggaauagcuugccugcauuuuuaacaccgccuuacugcacccccaguugaaaagaaaacaagaaaagaugggcuaggggaucuugaguugcauaaccaucaugcuguaauccuuauccaucuguagagauuugucaaucaacaguguggcugggguuugcuauucaugagagcagcuuuccuugcugaaaacaagcuauaaauaagaaagaauggugaaggaaaggaaagagcugaggaugugagguaaacaguagaauauuuggcuuuugaaguuguuuauguagguagauaaauaugcagagauaaacagggacagguacaaacccauagggaugaagaguauaaacaucgauuucaucaacaggcacccacuggcucagcuaaaaauaagugccucauuacaggagcagacacagaaagucauucacucacacaccucuuccuggaugacaaugauuuacagacaaguuccaggaauauaucucaaugaaugugaaaauucugacccucgccuauuacaggcugaaacagacagaugcuaagucaggcuguauguaacuuacacagacaugccaucagguauacaaacacacaccgccacuugcagccacacauggauggaugugcacagucaaacauaugcacagucaaacauaauauggaucaugacaaugagacagacguguaaccuacauuuaucaccaaccaccucuaugucucagagagagagaaacugaggcucaggaagagaaaauaacucacuggaggucacauagcaagcuggcgucugagccaaacuuccacguguuuggagccauuuugauauucaccuugccuucccccccaauccccauuuguucaguuuggaaacacacuuaugcacacaagccccauggauacuaaguggugagcagcacuuugucucucccguuggcuggccugcaaugccuauuccagcccacguggcuuugucauuaggcccaaaggcccugcaugaugugccuguaggcggcugcucccuugcuucuagcuggcucccucccaaacgucaguuucaaaggagagaagggaaaaccagccuugagcuuucagcaacccugaggaccuuguuucuacagcacagacccugaugccucccucccucccucccucccucccaaccucaauccugaacccagggacagcugggcugugcagggccagggccagcaaguagugacuugacggaauuauuuagagaaacagccucuccucaacuggcagcuuagacaggaaaucaucucugcucucacccaucaagcuauagaacuuuaugucugcaaggaaaacaugaacauagacaacaauuguugucagagcugguuucuuucagaaacuugguauuaacuucucucaucuggggaucacucugggucaucuugauguuagucauggcauuaggauuucagaccuaucagauaaaaaaagcaaagcaaacaucuggauguuuuugaacaucuggaaauuuggcuuagacaccagcuugccgugugaccuccagugagguauuuuccuucucuaagccucaauuucucuaccucuacaauaagaggcagcacacagagguuucauguggccugacaacaucacuaauucaucgguaguggcugucagaagaacuguguucaggauucugaugacucucuaagcuuuaggagaagaggucaagcgauugauuaguaaugucugccacaugugcaggagggguagguggaggccacguguuugucacauaugccacauauuugcuaucuuugggaucucggaggcuuuuccagaugcaauagccuggacacuuugauguuauuucucauccuuucauuuguggucaccacaaugcagcagcggugcccuagagggagccaaggaugaagccugaagcuccaccccagccucugcuagccacagugaaauguggcaucucagaugucuuuauggaaucucgggcugauuccagccccaaacucuggagccaccucugaguugccccagaagcucuccaguccuaaguuuuagcuaccacaccuuaaaaguuuccuuuagcgucuuuccuuccagcaggaaauagaaguggaagcagggagucaaggggcaaguggagagagguaaggcucuaaaaagcuucugcccaaguugauccggaaaaucagagcugaaaagaaccuaaaggaccaccuugccuaaggguuccauauuguguuccuaggagaaaguacagauguuccaagguaucuuagggaaugucccuguguguaggacucccacuccucagcuccacuccacuuuuaucugcuuuucuuuuuuguggauuuuuuugagagggaguuucacucuuguugcccaggcgagagugcaauggcacaaucuuggcucacugcaaccucugccucccagguucaagugacucuccugccucagccucccgaguugcugggauuuuaggcgcccgccaccaugcccggcuaauuuuuuguauuuuuaguagagacgggguuucaucauguuggccaggcuggucucgaacugcugaccucaggugaucuacccuccuuggccucccaaagugcugggauuacaggcgugagccauugcgcccagccugcucuuguuuuuuaauuucacacuuauugauuaacuagauaauacucauucacaugguucaguacaugcuaaaagauuucagcuguuugaaauaucggacucugcagaagacuucauugaaauaaaggauuuucuggcuuacauaauuuugagcacugaccuuauacagacaagcuggggguguuaguucuggagagcagaggagacuccccugaauucgcacagugagcugggagacaugcugacuugcucucagcucuccugacuuccacgucaugaggccaccucugagcugcugugucugcucccaggggugugagcaggagugccauuguagcugcauguggccaccucucuggccugccuggcucgguccccaugucagcagaccccaggcuccuuccgagucccaacucccuggagggccuggcucuuggcuuccuuuauuagccucuaggcuuguuuuccucucuuugggcuuguuuaccagcaacauguguuuuuggagcccuuguuuccaagccaaauagugagagugagaugcuuggcugguaucagcugcccaaguaagaggccagcccugggccuggucuucgucacuguauccucuggaggcuggacuuacccagaccaacaggggcaauauguccuuuguuccacccaaacaccccuuucucccugggcuuauaaagcacuggaauuuugcacugaauucuuucgggggauggagauucugggaaccucggacuuuauaagaugcucuucccaacgacaacauugcuuaccucuuuauuuggauucucuuguguaaaucacccaugagccuuuaaagauugguauguuauuguuuccauuuuacacauuggggaacaaauugaggccccaagagguaaaguugauuucuaaaggucauacaauuacuaaguggugagccaggauuugaaccuguauauucuggcuccagagccuaugagcuuaccuuuaugcuauacugccucauaguuuauuaucacucugucuaccaugguagccacuagccacauguggcuauuuagauuuaaguugauuaaaauagaugggcaugguggcucacgccuauaaucccaccucuuugggaggcugaggcgggcggauggcuugaggucaggaguucgagaccagccugggcaacauaaugaagccccaucucuacaaaaaagaaaagaaaagaaaaauucgcuggguguagucacaagugccugugaucucagcuacucgggaggcugagaugggagaaucacuugagcccaggaggcagagguugcagugagcugagauugcgccaaccacacuccagucugggugacagagggagaccgugucucaaaaaaaaaaaaaaaaaaaaaaaaaaaagauguuuuccacuauucucuauugcaguauuucaacaagguauggguuaaguaagauauuuuggauuggccucaguccuuuugcauaaaauuuuuaaauaaaaaaauugguuaaaaugaaauacaauuuaaaacucaguucuucauuugcacuggcaacauuucaagcauucaguaaccacuuguaaccaguagcuaucauaguggaccacguagauauagaauguguucaucaucuugggaaguccuguuggguugcauuacuccauaaguucuuuccacccaaauaagauuuaaugauggcaacucaguuucuuugcuucacauccuaagucuaucauucugagacccacaguccaugauucuaugauucugagguauccccccuguucuaacguucaguggcuuuuuaacguccaaggagagcccaaaggaggcccuuuauguuuugagggacaaaccugggggcuggcuguacuuuuccauccucagagucuuuccagagagagaagugaccucagcuucagguccugcuggcagccaaggacggguuuucagcagucuccagagcaaauaaaggcaaaaggaagggacucgauguacggaacaggaggcaguggcggcugggagggggcuaaaacugucugcauuugauggccaccaugccaagggaaauaugccuucucuuccuccccuggcccugggcauuuuccuucccaggaacucaggccaguucaaggcccaacugagccccauucaggugaccaccugggagcggguagcugccaagggaaauagugugcagagguagagacauaccaguggugggguaggguugcacggguucucacccuagcccugccacccagucacucacucacugcuguuagccguuggcaguuuucuccuuuccucuaggccuuggucuucucaucuguacuauugggcagaaauaugugacuugagcccccaguggggugcuggauuaugaaaacacccugaaaaugauaaauguaugcaucaucacagacuaaagaaauacaaaggagggaguuuuuguuuaauauuggucauuuauaugaagggaauuuaaauuuucgccaggcacgcuacaccuagguuugauuggcaaaggaucacagcugugaguucugaaugcugggguuugauacuguguucugaccuugcuggggugacuguuauacuccauuagcuuugcaggauggacacagggcucuuuggucagugguaguuuagagagccucagagagguaucucguggggaggcagggagauggcugugcaucuggaauaguucagccgcuucccuucccucccaucucaucaucugggggaaaagugcucuuggacuggugguguagcaccgggugcugggcaggacccagauuuuguguuuguguuuacaguuuucuuccaaaacuuuuaagguguauuccaagauuuugcguucuguucuuaacagucucucugcauuucucccccacucccacuugucugagcguaauuccuauuaggcucaccccaacuccaugagugagaacgcuugccuauuuggagagggccugaauuguugcaugacuuuggacaagugcuuccucccucucaaccucagauuccccauuaggacagugggacuaagaacccuuccaugccugucugccuacuucccagcauugucagaaggcucuaggagacaguguuaugugacagugcuuuagaaacuaugaagcagcacuauaagacuuagaguuauuuuucucuucuggcugcaacagcagggauggggguggcagggagggugagugugcagcuggaaaaggaauucaggaagaugaggaggcaggacagacagaagagccgcccagcgaaaccuuccccuggucacagaggggagcgcgguuacucugcucauaugaaggacgcagacucagggaaaugucugucuuccugucuuucuaaucugaagcuuacuacauuuccaguccuagcugggcuauuucuucaauaacaugacuucccugucauuauagcucagacaggguaacuuuuuguuuuguuuuguuuuagcugcuauuucacuuugauccuucaaccucaaacuaucucagacaaguccuuccuugauguuuucuuuucuguuccauuugucccaagccacaugcaggaguuauuuaucuugcgucuuccaaaaggggaagcaagaagggagauuuuuccacuuaagccuggggaacaagugaacaacugugugaggggaggaacauuccacaagcugccucaaaagggaagacuagacuccucuggaaguugggguuauugugaagcaauaccaaacccccagguccuuuacauuucuguuaguuuuacuucauucacucugugcaauagggggugagguuuugugucucuuuaagcccaagaaaggaccauuaugaagugggcucuuccucugccuguuucugcuucccaaaugcuauaguacaagugaagacauaugaucccagaggagaccauaugugucaagaccagaaugugcuuggggugucuuaagagcauuuuaaggaccgaggcugccacuucaaaguucaccuagucuacccauuucaauugauagaugggggaaccaaggucuagagagaccaaaagacuugauacuacugugguagaacaagacccccuggcauuuaauuucaagcugaguauuuuucuccaugaugccggguuaccucccaccaccauuuggucaguugagaagucuuggaagaaauaagggaugaugagccugacagggagguuuugggagaagaaagagggaagacauggccacuguugcuccugauggaagguuauuuguggguagagagagcagguuuguucuuuguggcugcaggggagaugggguagacagaucagaaaguuugagggaggcacauuuagaucaguaaaagaaagaacuuucuaaagucacuugagaaugaaaagccauuuaguuagugcaagaaaugaaaugucuccaccacagagccucuguuaggaauagcauuuuaguuuugaauccucagaggagauacugcuccaaaaucccuuauagucaugagaguauuagagucuagagcuuggcauuuagagaaugaggccuuaacaguuaccagaacagagguauuuucuagaucucagcuaacauccccucugcaacacauggaagcaucuggaugguuuccguacaggaccuaaagaagugcugucucuucuggguagaauggagaaaaauguggccacccucaaguuuccauggguuacauuccaagacuauuguucuuuguuuuagaauguggaucucauugucccaaacuggcaagaaguuccugccuauuaacuucucccauugcagagggaguaggaaggagggggaggaggcgacagaggaggaagaggagagauuggguuuagggaaaaaaauaauuuuagaauaucagggauugaagggaccuugaagaugaucugguuuggcauugcccaaacuuaacuaguuagcccaucaccuuaguugaaucacuuugcaaaaacuuuaauaaauguauuacaaaagcagauuuuauaucacuaccauaaauggaaaaaacucuguguaccuuugucauaaauagaaggaaacuguaaaaacaaacacauaaaaaaaacaaaacaacuugauucaguuccagcuggauauaacuuccuguggaagcucugagcuggaggcuuauucucuuuuuguuaaaaaaggagauagaugaguauaaaggagguguuuaagacaucuuggcaccaaacugagacuuucuucucauauaagcagaauugaaagaauauuaaauggaaccaaccuccucauguuuuucacuaucauuuaacuuguaccaucuaacauuaucuugcacauaucaggaauucagaaggaaaucuccauaaggaagucucacccucacugaacucucaaucucuccuccccauaggguucccagcaccaugagggccuggaucuucuuucuccuuugccuggccgggagggccuuggcagccccuguaaguaccuaaauaucaugucuucuuguuuucauuccuaccgcuagcaccagggguucugagccugccagcccuggaugcugaaagggaacagggacuuccccauuucaaguuaguggucuuuuuuuuuucuuaaguuaggaagcucgggauaaaaacugggaugaggaccauuggguggagguaucagagaagagagaguuccauguaauguuagauaaacuucuuaguagucagagccucccagcaaugaacuaggauugcuuuagaaggaaaugaccucuuugucauaugaggaauucaagcaggcaggagacaggaugugggggauuucugguaggggugguauuagaagagauucaagcuauagagagaggaauguguuggcuucugaaacagugaggguuguuugguuguaagcaacaguucaaucugacuaaauuggggaaggaggggaagauacagagguagauuauaauauuaaaggccuuggggaggacuggaaaagggcagcucuaggcuuugggaguuaagaacuaauggacagucucugagauauugcugucugaaugaaucaacuccagcaauuuucacaucuugagagaaugugccaagaagguuuuuauaaauucaaaaaaugagagccaaucuggcugagcuuggguccugagccagcuucuuggccaggugagaguggggccccuugauugacagacaguuccucgaagcauugcaugcagggacaggaguaguuauccacagcucaucuggaagccuucacaaggagaggaggaagaaacagggcaggcaaaaagugcaauuucuuucaaccugugauccccucauccucuguuuacuaagaagugggagugauggcagacccuggcaaucuugaucaggcugguagauggaggcaaaaguuucucaaaguuggcauuaaguuuugaagcagcuccagccagcuaagggccucaaaguuguguguuuucuugcuuccuccuacuccaaguugaaauggcaagaaaaauugccuaauaauacuacuaauaauaucacacugugaggaagaugaugacaucuguuaaaauucacagugucauccccucuggaugucaauuuuccuaucuguaaagugaaagaauuggucuggaucagugauuuucagacuuuauaagaauucaaagcagcagaaauacuuuuccaagcuaaaucuuagguagacaccuaggauauaaaauauauaaaaugggagcugcuugaguguuccacggugcucacaugacuggcuucuucuuuguucugucccucaccauggcaguccaugaggcacaacuuuggggaucuccaguaagcugcucuccaagcuccccuagccuguauccgaggccacaggcacuuuggaggugaagcuggccuuauuccugaccccucugaacgcuacuuucucuuuccaacagcagcaagaagcccugccugaugagacagaggugguggaagaaacuguggcagaggugacugagguaugugggcagugaccgcagccccuuagccccucucuaccuguaucugugcccugagaaauuagggcggaugcugugggucucaaugcuagaguggggcauucgucucccuguacacacauagcauagaugcaaacccugaguauaucccacauccugacacacuccugaaugcuucccaaaccuucaacggaacccuacguuuggggaccaggaccuuaaaauuuuuguuuuuuaagcuaugcaacaguuguucuuccaugauuacccacaguuuuugcaaacguaaaacagaggaggccgggugcgguggcucaugccuguaaucccuguaauccuuugggaggccgaggcaggcaauucacgaggucaggaguucaagaccaguguggccaacauggugaaacccugucucuacuaaaaauacaaaaaauuagcugggcgugguggcgggugccuguaaucccagcuacucgggaggcugagguaggagaaucgcuugaacccgggagguggagguugcaguuagccaagaucucgccacuguacucuacccugggcgacagcaugagacuccaucucaaaaacaaacaaacaaacaagcacacacacacacacacacacacacacacacacacacacacagaggaaaggggagaugcuuggguguggcuggcagggguggaggcuugacacccucuugugaacauagaucucagucaauuuagaaaguuuacuuugccaagguuaagaaugugccugugacacagccucaggaaguucugagacauguguccaagguggucgggaguacaguuugcuuucauacauuuuagggagacacgagacuucaaucaacaugucuaaauugugcauugguugaguucgcuaaggcaagacaacuugagaagugagggcuuccagguuagaaguagauaagagacaaaugguugcauuccuuugaguccuugaucagccuuccccugaauacacaauuuaaucuggcucagugaaucugcauuuuuacauaaacaauaggggagaggaagcaaucagauaagcguuugucucaggugagccucagagggaugacugcauagaauaggaggcagguuuguccuaugcaguucucagcuugacuuuuccccuuagcuuagugauuuugggguccaagguauauuuuccuuucacacucucuuucccuaacaccccuggugaccucuaaggcagcucaacagaaucccaggcauacugcaaaacacagcaggccuauagauuaaaucuggauucccaacccugcguuugugcuuucugugaccuggaacccuucagcuacccuuaugggucugggaugggaguggggccauuucacccauucuucucccucaauuccagguaucugugggagcuaauccuguccagguggaaguaggagaauuugaugauggugcagaggaaaccgaagaggaggugguggcggaaaguaugucccuucccuguaacuuggcacauccaagcugcccuuggcugccugggccuggggcacgaggacagccuacaugaggcuccuuccagcagaaaugcagggugggguccucagugggcuaugaaggaaacacggcuuugacuuaacaagugggaaacuguggcacucaguccccugggaucugggcaagaucgguuuccaggccauccaugugugugguaggaaggagaguucuccagcuggaaaugggcuucuccccucauagcucuuugcccugaguccaaagcugaguuucccagucccacggaggucgcugaucacaucuggucaccgaaaucucccauugcuucuguaucagcccgugccccacagagaaguagaacugagagaagagaucaggaacuugcacacucauaagcucauucuauuucacacaguccaaggaaacgagguccugaggaaaugcaaccugacauaauccguaccaugcuauccaugcguuagugcccugggagagaaaugaccuaggggcucuggcuccagcccuaggugcaaagcauuuguacucaagggguuaagagcaaggacuuuggaagcgguccaaccaagcuuugaaccuaggcuucuccacgccagcuugcuuagcaucucggagccucaguuucucaucucucauauggggcugaugaagauggcagacccuugucccagggcugccgggaaguuuucagacaagcugaguaggcauccgcuaaaggauuauuaaaacacccaaaauaaagcauugcgaggaaaaggccacauuaagcucucauccugaggggauagcuaaugguauuugaucuagcugggcacaggguuucuguugaacagagggacaucuacugagucauguuccuucccgccuccacgcccaccucauccgguguuuaccaggcucuauuguccagcauggacuuugaggcucuucucccuuuuccuuuacugccacuuaagucuguuuuguugggccucagcucccuggcucagugucaacagcugacuuucuaagccauucuagaaagcuuauucuggaauccagaaaugccccacugugauuguucaauggagacccaggaacacaaugguugcuucaaucuucaggaaagccauaugguaucuaguguuucugggucccagacugagccuccagccccccagaagugccugaccucuaucucaagcuaaaccucuaauccccaggcugaaccagcugcugcccuaaauguugacugugaggcucagugcaagagcaggcaggacucagggcuguccaaagcccagagugggggccacagucaaggacugucagcccugagaucuguccagguaggauggggguggaugugcuaguccaggugaugcuaacucccuugucuuucugcccuacagaucccugccagaaccaccacugcaaacacggcaaggugugcgagcuggaugagaacaacacccccaugugcgugugccaggaccccaccagcugcccagcccccauuggcgaguuugagaaggugagggcugagagacaggggcagggggaagggauugggcacuucggaauacaggaugucugcucaggaaacuguuggcuuggugguucuauggggcagugccagucucagaaguccccuugcuagaccuagucccagcaggaaagaggggaugagucagagugcucugccuggcacuggaucuuuucagcaaccagcaagacuuuaaacagcaccaucagguuccaagcccugugccagacucuuagagcuaagaguauaacagcaucagcaaagaaucagguccaaaaauacggguucuggggccaaacugaagguugacuucaaaccucaucuccaucacuuauuaggugugagauuuaagcuaaguugccgaaccuuuucaggucucaguuuucucacauccaaagagaggauaaaaauaguccuuaacucauagaucuguuguggagaugugucagaaauguuugguacauaacaaguauccaauaaaugcuacuuaauuuuaaauuaucucucaaauaugucccuucucuccaauaggauccauccauccguccaaguaaauauuuuuugagugccugcuccugccuaccaucaugcuaguggcagucuagcucauggcagcaaaucuagggccagcacuauuccuacagccucccaucuggcuucuccaucuucaguuucuccagagacuacauagccucugggcuccacauuuuaauaucauuguuaacauuuuccuccuccucaccccuccccacucccagugcccagucaccagugcccaucaguucucccucugcagugacauauaagcuauacuaaauaaguacggacaggauguucaacacaggcuccccuccuccuaacacagcuacuuacggccacugcauguccagcccucaacaucucugcuuggccaccccuauguucagagaucgacuaggacuccauuggcucagcauacaguuguacucacaccuaagguuuaguacagcgacauauucaggauauacagcuggaucguaagggaaaaagacacuagcagagucuggaggaaucuggguggagacugacugacucccaagaggggucaucagagugcauucuuaccccagcuacaaagaggcagccacaugugagugauguuucuuuccagggaaguucauuagagacucagcacccaaaguuuuaauuggaggcuggucacauagguacccuuugccuagcaugcaccagaauuucacacuuccagaaggaaagcagauguucagcauaaaccagauuguuuguacaaacaguccaggcauagcgagccacucuuaucaguuagggaaagauuuacaacagugcagagaacuguuucccagcuaaguucccagacaccagccacaggcugaccuuacaagcaggccuuuucuaaggauaacaauuccaggccugcuauguuaacucuucuuugaacacucuuguuucucucccauuccugucuuuaacuuucucuucaaauaucuuccaggauuuuuuucccuauaucucagaacugacucagucaugccucugcucagagaccaucgauggcucucagccugggcugagcauugaccugggaacccaaaaaguggauuuguggcccagcccuaucacuaacucacuauaugaccucaggcuaaugacauuccuugcuuaacccucaguguccccaucucugaaauggacaaggauauugguaucagcgaagggcuuugggaaugaaggaggggguacucugugcuuugccaacaggugugcagcaaugacaacaagaccuucgacucuuccugccacuucuuugccacaaagugcacccuggagggcaccaagaagggccacaagcuccaccuggacuacaucgggccuugcaaaugugaguguccuugggcccuuccagacuccugucuuggggagagagcucugagcuggcacugaugcugucucugccacccccaugcugggugaucuugggcaaaucucucucccuuucugagucucggcauccccauuuauaaaaugagguaauugucuaugaguuggcuccucucaacucugaguucagggcacuuucuggggaaggacugagcgauuauggaaggucaacaucagggaagauuucuggagucucucacuagcaucugagacaacugcauuucauuucucuaaugaggaagaauuucuucucucaggcuaaguugaaucuuucuugcuucaacacuguaaagcaaaaaugauguuugaccugggccuacaaaauauuuugaaaauaucugauuuugaaugcuuuaaaauaagggcaugccugucgguuugcuuugggcccuguuacuugguacugucauaucuucacccuuuuacuccauuacauuccuaucugcccuccgaagagagaggauaagcacccucuucuggaaaccugggagucaguugucuggggagggaugccaggguguggucugaucuuugguuagugaccccagcugcaaacucaguggggccaagugccuuguucaguauccucccuaucaugggagacccccaagaccacaccugcucccccuccaaggcaacauccacacugugggucuuguguauucuggcacccgauggcaaugaggagagccacucaccuaccucagguguacagggugcagaaaaguauguagggggugggaaacaaaguucuccucgugggaccccagguaugaaauugagaagguacagaguagaaaaggaggguugggggaagaagcauggguaggaagucccugggcagcaagacuagagagccugucuuaaggagucuuuaugaaguggcuuugcuuucccugaggcauguugcccacucacuucaacuccuaagguuuuuaucaccagauauucucucccagaccccagcugaugaugaagguagccucacagaggggacuuucccugguucaaugaugagggaagaacagaccccuaagcccccaggugaccacacugcccuggaugcuggaugaggcucugacauuguggccuugagcaagucccuucucuccaugcugaccucuaauaaguccaguacaaagugugaaccugggucaggcgcgguggcucacgccuguaaucccagcacuuugggaggccgaguagggaggaucacuugagcucaggaguucgagaccagucugggcaacguggcaaaaccuugucucuggaaaauauacaaaaauuagcuggguaugguggcaugugccuguagucccagcuacucaggaggcugaggagggaggauugguugaguccaggaggcugaggcugcagugagccgugauugugccacugcacuccagccugggcaacagagugagacccugucuaaaaaaaaaaaaaagaagaaaaaaagaaaaaagaaaagaaaaggaaaagaaaaguguggacuuggaugaaaucuucagguccaacauuugggauucuaaguuccaaagaccagguuggaaucauuucuaagaagguucuggugguuacacauuccugaguccucuacuccccacucccugccaagcugggccuguggauagaugugaucccucagccucccagcuucaaacaccugccagugguugacgugaacaacaugggcucagucucagcuaggaucacacccaaagcccagcacccaguaaggugcaggagccauccauuucccugagcagagcagauuaggcugaggaaagcagcagccaugccuuugcacaaugcauuucuagggcauucuucccacacauaaucuccucugcucauuguccugugaagaaacuguggccuggagagguugagccacugugccaaggccaccaaugcaggugguaugugggugggugggggccugggguggggagcacggcccaggcagggucugugcugaccgcccuuguguuuggaaccuagacauccccccuugccuggacucugagcugaccgaauucccccugcgcaugcgggacuggcucaagaacguccuggucacccuguaugagagggaugaggacaacaaccuucugacugagaagcagaagcugcggguaaguggucucucuggccuugcuggccccgugcuggugaagauccagucccauuccuagaacugggcccccagcugcagggcggcauccugcuccggagcgugcauuuaccccugagcaccaggacacguacuucucuuccugccuuuggaggcuguggugcacauuaacaucuuagaggcucugagaaguccugcagcagagaccugcucccuuugcuuaaccuaacguuaaacaaaagagacacaaacagcccuauuccuuuuuccuuuggagucuguggaucuuaagcuuuaaugagcauauuaacuaccccaagaagcugauaaaaugcagauuccuuggccccaucucaggccacugaaacagugucucuagaaagcaaggcccaggaagcugcauucuaaauacuccccaggugauuuauguuuauuuuauuuuuuugaggcaaagucucacucuguugccaggcuggagugcaguggugcgaucucgguucacugcaaccuccaccuccuggguucaagugauuccccugccucagccuccugaguagcugggacugcaggcaugcuaccacaccuggcuaauuuuuguauuuuuaguagagauggaguuucacuguguuggccaggcuggucucaaaacuccuggccucaggugaucugccugccucagccucccaaagcgcugggauuacaggugugagugugugcccggccuucgccaggugauuuugauguggguagcuauauggagaauucuuugaggucaucccaggcuucuauuuuugugaaugagaugcuaguacccaucuaugacaccucccuccccucgcugugagcuuuggucuggcuagucucugccugcucuggccuucugggaggggugggagggcccgacugguccagacaaucuccauggaccucuugucacacacagucucuacucccucaggugaagaagauccaugagaaugagaagcgccuggaggcaggagaccaccccguggagcugcuggcccgggacuucgagaagaacuauaacauguacaucuucccuguacacuggcaguucggccagcuggaccagcaccccauugacggguaagaccccagacccuagagugaacagagcucaaggcuggcaggugcacuagcuauggccagaaagccucucagcagccuauacugcuccaagcccuggcauccacaguuugccuggggauuggagcagaaggaugaggcaucuggagaaaagauguggaccugggacaaagaaaccgauaagacacucucaugcugaggugaaagucaguaggagcucaaaauagcuccauaauccugcaaguacuaggcguggauaucuggauaaugaaggagugugaauuaagaaggaguaccaggcuccaagggguggcaggggacaagguugggucagccacacgcccccuguccuucagcagaacauccaggggcagagcagccaccuggcacugucuaagcccccuccuaaggcucagccccaauagggcccaacugacccuggaaguuauccaaaaaagccugucuauuuugcaagcccccaguuugagggcucuugucccuuguccaaacgaguuaugaggcccugugcaacugcacugccgaacaggcaggcagcuggccaguuagcaaaugcuuauggagugugcauuuugugcccugcacuauucuaggcaggggauugaacagcagucagagcuggcaugguccuugcccucauggacuuauacucuguucauaaccugucacuaccuucugaacuucucuuguggugaugaagugagagccccugcucagccucagauggagcaagcuacaccugcaccuucccagagugguuuuuucuucguccuuggguuguggaagcagagcaucacacagaggggaaaggaagggcugcccuacucacauacucagggaacuuccucucuaggauguucaccccucgcucuuuguccagccugugugccuggagucugccaacccugccagugauccugagggcuggggucuccugggcucugggaaucucccggccacuucucucccaggcuuuugccauggcugggauccaacugagucacucauuauggcagggaggggaaaagucaaaggggaacaucuggagcucaggcaaagcaauuugaucccacugcaacagagggccuggagggaggcuuucagauggggugcaagaacagcacaucugggaaagggguccagcuugggcaaggggacccgcuuccuccuccucccaucccagggcuguaggugaccuugccugcaucccugccccucccugggccucaguuuuccaccaguacaaugaaggggaggagaauguuccuaucaguucaaacauugugugauuucuuuggugagcuggguggggcugcgaggucuagagguuaagaagacaacuggagucacauuguucccuggagauccuuuguggaucuuuagggacaaguaguugggggcucugggaaacaaagaaaaaaauuauacacaugcucuggagucuaaggccagcagggagaauagggagggaggacagugggagagacauccaaagggccucccucucagacauuacaggauacacaagcaaagcucuaugaagaugguuagagcucccguugacccucacugccaaucccagucccuuuccacauuccuccccagaaggcagcacugucaccagauuggugugucauuuuuagacccuuuacuaggcauuuauagauguauaaauguguguccauagacaauauacagugcugugucaugcuagauuuugaucuacccauagcagaagugcugaauuuugauuuuaaguuucuguguccccaguucucagccaauuaggaaacaaucaaauacaccaaacagaccuuuguuuuugagacccugaaaccuuagagcuggaagggccguuaguaauuauggccaucuccuccucuuugcuggaaggagaaacugagguuccgaauggugcacugcuguucucugagucucagagcagucaguggcagagcuagggguagaccugggauucuggcuuuuuguccugcuuuaaauauccuuuccuccaugcucuggggcaggcuaacuccccgguugccucccaaggcuggguguggagcuuuuccaugccucaggcccuccccugccuccuucccugcagguaccucucccacaccgagcuggcuccacugcgugcuccccucauccccauggagcauugcaccacccgcuuuuucgagaccugugaccuggacaaugacaaguacaucgcccuggaugagugggccggcugcuucggcaucaagcagagugagugucugaacaaagaagcaaggggcaugggcagaaacacugcucccagggugcuggguugucauccccccacucuccgcucucuuggucugucuguugucuguccucucugccugucucugcucucucugccuauuugacuccugucucuugggcgucuuccugauccuucucuguccauccaacugucccucucucuuucccuuccucaagcguuagcacucacccgugcuaaacacuauuuugggaacuggcaggcacacagagaggaaacaggaaguguaacuuggcagcguguguaagagacagggacaggccagagacagagagagcgagauuccuccgucacugacuuccugggugaccuugcauggccaccuagaccccugccccuggggaugggugggaguccacugacuccuugggaagugcguuaucaucgacacagccuuauuuuuaaccgugcucuuuucuugcuuugcagaggauaucgacaaggaucuugugaucuaaauccacuccuuccacaguaccggauucucucuuuaacccuccccuucguguuucccccaauguuuaaaauguuuggaugguuuguuguucugccuggagacaaggugcuaacauagauuuaagugaauacauuaacggugcuaaaaaugaaaauucuaacccaagacaugacauucuuagcuguaacuuaacuauuaaggccuuuuccacacgcauuaauagucccauuuuucucuugccauuuguagcuuugcccauugucuuauuggcacauggguggacacggaucugcugggcucugccuuaaacacacauugcagcuucaacuuuucucuuuaguguucuguuugaaacuaauacuuaccgagucagacuuuguguucauuucauuucagggucuuggcugccugugggcuuccccagguggccuggaggugggcaaagggaaguaacagacacacgauguugucaaggaugguuuugggacuagaggcucaguggugggagagaucccugcagaacccaccaaccagaacgugguuugccugaggcuguaacugagagaaagauucuggggcuguguuaugaaaauauagacauucucacauaagcccaguucaucaccauuuccuccuuuaccuuucagugcaguuucuuuucacauuaggcuguugguucaaacuuuugggagcacggacugucaguucucugggaaguggucagcgcauccugcagggcuucuccuccucugucuuuuggagaaccagggcucuucucaggggcucuagggacugccaggcuguuucagccaggaaggccaaaaucaagagugagauguagaaaguuguaaaauagaaaaaguggaguuggugaaucgguuguucuuuccucacauuuggaugauugucauaagguuuuuagcauguuccuccuuuucuucacccuccccuuuuuucuucuauuaaucaagagaaacuucaaaguuaaugggauggucggaucucacaggcugagaacucguucaccuccaagcauuucaugaaaaagcugcuucuuauuaaucauacaaacucucaccaugaugugaagaguuucacaaauccuucaaaauaaaaaguaaugacuuagaaacugccuuccugggugauuugcaugugucuuagucuuagucaccuuauuauccugacacaaaaacacaugagcauacaugucuacacaugacuacacaaaugcaaaccuuugcaaacacauuaugcuuuugcacacacacaccuguacacacacaccggcauguuuauacacagggaguguaugguuccuguaagcacuaaguuagc

SEQ ID NO: 16580 - RNA, 13806 nt, Homo sapiens
uuagcaggcugcuaacaucuucucaucccccucuccucuccccaagcuuuggcagaaacaagccagccaguaggguuuucucaacauucuccaacaaggaacugaguggacuaauacucagggguaaggacaguguaccaaaguguccauguccuagcauuguuucuuuccaaaaggcaaacgcuaugcuuugggacagugccagcaauuaggugcuuugccaaaaauaacuugucccauguggcccccauggggcagagacuaagauggaaauuacagagaacauagaaaagccagagguuuacaaagaacaggcuucuccacgagguaguggguucucuguccucggagguguuuaaguccagacugcucaaccccuuggugggaugguuguaggcagaaugucagcaccuauguggagacuagacuggaugacuuaacagcccuuucccaacuuugagauccugucauuguaaugacugagagcgccuuuggaugacuuccaugaagcaacugcucugggcaacagccucccucaauaggcaaggcccccagaguaagcuccuucuuccauccucucccucccaacaggcaguugcccugcaggauauuaacaaaaagcuucccacaaaauaaaaagccuaaacaccaaaauuagaugcaacacugcagcugcaaacaauuguuacuaucuguucucugaaaggcuagcagugacuauuuagcuaugacaggaacaucuaaaaacuuggcagcuguaacauguaaguaaaauuccucuucauuuuacaacaccggucuugaauccuuugguuuuuaaucuuucaugagauucagcugugaucuuuuuuuuuauaugcuguugccaaccuaagaguuuguuccuugaagcaagaaguuuguccauugguuuuuaaaacaucuuaaaacaacaugaauggcaggauacugauguuuccaugugagaaccuucagggcauaucaaagaaccauaccaggcuggaacugaggcaggaaccauacucuuuaagaagacaacgccaguucuggauuucaaauuccaguuuugcccagaagcaccaagaggaaagaaggcaaugcugcuacgucacagguggagagaagcgcaagaguccuugauggaugguauaaaaauggagcagccaagaugaacauugcuuuccccacaccccacugcucccugaagccagaccccguugcucuggagggccuggccacuucucacaggcaggagucccuugcccacagauagagccaccagaaacugcagaagaggcuaaggcgagugguuuagugguuugaugaaagaacagauuucuggacauaagaaaaacauagguucaaauagcuuugucuuuucucucaccugaccuguugaaaggucagauugaaaagguugaaaagaugcccacaaccuccacuuuccacaagcaccucuccuuagaggaaagacaagggacccaaguacacacacagcaucuggcugaagguaaaacauuuccccagguuucgcuuuggaauaaagauucuuucagacacaauugaacagauggauccuaccaucauauauucuugugcagaagcuauugucucucucaacugggaaaacagauuugcugcuaaagaaauagugaugugaccuacacgcccacaauucugguuuacguaucagaaaaauacacuuuuuuacucauuaagauauggacauuuccauggagcaaguuaacaaugccuuaaccugcaggccccaucugccccucagccuucuugaugccuguaucaacauccuucagcuguaagcagggagagaaucucuaaacacauagugaaugugaaugacugaaaacacucacagagcacuggacaugccauccacagccaggaggcauaccaaaauaggaugcccucacaguccagaguauauucuauauacaaccauuuauauauauuuaauuuaaaaggcugcaaucugcuagacaugcauuuugaacacaggcgaaagcuuugcugcaauggaacauacugcauuuuagugagcguggugacccuguccccauuccacagaaagcgugguacucugcuccacagaacugagaccuuuggacacuccgccgcccugcucaguaggggguuuaguccugacuucucugugauggugcucagauuaagucaucugugaaacucucugccaggccaggcuguccauuguucuuauuauuuaaggcuuaagaaauuaacucagaauugaaacugaguaggaaaaugacaccuuugaccauaugucaagauggucauaaauuagaauccaaauucuuuucuuuucuuucucccacccuccuaccccauacccucugcccuccauuacacagauuaaagaauuuugcaaaagcacauuuuuggauauaaagcuuuguuuucacaggauacuuuggcucugauauaauuagauugaggaguucaacguuuugaacaacaaaaaaauuagguaauuuucaaaaauuauuuuagcaaucuuucucccuaagagggaggcaaauuguucacaaaaaugagcaucagauggaauugaccuuuguugcccaaacucaugauuugcugaugaccagagcccagggagucaaggccagccagacuuucaauccuaagcugaacuucugggcaggaaucacauggccccuggcagcuugcauggugguugugaacuuaggaugaaaacuucuaaaaauacuugccccaaccuacuaaauaugucagugugucaaugcauuuauuaccaagaagcuuggcugaagucauaauaucuaacugcaccccaaagagugaagcauaguggggugcauaagggaccguaucuucugugagggucucuauaucaguguuucuggaaccucaacgaauaguuuugcacaugcaacuguccugaaauccuuaucugaucagaaacuuccuuguuggugcaucaggauuuccuccacauucuagcaguuaaguggugagcaacagaaauggcagaggucucagucaugagaggugugaagcggauguuacaaggcuggcacuauuagugacagcucaauuagccaauaccuacugauugagugccuacuguguacaaggcacagggugagugagggggaccagugucaaacugaucugcugauaaaugacaaagcuugcaacaaagcgggcgggauaucuaugucgccagcgggcagcaugcaaguccagaugugggucugcucaugcacuuccauggccaauugcaccuugcugcuauuccaagcuacagcucacacguggcagccugguggauaaggugauuaccaaaauauuucuuaucccacauuuccaguagaauugauuuaaugcuuuguugaaugcugaaauacauaguuuuuaauucuuuuaaugauccugauuuuuuuaguccagaguuaucguaaaagaaagucuuucuauacacaugcugaaucaugagaauauaauccuccugaccaaaaagauuuacaguauucaucauucaaacuuuuuuauuuacaauaauauuuaacagucuuuaugggcuuaaauguaguagauaucaccugugcaucaagcauuacacuucauuccuuuaagaugugcuucauccucacucaagcugcuugccacccuccgauuucugguccagucuacucuuguuacucuucaccauguagaugaaguaggcaagggucucuuuuucauucacagguauguuccugaagugucgacucacagucuauguggggggaaaauaccaaaguuccuuaaaccaugcacaaaucacaccgcaaauucuacauuguacaaagaagcgaauggaguuguuugcaugcuguggcgggaaugacaaaugcugaagaacuuccugccaugugcggaacucagagugcccuuugcccuuccuccccagggauguaggugguuuaauuuccaggauccaaaaguggcuuuuuaaccuacaacucuuccaaggugcaguucuauuucaguggcagccaaccaccugucauggcaugauuucacagucauacucauggaggagagacugggacugcucugguuggccagcugcuaccaaaccucucaggccuugaaagugggaagaaaugugucuuuaaaaaauuguggggcaggcgugguggcucacaccuauaaucccaaugcuuugggagguuaaggugggaggauuaguugaggccaggaguucgagaccagccuaggcaacacaguggagaacucaucucuaccaaaaaauuagccaggugucguagcaugcaccuguggucccagcuacucaggaggcugaggugggaggaucacuugagcccaggagguugaagcugcagugagcugugacugcaccccagccuaggagacagagcaagaccuugucucaaaaacaaauaaaaauuggguuaggcuggggaugguggcucacaccuguaauccuagcacuuugggaggccaaggcaggcagaucaccugaagucaggaguccgagaccagccuggccaacauggugaaacccagccucuacuaaaaauacaaagauuagccggguguggugacaggcaccuguaaucccagccacucgggaaacauggagaagaaucacuugaacccgggagguggaggcuguggugagcugagaucauagcaaugcacuccagccugggagauagagcaagacucugucuuuaaaaaaaaaaaaaaauuguguuaaaugaacagccaauugaacaaauugaacagaggcaucugaaccccaaaauucuucuaaguagugcauaacugccuccugaaagacauaucagguuugaaggaaaaugcaucauuuacuaaugcuccuaauacuucauuccauaaguaaugagaaugcaggucuccucuugccccaccucauucuuucccuuccaccagggagaacacuggcaaaugggugauguuauuuuaaaguaggagaggcuucugaccuccugugugucaucuggacacuggugaaggaguuguuuaagaaaaagugacggucgagcaagaaaccucuaaaggaaaaaccaaaaaugaaacaggcuggaagccuuucaggaaaucucaauggaucaagguggcugaaacagauaaaaaaagacagagaacuagacauaaagagugguuaucucuggaugauagaauuauauuuuucuuuucuccauuuuccaacuuuucuguaauaggcagaaaaauauauuaagaaaagagggauuagaaaauaccugcagaaaugacaaagacagaauuaucaagccaggcaguucauguauuuuaaaaauggccaguggagcauuuccccguaauccaaacuguguuaauaacucagggcaggagaaaacuuucuugggugccauucauuaaaauacugucauuaccaacaccagaguaggagaaaucaaggaaaaaaaaauagcuccuguagaacaucaagguuuugaaaugauuaaucugacacacaaaaugaucauaucuaaaaagcauuuugcuaagccaggcacaguggcucacgccuguaaucucagcacuuugggaggcugagguggaaggauggcuugagccaaagagaaucacuugagcaacauagugaggcugcaucucuauaaaaauaaaauuagcugugcauaggggugugcaccugugguccuagcuacucuggaggcugaggugggaaggaucacuugaagcugggagguuggggcugcagucagcccagacugagccacugcacucuagccugggugauaaagcaaaaucuugucuccaaaaaaacaaaaagaggaaucuuccaaaaaagauucaaacaaaugaacacucaggacuuagaaucuggagucaugagaucccaggcucaauucugcuaucaacuugcugugugauuuuaagcaaauccuuuccucuuucugugccaugguuucuuuucuggaacugaggccuuugcaggucuaaagcugugggguucuaaauugccaaagaggaauacagaguugcuuccagaacucuggaggaaauuacaauuagcagacacacaagguaagggagaaucaggguaaccaucagaagcagcacaaugcuggcucucuuuagagggcaauuuugucuaccuacuucugcuaacugggccuuauugaagccuggucuggucugcaacuuguagugucguuuauaacgucguaggguguucaccugcagcuggaacagaucaaccuagggagaagaggagaaaaauguuauccaucaccugaccacccaggacucaccaagagcccacuaugugccuagcacuacacuaagguaggggugaggauggggagggcuucaaaagaggucuuagaaauggucuauugaggacuaguaacuggcuaggagggcaaaaauaacaguagaaaaacaguucuggcuggggugggcugaucucacaaaacugguggaaaagguaaagcuuaagcuaaggaggagcagggucugauaaagcacugagaaacgguagggaauaggggaaaagaucacagcacagagagcugggagaggcacagaugggcaagggggucacaggcaacugugaugaauuuaaaaggugagaauggaugguagcacauccagaaaaacagaaggagcuaucacagaggguggagggcgauggcgcaggaugggucugguggugguuguugggaagacugauggggggauacggagggagaugcuauagcaacaaucagaaugagaugaagaggcugagcuuuggaggggcagugaugcuagaagggacaccaaagauggagagcaaaggcaaaaaccagagacauccuggaggaugauaggccagaacgaggcagcgaccggauagaggagcacaaaggagggcuguuauccucaaauagcucuuugcuaggcccagccuucugguauuagaauccuuaaccucccuccagagaaaguucaaaaguuacuguagugaaugugcaauccagcagguuagggcuggggucuuugcagaugacuggauaacagaggggaagggacccccccuuuuuguuucuaacaaaggaagagaggaaagcugcauagucaugaaaaauugaaggcccauaaaguugggcugccuuuaccugccucuaaaagagcuguucuugcuucaggcagguggagagcacuuaaaaacaaaaugaaugaucaauaugaggggccaaaguccuucauucuuuuucaaaacauuccucaaaaccuuuuuuuuuuuuuuuuuggugaaaaccacuuagaaaucgaauacguccauuucuuuguaaaauaacaauaacguuaaaggcaaaagcaagauucuguaaaccaacauuggaaaaggggacacagggaggggcagagggaaagggccagauuuucaacgguuuccuccacaucugcagacaaaggcccgccuacucuuucuauuccuacacagucauuuucacucugagugcuaacaggcgguugccuuaugaaauauucaugugucaaauauucaauguacacuauaaacgguucuucucuugcugagucuugagugaaaacaauuuaguagaaagaaaauccaauauuccuuccugaagccucacuuaauagacacgggcaccugaagggaaggcagccuuccaguuugagaagccuaggucucauggucuagcgcagugguucucaacacaggacgauuuugucuuguaaaggagguguggcaaugucuggagacacguuuugauugucaugacucaggguggugauggguagaaucucacgaggggaugcugcugaggcaugcuguuaaauauccuacaaugcagaggacaguccccacaacaaaaauuagcugaccccaaaugucaacagugcuagaguugagaaaaccggguccaguuuagucaacuuugaaauggauccuugggaacagccuggacuagaugucaagaaaucagugagagaaaaucagagcugguaugaacugaugacuuacaccuucauuuuuuggggaaaagacuucucccaaaccauuauacacucucuaaaggcauaaacaagguuuaaaaaaaagugacacugugguuguauuuacgcauucgucaggggcgucuugcagaaaagcaguguggucuacuggaaagggcccuagacuagagccuccaaacuauauacaugaccucggcucucugugccugucuguaaaaugauggggcagucugaccaguggguguccaagcuuuuagcucucagauuccauauuacuauaauucacuuuucaaauaauccacagcaaaacaaaaggacuaaaauuacuucuuaacacaaaaagcagaccaggccagaggugagaaucagauuagaauccauucuuccagcuuccgcaacugguuucuuugaccuuuaccucaggaaugucagugucgugcucgggagaaucuccgccaucgucacuugucuuccucuuccuuuuauuucggacacucuggaugaaauuuuugugaaaaucacagauauauaggugccuuaccugauggagacaaaaaucaaagucagaguuggccaauuccuuggagacagcaauagguaucugucgaauugcggggcuuccuuccauugcagggcauuggagagauagauggaagacaagauguaggccaucauucccagaagcucacuacugaguugcagaacacaaagagaaugcuaacaucacacuuggcagcguaucauacaccaaacuuccagugaauggugaagacaguaaaugguacagauucagcaaaggaagagaucccugcaacagagaugcucagggugaagggcccugacuaaaagggaggacuuuaggcagacaggaagcauuccagauggguaggagugccaagacuuuagaguuuccaauggaggaugacagaaagagugaggaggcccaggguacagugucaguugggugaugauggcugcccauguaggagcauaaugaaaaagugaggcaucaggggggugggcaugagaacagcuuagacuuuccuuccgacaagacagagucccucaaggaagcaggaagugaugugacauuuuuagaagaccuguaggagucauaaacuuauagucgacuggaauguacuguccuggggaggaggaaagcaggacacaagggacuguugcaacgguauuugggacacucuauuuuuacaauuacaauagcuacuauuguaggauaauaacucuuugaaaaacuuuguuucuaugugucaauuuauaauucuugcauuaucucacaucugauccacaaagaaaaguggaaaaagauguggaaguucuuacaagguagaaccacauacaagaagguggauacuacagauuuucuaauacaggcuggaggcacacugguaagugaagguggcagcaacagcuaagacaugaagaauccuccaaggcuggcuggaggaaccacugaaaaacuuuacagaaacugaaugcccagcaaaugacuugggguuguugauacugaaacagcuguugcacaaauguucugcagagacuucugaauuugaguuuauuccuuaaauccuuaaagauaaaaguaagcuggcaggaaauccgcaucaauuaauucagaccuuuucauggagaaaauaaugaaaacuguuuauuuauuuauucagaugaaugaucacuuucauguggcuggauuagugagucauaaguacuuuuaaguuuauacugugauggugucuugcagacaggagguacucgaaaaauguugauguaccaauauaggaagucuccuauaucuaaaaguggcuuaaggcuaaugaaagccaccacuuaacaugguuacaaacugggauagcuuugucagauucaacucugucaaaggacuuucaaacacagcacaugccacugucccaaagaaucccaccuagcugauguauauacuacuggacaugcuuuucuccaggaagaaagcacaacaaagcacacucugcaucccugagaggaagcuagcccuccauguuagcuagacuggcgaguccacucagaucaacugcuccucaaguucacaguaacaaacuucauaggagaacagggagaauagguggcuuccuaaagcuuuggcugggagauuucagaucaggacaauagaauaacggaauccuagcuguaagagaacuuagcaaucacuagugcaaucccauugaccccaauccguuuucuaaauggguaaaaugaagccauccagagugaggaaaugaccuggccaaggucacccaggccuucugcccccccaguacaugucuuuuccuacuccagcauuuuccuuuauacuauucucaacuuccacuuuucuccaggaaaaaaaaagcagaaauaugucaacuggagguauauuaguauuuuaacagaucacagaacacugccaaagucuauauaaaaugaguuaaacagccugaauugaauuucugguguuguuauuuaaaaagguucucugcuagacucucuuacaagauaaauaaucauuuucuccuuaaccauuuucaaguacauacugguuuucagaaauuucagagcucaguggccuuugggagugggguuggggcaggagggugguagcaaaggcucuaguuuuuuuuuuuccuucacuuucugcaauagcuaaaaauucuuguaacauaccaguuaccuggaauugaauuccugcccaagccugugagaaagaaauagaaucccuuucagaaauaaugacuccacaacaccaccuuaaaacaaauuuugagugauuccaccuggaaaccuuacuaccucagaaguauuacauuuugggaacacuaaugcuaggcucaggcugcccuucuucuagacagugugugugaaaugaucagcauagcucaacacagguuuuccaguacagucaauggguaaauaaaaggagucccaguugcagcagcaaaaucauucagaugggaaggcauccagugaucuaaaaggacuggaagauucuuuuaaggacuggaaauuauuauuauaagcugcucaaguaaagcagcuucuaacaaccuacacggaagguaggcaguguuucuaaguggaugaauucauugccauaagcauuucaccucaacgugugaccuaaggagggaucaccuuggugucuagacccuuguuuguucucagauauuuccauucaugcauucauugauagagauuuguaguaagaaagccauuaacucucucccaaccacuuaaaaauagcaccuguccaugcaagagcugcaacuguauuauaaugauuaacuuaaaaauggggguaggagggaagagucugaagaaaggacaggggcugggcgcaguggcucacgccuguaaucccagaacuuugggaggccuaggcggguggaucauuugaggucaggaguucaagaccagccuguccaacauggcgaaacccuaucuccauuaaaaauacaaaaaucagccaggcauggcggcaaacgccuguaaucccagcuauucaggaggcugaggcaggagaaucgcuucaacccgggaggcggagguugcagugagucgagaucuugccacugcacuccagccugggugacagagugagacuccgucucaaaaaaaaaaaaaaaaaaaaaaaagaaaaagaaaaaaaaaagaaaagaaaaaggacaggggagauuuuuuauuuauuagagacuuaaugaagacuuauguauagggcuuggaaguaaauuagauaauaucuuuaagaaauuaaccagccucuuaggugcuguguguaccugacacccucacuuccuaucucugggccuguuucaacccuaaaaucagaggggaaacgugcacucccuuucaguuuaacaagcagucucugauuuccuccaacuguggagaaauucugauucuagaagagaauggauguuaaccaccuaagcucuuagcuagucuaccugaauauuaaauauccccuuaacucauuuccaauuccuaaucaugaagcaaucacuuaaggcuuguagcaacagaugucaaacuaaaaaguucuuaauugguugacaauaggcacagcuucagaauuguuaacuagaaguggugaagucacacgggaggaguuuccuauaauaagccacaaagagcagggcaauccgauuuaaauuuaaauauccacccccuuauuucaaaagaaacuaccacuaagaaaauugauuucuuuucuuccccccuccagucacaucgacugcaagagccauuucucaagaccuggccuuggccuuauuucugccacauccuagaaaaacccauucccacagcugccugcgaagcagcuagcucggugacccucugcugauaccgaggaugcgggagccagggaaguaacugccaccuuucucugucugaaggaauaacaggguuccuagaaggagagagaaguuggaaaagagccggguaucuucaucacuccccgcuccgauucuugcuccuucaagggccaacaaaacuaacccaccucucccugcucuaaagucuaaaccaauaaaacaaguuggaaacugcuguccaaucuuuccaggcagcaggaguccugaagcccccgcccccauccucccggaucuggguagaaucacagucagagcaugucagcgcuggagcggccuuugaaaugcggaguccaacucaguucugcagagccggggcggcgaggcccacggcggggagugcccggggagucccgacuggagcccagggcagcggacggagagcugggggcgccggggcccagacgcgagcgggggcggacucacgcucuugucgauguccagcuugaguuucuucugcgagaugcucuucuggacccucuugcugaaggaggcguugcccgcgggccggacgcagcgcucgccguccucgaugaggcagcagcucuggccguagcccggggcggcggcagcuggggcggcggggggcccuucgcggcuguccuccuccgugcugaagccguucaucuccccgccccgggccggucccucugggggaggguccccgguaggccacuccgcggccgcgcuugccgcggggcaggucgcugagacccccgcagccgagggucccagaguccgucuccagcccgggcgcugcccugccccgcguccgagaggcccggcucccucggcccccggcccuccgccuccggaagcccccuuccucccggcucgaggccccggggucggcucccgcggcucgcagggccccgccgggggucacccggaggagccuucugccgggggcccagaaccguaacccugcagcggggguguccgggagggcgucccaggaaacagccgcuccccaaggacuccgggccuggguugccaggggguuucgaaggccccugccggcucccgccuucuuucggcagcggggcaaacucgcugccgggcagcucccccgggguggcgcggccuccucgcgcggggcccggccucgaacccgcggcacccgggccccgcggcucguccggcccacuccaccccugcagccacucggcugcgccccgagucccgcggcagccccugggccgcccggccgccgcccgccgaacgcuccgcaccacaacaguucgcuccccccgcccuucgcgggacagcggaagucccgccuucacgcgaccauuggucucauuugcucucugggcggggcugccgccgccgcuggcgcgucccauugggcgucgcc

SEQ ID NO: 16581 - RNA, 15490 nt, Homo sapiens
gucugccuggucguuuuugguuggaucggcuuguugcggggagggagggggggagauuguuugcagcauagaagcuccgcggacgggaagguaaacugagguaaggcugugcggggggcuuuugcgcauggcuggguagaauggacgggaguaggguccuugggauugcggaagaguguggaauuggagacgggaggcuuagaugucucggguuggacagagaaggugggguggggcucgggguuacaaggugaaucgcaaagccgggcugggguggagugggacgagcgggagaccacaggagauggaggagagccuaggggugcagaggaaagucucgaaggcgcugguugaggagggccugggucgagaggagcugggacgggggaagaguagaaucuaaaguccuugagggcuaaggagagaaguugagguagggacuggucggaauacaugggugggggcguggugagaguguaguuuuugggaggcuguagaguuggaaggggcugguggcugcgguuuugaugcugacaugaccauauacuuggccuuuguuucucugcagcuccccagagacgcucauccuacagccucagcucgggcccagccuucucucuccagcugccaccacagccuggaggcgccugccuccacccucccgaauggugcuccuccuagcaggccucgguccaggauccaagcccccuuugcccccugccuuggagcuguugcuccggguuugucacaguggacucccuguggcgggaagggaagaacuuuugcacagacaaggcuucagcucuaggaaccccacugacaacuugaaucucaaccucuaaccuagugugagguucuuccugugcccaccuuuucugccuuuugagaagagaaacucuucuccuggccaucuagagcccaggaagccccaagcuggggcccuggucccagcaugucaguccucucuugugcauagggcucugcccucccccugucagcauggcugagcucagacagguuccaggagggcgggagaccccacagggggagcugcggccugaaguuguagaggaugaagucccuaggagcccagucgcagaagagccuggaggagguggaagcagcagcagugaggccaaauuguccccaagagaggaggaagaacuggauccuagaauacaggugagagcacugagagcagggagagaaggagagcccagauuccagccucccugaagaguguuggaugaaugagggcuuagacuuacucuguccccagucugcuggggcaggaaaggagaacaaguuugucaacaaaucauugcaggguaauguaacaaguuccaaaagaguugugugucugaagugcugauggagugcagagaaaggccuggccuuagugcuugggaggcauugcugaaagcuucacugaaggagcaaagugucacuuggcaguagauggaggaggcacacuuuaggucaguggaggguagguguguuguacuucuuuccagauaagcagaggggcugccaccuuaguuagggaugcugugugagaggagaugacuuugauacugggggacaguuuugaggcugagugagagaaucuuuuccccuuucucaccuucucagcgguaccuuccagggaugugcggcccacauugcucugauaauguguuucacccuuguaaacagugagaccuuuccaguguuauaaagguagcaucaacuuuagaucuauaaagaaaccccauauguucaaggauuuguaacuuuuguuguggccaauccuuaguaacauacauaccuggcccucaggauagugggucuccuaaaggaauggaagagcaguuuauugccuuggagugucuacaaucuaguugguaggacaggcagaucuuuguguaggagaccuggggguagucagugaggaagaccaacuccauguggaagagaugccuggccaaucaaagcuggguugcaguguuucagggaauuggcugagaaugacuuccugaggaagcuucuugggcaggugacgaccaggaugcuccugcauguuuggggcuugagucugccauuuguuccggucacaucuccaagacucugauguuguggaagugacucuucuguaggugagcaagaacauaugaaggcucaaauuccuaggcuuaucugucagcaaaccuuuauuggauuacuccagugaguugggaagaaaucaaagccaguccuggcauucuuccuucacucucuguguggguuccugggauauguguguguguguggguuccucuucuacuguguccaugcuuauaauggagcaguggugagccauuuguuucuggcaugagucaguaauuuauuucugcucugccugacauugcauugaaaacagccaauuuuucuugcuauuucuacagauuuaucauccucugaggaaaucaguuguagugaaaaaagucuugggcugaguuucacgcuaccuccaaccccaugauuuaugauuuuuauggaaguuucuuuacguuucugagccucaguuucuucaucuguaaagugagcaguuggucuagcugauuugcacaacucauucuugcucugcucugacacaagucuacaguucuuucucaaacucuuuuugcuuguuccuuggugauaguuuguagauagcacuuugggaaagagcugucucucuguugcuuguggaggagggcuguguaaugugcauuauaugccucccuacagccuuccuugcccugcuccagagaaggcuucugcagaggagaauccacuguggucucuuuacuuggccucuacuacuccuauguauuuuuccagugucugcauaggcacaugguaguaguaggaagagucaugcuugcauugugcugucuaauaggguggacuagcugcauguggcuauuuaaacacaaucaauuaaaauuaacauguaaaaaugcaguuccucggccaggcaugguggcucacaccuguaaucccagcauguugggaggccgaggcagguggaucaccugaggucaggaguuugagaccagccuggccaacauggugaaaacccgucucuacuaaaaauaaaaaaagcuagccagguguuguggcgggugccuguaaucccagcuacuugggggguugaggcaggagaauugcuugaacccaggaggcggagguugcagugagcugagaucugccacugcacucuagccugggugacaagagcgaaacuccgucucagaaaaaaaaaaaaaagcaguuccucaauguuauacugacagugcauaaauagaauauucugucaucacugacucuucuaucagaugagcucuaugagaguuggaguacacugagguagcguaagacuuacuuugccuccagugaacuugugaugucgcuggugcaggaaagguaaagcagacccucgucucucuugcuaaacugcacaacacguuguggaauguuguggguuguauagggaggaaaggucuaguaauagcuucccucauuugaugacacagguguggguacgccagugcucugaccucagcagggagucagugucuucuugcugugugagagaggcagccuggcuugaggggcacccuucacggaggaggccgguggcauuuugcccuucugugcuugggcuuucaagaugaggaggagauugggguguuugucuuucgaggucccuuugaguguugacaguucacuagaccaugcacauugcucugaucauguguuucagugcuuuagguggguguucauuucucuggauucucagugcauuuacuggguuuccauccaccguccauaaaaagccaccagggagcuucaaaaauacccuuaccugagccuuuccagacauguggauucucuuagucuggguggggugagaagggauucugauguuacagucagagccaaauccacugggccagguauaucccaaagguagagcgccuguuucgguauuuucugaggcucccggaaauggcuguccuucggaugaggcccugucugaccuggggcuggggcuccuuugcaggcaggcagcuccauggccauuuauggugggauuccucuggaaguuagaaggaagucagcuggugccuaccuggagcgugcugucccuccagggaaggcugcuggcugugucuccuugucaugaucuuaguggaguucuuuugaguccuccaggcucauccucagcuuuccgagaggguuccaguggagggaagaggaaaggagcguggaucuaggauggaccugggucuguucugugacuuucucagcccccucuuagugguugcauucuuuccucagaugugagugcucucguuuaccugcuccuuuccaaacucucuagggugacuuugcaaccucugugaccucaucuagaaguauggguuuagcuuucacaggacagucaucacccuggccccaguuaccauuaguuugagucuuuugauggucugcacuagguggggugggagcaucugcagccugaguccccaugccuuugauucaguguccuggcauccugggaaucugacugcugugcccugggaaggucacccucccugcuggcugcuggcucacugauggaugaugcacguugauucagacuuuguccuccccaaauuccguuucagcugagugccaggagucccuggugaagcaggccaaauggaauguguugcugacugcccaaaacugucccagguccucaguggauuccugcucagccuuucccugggugucgccuaggugggcuaucccccucccuccuguggugaccuugcccuccaggcugcuuugcuccccaggcaucuucuuguccuguuagggagagcuuugugacucugaggggacagaucccaucagcagauggcuuucuguaaauugcuggaggugccacugggaagcuaguucccauauagaaagauaaugcccacuccugccacuugccaauagcaacagcucuucuuguccuuuuaacaguaguaacaacuuaugcugagccauccaauccauugaugaucuugucaggagcuggaaguugaugacuggaagcauuugaggccauggaauccaguggggaucccgucuuggacuuugauuugccacaugaacauugcaggguggccuuuaccaacugaccccccacaaucaauguuuguugcauuuccaaucccuguccuuuuccuacgugggcugugguuuuccuagauuacagcacuucuuucuuuacugagauguccuuccagugguguccucauucccaggaggguggucacaguggaaggaaagugagaucaaaggucgguccuggauccagacccaagucugucacuaauuuuccgccugguuguuucucaucuaucaaaugcaaaguugcugagaaagaauauuccagcaggaggugcugaaagaacuggucacucgucucccagauagccuaaaagccccuguaggccucgucaagccccaggaagcugggcccccagggagguagguugccuuucagcuugacagacauugccuuuuuagggccuguuggggugaucgugucaguugcuggugaugucucuguucggaaggcacugugaaacuuggaguuccaugugucugguaguguugaugcugacccuaugccuccucuggggcccugagcuguguuggcugccuguucuuccagaaugguuguuauuuuauggacacuggguugugggacacuguagaugcaucuacccaaauacaacaacuucuagaccuucgccacccaacacaggagccacaugccacugucuagguugagaugugucacaagagucaagugcauacggauugugaagacuuaguuuaaaaaaguaaaaguauggauaauaauauuauuuuauguugaucacauguugaaauauauuuuguauauauuggguuaaauguauuuuuauaauuucacucuuuuuuuaaauuuuuuuacuuuuaaaaaauguggcuucuagaauuaaaaauuccaugugcagcuccuguuacguuucuguugaauaagucucuucgagaaaauuuagagcaagcuuuuccaacccguggccugugggccgcaugcagcccaggauggcuuugaacacggcccaaugcaaauuuguaaacuuuucuuaaaacauuaugagauuuuuuuuugugauuuuuuuuuuuuuuuuuuuuuuuugagacugagucuugcuccuucacccaggcuggagugcaguggcacaaucucagaccacugcaacuuccgccucccagauucaggugauucuccugccucagccgucccaguagcugggacuacaggugugugccaccauacccagcuauuuuuuuguauuuuaguagagaugggcuuugcaucauguugcccaggcuguucucaaacuccugagcucaggcaaucuucccaccucggccuccugaagugcuaggauuacaggugugagccacugcgccugcccacgauuuuuuuuuuuuuuuuuaagcucaucagcuguaguuaguguuaguguauuuuauguguggcccaggacaguucuucuuccagugugucccagggaagcaaaaagauuggacaucccuaguuuagagccagauuuguggcccuccuuaggcagggucuacacuguuguagguaggugugugcauuuucauauccucauuccucguuccauuacagguuucuaccuuuguguucuuccuguuacuguaauuaacaugucaaaccauuuccuguauucuuaccugcugacccagaucuuuucaggaucaaggcaggggauggggggaggauagaagagguagaagggacuaaaaggaagauugugcaugucagccugacucccucacuggguugcugaaaggcccgaaugaggugagugggggccaacaucacggccauaugagugggaagugauuguggugucacugccaagugcaagucaugggucugggcagcaggcacaugcugggcugggucucucuggccuguccagccuccuguccagagacagcaggggcuggugaaggcaaauccuauagcuaggcaccagguauuuccuggcacaaggcccuuggcacagaccagcacugcuccucaguaguguccuuagcucaccaggggcucugggaacuuuuguguuuucucgggcaagggaggaugacuugaggccaguaccccucucagcucucuuccauuucauggaaagcccuggaugguucuauugcuucucucuccaguccuuccaggggccaggaaggcacucaaaccagcuuguccagcaacuuuuccccaggacucucccucccucccacaggaucugcucuauagggaccugcggucauggucacccauugcccaagcaggccaaaaggcuucuuggacucuauacacuuuccugaucuugaccuuagucauccaccaagccccugugauucuguguccugcguugccuugggaucugcccucuccucugccaccuggaauacuauagacagccuccaccuuuuuuuuuuuguuuguuuuuuguuuuugugauggagucucacugugucgccuaggcuggagugcaguggcacgaucugggcuuacugcaaucccugccccccggguucaagccauuuucgugccucggccucccaaguagcugggauuauagaugugugccaccacgcccagcuaauuuuuguguuuuugcuagagacagggcuucaccauguuggccaggccggucuugaacuccuggccucaagugaucugcccaccucugccucccaaagugcugggauuacaggugugagccaccaugccugucccagccuccacuuuugucucccuggcucccccaggcuuucguuacauuggcaccaggcucugagagacccuuuugccauugcagaaaguccugguacuaccucccauagugcuguagccuuacugaccuucucaccugccaacuugucugcccaggguaccugcuccccuuugguuccuuggcccuuuguucuucacuggcacuuuauuuuuuugagacagagucucgcuauguugcccaggcuggagugcaguagugugaucuuggcucacugcagccucugccucccagguucaagugauucuccugccucagccucccaaguagcugggacuauaggugcacgcugccacacccggcuaauuuuuguauuucuaguagagacaggguuucaccauguugcccaggcuggucucaaacuccugaccucaggugaucugccugccucggccucccaaagugcugggauuacaggcgugagccaccuugccuagucauucacuggcacuuuugugucuaugaaguccuuccagcugcugagcaaguguuccaggcauccuacccugaccuucugcugcccaauuaggugaccuugcuacccagagagcacccacacccaccccucacaaggcugcacauacugcccaggaccugcugcugacuugcuggguuuccuuacaggcugccaccucuauguccugaauucucaggucucacgguccugagaggugauaagugugcaguaaacaugugcugacugaguggcccugcccuggcccagguggccauccucucgcagagagcgagccuucagguccaaggagacucccucaguuugaggaaguguugcaaucucacggagagagugagggcucaccacaacuucacguugugcauauuaguguugcauucuccaaaccucaauuucuucauccuugaaacugggguuuuacuacccaauacaagguagaguugugaggauuacgugagauuguauguaucaggucccugauagacaagaaagcuuuuggcaaucuccguaucuucuuuccuuuccugagugucucaccucauuucccugggcaaguggggcucucucucucuguguugcuccugccuugcaugguucauucaaggcuacuuccuuccacugcacuaauuugccaccccucucuguggcaggaggaguuggagcaccugaaccaggccagcgaggagaucaaccagguggaacuacagcuggaugugaguguccuuuuccuuaugugcuugggcugguccuuggaaguaucuccaucugucucuuucccagauugaggcaguggcggugggaggggugugucugagaaacaagaggggcugggacccaaacaugugccuuuccucugccuuguuccuuuccaggaggccaggaccaccuaucggaggauccuacaggagucggcgaggaaacugaauacacaggguucccacuuggggagcugcaucgagaaagcccggcccuacuaugaggcucggcggcuggcuaaggagguauggcuggcugaccacguuugaggaaggcuacgugcugagccuggcccuggauucuucugucucuauauggagugagagacaaaacaccagacccugagggcagagcccugggcuagaccuggcuggucggaaccagcucugugggcucaggagguuccuuuaccacgugggcucugggcuuauggucuauaaaauggugaggguggcugugggagaauauuuaguucagcccugcuaauguuuaagugccuucuguguaucaggaaucaggcuuuaggguauaucagauaugucaguucuaacauccuguuguuuucaucugcgcccauuuccucuucccuuugguucaugucucucuucugaaucuuuucuuugcuuacuccucacucuuuuccccaucccacaccccuuuuuucuguaacaaauuacuuuuaacaaauaauauguguucaccauuggaaaaacauaauaaaacaagaaggaaacaaaaaucacccaaaauccuaccaugcacguuucaugcauuuuguuuccugggauuuguugucauccuguauggugaggugacagauacagacaacugccuuggaagaagaguuuguucccgagaggaggggacauccaugccaugcagggccacacggggaagcagccaggguccuucaggaggcagaagugaaggagaaagcaaagcgcagcgccuuagugugguuuucguggaaaggaguaggugaggcaggguaggcaaguuuggauaaguuuaggaguggauaguuggaauaacuuugcuaggcccugggcuauaggggcggccucuaauugucuaguaccuggcccugggaugacuuagggcagaggaaauaucggcuuggucggggagaaguagguaaaggaguuagcuggggauccaggcuuuggauuaggugguugguuugcauaugaaaggcacacuuacaggggaguuuacuguuucuaggaauuagcccuggaaggggcaguuuguccuuggccagcaaggucccccaagacaugaaagcaucauaaaguauagaaaauaaaaauaugauuaauacagcacagauaaccaugugugcuguauuaaucauauuucguguccuuguauauccagccaaaaugggauuacacaguaugugcuauuuuguucuuuuauuagcauuaugacaugguuccaugucaauaacuauacauccaagccgucauuuuaaaggacugauuaauauuuuauuuuuuuaagaaauggggucuugcucuguugcccagacuggagugcaauggugugaucauagcucacuguaaccucaaacuccuaggcucaaguaauccuccucccucagccucacaaguagaugggcucacaggcagaagccacugcgcccagcuuauuuucuuauauuagauguacuauuauuuauuuaaccgauguccuauaacugaaaaguuagguuuguuuuguuuuuugcuugguugguauggcuaugaugacugucccugagcacuugucugauuacuuccuucagcuugccugcugaacauggaauugauggucucaaggucaucuuuucuguaagacucugucuauguugcuaaccaccuuacacuaaaaugguuuguguuuuccuuuguuuucccuaggggaaaaggcuagcagccuuugggagugcuggauuucacacaucuacccuccacuggcaaaauuuuuauuucuucuaguccauauccuuaugaaauauucuuuauagaauguugcuuccuuggcauuuauccucagcacaguuugggaaaugaagccgacauugcuaguaggccuuccuccuucucuuauccucacgucuauuaugggucuccaugggcagcuggggucccucaggguuccccauccugauaucccucuccccccaggcucagcaggagacacagaaggcagcgcugcgguacgagcgggccguaagcaugcacaacgcugcucgagaaaugguguuuguggcugagcagggcgucauggcugacaagaaccgacuggaccccacguggcaggagaugcugaaccaugcuaccugcaaggugagccgggcggugccagcagguccccuucgcugguucucguccauccuuugcuaugucuuuaucaccucaccuccucauucuucccucuauucuagccuucuuucaacuuugauucuguuucaggcaaaaccuguuccuaguuuucuguucuguuuggccuccauugcuucccauauuccauuucccucugacuuagaaugucaucccgggcucuucuugaacguuugccuccaggugugggacuaacccaaacaauucaucccugguggauacugaggauucaacauucacauuuuauuauguuuagcugugugacuccucgcuucuguuuucagagucugcucccuuuccugcuuuugagcucugacaguacaccucgaguuuugaaguauaauuuauguaucauuuccaagcuccugaaaggggacuggggagcggaaggaucucugccguuggcccugucugccaccuucagcuugcacagggcaggugucagcaacucgaggggguguuuguggcuugugauucuucaucugccccucacacagaacaggcaccucacuucuacucuagagcucaugcaaaugagagcacacagcacggggggagggguuaggggaugguguauaguguagagcuacaccugaacagggagcaggugagggcuccagccgcuuugucuaccaggacaagugggccaacuguacaacacccugagcagaagcacgccagagccccauccaaccucggcccacuuguccuggacggugcccacauaggguguggaaaccuggagaacccagcgcacagcuguggcuccccacacaggcucuucucacucccagaucccuaaccauuggcgcugagggcucccugaagagaauggcugcugcagaugugugaugugcugacagacauuccccugaugcucucaagugguugagugggcaccagcaucccuuuccuggcagcagcaaagcugaguagccaguggugcaggugacacuaggcaagaacauggggaagacguggcucagaggcaugugccugugaugugguccucgacggucaggcagcagauccaagagagacagaaauaagcugucuugaggcucauagaccccguguuccccugcgugucucgggcucuguacacaguuggggguuugcagaggauguuccuguuuggguuccccccagggcguuguucagauuggcagccuggggcagaugccagagacugaagcauggguccuggcucagugauguguccucugggccaggugaaugaggcggaggaagagcggcuucgaggugagcgggagcaccagcgagugacucggcugugccaacaggcugaggcucggguccaagcccugcagaagacccuccggagggccaucggcaagagccgccccuacuuugagcucaaggcccaguucagccagauccuggagguagcugagugggugagggggaggaggaauggguaggugggggugcaggcuggaggggaugcuggucggccucucugggccaucuuggugagguggccagggugaggccuccggcuagcgguggggaagggugguggcacacauguuccaaaugaccuugcaggagugagaggcagggaugggggcuggugaugggggcuggugacggcgagaacguaguuggaagaagggagguaaacaagaggaaaagaacugguggaaaucugggauggggaagaagaaccagccauugggugaaagggaacaguggggagaggaugaggaagcaggagcugguggagaggaaggccugagaggaaggcucuggaagguggggcucaggucaggagcaggauugcuggggaggaacaacgcagagcaaguggagcagggaaggguguugugggucuguggugggugcugagaguggagcagggaaggcuguugugggucugugguggaugcugagccagcuguccagguauucugggagagcaggcccucagaccucagugcagagugcugaggaagguggagacgugccccaugggucgccuugcucugcucugcccucugcaggagcacaaggccaaggugacagaacuggagcagcagguagcucaggccaagacgcgcuacuccguggcccuucguaaccuggagcagaucagcgagcagauucacgcacggcgccgcgggggucugccuccccacccccugggcccucggcgcuccucccccgugggggccgaggcaggacccgaggacauggaggacggagacagcgggauugagggggccgagggugcggggcuggaggagggcagcagccuggggcccggccccgcccccgacaccgauacccugagucugcugagccugcgcacgguggcuucagaccugcagaagugcgacuccguggagcacuugcgaggccucucggaccacgucagucuggacggccaagagcugggaacgcggaguggagggcgccggggcagcgacggcggagcccgugggggucggcaccagcgcagcgucagccuguagccgaggggccaggguuccuggcuugaaucugccaccacgggccgguuggggcccacagucuucucacgcccucuccucuggggccucgucuucccgaagguccccuucuccagugcuucccugggagaggccagcuguguucgaguccucugugccugcccuggcguucucacagccucccccuuccccucagcaggcggcucucuuugccuuacccauucagaaggcucgcccucggcgcucugucugccucugccugccagcucaucacgaucugcagggcauugacccuuugcuuucccuuucugcucccucucuuuccaucuguuuggcuuuuucccucagggaacuuggucuagaaggcacugggaagcucaucagagaaaaugggugcugggccugaguacucccgucggaggggauggacagucaccccucccguugguuuccagccccgccccccuucccaaggcaacucuggaggguacccuagguaugcugcugagcccugccccccguccugcuccagccugcccguguguaaccuguaagauguacugugugccuccggaagacaccaccuuucccuucagcauucccuuucaugaccugaggcacucugcgaugugugccccaaagcagaacuuacagggccugcaggaagcuggugucagggagagaaacccaaccccacugucaacauagggagcaucaccaacuccagacuggcuccuguggguaugguguuuccgcugggcuggguccucaacauugccaaggugcuagugggucccuaagagggcccauguugggggugaagucaugagguccugaaggcuuaggccccugucauucccacccucacucuugcugcacaguuguguuuacuuuuucuggguagaggaugcugaacugacucagcacccuccugcaggacgggguuagggaauuuggugcucaauugcucucccuugcucuuccccaaacugaaaauaccuacugcaggaucccucggggcacacugaagcuuggcugccaacccucuuacuuccuuuguuacagggagggguuggcuuggggugaaaaguucugcccuccgcagggagcagcuccagcugccuggcagugcucccaguuuguagggaagccacaccagaucugggugccuugggagaaccaguccuuccuuuugacccaccccaggaagauggagugcucuuuucuaggcccauguucugccagcaaccgggaugcgugggcaacuggacucugcacgggggucuacagguugagggagguuggucacaaugagaaccucgggguuugagguggccaugggcagacagccgaaagggagggagggugugggugugcgugugugcaugugcugguguguaagggggaaagggucuuuccugguuuuauuuaaauaaaguaguuuauguaacaguuaac

SEQ ID NO: 16582 - RNA, 1073 nt, Homo sapiens
aauuccucaaaaugagaugaauaugagaugaggcaucauuguaugagagucuaaggaauaacagggauaaaauccuaaguaucugauggguagagaaaaggaaaauaaaucuuuauauccaaauuuccuacuuuauaauuuccuaaaggacgaaucucacaguuaacauuuucuucagagcccccaugacauccuuauuccuaagacuauagauuaaaggguucagcaccggagugaggaugguauagaagacagauaccaucauguccuucucaggggugugguaggagcuggggagcauguagguguagacggcagccccauagaagaggaugaccacagucaggugggaggagcagguggcaaaggccuuuuuccggcccucugcugaguucauccuguggacggugaggaggaugaguaaauaggagcuugaaaugaucgucacagggaugaggagcaugaggacacagcauagguacaugagggucucauagagugaggugucugagcaggacaggaucguuacagcagggacuucacagaagaaaugaugaaucucccaggaucugcagaaggggaagcucauggugaugggagugagcaugaagccauccacugagcccaggaaccagcagcccgaugccaggaaaagacagacccuaugguucaugaggacaggguaacggagaggauggcagauggccacguagcggucauaggccaugguggcuagaaggaaaaauuccgaaccugcuagugucagauagaggaacaucugcaucccacacucaggggcugagaccuuauucacacccaugaccugguccaggagcaucuugggcacagugacagaaauguacgccauguccaugagagacaauugacugaugaaaaaguacauggggcuguggaggugggcgucacaguguaucagaaggaucaggacagcauuuccagacaacgccuucaggaaaaccacaaagaugaccacacuaaguagagcuggauguuuggaucgucugaagagucccaugaggaugaaauccaacuuuccagugugguuggccauc

SEQ ID NO: 16583 - RNA, 923 nt, Homo sapiens
aauaucccaacagucuccucacugcccccgucacuuccuuauuucucaggcuguagauaaauggguucaguagaggugugacaaugguguaaaauacugccaccgccuuaucccgugaaggggaacgcaaggaguguggccuuguguagguaaagagagugguugcauagaacaggcuugccacaaucaggugggaggaacaaguggaaacagcuuuugccuguccuuuuccugagcucaucuggaauaccacaauaagcacacgagcauaggaagccagaauggcuaggaaugguaguagcaagauaauaaguccacucaggaggacuguauacucauacugggagguguccugacacaccaaugauaguagagcuggaacuucacagaaaaagugguuaaugagccgagaccuacagaauggaagcugaaacacauacaauguauguaugaaagcauugauagaaccacuggcccaugcacaugcaaccaugaggcagcagaucuucuugcucauaagcauaggauaauguaaagggugacagauagcuacauagcgaucauaagacauaaaaccaaggagaagggcuucaguuccaccaagggccaagaacacauacguuugaaucucacagcccaaaaaucuaauggucuuacucugugagaggaagcugacugccaucuugggcacugugguggagauguacaugaggucaacgauggagagcugacugagcagaaaguacauuggaguguggagucugguguucagucgaaugagguggaucagcaugauauuuccugucagagcaacuguaaagaggguggcaaugacgacaaagagaagagaguuuauccagccauauuggaaaagaccaacaaguagaaaaucugucccaaaacuuugauuuccuguuuucaug

SEQ ID NO: 16584 - RNA, 1234 nt, Homo sapiens
gacaguaccucaugcgcugucucaugugcgcucucucuuucgcucucuccuuuugccucugucucugacucugugugucucuuucucuuuuugucucucugucuuucccucuccccucccaugcagugauggcgccaacccguggcagucccagagcuggaggcaggaggauggauccucaucuccaugggaagugucagcguguggcugccagggaagcguggcaggcgccuggccuuggguccaucuacauaguugcguguuucaacaauguccauuuauccuucaccccgaggcguguuuugggggcugcaaacaccucccgguagaggcuggaccugaggacccuucccaccugugcccgucccuuccugaaguccuagccacagcccauccuccaugagucccggcagcucugggucaugcccuucccuggucacccaucugccccucaccucgucauccagggacccagacccugcaccuuccaugugggcccacagauccuuggcagguaccugaggugcaccauugagugucggauuugggguuagcauccagaaagaagaaugcgcaugacgcucugugaaggcuggaacucaggucuucagggagagaaaggaagacuggauugcaccuugaugccuccugaggaggcggccccccucuugaggugggcgugggcccggcccagccuuauccaagucgcucuguccaccucccccuuccuggcccccaccccacuccugugccucccaggagcccucccugugcuccaccugccuccgcagaaggaagccucuuucucuguuucccugggugagggggcuggcagguggcuaaccccauuuagcaucuccaggcccugccaucgugucucaucuugcuguuaucucuagcucuuucccuccucccauuuccuuuaguaguugaauuuugcaaagcuuguagcaguagcucaguugccugcagcauccuuguguguagauaaauuagucgacagaaacucagcacuggggacaggauugcaaagucggggacauagaugcagacaguuguugagauuuggggauagccgggcuugugagcggugcccauuuccagaugaagccuuucagcccuucugaguccccggcccuuggugcgaugucugugaguuugaccugcccagcgugugggcuggcucaaugcugaauaaaguggguuugugucagcucguuugcuucgucuccgu

SEQ ID NO: 16585 - RNA, 469 nt, Homo sapiens
aaauccugagccuucauuugaauacaaaacguacaaauagaguuacuccgagcgccgcgcguuucuguuuggagagacucagccaucaugccagacccguccaaaucggcuccugcgcccaagaaggguucuaaaaaggcugucaccaaggcacagaagaaggacggcaagaagcgcaagcgcggccgcaaggagagcuauucuaucuacguguacaaggugcugaagcaggugcaccccgacaccggcaucucguccaaggccaugggcaucaugaacuccuucgucaaugacaucuucgagcgcaucgccagcgaggccucccgccuggcacacuacaacaagcgcuccaccaucacgucccgcgaagugcagacggccguucgccugcugcugcccggcgagcuggccaagcacgccguguccgagggcaccaaggcugucaccaaguacaccagcuccaagugag

SEQ ID NO: 16586 - RNA, 10363 nt, Homo sapiens
ccgugcugccagccaccccuagggucagccccagcccuguucugagccuaggugaggugccucuggggugggguguagacagaugggugggagagaaggaggcaggcagggugcccggccggaaaugggggcggggagaagaguccccgcccagagcccagacugccggaggauacaggccagagccgccuggacugggcggcugggcaggggaggggaggggagggcccaggcagcccccggucgcuugcuccagggcagguggacugagcuucggaggcuggggcuggccucugaccugcuugggcuuggagagcccugcccgcugcccugccccccaggacaaucagggauucagacccugaggccgaggggggaacaauggggcccuugagggccccuccuccagcccccauugugcuugguggugagagguggcccuggcucggccacacacccucggggaggaccagcauccaagcagguggaagggcucugagggagacuggaauuuucuggccuggagaagguagggugcugggguccauguauguaccucauggggcugggggcuguugccccaggagacagccucacgcugugccccuuggccuugaggccccgaaggagggagggcuuccuagggcccagccauaggagggugcacuccuugcgccugccacccccuccugggcuccgcugcuccacgcagauggugggguggcccccccacuccaugucuguguccuucaggcccagcugccuucaccgcagggugggcaccaaccgguggggucugcucugggacagcuggcaagcgggaggggggugccuucaguaccucccccagcagcuggggccccucagguagugauagggcuggccucugaaacaccagccagcugcauuguguccaggcccagucccccacccucagcggccaccuggaggugagggggccagccugccccugguauagacagaccuggggcccugcucaguccccuccauagaaggccacaagccacuaaguuugcacuggggcccagccuaggucugaagcccagcagacccuguggucaaggauccaaccccagugccugucagugcugugauuaacuggguggaggcccccccggggugcuggggcaggcccucagugcaaggaaggggcggcguggcugaggagggggaggcccacaccccucugggagggcggagcaccccagggcugcugcgcagggaggccacagcccaggcgcgggggcccccaucccagagcuggauggcagugagcccaggauuccuggcugcugggcguucaggagggaagagacggguucguggauccugcggguggagggcagggacagccuuaggaggcugggguaaucaucacccccucacucccaguauggauacccgccagggcucgguuucuggaggguguguggcucagcuccaggccugcaacagcccuggaggcuggccuggggagcugcccaggcuucagcgaugacacacucccagccugacccaggccuaacucgcccccuugguccaccuccagaggaggaacagccccucacuucugggccugacagcucuguuccugcuugggacccugagggagggaacucaagaacaggcugcaggaggggcccacgcauucacagcgccaacaaccccagggaggagagggcuccacgggggaggaggcaccagccuggaugcugccuugccaccugcacgugugcacggcccuggcaaggccuggggaucccacagacucauaccuccacaccacgcuccucaguguccccucacuccccugacauuccugagcgccacacccaugcucuugggcuccugggggucuggucaguucaggagcuguggcaggccauguaaggggagccaccaugugggcaggcacuuggggucuuggugggggcaccuugcuuuccugggccugguggggacuccugagggaggcacguggugagguugagucugaauagggaggguucauggcuaugugugagagugagugugugagcccagcuccauguugagcucgagcagcagugugcauguggcagugugcacugcuuguguguggggggguggagggaggagcgugcccuguguguacaugugaaggaugcaugaggauggcuggugcccacacccaguggggccuacugcugcacaggcaggacagugaggccggccacagagcugcuggggcagagugggcauggagggaggguuccaggccucgggcuuggguccuagguggcugagcucugcaccucccucuggaccagggcauccagaggagcauggcugagggugcacucggggcugaccgucccagggccugggcuguccaggacaggcagcugggggcucaggcagggacauggaggacagguaguggagcugccaccacagagcugagcucugggcaucaggguagggggcuacggccugucagcgggugaggagaaauugaggccugaggaugggugagugcuguagcccccucugagugaggacuguccccacacagggcccugcaguggagugcaggggaaggaggggacugugccugcaggagcuccagggaagugggacugggaaucugcuuuggacugugaguggacaagcgacagcacagugccugccaugcgcugggguaccaucauuuucggggaagggaggagccugccccagggucccgccuggugaacugugugcgugggugccugucugguggcugcccuaaacugcagaaaacacccacccuucgcggccugcccugggagggccuggagauggaaggaaauaccugggccccugacccugugcuacacccagcagggcggggcucguucugcagugccucaggacccuuguucagacccaggaugagcaggagcuugaugggggagggggcccggcucugaccgguguccugagauaccaggacaccaggacacuggucagagcuggcccagccagguuugcagacaggcagccucagcuugggccugcuugcccugaaacccuucccagagguggcccccacugugagcccccauggugagucccuuugcucuugcugcgcaccccuuugaagcccuuccugugagcccccgaugccaccagggcgagaccgcccccacugugaagcccccuuucacacccuggccuaguagcgagcccccaugagacccugguccccaguaugagaacccugugaguccccggcccuccaccaaugcccacauccuccucuacuucccacagccuucccugaggcugacccugccucaccacucccagaccugggccaggcagcguccuggcugguggccuccuguggucaccccccuaccucgcccugacaccuuacuaaccccagcagcugccuccucccagacucugaagcccaagggugccuccaguucuuuggccaagcugaagccucuccccaccaauccucauuuugggcacccuggagguguagcuuuggggugagaucucuuggacuugugugcacauagucugcaaaucccgggccuggcucccugggggccagcaccccuccccucuccucccgugggccuccaccaagccccugcugacagccucauccugcagcacuagacagugcccaccucagcuugucccgccucucuaucaugguccuuucuuuaaguagggguuuauuuuacagcacuuucacagaaaagggccaagguguggauggcucaugccuguaaucccagcucuuugggaggcugaggcaggauugcuugaggccaggagaucaaggagacgauggugaguuaugauugugcggcugcacuccagccugggcgacagagcgagaccccaucaaaaaaaaaaaaaaaaaguaaauagggucuggcucugucacccaggauugagugcaguggugugaucucggcucacugcaaucuuucccuccgggguucaagcgauucucccaccucagcuucccgaguagcuagaaguacaagcgcaccaccaugccuggcaaauuuuuguauuaagaccccauuucucuuuucuuuuuuuuuuuuuuuuuuuugagacagcgucucacucuguugccccagcuaaguacaguggugcaaucucggcucacugcaaccuccgccucccagguucaagcgauucuccugccucagccuccugaguagcugggacuacaggcacgcgccaccacgcccggcuaauuuuuguauuuauaguagagaugggguuucaccauauuggccaggcuggucuugaacuccugaccucaugacccacccaccucagccucacaaagugcugggauuacaggcaugagccaccgugcccggcuuaagaccccauuucuuaaaaaauaaaaauaaaaauugccagcaugguggcaugugccuguagucccagcuacucaggaggccaaggugggagaauugcuugagcucaguaagauuuacagaaaugcugugaggauagugcagaguucuuauagaccucacacccaguuuccccguugcugacgucuugcauuagcgugacaugcuccucauaaugaauggaccaauauggaugagcugggauuaacugagguccuugcuguaugcagaugucuuugccucuccccuacagcuccuuuucugccccgccauggaucccacauggugucagucaccgugucucccuggacuccucuugguuucggcagccuccugggucuccuuguaugggguguccucacugucuggaugaacacuggccggauguucuguagcaugccccuugggugggaucccuuucacccucauguuuccuuaugagucuucagggggauggguuuugggaggaauaccauggaguugacgugaccuucccaugagaugcugugaagcauccacaccauucacgaugcuugugaugacaccuuggccgccuggccaggguugguguaggaggcaugcugcagaggcgcucucccccucucccucccacacccucugaagccagguuaccaggugcagcccacagguagggaugggggucaugcuccccuccaguacagaguguccacauggcugcuuuggauugacucugcacagaggagcugucuccugucccccauuugguuauacauucagucacguacuuuggcuucuaaucuaugucagucuguaaucuguaacacaagacuacuugauuucuuucacugcucagagggauccagucucaggcacugggugcucuacgugcaggugcugcuugcacagacuuccucucugacacuacaguuugcgccaggcucuucuguacauucccagccccagcccucgggucugccaguuccccaccagggguuccugauuccugugauugggaguggagguaggaaccaaggccugggccccagguagauucuugcuccuaggguguuuuugcauugaggccuuugcaggcgccagagcaaaggugugugucugaacccaggugcauccacauagcuguauuuucuaugaaaccgcccacgucucugugagacacccuguggucuccagcugugaucgucaucacauggaauagucacuagcagcauggaaggcggugacacagcgacagccucagggaagggcugaaccugugugugugcgccugugcauguguguguggcgaggccagguagcaaaggcuccuggugggagugggcuccagccagugugggagccgugggcagagcacacgaggggauaucuggagccaggcguggaaugggggcaggggaccuggcacuaaggcaggugaggccgcggcauucgcucugguuaggagucacaggcagggcaggaguccugcugggugggcguccuaaugcuccccaggcuugcaggcaaggagugaagugcuugaggcccugcaggcggggccaggcucaggauuggcugggauagggaagcugcucugcagagcagaguggcauuuggguguggcccucuggcaguggcugugcuugcugggcaucugagugcccauguuggggguggcagcaggcccaagagagaauuacaggcuggagguguggaucugggaguccccauaggcguggcccugagaccaggacccagguucuuccagaccauucccaggaccacuaugugggugcaagugacacaggcccccagagcuaagugccagcccucagacgccagggcacaucagcccagggccgagccacaguggucuccagagcugagccaauggcgccguuuccucagcugaaucaaggaagccacuccgcagucagccacaacgggaaugcucacaccaugggcacuggcaggcgccauuacugcaggcugcccccagagagccauuuguucaauauugcccccacacagcugggcaggcuggcccuggcacugaaggccuccugccccaucucucccuugagccugcucugucucagguuccugucgggcuggaaucagugggccuuagccugcugugaugggucagguggggagggaggugggcccugccuacuggagccagggagauaggggagguggccucagggcuggagugugcccgccugugcaugugugugccugaucacacgugugugugugugcacgggucugugugcaugugugugcauauauguguaugugguugugcauacguaugugcaugugugugcauaugcacaaguguguaugugccacuguuuucaugcaugugcaucugcaugugagugcaaagaagcaugccuguggauguacacauacaucuguuugcauuaacccuguuugcaugugugucugagcaugcacguguacauguguaugcaugugugugcauggguaucugcauaugcaugugcguguucaugcaugugcacgugugugcauguguacacaugugaaucuguggguauguaucugagugugugugcacaugugaauguguguggcucugagggguacugcacagaugugaggaagcagggccacuuccccaggaacccugacugcccccucuuccugccccggguggggaggccucagcugcauaaagaggccgggagccucaccagcgacugcugcuggucccacaccugccgcugcugccucccaggccagguaccgggagggggccagaggcggagggagcuaaggggucuccugccucagcgacccaggagcagguacuggcccuggggcaaccgccagcagagggugggcaggggagcugcaggagcucuccuucuuuggagcacaggcccugcugcacagcccuuuccugggcacuugcccaccuugggcuuggcuggucugcggcauagcugucucugagggucgcaggugcugaguguggccucacaucacugggucuauaaccucgcuggacaccgucccuccuggacggacgacuggcuucauccugaccccagcuagagauggucuggguugagaccauggaggaccaggaaccuagacugggcgggcggagcccugggacccugggcaccugagaagggcagcgggaccagccgggggcuggagggaggauggaggauuuuguggagguggagggaccccgacgccccuguccaggguguggagggaccccgacgccccuguccaggguguggagggaggcagagcagggccucugggggccgaggggcuauggggauuguggacugguggcacuuuggggucugggagcugaugguggugcaggcacggggggcugugaaggacugagggcugauggggcugcaggggcuugggggcuagggagcuggaggggccaggagggauugaguggcuaggcaggcuggggagacccuuuggaugcugaaacucugugggacccuccccaacaaccuggaugcggcuggggcuggguugguggccaugggugcaguggacacugagaccaccaguccccacacacuugaguggugcuugccucaguguccccaucugccucaugaaggcaacucacccagcuggggcccugcaucugcacgagcaggggccggaucaggugggggcuuccacuuccguuuaaggcgguaagcuccacgucauugacuguguaagcagagaggggccagcugcgaggcaagccuggagccccggcucugagcgccgcgggcuccuaagugcaggccccuggcugaccccuaccccgccccacaggacccgcccgcccgccccuaugaccaacaugagcuggagcuuccugacgcggcugcuggaggagauccacaaccacuccaccuucgugggcaagguguggcucacggugcugguggucuuccgcaucgugcugacggcugugggcggcgaggccaucuacucggacgagcaggccaaguucacuugcaacacgcggcagccaggcugcgacaacgucugcuaugacgccuucgcgccccugucgcacgugcgcuucugggucuuccagauuguggucaucuccacgcccucggucauguaccugggcuacgccgugcaccgccuggcccgugcgucugagcaggagcggcgccgcgcccuccgccgccgcccggggccacgccgcgcgccccgagcgcaccugccgcccccgcacgccggcuggccugagcccgccgaccugggcgaggaggagcccaugcugggccugggcgaggaggaggaggaggaggagacgggggcagccgagggcgccggcgaggaagcggaggaggcaggcgcggaggaggcgugcacuaaggcggucggcgcugacggcaaggcggcagggaccccgggcccgaccgggcaacacgaugggcggaggcgcauccagcgggagggccugaugcgcguguacguggcccagcugguggccagggcagcuuucgagguggccuuccuggugggccaguaccugcuguacggcuucgaggugcgaccguucuuucccugcagccgccagcccugcccgcacgugguggacugcuucgugucgcgcccuacugaaaagacggucuuccugcugguuauguacguggucagcugccugugccugcugcucaaccucugugagauggcccaccugggcuugggcagcgcgcaggacgcggugcgcggccgccgcggccccccggccuccgcccccgcccccgcgccgcggcccccgcccugcgccuucccugcggcggccgcuggcuuggccugcccgcccgacuacagccugguggugcgggcggccgagcgcgcucgggcgcaugaccagaaccuggcaaaccuggcccugcaggcgcugcgcgacggggcagcggcuggggaccgcgaccgggacaguucgccgugcgucggccucccugcggccucccgggggccccccagagcaggcgcccccgcgucccggacgggcagugcuaccucugcgggcacugucggggagcagggccggcccggcacccacgagcggccaggagccaagcccagggcuggcuccgagaagggcagugccagcagcagggacgggaagaccaccguguggaucugagggcgcuggcuugcgagcugggccagggaggaggaggguuggggggcuccgguggaaaccugcgaccccuucuccucagccuucuccuuagccgguggccucaggcagacucugcccagaggggcagccaggcugcucagggaaggggcugaaagcggcagaggagugcccuggcuuggucaccacuggggccaaggugggguggagagaggccuaggagccagaaagggcccucugcuguggucugaaccccagggggaguggggcauugacuccaccccuguccugagcuggaauagguccucugggaugccagcucuccccuuugugcuucccugcagcaacccauggagggcccagggugccugguaugggcaucaguuggugggggugcgggggugcguguccccauucccugcaacagcaaauggggcuccuucuucagcccuccccuucccagccccaaacugagacagacugggagcugggagccugggguggacaggaccauacccucuuugagcuucugcgaugccggccuuccguuccucugggaggcuugaaguucugcaaagauguugauaugccuugcagcuuggacccaaugggugguggucagggccugggggcuuggccaugcugggggaauggggcucuggguuccugccuguggccugucuguccuccucccuaauucagacccagccucaagaggaaagggaguaaaauaaaacuaacuuguuuauaaccuugugugugcaug

SEQ ID NO: 16587 - RNA, 5829 nt, Homo sapiens
cagaggcgcgcggcgaagccgagugggcgcgggagugacgucacggcgcgcgacgcggaggcggggucgggccuggguccgacgguaguggguagcgggucucggguugcggguugcagguugcaagccgcaggccccaggcaacugccuucccggcgccauguucggcuccagucguggaggcgugcgcggcgggcaggaccaguucaacugggaggacgugaagacugacaagcagcgggagaacuaccugggugggugcgcgcggugggcgggcuccgggcuccgggcuccgggaucccgggcgggcgcuggacucacagcgucuacguccgcaggcaacucgcugauggcgccgguaggccgcuggcagaagggccgcgaccucaccugguacgccaagggccgggcgccaugcgcgggcccgagccgcgaggaggaacuggcagccgugcgggaggcggagcgcgaggcgcugcuggccgcccugugaguguccgcggacggcagcggucggugccugggacggcgcugccggggcaggguggggccggggccggggacugggggucgggcugggcgggagcggggcugcggggacucgcgcgggcgggacccugaggacgaaggcuggaguggugaggaccuguggugggaggagguccguccguccugacgccugccccggcccucucgcaguggcuacaagaacgugaagaagcagcccacgggccugagcaaggagguaacuccccgggguggggggcgcguggagggccguggguguggggccgacucgagcgcucccugugcucucgcaccugcaggacuucgcggaggucugcaagcgggaaggaggcgaccccgaggagaagggcguggaccggcugcuggggcuggggagcgcaaggugcgggcggguuuccaggggagggcagcacugggcucgauugcucgggugaggcggaccccugccguacugucuucaucgccaugucccugcaguggcuccgugggccgcguggcgaugucccgagaggacaaggaggccgccaaacuggggcugucuguguucacgguaaucccccgccccgccugaccgcagcaggggcuaacagggguggggcggggcgggggcacugaacggagcuccccggggcgcugcggggcgugguguggggccggcccgcagacuccuccgcagagcucgcuucucccgcagcaucaccgcguagagagcggcgggcccgggaccucggcagccucggccaggaggaagccgcgggcggaggaucagacggaaagcaggugaggcugugccaccugggcuagcugugccccgggguggggggucucgggaggaccggagcggcucccacucgggcagguggcagcuucucuuggcgcaccggcccggcggguggccugcccuacuuuacuuccugucccaguuacuccuagguuuuucucuaggggaguuucucgggucacccuugaagagagguccuaaguacuggcaguggucgggcgcugugccgugggagggcacucaggaccuggggcggggccuuuuccugccguggguggcaccuccagggcuucuccuggauggugagccugggccugacccuaagaguggccuggugggugcagguaggaaggugucaaccugccaagggcacggcugggguggggcaggggcgugcuguggagauggggauauugcaucuguuucuaacccacguagccacuggccacgugacuacguaacugaggaguggaauuuguaguuugauuuaacugauuuaaagacgcacuugugggugguggcuucaucuggauggggccugcuuguguucacucucuuggcuugcaagacuagggucugaggcacaccuuguauccuccuuguaguugugagagccacaggaaaagcaagaaggagaagaagaaaaagaaaaagaggaaacacaagaaagagaagaagaagaaagacaaagagcacaggcggccagcugaggccaccuccucucccacaucuccugagagguaugcccugguccauaucugccucuugggggugggggccugguugacuccuuccgagugacugacugccauuggucuccccaggcccaggcaccaccaccaugacuccgacuccaacucccccugcuguaagaggaggaagcggggacacaguggggacaggaggagcccgucucgcagguggcaugacagaggcucugaggccugauggcuggacccugcucacugcuguugugggacccugaacccucccuucaccuugcuugccuccugccucggaagcuccuugggugugggugaagcccgaggcugcuccuguggaaguggcucugggcaccagccuguggggcuaaagacuugacagcuagcucuggagcagccggcuuccuggaaaaccuccagguuucgcauaccagggauggccccuggcuuggccugcgaaggugaaccugcccagauuuaucaguagaggcuggacucccucuguguccugcccaugguugcagcagccaugggccuaugagcggucuaacuguggccaaguauggugaccucuauuuuucuuuauauugacucuuuguauuucaauaaauauauuuuaaaaggaagguauaucaaauuggaaggucaguaucagggguuaaugagaucccacuggaacgucggagcuggggucugucucccaggagucugagaccuggugauuuuuuuuuuuuuugaguuucacuuuuguugcccaggccggagugcaauggugugaucucaguucacugcaaccuccgccucgcggguucaagcgauuuuccugucucaaccugaguugcugggauuacaggcgcugccacuacgccaggcuaauuuuuguuauuucuuaguagagacgaggucucaccguguuggccaggcuggucuugaacuccugaccucaggugauucgcccgccuuggccucccaaagugcugggauuacaggugugagccccggugcccaucugauucuuaauguccugggggaauguaguccucccaugugugcccagagcccccaccaaaacccagggagggcugaggcccuggaagcaggugcucagcuggcaaugugggaaccuggggcagggagcccuaucccugcgacaggugaggucaaagacugcagucuguggaggcacagccucaauuggguguggggguuggggagcuccuccaacugccugcuaccccaacccucagcuccgcuucuccagaggcagugggcugggugucccuucugccugacccuaagaaggaucagggcuguucaggaugugugcggccaccaggcugcauggcauaaagacagauggcaccugggcugcaucacaguucaaugcagcguugcaguguugggaucagaggcaugagcucccucaccuggccuguuucugauuucaagggaaguuaugcagaccuuccucagggcccuggccaagguguagcuuguggcuuugaccucugcccucacccucggguggcuacuggaguagagacugugcugucuugggugcugucaagggggaugaagguugggccaccuagccagggcagcccucucuuuugggacucugcccaacagaaggcagaccuuagaccugcugauggccccaucccagaaacagguacccccagacuggcagcccccugcugcauggcaucuugaggagaggugggggcugugcccacucaggcagggaccauucccugguuggcacaaagcccuauguaugcuagcaguggcccugccccauagccagcuauacaaagugggguucagcagcaggccgauggagggaaggacggaggcugaggucuuccauggugccugcugaccccugcccuguauggcccaggucucauuggcugggcccgacaggacugcaaacgagaucaaggucacugugggcaaccaugcuggaagagccucucacacagacacagagaagugccugcacacucaggagggaacauggggaggguguggacugagguggcggcccuaggcagucaccuguacuuccuagaguaaagcuggcugaugcacccaccaucuccugggggcagcaugccuguguggaagcacuggagagccggugaaauaguuaagagauuuuauucuaauagcuauaauuacagugcuuguuugucgaaaugaaaacugaaaacaaguauacaaaacaguugauuacuaaucguguauugaaagcaguaagagguuccacgacaccaaauagaccaguucugagguuuccccaagauaaauuuaacagcuccagcuucaguguuuaucaaaauacaaaagaaaaaaguagagguugucuuuuucgauggcaaaucggacccuugcaggcugagggagagaaagcuacaucacacacagagguggggugcucccgaggggcugugggucuagguggaccgccugcccggcuugcacgcgcuccugcuggugaggccccagacauccugccaaagugucugagcgagcacgaguguuggggacgacggacccacucuggccacacggcgaccgagggacagauggggcccugcgucccauaggcugccugaagguggguagggcggccugcggcauagugggguggcugugggcucccagccuggccccugggaaccgugggagcacagggacaagcacauggcuauggaaugcagggugacccaaggacaagcgaguugcggggaucucuacugugaccaugcagaauugaucgcagucugcugcgccaccaccaccucauguucccgaggggaacagcugggcuggcgacuggcauccaggccguaacugcaaaucuaugcuaggcggggucucccuucuguguguucaaguguucucgacuuggauucuuaacuauuuuaaaaaaugcacugaguuuggguuaaaaaccaaccaccaaaauggauuucaacacagcucuaaagccaagggcguggccggcucucccaacacagcgacuccuggaggccaggugcccaugggccuacauccccucucagcacugaacagugaguugauuuuucuuuuuacaauaaaaaaagcugaguaauauugcauaggaguaccagaaacugccucauuggaaacaaaaacuauuuacauuaaauaaaaagccuggccgcaggcugcgucugccacauuuacagcacggugcgaugcacacggugaccaaaccacggaggcagcuucuggcacucacaccacgagccgcacguuugccacaugagaguaaagcagagggcaagaggagugagagggaggggggucgcguucacuucugguuccggagcugauuggacagccaguccaguccuucauagagcccgucgccgcugguggcgcagguggccugaauguaccaguuccuguggcguagugagugcagccccagcuugucugugaucucggccgcauucauggcguuggggagguccugggggaaggaaggguuggugggaagggcuguccacaggacagagaaaggggccccaccagccuccaguaaccccuaccaccaggcggaacccacacuggcuccucacauuccccaggcuggcccgggcgccuaccugcuuguuggcgaacaccaggaggacagcaucccggagcucguccucggccagcauccucaugagcuccucacgggccucguucacacgcucucugucauugcuguccaccacgaagaucaggccugccgggcagccagugucaaauggucauggg

SEQ ID NO: 16588 - RNA, 5829 nt, Homo sapiens
cccaugaccauuugacacuggcugcccggcaggccugaucuucgugguggacagcaaugacagagagcgugugaacgaggcccgugaggagcucaugaggaugcuggccgaggacgagcuccgggaugcuguccuccugguguucgccaacaagcagguaggcgcccgggccagccuggggaaugugaggagccaguguggguuccgccuggugguagggguuacuggaggcugguggggccccuuucucuguccuguggacagcccuucccaccaacccuuccuucccccaggaccuccccaacgccaugaaugcggccgagaucacagacaagcuggggcugcacucacuacgccacaggaacugguacauucaggccaccugcgccaccagcggcgacgggcucuaugaaggacuggacuggcuguccaaucagcuccggaaccagaagugaacgcgaccccccucccucucacuccucuugcccucugcuuuacucucauguggcaaacgugcggcucguggugugagugccagaagcugccuccgugguuuggucaccgugugcaucgcaccgugcuguaaauguggcagacgcagccugcggccaggcuuuuuauuuaauguaaauaguuuuuguuuccaaugaggcaguuucugguacuccuaugcaauauuacucagcuuuuuuuauuguaaaaagaaaaaucaacucacuguucagugcugagaggggauguaggcccaugggcaccuggccuccaggagucgcuguguugggagagccggccacgcccuuggcuuuagagcuguguugaaauccauuuuggugguugguuuuuaacccaaacucagugcauuuuuuaaaauaguuaagaauccaagucgagaacacuugaacacacagaagggagaccccgccuagcauagauuugcaguuacggccuggaugccagucgccagcccagcuguuccccucgggaacaugagguggugguggcgcagcagacugcgaucaauucugcauggucacaguagagauccccgcaacucgcuuguccuugggucacccugcauuccauagccaugugcuugucccugugcucccacgguucccaggggccaggcugggagcccacagccaccccacuaugccgcaggccgcccuacccaccuucaggcagccuaugggacgcagggccccaucugucccucggucgccguguggccagaguggguccgucguccccaacacucgugcucgcucagacacuuuggcaggaugucuggggccucaccagcaggagcgcgugcaagccgggcaggcgguccaccuagacccacagccccucgggagcaccccaccucugugugugauguagcuuucucucccucagccugcaaggguccgauuugccaucgaaaaagacaaccucuacuuuuuucuuuuguauuuugauaaacacugaagcuggagcuguuaaauuuaucuuggggaaaccucagaacuggucuauuuggugucguggaaccucuuacugcuuucaauacacgauuaguaaucaacuguuuuguauacuuguuuucaguuuucauuucgacaaacaagcacuguaauuauagcuauuagaauaaaaucucuuaacuauuucaccggcucuccagugcuuccacacaggcaugcugcccccaggagauggugggugcaucagccagcuuuacucuaggaaguacaggugacugccuagggccgccaccucaguccacacccuccccauguucccuccugagugugcaggcacuucucugugucugugugagaggcucuuccagcaugguugcccacagugaccuugaucucguuugcaguccugucgggcccagccaaugagaccugggccauacagggcaggggucagcaggcaccauggaagaccucagccuccguccuucccuccaucggccugcugcugaaccccacuuuguauagcuggcuauggggcagggccacugcuagcauacauagggcuuugugccaaccagggaauggucccugccugagugggcacagcccccaccucuccucaagaugccaugcagcagggggcugccagucuggggguaccuguuucugggauggggccaucagcaggucuaaggucugccuucuguugggcagagucccaaaagagagggcugcccuggcuagguggcccaaccuucaucccccuugacagcacccaagacagcacagucucuacuccaguagccacccgagggugagggcagaggucaaagccacaagcuacaccuuggccagggcccugaggaaggucugcauaacuucccuugaaaucagaaacaggccaggugagggagcucaugccucugaucccaacacugcaacgcugcauugaacugugaugcagcccaggugccaucugucuuuaugccaugcagccugguggccgcacacauccugaacagcccugauccuucuuagggucaggcagaagggacacccagcccacugccucuggagaagcggagcugaggguugggguagcaggcaguuggaggagcuccccaacccccacacccaauugaggcugugccuccacagacugcagucuuugaccucaccugucgcagggauagggcucccugccccagguucccacauugccagcugagcaccugcuuccagggccucagcccucccuggguuuuggugggggcucugggcacacaugggaggacuacauucccccaggacauuaagaaucagaugggcaccggggcucacaccuguaaucccagcacuuugggaggccaaggcgggcgaaucaccugaggucaggaguucaagaccagccuggccaacacggugagaccucgucucuacuaagaaauaacaaaaauuagccuggcguaguggcagcgccuguaaucccagcaacucagguugagacaggaaaaucgcuugaacccgcgaggcggagguugcagugaacugagaucacaccauugcacuccggccugggcaacaaaagugaaacucaaaaaaaaaaaaaaucaccaggucucagacuccugggagacagaccccagcuccgacguuccagugggaucucauuaaccccugauacugaccuuccaauuugauauaccuuccuuuuaaaauauauuuauugaaauacaaagagucaauauaaagaaaaauagaggucaccauacuuggccacaguuagaccgcucauaggcccauggcugcugcaaccaugggcaggacacagagggaguccagccucuacugauaaaucugggcagguucaccuucgcaggccaagccaggggccaucccugguaugcgaaaccuggagguuuuccaggaagccggcugcuccagagcuagcugucaagucuuuagccccacaggcuggugcccagagccacuuccacaggagcagccucgggcuucacccacacccaaggagcuuccgaggcaggaggcaagcaaggugaagggaggguucagggucccacaacagcagugagcaggguccagccaucaggccucagagccucugucaugccaccugcgagacgggcuccuccuguccccacuguguccccgcuuccuccucuuacagcagggggaguuggagucggagucauggugguggugccugggccuggggagaccaauggcagucagucacucggaaggagucaaccaggcccccacccccaagaggcagauauggaccagggcauaccucucaggagaugugggagaggagguggccucagcuggccgccugugcucuuugucuuucuucuucuucucuuucuuguguuuccucuuuuucuuuuucuucuucuccuucuugcuuuuccuguggcucucacaacuacaaggaggauacaaggugugccucagacccuagucuugcaagccaagagagugaacacaagcaggccccauccagaugaagccaccacccacaagugcgucuuuaaaucaguuaaaucaaacuacaaauuccacuccucaguuacguagucacguggccaguggcuacguggguuagaaacagaugcaauauccccaucuccacagcacgccccugccccaccccagccgugcccuuggcagguugacaccuuccuaccugcacccaccaggccacucuuagggucaggcccaggcucaccauccaggagaagcccuggaggugccacccacggcaggaaaaggccccgccccagguccugagugcccucccacggcacagcgcccgaccacugccaguacuuaggaccucucuucaagggugacccgagaaacuccccuagagaaaaaccuaggaguaacugggacaggaaguaaaguagggcaggccacccgccgggccggugcgccaagagaagcugccaccugcccgagugggagccgcuccgguccucccgagaccccccaccccggggcacagcuagcccagguggcacagccucaccugcuuuccgucugauccuccgcccgcggcuuccuccuggccgaggcugccgaggucccgggcccgccgcucucuacgcggugaugcugcgggagaagcgagcucugcggaggagucugcgggccggccccacaccacgccccgcagcgccccggggagcuccguucagugcccccgccccgccccaccccuguuagccccugcugcggucaggcggggcgggggauuaccgugaacacagacagccccaguuuggcggccuccuuguccucucgggacaucgccacgcggcccacggagccacugcagggacauggcgaugaagacaguacggcagggguccgccucacccgagcaaucgagcccagugcugcccuccccuggaaacccgcccgcaccuugcgcuccccagccccagcagccgguccacgcccuucuccucggggucgccuccuucccgcuugcagaccuccgcgaaguccugcaggugcgagagcacagggagcgcucgagucggccccacacccacggcccuccacgcgccccccaccccggggaguuaccuccuugcucaggcccgugggcugcuucuucacguucuuguagccacugcgagagggccggggcaggcgucaggacggacggaccuccucccaccacagguccucaccacuccagccuucguccucagggucccgcccgcgcgaguccccgcagccccgcucccgcccagcccgacccccaguccccggccccggccccacccugccccggcagcgccgucccaggcaccgaccgcugccguccgcggacacucacagggcggccagcagcgccucgcgcuccgccucccgcacggcugccaguuccuccucgcggcucgggcccgcgcauggcgcccggcccuuggcguaccaggugaggucgcggcccuucugccagcggccuaccggcgccaucagcgaguugccugcggacguagacgcugugaguccagcgcccgcccgggaucccggagcccggagcccggagcccgcccaccgcgcgcacccacccagguaguucucccgcugcuugucagucuucacguccucccaguugaacugguccugcccgccgcgcacgccuccacgacuggagccgaacauggcgccgggaaggcaguugccuggggccugcggcuugcaaccugcaacccgcaacccgagacccgcuacccacuaccgucggacccaggcccgaccccgccuccgcgucgcgcgccgugacgucacucccgcgcccacucggcuucgccgcgcgccucug

SEQ ID NO: 16589 - RNA, 598 nt, Homo sapiens
aagauugaagacagaaucauaaaagccauccugagaaagaagaauacagaugaggcgugaggacaccaacaagcuggugccgaccucaggagguggaggcccugcugcauaacaagaugcaggaaggagugagggcagagcgugggcucugaaggugccauggagguagugcugacugauaaaacagugucuuguugggcccccaaauggagguaaaacaugcaauuagcacauaacucagggcgggagagucgaugggaauauguucucuggcccugugcugcccagguagagaaggcacuaaccagcaucaggcuuagguaggucacagacacaugguauagcauugaaggugacuguggaaauuacaaaaaauauugugcaacuucagaugagcagagggaauauguggaauaacaacaacaacaacaaaaacccaaaaagaggaaaagaggaugaaaaaacccaggacaggcauggucaacagaaaggaugagacaagaggguaaacugaggcuccagacccuaggggaugaacugcuccaggcgaaagccuggguugauuggagugugguuaagggcuuagucuaauuucccu

SEQ ID NO: 16590 - RNA, 2181 nt, Homo sapiens
uuuuuuacacuccaaugccaauuuauuuucaaaaagggcucuguguuauccuauaguuugccuuuuuuuguauaauuguacaaacuuugaaaguuacauaaguuguaaugaucuaauauuauuaauagcuauccaaaaaacacuuucccucccacucaacaaccauccagggggaaguaaaaguccugaaaagagaccaguucaacauggccucuacccuggcagaaacaaaaagugagaagagaagaaaacagaaauuaacuaagagguguugccagugucucucaggaguggggcccuggcugucgccaggggucaugaaaggcagagccugcagcauguaguagggcagccaggagaccuugcagccuuaucuuccucacccccgcacauccacaucccaacuuaggugucauggaaauccuucagcaggguucuccuccacugcucggcuacaugcaucugguucuccaaguccccucugucauagcugucugcauguuccacuuuccaugagagguuuucaauuucagccuccugcucagccugcugguauucaaacagcucauuccuggguccagacuccauguaauauguauauggguugauguacugcaggguguaucaacaccuggccaagagcuuggcugcacucuguagguacugccagucaauccauguccccagauuguucaugacccucuccugaaucuucucaugaaucugcugguaugucugugccucuagcugcaagcuuuuguugugguuuucccaccucucaaaguagaauaaguacuuuuugagggcuucccucgccugggcuuguuggcgcugguucacaaugucaggauucuccuuguaaguacugcacucauauuauucacugccaugugccuuccaaucuccuagauauguccagcagaagucguguuuacauuuggagcauugcaugugauugcagccuccauucuucucaaugcagauguuguauucgggacagucuuuagugugagcacuacuguagucggcuguuucagaguugucugcacacuucuugagccauuuucggauggugaugcggucugugggugcgugauauauuugaugacacuugaaacagaagaccucguugcaccgauugcacuauacucggugagcucuaggcuccuguacccgaacaaccaugaggcagucugcaccagggcacagcuggagcuaguaaugacucuucacauagucccugaagagguagcaccuguauuucucucucaauucuucauugggaagcaauggaaacacaaaguccucugguguauggagugggacaguccugagccaugcaagcgacucccacacccacaccauccuuaacgagaacugagcagugcugcuccaagcagcuacggcaaaacuggugcugacagaccagggagaguagguuuuucuuucgcgcaaacugcauacacacugcacagaggugagggggaugagaugcgggaacauguuuugauggauuaggcugaacucgagccucaacgagcaguugagcagaauuggacuuguaucuguccaaucucucugaaacuugccaauggaaauuaacuaauauaaguuuagcaacugaaugagauaccuuuaggacagaggcuaagcuggucaugugcucguucagggcacccucagauuucuuguaggucaaguaagugaacuaguacuccucaggaucaaaggcaucagcccccugcugcuccacauugcuggcuacucccagguaauaguccucuauguccccagggucuucauccucuucuuguuccucuuccucacaauuugagucauagugcuuuucauugcugucagaccccuggcuauucauguccacggacaucuuagcauccagccaaguugcagaaaagcaguugcuuuuuccgccuccccacaaaacuaccgcuuucucaagugcauuaguauuuuuguuuucuguaauucuuggagaucucucaggcagaugucacccaaauauucuauguaauaugauuuccaucgggagcuguggcuucauggccgcugagcccggguuagccagaccaagucaggccgggccagagggaucugacuggggcccagcugcagcagagguggaggcgacgggccgacgcugguccagccauggccacuuuc

SEQ ID NO: 16591 - RNA, 153569 nt, Homo sapiens
ccacuaccacaugcuccaaugucaccuccuccgugaaggcuggguuagcucaccccccuguuuaaagacucaccaugacucccagcugccagugggaugacaugugcacgccugggcuuggaauacaaggccugggugauagagcccucuuccaaucccucuugcuccuucuuccccuaucuccacuuccagccacacucaacccucucacuguccacuuaaacuuccccuccuccuugaagccacccgaauuuuucuaaagagcgcauuucuccccucucugggcuccugcaaccuucugccugagccuuugacagccuuuuccagguugucuuuuggccaggaggcuggacaauggaggacgggagugacagcucggccccuuccuagcagagugauccuacacaaauuacuccaggugucugacccuucauuuccucaagcacaucaugggggaaagaaugccuagcucagcaccuggcagagagucagccuucgcucaucuccccuaauggagcugacagcucuucaaguccgcugacaucuucucuuagucaucccuugaaauacuacccgcuguuacuucucugcuccucagucuccuccuauguaaaauggggaugagaaaggagagguugcgaaccuuuaaugagcgagcccuuggaguauccagcccuucccgacgcuaacugacuccuacgagggggccugguacacaguaggugcuaaacuaauccucuccgagcugggcuuggggaagaugccuccguuggguguacagcgugggcgcgggaaggcgagccugggagcgaggggguugcagagaggcagccugaggucggcuccgccuucccccgcaucccccgcccgggcccugcagcugucagcccggccggccucggcgccaguccaccaaaccugaacgucccaugccggcgcccccaccuucccggccugcacaacuuaccuugcgcucggcggcccucggucccgcccccgacugccauuggcccagagguuccuuuguuagcgagagcgcgccaaccccauuggccgguggggcugccgaucgcgucgggcgcggccccgccccguacgccccggcaccuccccgcgcccggccgcccgcccgcccgcccgcccgcccgcccccguagugcgugaggcgcuccggucccauuugcagcggccgcggggcgccgagggcagcugcggcggcgcggacgagccgggacggcggcgaccggagccugagaggcgggccgcagcgggaagcagcgggcccgaggccgcguccaugggcccgcggcggccgggcggcggcggugcgggcgggagcugggcgucgcgcgcgcugugaggcccgggcggcucaggagccucggcgcgugcagcgaaccgcccgccgggaaggaggccgggccgggccugcggcggggccggcgagggaugcggcgcggccgcgcugagccccuagcccgccgggagcgccaggccggccaggccugcgccgccgccgccgccgccgucgccgccgcgccgaccaugucggcagccaaggagaacccgugcaggaaauuccaggccaacaucuucaacaagagcaagugucagaacugcuucaagccccgcgagucgcaucugcucaacgacgaggaccugacgcaggugagcgacuggggccggcccggacaccuccguucugggagccgcgggucggcggccggggcgccgccaagggcugcagggaaaauaaaaauggagcagggaaaugcgcgaguccuggggcauggggacggggacgggaagugcauugacagagcugggacaaagggaaaauccucgaguaugccgaaaaauaacauccuuucccguucccauugcccggcugugugauucaugcuuuuugggugacucaaaagugccugguuucgcuuaguaggaacaaagcgcuuagggauugcaugccgcuugacgggaccccccugagauucuggcuugggacuggacuuggauuuguccagccagaguggcccaggggucggauuguuggggaggacugugggcuuccgucuagugggacgcagccugccccgauucugaaucaucgucacugucaagcacuggagagaggugaagggguguccaaaucuggcgaggagggucuuguucuugaacuuaguuuggcaggccguaguuuagcggggagcugggaccaguucccuggucacuggccgaggggugaggagaccuguggguccucgggaaaguugauuucugucucccagccuuaacugucaaacagggcuuugaacuaguuaugacucccaaacgugcauuagagucauagccauuaaacacagaguucuggggcccccgcccuggagugacuggggagauggggaauuuguauugaugaaaggcuccaagaggcuuggcugcagcccccauggcccuugggaaccccugcagugauugcuguuugaacuccuaguguuccaggauuccgagccuugugugcaccuccuugggaugugccucgguacccuccccacggccaucaucuccauccucuucagagcuuucucucagccuccugaaugaagccaggggaagucccuucacauuccaguccagugugaccuaguuguagccacuccugucgcagaagaaccccuuagacugaaaacgagugaacgggccugguuguuuuuaaugccacuucagugcacccaggguuugacuuguuuacauggccgacuggaguagggugguggggcagggguuacggccuggggcacggggccuuucucugaggucagguuuccaacugccaggaaaagauuccuuucaucuaaaccccaaaagcuuaacgaaacacucaaggcugcaaagucauagaugguuaagauaccaaggguuuuaaggacggucagcuugggacggauagaacucauuuaccucggaggguguuuuggaguguaaaggagaacuugauuccuucuucucaucuggaugcuuuuuuggaugaaacaguuuaugcgaugaggaguuguuaggagacuuugcuucaggucuuggcugucacuuccagcugugugaccuugaacaaaucccuuuacuucuguaucuuuuaauuuccuuaucuguaaauugggaauccuggucccuggcuuaccuccuucacugagcauuugugaaaagcaagaaaugauauuuuaugaaacuuuuuucucuuacaauuuaacaaaccaaaaaaaccugccacuuuaagaaguuucugggcaaggguuguucugagagagguuuguaaguuuccugguuauucuaagcaacugucaaaauugguaaauuuacaccucauaggggcuguuuucgaauucuuaagcuuagauaaacuaggauggaaucugcauguuugaguccaaucugcuaagauuuuuuuuaaucuguugauuauuaauuggauucacggggagaggcaaacuuaaaauacuguacucucacuguauucaaaguugaauuguggguuuugaaacaggccugagaccuucagggcacaacuggaaugguaguuucugaaauaaugagugggguuauuugugcugggagagguuagcccagcauucuaccuccugggaucuuucaggaagaaacugcucuugaaaagagaggagggagacucagggcuguugccaacagccuucucugcugcucucugcauccggcccucccucucacucucauccuuauggcuccauuagaaaaccucaaccaaucgguucccaucagucucccccaagccccugcuuccugcugccccucccagccuggagcuuauuuuagaccgucaaagcuggaagauacaucagccaccaucgaggccacucccuccuuaagaggagaggauacugggcccagggagguggugggcagccuuggccggcuuuugcucuggagaugucaucuucccaggagcagacauuucucugagccuuuugguuugagguuuauuuccucagcuguggguuuuguuuguuuguuuuuccccuagagaggcacagaaaccucuugcagggacuguauuauggcaucagaccuggaagggacuuggagaucagcuaauguaaccacuuccucuuaccggugagaagauugaaacccagagaagggaagugacuugcccaguucagggauggagccaggauucugaagccaauguuaguuccccuacuccuguucagggucuacaguggccacaccaugagcacaugaugaggacaauaaugucagggauaguuauguugcaggaggugccuugagaaugcuggcuuggagcaguggaguucuuugccuuuuccuccucacggaaauuuggaguaaucugggauaagugauaagugaccguccuuuauuacuuguuccaggccccuguucacagagugucauuuauccuccaguuuuccugugcauuucucagcgacauacggacccaaauauacaguuuuuuuuuuuuuuuugaggcggagucucgcucuguugcccaggcuggugugcaguggcgcgaucugagcucacugcaagcuacgccucccagguucaugccauucuucugccucagccucccgaguagcugggacuacaggcacccgccaccaugccuggcuaauuuuuuguauuuuuaguagagacgagguuucacuguguuagccaggauggucuugaucuccugaccucgugauccgccugccucggccucccaaagugccgggauuacaggcgugagucacugugcccagcucaaauauacaguuaaaccuuuuuauccugaacugugugcauguauuugcucugcgacauauuuuuuguuuucugcuuaucagcauaucuuuacguucuuuucaugguguugcauauaaagaugccagaaccauuuugcauauuaggccuuuaggaguguacuauaauuuaacccguuuccuuauugauagacaucaagguugcuuauggguuuugcuguuacauacagugaauguuucggcaaagagucuuauaaauacuucugggugugugugcgugcaugcaugaaugcaaguauuucucugggggcagauaccuauaaauagaauggcuggguugacaucaagcgcauaaauuuuuuuuuucagauaccacgaaauugccuuccaaaaaaggcugugugauaacauuuccaggacuggauauuaucaaaugauuuaauucucuaauaauuuuccuaauuacucaugaaguugagccuuuuuuauaguauuuacugaguauuuuuguuucuuuuguggauugccuguucguauugcuugcccauuuuucuguaagguuaguuuuucccccaguugauuuguaggagcuuucuauaagugcuuuaggucaggggucugcaaacuuuuuugguaaaaggccaaauaguaaauauaauuuagugucugugggcuauauggucucugucacaacugugcagacuuugccgucucaucacaaaggcagccguagacaacacauuaacgaaugaguucgaaugaguuacuguguuccaguaaaacuuuauuuaccggcagggcgcaguggcucaugccuguaaucccagcacuuagggaggcugagguggguggaugaucugaggucaggaguucaagaccagccuggccaacauggugaaacucugucucuacuaaaaauacaaaaacuagcugggugugguggcacaugccuguaaucccagcuacuccuugggaggcugaggcacgagaauugcuugaacccaggaggcagagguugcauugagccaagaucgugccacagcacugcagccugggcaacaaagugagacuccuucucaaaaaaguaauaauaauaauaaauuuaaaaaacuuuauuuacaaaaacaggcagcuggcaugauguguggccugugagccauaguuugcugacccugaacuagauauuaauccgaugcuugccacguauugcagguauuuuuucccagaaugccacuugucuuuuuugugugguuauuuuucuuuuucauaauauaaaugcaguuggucuuuuuuuuuaauaguuuguaguuuuaaugucauguuuaaggccuacuuuccaagauuuguaaaauaauuucucauauucuuuuauagcuauuuuuauacuuagcuuuuuaaucuaucagacuuguuuuuuaggaaaauaauucugguuaaaggcagaagaucuacuggaggcuauuaaacuggguaaauuacaaucaaggcauucucuccagaucagugcuggugaggauggaaggaaucagacucuagggacaggauguuguugguugaucagagguggguguugaggaaccugggguaguuagaaguaccuuuaacagagauugagaagaacagauuuggaguaaacuugggggauggggagggguaaaaaauaauaugguaaguuugacccuuauggacguagagggaggcuggguuggaauucuuaagucuuggauguggaggugguugcugaaaucaugggagugagugugagcacucaggaggcugcauagagugaaaggagaggaaccagccuaggaagcccccauguagugggcaggcaaaaggggagcaggugcagaggcugggaggugaaucagaggggugggcauuagugggagaagcaggucuggaacccagggugcucagcuucuacauccgcguguugaucugggggugaugucucuuucuccugcugacuguguaacuucaggcauugccucuguggaaggagccugcaagccuguuucuacuucuuugucuagcccuguuuuuuugugggaccuuggcugggucauuuucauugcucaggccuguuuucccaucuggaaaugagcucggucuugaucucucccaggguucuuagucuuccuggugugauucugcccuugcugugcccauaccccacugccaaggcuccaaagcugcgggggccucaggugggaauuucagacauagagggugugggccaggacgaggucucagggaagcauuucaucagguuucccuuuguuccuguagacauucguagaaguucuaaggcauaggacuuccugauuugacuuaauguguaucucagaaacaacggggagauuucgcaucccccccuuguagaagaucuguaacaggaguugguguguugcuuggcagggagcgugucaaaaaucucagacacacaaaaucccauuucagacggccaagcaccaugacaaaugcucagcguugucaucagcgaaacccaaauugaaaccacagugagauaucacuucauaccugucaggauggcuagaauuaaaaaaauaagaauauaacauguuggcgaggaugugaagaaguuauaacucuugcacguugcuggugggaaugaaaugguguagcugcuguggaaacaguuuggggguuucucaaaaaguucagcauaaaaccuaccacgugagccagcauucccacuucuagguauaugccaagaagaauugaggacagguguauucaaacagauacuuguauacaaauguucauaacagcacuacucacaauagccaaacggcagcaacaauccaaguguccauccacuaaugcguagauaagcaaaucauaguguauccauaccauggaauaucauucaguucuaagaaggagcgaaguacugagacaugccacaacauggacgaaccuagaaaacauugcgcuaagaggcagacaugaaaggucaugugucacauacugugugauuccauuuauguaaaauguccaaaacagguaaaucuguagaaacagaaagcagaucgguuguugccagagccugaggguugggugggcaauguggaaugacugcuaaugagacugggguucuauuuugggggugaugaaauguuuuggaacuagauaaaagugcugguugcacagccuugugaaauguacuaaaugccccugaauuguucacuuccaaaugcuucuugacuuaugaugggacuuaugguggggguacauccagguaaaacccaucagaccuaucacaaagucaaaauuauaagucagggacugucuguacaagaaucgcucucucacacacacacaccugccuucugcuccuugugucaccuggagugaauaucugauuguuucuagagucuagaccaaggcuuggcaauuuuuuuuauaaaggacucuucuuuuauccuggggaacuccuuccccaagccacucuuucccaccugaaugacacaguuggaccaggucggugguuuucaagcuuucaucaaaucccggagccuuuuacucaaaagaaaucuuguauauuuuagguuuugcaggccaacaggcaaaaucgaggagguuguguaggauauagccacuuaaaaauguaaaagccauucuugguuuuggggucuuagaaaagcagcuggugggccaauuuggcacaggggcacagugugccaccccucagaccagcccuguccucuagaacuguaauggaagccacauaggaaauuuuaaauuuuccagcggcuacguuaaaaaaguaaaaagaggggccgggugcaguggcucacgccuguaauuucagcacuuugggaggccgagacgggcggaucacgaggucaggagaucaagaccauccuggcuaacacagugaaacccgucucuacuaaaaauacaauaaauuagucggggccgggcacaguggcucacgccugcaaucccagcacuuugggaggccgaggcggguggaucacgaggucaggagaucgagaccacggugaaacccugucucuacuaaaaauacaaaaaauuaaucgggcgugguggugggcgccuguagucccagcuacucaggaggcugaggcaggagaauggugugaacccgggaggcggagcuugcagugagcugagauugcgccacugcacuccagccugggcaauagagugagacuccgucucaaaaaaaaaaaaaaaaaaaaagaggugaaauuaauuuuaauuauguuuuauuuaaccagauauauccaaaauacugucauuacaccaugcaaaaaaguuaugacgugcgcauuuuacguuacagcacauuucagcucagacgagccacuuucccacugcuuaguagccuggugguguggccgcugcccgcaguccugguggcagcccuggggugccacaggugguggugaguuuccuccgucccucccuugggccuuggguuggaagguuccuggagugcugcuucucugggacuuguuacuccuguuuguguccccacuccuccuuggcccuuggugucuauugccaacuuuugaaguuucuuucuuugacuaucacaucuuugauggcuucuuuugguguguuagaaguucucuucugggcucugauccccacucccugcccagaggcagaguuuaggggcagaagggaggaagguccuugccagggccucaggccuguccuguggggagccggugagggccguggugggcaggcuggcguaucccccucuaaacuggacgugcaauguuccaguauuauguaauugcacccuagcuuuuuucccuggguucuagccuguuaccugaucuuuuccucugauuucucuuucccuugccacacagaaggacuauaguccaaggccuauguucucuuccugacacaaaugugcagggugacccaggaaggugacuuaugucucccaccuguaaagcgggugccugccuucucuuugcagaguagugugcugauggaauggggaguuccugagccccccauguggugagggauguuccaggaagcacgcuggcugccgccucugggggaaguagccuuucuuugggcaaccucauguucuuuagcagaaauaaagaaauuuaacucagaauguuuaaauuguucccaagcugccacuuagucuugaaagagggagagaguguggcagcgaggcacaggggaagacauccuacuacuggacauggaggaucauugggugcuaauuuggaagcaucugaccuaagaaaacgggcucuucucuuauccugggaaacucauuccccaagccacucuuucucagcugaaugacaccguuggaccagguggaugguuuucaagcuuucaucaaaagcagugcagcucugggcaaggcagccaaagccuggagcuuggccucccauccuggggcgggguggcgggggagggccuugggucaucucuggggccauuuggggcagguucgaaaacucugcccuagauuuugugcuuuuuccaguuuuagcaauugaggcagucuuacagcugcucuggaauggagcccccaugcccuacccagagcucucaaggcauugucacuuccguugggggcaagagcaccuaggggguugauucacugacauuuugucucuggaagcuggaacugaaaucuuccaaaccacucacugguuuucucagucagggucauccuaguucacaugaaaccacagccugguuuuugccuggagccuguaacccuucuggcuccuuccccuugggcgcagcuuggcgguugcaugcugugccagagguggcccuggugucagagcugcuuugcagcgagacucugaguggaugggccugccggauccuuugaaccucuaccuacuauauugugucauagcccgugauuucacacagaccucagcaggcaaggguggccagcagggcugguggcagcaaggccucccucggaggaggggacccugaguuuucagagugguugagcggccugcccaaggucacugagcugcucagcaauggggccgugauacagauuucagcuccaugaggcucccgugccagaguccacccuggcuccagacuccacccuggcuccagacucauccucccuguccuugggaaggccacuuugcuuuguaaacuccuuaguguuuuuguuuggccccggggcagauggguaguagggagauugguauauugcagugcugcagaauaaaucacagcuguuuccuggacuucuaguuccuagcccugggaagagggaccugcuggggcugucugcaccugcccucccugccuuucccccacauuaugcaggugagggauugucuucaauuagcagauggagccgccgagaccuggagagguucagcagagguucagcgaccugccuaggucacaggaaguccagcacgauuuuuuccaaaguccuguuuggccaccuugucucuaauaaguguuaaccuuugcuaucaggaacagggccuugccccaacuuggacuccuuaguucuugagugugugguggggcgugugugugaacggugcaggcuguugugcagggcaucgcccagaucuucaccucuccucagccucggggugccccacauccccaacaugggcuacuggccuaggcagcagccacaccuuuggcacagcucugaacaggaagcacaauuuuuuccucugaaagaggaauucagaaucaggaaauagcuuuguccuugaucucuguagguucugaggcacuggauuuaacagacccacaagcaaccguggcgcacuuuccacacaagguuucugaccuccucgugguccuucccauagauaaaggggccaagggaagggggagcagcugcagggagccccagcugagccagagaaaggggccaugucuccugggucuccugaugccauacccagagccucacuaucaggacugggugagccacuugaggcucaggagccucagggccgcgggaggggugggucagggcauuugcauggcuucugcuuggggaccugcucugaccuagaaaucugacacagucccacuuuucauuucagugcgcccaggcaagggaauuggaaugguggcgagcccagauuugaguuuccauucuagcuccauuuuccaugcuaauggagcaaguuacuuagagcugaagcaucuaugccccucaucugaaaacugggggguuauaauaauaguacccauggcuuuggguccugaugaggaugcaggaagaugcuuccaaaguccucagcaaccgcaggaucuguggcaagggcagaguuuguaaauacuggguuauauggugggugcuuaguaaaugggguccguuuuaucagcaauaaaccauguaguauggagcugugugugggacacggaucuugcccuugggaagcucucacuuagcaugcuggcccaucugcucuugaauguccaccaugggccaggccaugggcgagauggggcaggggcagugcggggagcaccagguccccaucccucuuagguuacugcagagaaaacagcccagggaggggaccuuccacugugauuuugugggcaagcuggcccucaaaccuguuucugucugucccaugcccauuaaacagaagcucaggcccaugcccauuaaacagaugcucaggcugucuccucucccacugagcugcucugcaccacccuagcagcuuucuuaugucagccccuugaggacuggaaggaaguagucaguuugccuuguguguguuugauuuuucagaauguguaaguacaguaaguccucaccgucauugaugggcucuuggaaacugcuacuguaagcauaacaacacacaaccaaaccaauuuuaucauaagcuaauugauauaaacaggauuuaaguuucuacggcauauuucagguuauaaaaauuaaccaaacuucuaaauaaagauccaaaguauuucuaauauuaaacauggaaauacaugugagcuauuauauacauuucaggaagaugaauaaaaacaaguaagaucauuaucuauacaaguuuuggugagugaugacagugagugaugacagucauggugguagguuaaaucaaggaauaaaugucugcaaagugaaaauuguaaggcauaccuccuaccaccaggaaguucaaaaacaaggacaaaagcggugggcuggcugagugcuucuuacugcauaguuuauugucauguguuugugugauuaucguagacuugaugacuuuuuaguaggcaguuaccuguauucauucaugcguuuuccagcuugcuuauuccaguucaaugucaccgguagcuggagccucucccagggcacaaagccuggacaggacgccguuccaucacaggacacacuugcacccacaccugcucagacugggaccacuuagauguccaguucacugaaugugcacaucucugagaugugaaagaaagcagaguacagagaaaacccacggagucgugagagcacacaaacuccacacaggcagugggugcaggaauucuuuuuuuuuuuuccucaacauuguuauaacaaaucaauguugaaugaaauggcauuauuugaggaccugcuguguaaggacugaacugauuuuaagaauuuuuaggucaggugcugcggcucacaccuguuaucccggaacuuugggaggccaaggugggcagauugcuugagcccaggaguucgagaucagccugggcaagacagggaaacccugucucuacaaaaaaguaaaaaacauagccaagcuugguggcacaugccuguggucccagcuacuugggaggcugagguagaaggauugccugaggcaggagguggagguugcagugugcugagaucacgccacugcacuccaaccuggguaauagaacgagacccuguaucaaaaaaaaaaaaaaauuucuuuuuuuuuuagaggguaggaagugaaggggccaggcuucaucagcuuaggauuuaauguuagaggccacuucugugccccugucaagcccagagaagucaugcaggucccaugaagggcagagcagaucccaauuuuaggaauuucuuugauggguguaugaguugccaugggcagugugggagaagauuaagagaagccaugcuuaucccacucguauccauggagcaacugccuugcaguugucugggaaggaaaauccuugugccgggccugguugaaaugcccaaggaagguagagaggaucccagagcuggggagccgggucuagucccaaaucacugggugggugggagaucuggccaggacguuucguggcccccuggucaccaguguugaguggguccccucagcuggcaggcagguccuuccagccucucuguccacccuacccccagccuuuacaagucauucacccuugcagggaaaggcaccucugcugaggggacccuucuaugagaucuaaacaggaggagucucuucuuuugagccugagaacgagcucuucuaauaggcagaugucaccucggcagacagcccacuacuucucaauuccacaucucccuucccgccuggaaaccccgugagccugggagcuuaggaguccucuuccuagggggcccggccagcuagcaccuggccuucuaugguguggagguuuuccuauacggaaauugcugaaggguggccugcccuggcauuguuuuguggcgcuguuggugguauucauagcugacaggaauugccaugugccaggccacuauuagcucauuuauauuuccagcagucucagaaggcggaguuaagagaaggguagagagagguaguauaauaugccuagagcagcuccucugguggcaaagccgggaggaaacccagcugugggacuccaggccuucccugucuccacaugacucgagaggacugagcuuggccuugagaccaucaaugucuggcuguguguggcccccuuggccccuaguguccaggagcggggcugaccaccuuggcaugugcggggaaggguggggcugaccucauuuagcuuuccugcccuuuuuuugcuccuccuuccaccgugcuucuguccuaccuguuucugaaugggaaggacggcuuuuugaggaacagggugugacucuucccugcgaagacguugccccagaaauuuguccccacgcauucuccagcccucuucccuuugccaugaauggcgucauguuccaaaaauccuguggccacgggcuguuugucaagaccaaacagggaagaggcuuuuaaaaugucacuuucccccuccagcuugaauacaguggggagcaggggcaggggccggggcugggcuugcaggaccugugugugggcagagggaggccaggagcccagugggaguuggggguaguuuacagccagccagcagcugugggcccugcuguccccgugcuaugauggggugaacugugugugugguuccuugguuuugagggguuuuuuuuuugaggugaaauucacgcaacauaaaauuaaccauuuuagcauguacaauuccauugcauuuagccuacaguauuguacaacugccaccccucuucaguugaaaacauuuccauugcuccaaaagaaccccccaccuuaacuauuaagcagucacccccgccuuuaguccccagcaacuacaaaucugcuuugugccucaauggauuuaccuauucuggaaauuucaucaaaacagaaucauaccauaccauaugugaccuuuugucuguggugucuugcacuuggccuaaugcuuucaagguucauccaccuugcagcacaggucagaauucauuccuuguauggaugguagacagugggauugcuucacccuuuuggccguuguggauagugcugcugugaacacaggugugcgggcauuugucugaacaccuccuuucagcggaccccaggagaggacuugcuggccuguggccauucugucagugagcuguuuggcaucagcaccuggagccacaugucagcccugcagacugcugggugggagggcuaugggugggucccaaauaaggccugcccagagccuggggcucuucacagaggagucugggauggaaacuggguuccuggaccaucccucaagagucgcacacaugaaaugccgccaugaggcagugucacggggcggugcagggguggcucagcugcucggagguacacgccuucuuucuucccuuuuugucugaccugaagaucaucugacugccaagaaagaggcaaguuaauccuuaaacauuguuggaaggagggcuguggggcaugggagcugaaggcuggagaccccagggagacgcggugccuucccagugcuaggugcugggagcugcuggcagagggcccacagagccccacagugguccccagaggaccuuggggucagcuagagggaaaaggccuuugcuacgcuguucaucacuguuaccaguuuucaaccuuuauuucuuuggcagcaaaacacccacccccuugaaaugaaacguggagcucacauauaugaugcacgaauguucucauguugaaggacaggaagaggaauggcaucagcuaugagaccacccugacccccacccgcugccccauccuacacccgagguggccccugaagcaugaccuccagggaucuucacaguuugaagagccgcugauauacucuaauacuugcaguaauauuuuuuaauagaaugcaauauuggauguacacaaaaggauacaagcagcauacauuuacaauauaaaucuaaauaauaaaaaugaaugcucgugaaccugccacccaacuuaagaaagagaacacugacauccauucaaagcauccuucacgccccuccccagugguaucccuuucacagaggugaccugagaugauuuaggggugggagccgaggcccagauggguagcucaggcauugcccuucacaccagugcuggucgagcuguucuagggaacacggacagaagcacauuccaguggaguccccugcuuuucugacuccucuccacaggcucagggacguuaguccuguggcacaguaaaggugcuuauguuugugguccuucaagccccucuuugcaagcagggaccuggggagaggauucuaggggccagggggagcagggacccagggaggggaucuaagacuauggggaauggggacccagggaggagagcuccaggacuauuaggaguagggaccccgggaggggagcuccagggccguggggaauggggaccuggggaggagagcucuaggacuguuaggaguggggacccggggaguggagcuccagggccguggggaguggggacccggggaggagagccccaggggccauggagaguggggacccagggaggagagcuccagggacuguggggaguggggacccagggagggcuccagguccauugagaaacagguguugccucugucacagccccuccuccuggccuccucaccaaggcagagguccgcauuguugagagaaagguuuuccugucugccugugccuuggagucuguuucauuuccagauggaccauauguaacacagccaccaggagcaagucugggguuagaugucgccuuuuaaggcagugcuguuggauagaaaggacucuugaguagaaaccaggagauagacuuaaaggcaaguuuguguuugggcacauggcaacugagaagugggaucagcagggcugcuccccaagcaaaggugcagaagggguggggacgugcuaggggaguggguggcuaggucagcaguucucaaacuuuuuggguuccagaccccuuuaugcucuugauuauugaggcccucagaacgcuuuaguuuaccuggguuauguccauugguauuucuuguauuagaaguuaaaacugaaaaaguuuauucaugaauucacuuaaaaguaacaauaagccuauuauguagucacguaacauauauucugaaaaauaacuuuucuaagacaaaaauuugcugaaaagccucacauuuuuaacucuuugcagagcucuuuacggucugccauaaugaaagacagcuggguucucagagcuucuacagucuguggccauagcauguccuguguagccuuugggcagcucuacuguacacucaugaaagagugagagaggaggcaaaggauguuuuaguauuuuuauuaaaaugguuuugacucagggaccccaaaaagggccucagggacucccaccuuugcagaccacuggucgagcuuaaguugggccaugggcuugaggagcaugccggccucuauaggaggggcagugcaguucacuguuccaggcugcgccgcugccuuggggccugcucggcuguggcugugucagcuucccacagacgguguccccugacuuccauuucugaagucugucauuugcccccucccagggaagucucccacacuccuccccuuugcucccuggcauggugcugaguuccuuucccuuugcaccaccuuucgugucuucgucuccuuguugguauucccagaggcuuugcgaacuuugcaucaguggccuugcagaggcugguagacaucaggggcaucccugaccugccuccauagagagcagcagaauguggggauggggaguggcccaguugggaggugagccaauugcagucugcagggucccgggugggcauggcuguucugaguucugggaccagcaguccuggcauaauuagcagaaucccuuuuccuuccccaaguacucccaauuaagacaauaaauuacguugagcaccuuacugaugaggcucugaaguagguggcuuauuggcccagcuuuuccugggguggguggaggugguagccugcacccagccuugaugucuuugcacagguaggaaagaguccuucuggaggacagcccccaaucuccgccagcuuccugaccuccugcgcagauggccaggcugggugugugcugcaggaggguggucuguggcuggcucaucuggaaguaaaggcuguagggcucuuccuuccaugugugccucaugggcaaugugcuuuggggccccaccgggucccuaagcccccacuugcagccucccagggccguggccccagcugcauggauguggggcagaacugagugcugugcuggugaggaccagaccccuaccccugggagcacaucucacuugggaacaugcccuucaccugugucacccuuuaccuucuggaauggccugcuaaacuggggaggagugucccaugggccagggccaguguggaaccagguggccuuggugccuguuuugcuuccacugcuuccuggcucuauuuacuuggacagaccacugagucucugugugccucgguuuccugggguauaaaauggaggucaugagagcucauaugcccuaagcccuggggucagcuccacugccagcggggaggagugcagaccugcccucgugcucccauagcugggauguauguccucccugcagaaugcauuccuggcagcuggugagcagguguucucccucggaggcuuggcuuccucccgggacagggcucuggguccugaugauguugaaacacuugcgggggcuguagcuccaucuuuaguaucugcacaguggcuggcuguuuguggaagccuauauugaggaagguaguuuggguccacaacuguguggcuguagagcaauagaacaguauucuccaggacucaaggccccauggacaacuuuuaguaguucuagcacaguuuggucaacacaggacaagccuguggccucuugaggggucugcaguggugaccaguguucgucggcccuggcaggcuuguucugaaagagaagcccccauucugagcauggucagaggugugugcugagaacccacugugggugaggcaggugggcacagcuccgccaagaagcuucccuccccaagugcugagauucagagccacugauccucuugcaguccaucuggguggccacaggacacacaaggucuuggcaggggugaggcuugagacuggacuuugcugugugcucaccccugacuuuuacugacuuacaucagaaugucccagaaaagacggacaaccuugaagucucccaugauuuacaagcuuagaaagagggccagacggcugcuacccagguauccuuucucuuuggaauugaaaugcagagaacauuauuaaacagccuauuugcugugaguguggaaguguuuccacagacaccuuuuugggaaaaagaaaagggcaagaaucaaccugaaaacuacagaggauauauuagccacgguuugcacgcauucugcuuauggaucuuucagugacuccagugaggggccaucugucccauccagugccugagugcagcccccacccccaccuuugguccagagaagucuuugccccaagaaucugcccagaguuggggcaucagccccuacagguguggguccuucuucaggacuguguggaacuuuuccuuuugaagaacuuuccuggggaugaccacucugcuuggagucugggguggagccuggugugagggagccagcguaggguuugggugccugccccacccucagaagcaggagcccagcagcccuuggacugaccggugcuguucuggggcucccacuggcuccuuccacuguggagcacucccgugaacacugcuuugguuugaguaccaguacaaguguuggguguauguuccugaccuugaggcauucuugauugugcaguuaccuaggguaugcuugugucugacaugaucauuuuuuuuuuuuaauaaaaaauggcauggaaggaguauguguauuuuucuacuguagauuaugaaacugagaaucacagagauacugccuugcccugggccacacaucgaguaggugguggagccaagacuugaauuggccuucucguucccaggccaguguacauuaaauaccuggagcugugagguccuguugguggacaguagaguguagggguucccuaacuacaccuacuucuuguucugccaggaaugaccaagaucuccccuauugaagccacucugccaggguuauaucagaaguccugcgugcucggucaggcaggcaucuuccccucccuuaaauaauaacugguaagugccauguaguggcauuuacauuacaaaaaugguaaaaucaagcaaaagcccccaaaccugcugcugaucuuggcaguccgcauaauagcuguuuucucaucaacucucaaucuuuguccauccuuacauguguuauaaacagaacugaccacgagccccuugggagaugugugugcuucauguuuuuaucugcagggccuugaguggugccagcuucagggcagcugcuggagaaauucuguugcacacuuccagggggugccguucaccagcggacagagcagcggagccaugaaggccugcgcaggacaggccagcugcguugauagugugggcggugcccuggagggcaucuugaauccuuguccucgcugguaauuaauggccagguagcguguuagggaguagauguauagucacucucgaaacuguuucucuguuggguguugagcucuucccacaucaggaaugagacuguuugcuucucucuuugugaguucuucaggcccaggcucuggacaugggcucacuguaucaggaguguggaagcaucguggcucuugcauguggccgugugcugcugucugagugccagcuuuguccacacccugucucuuguccuugguggcauagugcacacaguggcacaacuggagacuuggacucgagaaaggagaaguacaaguuggauucagccaugugcgggggcaggcccuggcuugugucuacuugcgccucagugcugaucgucccucacuccugggugcugaccagcguuguccuagugaccugggagcucaggugugggaggcagaggugcagugcagccuggcuugcccaggucuuggcugggagggccuuccagcagcacucagagcuguuagggagcaguuaccuuuucagcugggugggggugacuaauaaguguaccuguagacuuguguuuauuuauuuggucauuggagcccaacuuuguacugggugcuucacuggaugaggcaggauucuuguccccagcgaggagaugugguguugugagagagaaggaauacauuuggccuggagccgguuaguguucuugaaggaggugugggauuuugaggggucuguguaugagacagugaaucuccuuauuccauggaauagaagauguuuguguaugggaggugagggggcaugggaccauagagggccuucuggguggcaggaugugauggggugagaagagugagacccaccugucugcaucgacuguuugaggccugcccucuuuggugccggauugcgcaauaugucugacuaccuuucuccccacccacugcagucuaaggacaggugaguccaaggggacaggaaaccuggguuaaccaccguuagagaucuugucaccgacuguucccuucucuuggagccacaaacaggccacacggagugagagccaagcauguugugugggcugguugugaugggguggcuguguccagagaccugugcacgucugagacgcaucagugguggcagcuugacaacacuggguauaguaggcugagauguuucucugucccuugccccuggccacccgcuuggggcaguugggcaacccagaguugagacagcuggguucauccuggcaugcaucccagauuugccuggggaggguggugaggggaagggacagaagaacccuugagagaagggauguggguggccuccagggaaguaguuggagaggccagcagagcauacgcggugcagcucagggccauggcaggcaggcgucacugaagaaggcccguggccauacccuguagaccccugaggacugacugcagaggccacaguggcugaguuuuguuuuucgguuuuuuuuguuuuguuuuuuuuuuuuugagauggagucuaucucuguugcccaggcuggggugcaguggcgcaaucucggcucacugcaaccuccgcuuccuggguugaagcgauucuccugccucggcgucccaaguagcugggacuacaggugcgugccacuguuuuuccuuuuuuauuaaacuacuuacguugagauaaucguguuuccccugugguuguaacaaauaacagagaucccauguaccccuuugcccagguccuccgauggugaccuucugcaacacugugguacggcaccacggcugggauacugacuacaaugcagaaagcacccagugucuccaucgccuucucccucccacaucaacccaaccccagccacccaggaauccugcuccauuuccauaaaucugacauuucaagaauguuaugugaagaaaaucauacaaccuggaaccuuugagauuggcuuuuuucaccuagaauucucuggcuauucauccagguuguugcuuggaucaguaguuugcuccuuuuuauugcugacucgcauuccaugguaagaggggacaccuaggcuguuuccaguuuuggucugcuacgaacaaagcugcuauaaccauucacauguaguuuuugugugaguguauguuuucauucccuggaauaaauauccaggagugcaguuccuagguuguagguaguugcauguuuaguuuuuuuaaaaacugccaaacugucucacaccagcaguguaugagugauagauauacuuacuuugugacguugccagcauuugguguugucaccauuuguuuuuuuuagccauuauaaaauaagauguucauaaauagcaugaacaccucuucaugcuauuuaucuucuguagaaagucuucucgugucuuuugcucauauucuaauuggauuguuuuguguuuucacuauugaguuugagggucuuuauauagucuaaauacuaguauauagucuagauauuaguccuuugcaaaaggacauuugcaaaauauuuuauccuacuucguggcuuaucuuuucaucuuccuuaggacuuugugcagagcaaaaguuuuuaauuuuaaugaaguccaguuuauccauuuaaauauguuucauuuugucuuguuuuuuguauaacacuacuuucuguaucagcuugagaugauuuuuuuuuuuuuuuuuuugccuguggacgaagggucacucuagcaccauuuguugaaagacuguauuuccuccauugaauucuuucugcaccuuugucaaaauugggcauauuuguguugguuuauuacuaacuacuguuccauugauccaugugucugacuuuccaccaauaccacacagucuucauuacuguggauauauaauaagucuugugauuggguaaauagauuauacccucuuuuuuuuuuaaauuaaaaauauucuaguucauuugccuuuccauguaaauuuuagaauaaucuuguccauaucuauaaaaagucuugcugggauuuugaugggaauuguguuaaacugaauaucaguugggugagaauagacaucuuagaaucuugcaguccacgaacacauuaugucucucuuauuuagaucuucuuugauuucucucaucaguguuguguaguguucagcauuuccuguacauauugugugguauauacaccuaaguauuucuuuuuuuugaagcaauuuuaagugguauuguauuuuaauuuugauguccacguguccguugcuagcauauagagauacaauugauuuuuguaugcugauccuguauccugaaacuuuguugaacucacuaguucuaggaguuuuuuguagauucugggauuuucuauacagacagcuaugucaucugugaauauuuuauuuugucaguuuugaucuauaugccuuuuauuuccuuuuccugccuuacugcacuagcuagaaauucgcgcacuauguugaauaagaauucugagauggccaucauugccuaguuccugauauuagagggaaagcaaucagcauuuccccauuauguguaaugcuagcuggagguuauuuagagaugcuuuuaugaaauugagcaaguuccccucuauuccuacuuucugagagguuuuuaaaaauaauuaugaauggauguuggauuuugucaaaugcuuuuucugcaucaguugauaggaccauguggcuuuucuucuguagagcauuaauuugguggauuacauugguugauuuuugaauauuaaaccggcaucccuggaauaaacccccuuggucaugguuuauaauucuauaaauauauugcugaauucuauuuacuaauauuuuguugauuuuugcaucuauagcagucccccuuuauuugcaagagauacauuccaacagccccaguggauuccucaaaccacggauaguacugaaccugauugcuuucaguuggaacucauuuuugauuggaaacaaccuagauauccccucaugucaaacccacagauacuuuuuucaucuuuuuuuuuuuuuuuuuuuuuuuuuuuuuuuuuuuuuuuuuuuuuugagacagugucuugcccugcccuguugcccaggccggaguguagugguaaaagcauagcucacugcaaccuugaauuccugggcucaagugauccucaugccucagccucccacguagcugggccucugccagcacuugccaccacaccuagcuauuaauaauuuuuuuuugguagaaacagggucuuguaguucccaggcuggucucaaacuccuggcuucaugccauccuccugcuucagccucccaaaugcuggaauuacaggugugagccaccacacccagccauaaauacuuuuucuaucuuaccugggcacuucaucacgcacaagggcuguaacauuugcaguucgaggugugauagaaaaauuagcaugaauuucuuuuucuuucucaauuucagcgauagaagauuuauucuuacuguacaucuuagcaaccucagcauaugauuuuuuuucuuaaauugaaaacuuuuaccauuucccuuaaaggaagcacuuuauggcuucucuuuggcauauucaaauugcugucaucacuacucuugugcuuuggggccauuauguauaauacuagcuggaugcacaagcacugcaacaccaccacaguccaucugauaacugacagcuacuaagugacuaaggggcagguagaguauacagcguggaugcgcuggacaaaggggaggcuccacauccugggaagauggagcaggacgaugcaagauuucaucacacuacucagaauggcaugcaguuuaaaaccuguaaauuauuucaggaauuuuccauuuaauauuuuaaggcugugguugaccguggguaagggaaaccguggaacuguggauggaggaggggggaacuacuguguauuaaugaggaauauuaguccauaguucuuuauuucauuuuuaaaaaauuuugggguuuugucauguaauuuguuugguuuuggugucaggguaacaccagcuucauaaaaugaauuggaaaguguuucuucuucuucuucuucuuccuuuuuuuuuuuuuuuuuuuuuuuuaacaauuauauagaauuagugucaguuccuuaaacacuuguuagaaaucuccaguaaaaccaucugggcuuggagauuucuuuuuugugaguuauggaauuacauauucaauuuccuuaauaguuauauaaucauuuaaauuauguguuuuuuagagaaguggguccauuuccuauauguugucaaauuaguguugguagaauuguauuaguauuccucauuaucccuuugaugucugcagaaucugugaugcuaucccuguuuuauuucugauaacaauuugugccauuaugucuuuuuuuuucuuuuuuggucuugucagcaguguuuuuuuguuuuguuuuuuguuuuuugagaugaaguuucgcucuuguugcccaggcuggaaugcaguggagcgaucucggcucacugcaaccucugccucccagguucaagcgauucugcugccucagccuccagaguagcugggauuacaggcaugcuccacuacgcccggcuaauuuuauauuuuuaguagagacgggguuucuucauguuggucaggcuggucucgaacuccugaccucaggugaucugcccaccucggccucccaaagugcuggaauuacaggcaugaaccaccgcgccuggcugaaguugaucaguuuuaucagucuguucaaagaaccagcucuuuguuucacugauuuuuucauugauuucuaccuuuaucuuuuuuuuuuuuucuuuuugagacgaagucucacucuguugcccaugcuggagugcaguguuacagucuuggcucacugcaaccuccgccucccgguuucaggcaauucuccugccucagccuccugaguagcugggacuacaggugugugccaccacacccagcuaauuuuuguauuuuuaguagagaugggguuucacuguguuggccaggcuggucucaaacuccugaccuugugaucugcuugccucggucuguaaucccauagugcugggauuacaggugugagccacugcgcccagcccgauuucuacuuuuaucuuuuauuauuuccuucuuuuucuugcuuuugauauauuuuguacuuauuuuucuagguucuugagauagaagcuuagauuauuuauuugagaccuuuccucuuuucuaaugugagcaucauaguuacguuaguucccuccuaggacugcuuuaauuguguuauugagagggauguugaagucuccaacaauauuuguggauuuauuuauuuuuccuuuuaguucuauuaguuuuaacuucacauaauuuugcagcucugauguuuaaaggugcaugaacauuuaggcucacuaugucucagugaauugacccuuuuaucauuauauaauauuccucuuugucucuggucauuuucuuugugcugaaauauaauuuaucugauaacauaacaacucugcucuccuuagauuaauauuuucaggauguaucacuuuuaguuuuuucuuuucaaccugccugucaucauuauauuugcagugaauuuuuuguagacaguguacaguugaauuauuuuaaaaaucuacucuaucaaucuuuuaauugguguauuuagaucauuuacauuuaaaauauuuacggauaacuuagggcauaguuaaugcgucucugguuauuauuucuguuuuguuuugcuuuuuuuuuuuuccugcuuccuuuggguuacuugaacauuuucuuuagaauuguauuuugauuuauauaucaaaauauaguuuuuuaaguguaucucuuuguauauauuuuuuacugguuauaauaagacgugacuuuauauagacauaacuugucacagucucuugguggugucauuuuaccaguucaagagaguaccugucuguucacuccuuuaccuuuuccuuguauaauugucuuaaguguuuacuucacauacguuuagaaccacauuagacaguuuuugcuuuagucacgaaacagaaaacucaagagaaggaaagccuaauuauuuacccccucccucccuuuauuuuacuguguucuuucuuccuuucagauguuccaggauuccuucuucuaugauuuccuuuuuguuuagaaaacuuccuuuggccauuuugcuagggguaagucagcaaaaaacuucucuuaguuuuccuucaucugagaaggucuggauuucccuuucauuccugaaggauauuuuuacugguuauaggauucuagguugacagguguuuucuuucagcaccagaaaaguagugugccacuuccuucuggucuccaugguuccugauaagaaaucuauugucauucugcuuaguuuucucaaaacuauaaggucuuauuuuucucuggcugcuuuugagauuuuuuuucucuggcuuucuuugucuuuuagguuuuucuuuaguuuaguuauuguaugucuuggucuggauuucuuuggguuuauccuuugauguucacuaaacuucuugaauguguagguugccacuuuugccaaauuugggagguuucuagccauucuuugagcccuuuuuccgcuucacccuuccuccuauccugcagagacucugaugacaugaauguuagacuucuuguuacaguuccacaguucccuuuuauuuauucauuuuuuccugucuguuuuuccucuguuauuagaugggaugauuucuguuguucuguguuccaguucacugauucuuucauugcccccaauccuucugcucuuaagcccacccgggagcuuuuauuucaguuaccguauuuuucaauuucaggauuuuuguuugguucuuacagcuucuauuucuuugcugucuuucccuuuaauucaagugugcucauaauuucuuguugaagcauuuuaucaugggugcuuuaaaaucuuuaaaugugggauaauucuagcauggcugucaucuugguguuggcauuucuugguugucuuuguucauucaguuugugaccuuccugguucuugguaugaugaugauuuuugguggaaaccaaguguuuuuguauucuguugggugacucugggucucauuugaaccuucucuuucaguggauuuuucugacagugcuuccgugggggaagggagucaccaugaccaccugguuacuuagauggagacagaaguccaucccucggccuccacugaugccugaacugggaggcuccucaucauggguucccuucccacugggcaaugguaaaaacccugacccuccucugggcgcccucugacacacccuagcauggagcaagaaggguccucguugcuguuggugggauguaaggcccuugugucuucugacaccacccuggccgggguguggggcaccucacaaggguggaaguccaaccuuugcucacuuggggguggggugcugccuuuccugugacuuuuggccagaguaaggcgguucuugucuaagaguuuucugucuuguugggcugcuccuuucugguucuucagcuauggaaaguagcuuuuuguuguuguuuuuuuugguugugugcccauuggcguuuucagguugccaguuucuccaguacccacucugggauagugagacaaaaagaaagccugggagagucaccacgguguccuuccuuggauccugggucccuggcccacuuaccuuuuuuucuccaccuuucagagucuucucauguuugucuuauacaugauggccccagguuuuugguuguacuuagcaggagaaaucuacaucugccccaucguccaggaagcagaaguuucaaggcacuguuuuugaaagagcuucagguugaaggcacacccagaccaccagcagccucuuccuagaggccagccagaaguggagccuccgacuugugugggucaugagugaaggccgaguuuaauuggagaggagguagcucgggggagucucucauguggucacuuuuauaugggauccggagccacaugcauccucugggaggaccugcauagaaaggggcccugugugcagggcugcuugaaacaggacucgggccccauccuuuggguccuuacagcccagcucagaucccccaugucaacaacagauaccugcuucuccugccucccuccaaaaugcccagcagcucaaccagaaaacagcaaagcuaagccuacccacgcagcauuuccagagcacacucccuccugccugcugccuuuugggcugucuguuuuagugucccaguuucagauuauuauaggaccgucuggaagagaauacuuuagggccuuuuagaggugcugccccaggaccaggugggcgugcgugggagccucugcccgugggcauugcugcacuuaaagacacuguggucugcugugcgggggaggaugcagcaguuuuagauagucugagacauagagaagcagcagcucuuccugggaggccuuucccacgccuuggggaugaggacagguugucugagucaggaccuagguuauguaaggagaagguaacucagagagggcaccacccacccacugcuggccuaggccggugggcacucaccuccacucccucugcacaccugccucaggaucaaggacacagccagggcuaggcagaccccaucccugccuuccuggagcgaagguucugggguggggguggggggcaagacaugucauagcaauguaauuacguacauaaugaaaugguagguagaaauuaguucugugaugugcagugacgguaauggcagaagugaguuguuagagacugagggggagggucaggacuguccccuugaggaagggacauuucggggaagcccugagggaugguagagagggccagguuuuggggagcugaggaggcugggggaggcugcgcagcccacguggcuggcugugagaggcaagagugguggugauauagcuggccaguuccugucccuggcucccuggacuugaggagugaguucucaguaauuacagauggcuccucauggccccauggcgccaucauuccugccucugcaccugugcaucagcugcgccccugcccagagaguccucuccaccccaggccucccccuguuaucuaugggguccuuaccuucagggcuuuuuuuuaauagcuuuauuaagauaaaauucacacgucauacguuuaacccauuuaaaugauacaauucuaugauuuuuaggauauuccaacugaugugcagccaucaucacagucacuuuuagaacauuacaucaucgccaaaagaaacccugcaccucuuggcugucaccaaccccuuccgccgucccagccccaggcagccacuccucugcucucuaucacucuggaauugcuuugaugaacgcuggguggggugucaccugcaucccagccugcuccuccacccagaggcccuacaucucgcucucugcucugugucugcgccgcccgcccaccugcaucaguccccucuguggugauccauaucaggaagucacagccaagcaaaguggcugcugcaggcucccugguauacagcacccagggccaugcacacgggguuccugagcagagguuugcugacgaugccuggguugagaccagggcucggguucugagggaacagaugcugaucccuuggcuccccacaguuccuccuggagaaaggucagguaaauguagcugauuaugugaugacaccccaagcccugccuccagaggccagggugguggcgcauagucaagauggagauagaggaauggcuuggcaggcuagccucuggccucacaggugggcacuuguggccggugagaggccgagcugggagucacagaguccagauacacacagggaguuguccagcuccggcuuucccaugcaaggccucuggguggggucugcuuaggaugugcacuccugggugggguguggagaggccgagcgugugugcccaccuugagguuugcugggcacagcuggaguucguagagagcacagaccucuccucgccuuugcuucugccuucccaggugggauuuccaccacauacuccuuggcccuccuggacuaugucugcagccaacacccacuccccuguugcagcaaagcaagccucuccuguccuugcagcuuucccccgaccccaggcacacagcuccacuugcaccauucauggggaaagccagugcuccuggggaccuugaggacccugcaggcggaagccaaguaaagggggguucuugguucagccuggaggcuguguggccucuggcacguggccugcccucucugagucacggucugcagcuaccaaaugagguagugugguggggccuccuaguuuggagagcacugaauaaaaagcacaucaggaggacccaugagggguccuguguguguaagcagcagucagagaacuuggguuuuaauuuguguuaccgcccuccgaaaggcacuggauaaaugggacugguuguaccuuuuccaaugcauucucgccagcuggguguggcugaggaaggagauugagccagagugucugucuagauuccccuuguugagcuccucccguggucuggggaguggggacucuguggcugguaaaauauagcagugccucacauuuguugagaccucacaggccagacacugugcucaguguucuuugugcagcuuuuuaaguugagcuauaauucacauaucuuaagauucacucucuuaaaguauacaguuuggugaguuuuagcauauuuacaauguugugcaaccaucuccacugucuaauucuagaauauuuuagucacccacgaaagaaaccccauaccuguuagcugucucuccuuauuuccuuuccuccagucccuggcgaccacuaaucugcuuucugugcuguggauuugccuauucuggaccauuugcauaaguggaauucuguaauaugugggcuuuugugccuggcuucuuugacuuagcaucauguuuucgggguuccucgguguugugguguauguuagugcuucauuccuuuuucuggcugaauaauguucccuuguguggacccaucacacuuuguucaucuauucaucuguccauggauauuugggcuguuaccaccuuuuggcaggugugaauaauacugcuaugaacauucaugugcagguauuuauuugagccccuguuuuccguuuucuuggguguguauacauaggggugaaauugcugggcccuaggguaacucugccuuuaacuuucugaggaacugccagacuuuuccaagguggcagcaccguuuuacaucccugugcuggguuuuacugauugcauuaucucaucaguccucacaucagagucaugagguuuagguagaauugucaucacucucacuuuucaaaugggagaguuugaacucaaagaguuucugcacgcagucacacagccagucaguugaugauucuuuggccagagcuggcuuugaucacgaaagcagucucuucuccaggcccuguuuuguaucuucaggaugaagcuuuuugacuguguuguucauguccuauuuccuggcgccuggcacacacugacacucacauauuuguugaauaacaugucauuuuuuccugaucuugguggcuugaucaguaacuugcaggagacagcaugucuuaggggauccuguacucuccagguucucacacuccugccagggccuguaugcucuccaccccggaugcugcagaauccccgccagccucugacucucaagcagcugcagacgcaccgcaguggaaauaggugucaugaccucugcagagcagaggcaacaucuguuuccagcgagugcuugcuguuaacuugaccuguucucucuucuggguugaaggcugcuggugaccugcccucuuuuuucuccucuaggcaaaacccauuuauggcgguuggcugcuccuggcuccagaugggaccgacuuugacaacccagugcaccggucucggguaagggcaucagagccaacucucagggaggaaccagagaagggacccaucuaagggugaacuggcagaguggaagagggagauggagaguugaacaguggauccugggauagcaggaccagcagggcucccccauuuggugcacuuguacguuguacagaaaaggucucaauuauacauaguuguguguagugcucccuucagaaugaggagcucucauguggguguugccuguuuugugggucagguugacucuaggaacaguaaaauggaagaggcaaaagagcaguuaaagguuugcauuauaccgagcagcucccaauuccuuccaugccaaggccugccccuguagcaccucccuucuuccugagccagggguucagcacacuagcacuagugaaggguugggggcccagaggccuuggcuuaccucuuacuaaaaugugcauugcccagggcagggccccgcuagagcugggaccaucauuggccugaccugugguuuguuucucugccaggaagccccucuggauuugacuccgguuacaaaacucuccuuccucacaaacuuucuuacagugcugccgcuugcacccuauaaauugcuuccacucagcccccuccauccccgggagcucccuuuccucuucuucuuaguuucugcugcucauccuuuccccacccugaauauuacacuuuggaguaggggccuugggcuguguauucuggucccacaggccuugcauugugucucuguucuuugggauugcuucuagaauggguuuugauuucagaggcugcacauaaggcccuuggaaauguuccugggaaacauguucagguggccuccucuacacacccagcauagaccagcccucuacaaggccucuuugcaaggcccuuugagucccuguucaugccacccagacaggagaacucaggcaucacugguccagcugggcugcaguuuccagggaguaguucccuuuccuauuuuauaucaagguuguacaaaauugccauuuccagccucugacaggagucuuuuuauaaaugauaacccuggcccaaagcagagagaugugcuuuuauagucaguucacguggccucacugccaguuaaacucugaguauuguugggcucuuugcuuuuuuuuuuuuuuuuuuuuuuugaaacagagucuugcucugucacccaggcuggagugcaguggcaugaucucgauucagugcagucuugaccucccagguucaugugauccucuuaccucagccuccugaguagcuggggcuacaggcgugcaucaccaugccuagcuaauuuuuguauuuuuuguagagacgggguuucaccaugcugcccaggcuggauugggcuuguugaaauguugaaaauaggucauggacccuugugaugauuuggggcugggagcugugccugucauucaugaccugggccagcagacucgcauuauggacaagucccuucuccccacacaaaggaagacauacaccgcauaguccauuucauuucagcuccugauggcaucugaccgccguggacacuucccaguggucuggcuuuuggagggagaguagagcgggggaugaucugugccaguuggucacuccuuggauauuggaguuauuuccacuggucuugcugcuccucuguuuugauuuucauuaacucauuucaccucagugaauucuggagccuggcuguuuuugugccuccucuuugccaguggaucaucagaacaaccccuuuuguagcaguuucccagguuuuuucagaaguggugaauccaugccuuggcauuccuggauuauuccaugucaugucagaucauucaucaaauaaauauugacacaugucaugugaugcauucuaugcugagcaccaucaggaauacaaaaagguaaccacacguuguuucugcuccugaggagcuuccaaguguuaaaaaaaaaaaaaaaaaaagacuucuuauuaagccucaaucacucaugugauuugggccugucucccagcccaguccuggcugaugaaucaacauucuugugccucgggucccucuuuuccugccaccugccccagaaguggaaucuguggagugaccuuccuuagauauggacuugucagacgugggaacuccagaagccaagcucuggggccaggacccagauccuccuaaccacccaccuugugcuccguugcagaaauggcagcgacgguucuucauccuuuacgagcacggccucuugcgcuacgcccuggaugagaugguaaguguuauccuugcccacucccuguccccagccuucaccaagucccuccauuacagugcccuugcguugucaugugagagcacagcagccaugugcuccugcuugugucuguuugggaguguggaauguuuugaagaacuuguggcaccugcuggagacagcuuuaaaaacccagaccuuugguuugaaacaucaucuucuguggucuugagugagaggaagaagugagggaggaagucauuucuguugaaggcuaauaguguggacuucacuggagcacuccugguuaggggaaagcaagggcaaaguccuggaucacgugugcaggcuguggaccugugggcguggggcaggggcuggcccuggggcuggcacaugugcucacgcaccuaguccugggguugccugucaauucugcgacuguaauugguuuugcuugucucauuugagcuuggcuuaguuuuccgagcugacuucagaggccuccuggucacaaggucaucguucuucuggucacuaaaccaggcagacaggcuucuuccuccuccccaccucccugguuuuccaguugcuuccugggcuggaugaguguuugcugcuguugccccagaggccaaaccugaaaaucaacuagguggaauuucuggcuuuucuuuuuccacccauuuuaucuccugacuuuuucucuaaaggagauuagucucuccuaauuaaucuaaaguaggacugcauuccaaacuuuguaaaggguugaagaugcgagauuugaucgccuuuuccaguuccacuuggugggugaauguuugugugcccauaugugcagcauuuuaaaauugggacuguccuggaaagccuagucucacuauguaaaauaggcagccccugccuauccuacccagaguuuguuucuuugcugcaggggcgagacagacucuggaaguaugaguggagauaacugucccuagagguaccuuccagacugcggcaggggguggcgggggugccugggauuuuuggguggucauuacagcucacaugugcaaaggucagaagugggcguguuuguacucgaguccuaaccuuugugaugugauauguuuucuacuuuuguuucuggggugaauuaagaggaugguaccauaauccuguaucaacugucaccucacugguuccuacuuaaaaagaauugucuuccuuuucauucuuuccggugagcauauuuguacaucaugauuagagcauaggggguuuuugcuaugggaacgucugugcuccaggguaguguacuggaggugagcaccgauuguggacuuggcuggaaguaggagcagggagacaaagcauuuggacacuccguuccuuugaggcaagaaagcagaccuggaggauuagacuucacacuucguguucuccuggcuuagcccuuacacagggaguagcccuggggucagagcugggcuccugcagcugugagguuuaucuugccucccuguggcugacugacuggcugaguccugcaauugacuuaacaguaucagaggagccucaagaggucacuggauuacauucaggcugggcugggucaugaaccaucccaaaaaaacaaaguucccugcacuguuuccuuggggacugauaauuucagucaggaaaucuuucuuuaggucuaacuaaaguccagcaaaauccauuauucccucuggcucaguugcacaagcacaaagaggguagcuucuggggacgccuuggugcuggcacaagugcagagcacaugcugccucccaggcacggcuucuggauaauugaggccgcuuagccaggagcaccgacacuucacagugcacuguggucucccagcaaccuggauaugaguugcguauuauuucauggagugcucaggcagaggugggacugugccagggauguggggaaagaaagaagucccagggaaaacuuggacugagagagggcaugggggcaggcccagagcugggaguuuugggccacgggcugcuuucuggcagaugaccugggagcuggagaaacugacccagugagcccaucaguaaauacugcuuugcccagccgaggcuguggagggguuucccuguuguaucaggaaggucacaggggaagguugcaaggaggcacuuaggguagaagccaggugggaggaggcagaggcuggagagauuucucuagcacccagugcucugcaucaggguuugcuccucagagccacuccccagagugagcagacagccuguagcccaggagcuccagcuuaacggucaaccgcccugagcugagagucccaccccaaacaggcuggcaggauccugagaccuggagcaggaaaacuccauuucagauaggcuuauguguggguaaacuccagccaagcuggaagcuuccuuugugagugccuggaaauagaccagugguccucagcgucaugccucccagggccacuggccaugucuggagucauccuugauugucacaccuggggcaggaaugcugcuggcaucuaguggguggaggccagggaugcuacugaaucuccuucacagaacagcccccagaacaaggaaggcuccagcccaaaaugucaacagugccaaggccaagaaacugagcaguuucgacagggguuuauuuaaauucuuauuuauuuuuaaaaaugaaaauguaaaugugauuugcuauuagcucugcucuuaaacagcacgggacucaccugucagauuuccuggagugagggggaugauggugcagugccagucguagaauggggugggccuguuucugaucuagagaggucuacgggguuccccugcacaccaggcaaccacagggccugcagaacugcuuguguguguguguaccagggagcacauagguggcacucccuacguggugcccucagaccgugauguugcaaagcaaucccuaccugggcauuugucuccaaaagcagcagcucuaagcagcccguggcuaccucugacccucccaggcucauauaauaaacuauagcauuuuauggcuggucugugcccuccacacucaaucagcaucuauuucgaauuguuacugacuuauaugauguuaccauuugauuucauuugcuugaguguuaucuugccaacuagacugacuucuuguuguuguugggcccgugauaauucuuggugugucuccccauugucuagcaugggguuugggcggcacaaaucuagccagguguucuguaaauauguguggaguugaacuaccaacuuuguaaaugccuugcugcguaauuucugcucccagcuugaaaaccuuaagacagggcggguaggaaaagagagaagauaggaaaagggguguuccucggagggagauuagcaauguagugaccuuuagggauuacucagcagaagggagaaaaccucccaagagcuccagauaacugggauggggaaaauucgguuaccucagccccacuggguugggaccuggagaggaagguggacaucaggaggucacagcgugcaggagagggaggaaggcagcagcagucccuggaucuggggacaguggcuucgggaagcccuuucugcucggggacuucugcuggggcuggggcugcuggacuucauccaguuccggaagcugaccauugccucuccaggcagcccugagauggggcuaacuuuggggaaucucuuuuccuuuuuugggaaauuucuuucucgauacacccacguacccuguaacugguggguguggaggagaggcaaauuucccgaaaaaggaaaagaaauuucucaaaugcaggcugaggugaggugggguccgggcagccucacagacaaguaaaagccugagagauuuggcugggccccugguuuuucaggaguggacaaagcaacaaucuagaaacccagauugcugccucuguccucugccuuuguuucuccaccuguaaagugcugcccaugauuuuaccuaauucugucaccaaguuuuuggggacugaugucgagcugagguguggaugucaccagacaucacuagaaggcucuugggaggagcuccaggucuagaaggagagugggagcgccaggaguuuaggguggagcaggccaggccaugaggcuuugggauucucaagggccugcucuccaaggcaaaaagcugaucaaaugcuuuuuccaauuuuuuuuuuuuuuuuuuuuuuuuuuugagacggaguuucgcucuuguugcccaggcuggagugcaauggcgcagucucggcucacagcaaccuccgacucccagguucaaaccauuauccugccucagccuccggaguagcugggauuacaggcaugggccaccaugcccagcuaauuuuguauuuuuaguagagaugggguuucuucaugcuggacaggcuggucuugaacuccagaccucaggugauccgcccgccucggccucccaaagugcugggauuacaggcaugagccaccgugcccggucuguucgaauguuuuuaacugugguaaguacacuggaaauucaccaucuuaaucguuuuuaagugugcaguucaguggcauuaaguacauucacauuguugcacaaccaccaccaccggucucucuccaggacccuuuucaacuugcuaacugaacugugcacccauugaacuauaacucccuuccccagccccuggaaacccccaugcuauucucugucucuaugaauuugacuccuccagcaccucacauaaaugggaucaugcaguguuuguccuuugugacugguguauuucacucagcauaagguccugaaagaucauccugguuggugucagaauuuccucccuccugauugugguaggucugaugaucuuggaccaugucugcugaccccaagccucucacacauggaagccauggagagacugaggccaccuucuguggcaggcauggugcugagggccggccuccaugguguggagcucugcuccauccuagccuggagaguccuugagcaucacgagagaugagagcugccugacuguguaggggcugugcuaaggacucauaaucucagcucacauccucggacauaguagagaaaacacuucuagcucuuggauaugugccuuuuucaggggcaaccugggaguuugucagucccguaagaugugaaguuccagccugagaaauuaauuuggggugccuguguacuuguguauaaaguaaacaggcuugguccaaaggaucuucagagcacuccaggugcagacagguuaggauucugguuuauuuugaguuugcuuccuauaggagaguguccaggagguugccuuguucuugggaccucugcucaccucacucuugacaaauuucugcaauuuuuggugguauuaaagccaugagcagcccaacguugccuaggccugugagagccuaggaggaggggcauuaccgcugagcccugcugucuuuaggaucuaucauuugagguuucucucccuuuucugcagcugaccgcccaguucccauugcucccuaagccauuuuuuugcagauguugcccugcaucagaaucugcagggcgaggcugggaaaccaguuuaaauaaccacuuuguguguuuuuuuguuguuguuuuuguuuuuguuuguuuguuuguuuuugagauggagucucacucugucgccaggcuggagugcaguggcgugaucuuggcucacugcaaccuccgucucccggguucaagugauucuccugcuucagccucccgaguagcuggaacuacaggcccgcgccaccaugcccggcuaauuuuuugcauuuuuaguagaaacgguuucaucguguuagccaggauggucucgaucuccugaccucgugauccgcccgccucggccucccagaguccaugugauuucuaaccacuccauuugagaacugcugcuucaagcucugacuuuguuuccucuagcucggagcuuucccaggcaggcgagaggaaccaucugcuccuccuuggugcugaggcaccucccgggcaucugauucuuugggaaccauaguggcugcuguguccguaacagagcgguugagaggacacuaggccauggaaggccucuucuguggugaagcucauaccuuucaggacccacaugaacauaugcagacuaaaucccuagcagaaccaugauguguaggcucuuaaaggcggugggugguuggggaggcagagaagucuucugggaggagacagguggcacuuggcugccuuuucgcucaucacagagauucgggaggagccaugugcccggccggggcuccuugcuggcacuuucugcccauucucuauccuacuucucacaaugguagauaccauguccauuucacaguugaaaagacugaggcccagagagauugcgagguggcucaacuaaugagugacagaccuugauguguaggcaaggcagacuccugcugagagagggauggugucuuuccuucaccaagugaucuuguccuucacauucagagaggccgcuccaccagcaccugcugccucgugcggguggaaaauagggcuugcuggaggccaggcagggcucucaguguccuuccugacccucugguuugucuguugcugcagacugacccaacuauaguagcugaccugugucuuuauuaaugccauugaaccaagcuagcugcaggccugcaacgcuguaggguccaccugccuucuuugcuacaugggcauaugaauauauauucagagagauuuacagaaaucagaacaauaagaacauagagccuguaacugucugagaggcagagaagcuuccuuaggccuggaggcccuucauguuuaaaggacaggaaggggcaagacagggaaccggggaagauguuuuaugggucagucuuauacuuucagguuuagcuuuaaaucugucauguuucagccuugcccuggccuuugugcugagguccuggucgcaagggaaaggaggcagguccuguuguguggugcguggagcccaaguaccuuagggagggcuuguuggaguggggucaguaacuguggggucacccaggcccucucucccuguguaggcaccucccgggcuauucggaccacaggaagcccuguguucuuuccuccucugcucagcugcucauuucuauuucugugcuguguguuuucagaaucagaucauuuaaaaaaacaacuuuggacucggguguguuuucaucuuuacaugagccccacgagcaagguaugaggggcuguuaaugggggagguagcccccgcaggcccuccccaugcaucgcauucccgcggggucccuaggugcuuucagacuuuugguugagagacuucggucuuuaaguggaauucugcacggagucuuaauacaaguuuuaaaauguauacagucaggugcugcuuuauuugaaguuuuggaauauuucugaccccucccucaucaacaaccccugccccuggcagcugcagaaaagaauacacacugacggcugggugugguggcucacgccuguaaucccagcacuuugggaggccgaggcgagcagaucacgaggucaggagaucgagaccaucuagcuaacacggugaaaccccaucucuacuaaaaauacaaaaaaauuagccaggcaugguggcgggugccuguacucccagcuacucuggaggcugaggcaggagaauggcaugaucccgggaggcagagcuugcagugagcugagaucacgccacugcacuccagccugggcagcagagugagacucugucucaaaacaaaaaggaauacacacugaccagaccggaccaaccuccuucucugcggaauuauccaggugcccagaggcccagaucacagaccuguucaggaaaggcaccucuucuugugcaaucauuugauaauuuuuccaaaugaauaaauuuauuuuuuaaagauuucccaaaguagucaaugucuucaagcucuuugccaguggugacuggugaaugagcagugcccauguuuauaggugaacucucaggcacacggaggcuuguguucacaaggagaagcggcuggguccggagcacaguccauuggcuuucagggcuggcauggccacgagauuccagaaauugaagacaagccaaggguguugagaagguucuuccaggguguugaggauuuuuuaccccugcccuccacccgacuugacuuuucaggacacagagccuuagaugaguccccaucccgucuugauuuggucaugacaauugagauguugccuauuuguaacaaugaauuccuuaaugaaggaagguagauucuuggcuggaagaugaggucugaaccagugcgguggagucugugcgaugcucuuuucagcagcagggaguuggugggauaauaaguggggcagggagggcccugcucgacugagcuuccuguaggccacuuugccuuagagcaucuguggccagauuuaaguuauuuugaaacacuaaaggugagugagccaggucugggugcaggugaacccagguaggauggaaacgcuuccuaagugcugugaaaguagaggguaggggucauaagggaagcucagagcuguuugcugacaagugacacccacuuuuuuucccugaaguguaauuuacggugacucaugaaaguucacccauuugaguggagcacguagaggucggagcauucucuguaccuccgugggagcuucaagauggauguucucuggaaacuggaggcugagcuuuaagcccccucccuuccuuuugucauaguugggagguugggggagaagagcuaaugacagguccgggaagggcuugggacccagucuuauaagucucuuggacccggaacuguuaggcaggggcagguucugccuuugggagcuuucuuguuguuugcaccucugcccagaggcccaagugacauuucccacacugaaagaaucagggaauggaagccagcaaagguuaaucaugggacuguguggaccaaaaacagccaacuccugagggugacaguuggggguucccacugugaccugauccagaccuuccauuuuguagugaggaagcuuagcuagggggagggggagggagugacugaaccacagauguggacaagcagccgggucccuggaucuccugucccgacuuagagccugggaguugcccuucagggaaggaaagagggagagggaaguguguggggcaguuugaauguucugugccuccaguauuagauguucuguaccuccaguguuggagucauacguggauggcugagcccuguagagggaagaaguuggagcagaacgugccagagugagcaggcaaagaggaucagaggaagggaccucugcagguacugagagggcucugcaggucacccugggucauucuggagagccaagagaagacacagguuggcccuggccagacgcgaguccucccuguguuccuaacccgaggacaccugucagagcaugcggagcaccuugcccuuaacuuccacgaggaucucccucuacaggacggugagcgccucuaggcagcacuggugucugccugcguagacagggcacauguugguuggcuggcgaaucaggcagcuguccuccccagcucuuucuugcuugaguuucugauguaaagauuucagguaggccacucccaaaagucccccuucuuugaaucucaggccgcacugagaggauuuggugaccucaggugcccagugagugccuuucugucucaucaggacugucccgugcgcuuaccuuccuguuacauaaguggugagucaaggacacaaaaugggaauuagcugccagccuguguucagggcuauaaugagauacccacauucucucucugccuucccuguguugccugaguggagugacugcuggccacccacaauugauuaucaaggggcugaagagggguuccaccugguuauccacuuaggugcucucuguucagacuuuugccaugugcacagcucuuucagugauggaaggugaugggagcggcgagagcugucgugaggguaaagggguuucuguggcccacaccccgcacuggggaggcagccaggaagaugggcugugauuggcacccuugcuggucuaucuucagagcuguggguggacuucucugcagcagcugugacgguacccugcagcgugaaggcucgugauaacguacugggcgucucccucccacacagagagaaaugacuuuagauauuaagaaagugaaaagcuuggaauaguugguuaggaaacuaauuaaguaagagcggggaaagaagugucaaaaaaagucauuucaugggaggugcaacagaaaauauuuaggguugaaaaagcaaagccacauggcuggugcuagugucuucacguguuugugcagugcucacacacuugcacaaacagggcuggcagcauggagccagacugcaaagucccccaggggcacaucccuuccacucucaccuuuuaggcuucccuugcucugcccccugcugagauccccaccugccuggccaugucuuuugccuggggcauuccuggaaaauauaucauguccaaaaacagucugaugagcugauccacguagggcaccacuucuggcaggcaauguaguauguuagugucuuagccucuccuggccucugcaagacuguuuuucagaaaaaucuuuucuuuggccgggaaggaaauguucuuuaugguggggaaaacucucugaacccggggagcaguugcacuggugggaucucagagaugcaggucagcagcacagggaccuuaggaaggagguguccuucaccuuaugccauguacuggccugagggcugguccagcccacacacaggcacggaccagucacuugcaaacaccugcccucagugugucagaaucgaacuccaggguggcuuccuuugugggaggugccagucacagcacacaacauggcagguguguuuguuuccuguggccacuguaacaaguugccacaaacuuaguggcuuaaaacaacacaucuuuguucucugauggcucuggagguugagaguccaaaaugaguaccacuuagcuaagguccagaugugagcagggcagcuuccuucugaggucccgggggagaauccccucuccacuguuugcaggcuccaguggccaccugccuuccuuggcucguggccucuuccugucaccacuacagucucuugcuccugucaucacauuuccuuauccucuuugucacauuuuccucugccucccucuuagaucagaaucuggaugacuuuuucuuucauuuuuuauuuuuuagagauuggguuuuuuuuugucaccuauccuggagugcaguggcgcagucauagcucacugcagccuugagcuccugggcccaagugaucuuccuaccugagccuuucgaguaucugggauuacagaugcuccgguguugagcucuggggaguucagcagggcuaaguaggacuugugggggugcugcuaggugugagguguaggcgugagaaacggggaaaggaagauggggccaccagagacugcccugauggaugacauagucaccaccuagguaucagcaucaccccacuuccagagcauuuguguuuucagugugaagcaggaucagggaaugucauugcuggaaaggaccuggaagagccagccccguccucaguugggggcgauggagaaguggcuuuugcuccgguuggggcaguguggagccuggcacugcagagcuuugaagguuucccugacucaagucagcguggaagcugagccccucaauguguagagcgcagcagacacgacgccuggccuccuguucacugauucaaccccagggggagguggggagacggaaaagacuccuuguccuugagcagggucgucuuguuggugagacugguuuuguguuucucacgugugaggugcagacaggcaugguguugcagaccaagaccuuggggcacgaaggugaaggaacagggacagagcagguggaggaggagagagacucccuggagccacaaggcucugaaggacugugcagucccagcugugaccuaccuccaaccagccgcacuaaggcaggcuugucccgcaggggcagaagggucuuacggccccaacccguccccuguccucauguagcuaaugcuugcuuuugggcuucugucuguuccucugccucgauggaagggugguagaugggcugcuccacaaagucuaauaagcagugagucauugucuuccucugagcccaccaggguugcaccugguggcuggggaaugcuuugugaugcccagggcccagcugagaagcagugguguugggguucaucagugguguuggccgucugucugcagggugcaguggcugucuuggggcaaaaguccaaggcucacuuccucuggacacugaguacaguuuuuggaaccagcaagcgucugugaucaguguagagguaaaaagaaaucacacacaaaccacagugcuagcguccucacuguguuugcauuuaauccugaaaauggucgcaugaggagagcaguaacuugcccaaaaucaggguuuuucugggcgaucuggggguuuugcguugagccacagguuggagaccugguggguggagcuacucuggcuccauucccauucugugagcuggggcccagacacgcccuagccugaagguuuuggagccuuaccugguuaauguuugaagaucucggcuaugccaggauaaacuggagcagguauuuacaccucugccaagugaugggcccuaacgcugucagguggccaauaccuguggagcgugccggccacaggggaacacagggccaggaguccucuuggcuucaucccccaagacagcugagguuugaagaucucgggggcgguuggggagggggugggguuugacuugcaccuggauauggaggacaugcuugccuggcccugacuuccaguggguuuucagcaagagacccaccgaggacgaccauauauucuggucccagcagcggacccagaggccguucuagcuguaucugaaggggccaugagaacgguaggugugggguggucugggaaggagggucuuuggggacaucaucuaguccagcccucaccuuugacagaugaggaaacugagacccagggggcaggcaggguccccacuaucacucccaguaggcuucagagacagaugccgcuugcuccgugcagcaucccucccugcccggauuggugugaacagggcaguugucagcgagcagugagcgaccaagagagacacuccucaaggcucagcccagcagaugcucucgugcguauuaggugcugggugacugggggcugaauggaauguguuguccagggucaugcggcugguugucccagaaccauggcuggacagccgacccuuuuccagugcccuuuucacuacaucacaucccuugcgguccucccggcccugcuuaaagaggcaggguuggugcggcucucccucaggaaaaaccgagggugcaaagaauggggagggugagaggcugugaugagagacauggacuugcagugggagaggugggauguguguugcaagaacgccuuggguuucuuguuucuuggggccuccauuccgagauggagaagagaauacuauuugugcuccacgagaaaagauuaggaaaacagccccacuccaguggaccuggcagcauucuauauaaacaucgacaucugggagagagguccaguugaauauuguugcaaauggacuugugcucuuuuugggugaugcuauggcgacccacacuagaggagggugcuggagcccagcgucaggccagggcccucugugggaacaaccccuuaacucccugggcccugccuggcuugcuuuguuugacugccuguaccaucuugucgcuucuuccaccauauuccccauggcauccucuccccacuccaaagaugggugguguaagcccuacaaaguggggcagauggcuagagccacaggugucagccucauucacaucauccauguggccagacuucagcuuccucuuucucauggucugaggcguguuauagucguguuaaauguccagcgcuagaauuuuagggaaggggaguggcugugaauauaugucaggugcacacuguuuggucaucugcuugacuugugcuaggcacugugaugugcagaauaugucauugugacagcugcguccucgagggucagguuagguagguggacacuucuaaucuuuagccccucccuucuuaguagagugggagugggggacggagaggccagagcccaguuggugggaauucccgaaggcuucccucauccuuuucuuucuccuugcuugcuucuauucacguuuucugucuccugcagcccaugggaucagacccugcgcugagcuccuucacugugugucuguugcugaaguaaaugcaagcccuguccuuuccagagcaggaaaggggaguaaaguuuuccuccuggggucauuucacccuuguucucuaucucucucucucucugucuccuacagagacucugcagggaaacacagguguagguaaugucaaaggacauccaacuuguguucuaggaccacagccucgcccuucugucguggcccccacugggugaggagagcgccccggccacaccaggggucaguugucgauggaaaggaauagacgugcaagugugcauuuacuguuuguucugucacuuaccagccauuugagaaguccugggugcugugagguggacugugcaguaauuugaaggguggggagggguaagagggcuguugcauagaagucuagccuuagaguaacacauuugaauuuuggauaaacggguggcaacggccaugcugguuuccuucauauauuguuagccuuuuccuggcugggaaaaaagcauuugccuaauuuuagaacacaucagucauuugguugaaacauccuauuucccccaaagucaaguguuugaauuguaacaacuuuggaggcuuggaaaggaucuucgcauagucccugcaugaacucuccugcauuggaugcccugucugaggaguuugaccuaggaguuagggaaacaaucuuuauuuccaaugaagaauuuuauguauaaacacaccuaaagagaaguguaaaaugcuugaccugaggaccuugggagcagucucucagacccuuaaaacuuauucuguauucucauuggugugauaguggggcaguaguuuguuguuguuauuuuuuccggggcagggggauuacauaagauuuacccauuucucucccuaucaugcaauaguuacccuuggaucuuacugugcucccugauauaugugaagguugaaaaugggccagaugggaauuuuaaaggcaaugaggggcuuuaauuguuuuuucaaaauaguguauguacaguaguucaaaaagucagauauguaaccacaaagcuuauacuaaaagaguuuucugcuccauuucuucuuacuccugaguccuguucccagaggaagccauuucagcucuucuagccagaauacuccggugccuaccucuguguuuguaaauaacugguuuuuacugcuacuucuugaguuuuagaagauauuaucuauugguuuuauacaccacagauaggauuuagcucuuucaucggccuggcuccuugcuccuacccagcuacccuuguuuuuccugguaauguuacucacagagcuggccguccucacguuccagacugacucuggcuguccucuggaccugcugcauagcucuccaucugggcuugaccuuccccaucauccugggaagccucucucucuuucucucucucucuuccaccuucucccccaccuguuuuuuuguuuguucguuuuuguuuuugugggguuuuuuuugguuuguuuuuugguuuuugguuuacuucacuuggugaaaccucuugagaaaugcacagggaggaaagguuuuguggccuugccugucucaggaugccuguccugugcacacucuugaccaggagcuggacuggcuguagaauguuagaugggaccuaauuuuccuuggaauuuugaaggugguguucauuuuuuaacuuuaucauugguauugagaaguucauaugcaagggucugauuccugauccuuugcaaauaaacugaauuuuccuuccgaaaacuuucaggagcuucucuuuaucccuugaguucuaaaauuucaugaagauaugccuugguguggauuuguuuuguuuuauuaagcuagaggcuuguguauauuucagugugggaaguucugaccuucuaguccagagugugucuuauauuuucuuccucugguaauuucuuucuuuuuuaacucaucccucuccucucuucacugucuuuuuuuuuuuuuuuaauggagucucgcucugucacccagguacaguagcacaauguuggcucacugcaaccuccgccucccagguucaaaugauucuccugcuucagccucccagguagcugggacuacagguaugugccaccaugccuggcuaauuuugguauuuuugguagagauggggguaucgccauguuucccaggccagccucaagcuccuggacucaagcaaucugcccaccuuggccucccaaagugcugugauuacaggagugagccacugugcccauccugguaauuuuuuuuuaaaauuuuuccuggucuuuacuucugaaacuccuguuauuuggcuauuacuccuucugacucgauucucuaaguuuauugucuuuuucuguggcuucguuuugccugagaucacauuaaccuugccuucuaacccuucuguuggggucugauuccaccuauugaauuguuaauuucuuagagcuuguuuuuuguuuuccguguguccucuuuuguagcauccuguuuguguuucaugggugcaguacuuucucuaaucauuucaguuauuuugaaguuguauucugucucuggucugacuuucauucuccuaguucccuuucuguuuguuauggucuugggcuuucucgaaugaguggcgacccuucagaaggaggcuguguguguauauggggugcguguaggaauaucgacuggcaggcuuugccuuagaaggacaggcaggcagggcaccaguuuguuuugggagagacccuagaauguccgcacguacgagcccucucgucuccauuacauggagaaugacaguuuuaggaggucuuucucuugggcuuguugguuuccccugauaggaauucucucaucuccaaucuaggaagaccugugggcagcagaagggcuugggaugagggacucaacuuuuaggaugcagacuuucuuggacuuuuccugcuguuaguccuucaccccuacuuccccugcccccucagcugugccugcugccccugacucuaggggcccuccuagggcaacccuccgugcuggucaguauauaggauucucuggccagagccaagcccugggaucugccugcccuuguacgggugcugaucaguucuccugcucucagcccugccccugcuguuggaguccccucugcccccaggcccugagcuuucuggugucugcagcagugccagccugccuccuccuagcuguccucaggaagcuucuuccaugccaccaggccacuuuccauguauccagccacuucccacucaaaguuuacuugauaucuuauaucugcucuugucuccucuccagcuuuucauccuugagaguuuauaccucccccccacacacacuuuauggucauauuaauuaggguuuuagcaggcaauugaacauucugguguguuaagucaccuguguuuaacuggaggccccucugugugucaggaacuggcccgcagccugucgacacguguugguguccaucaugggcauaucgugccugccuuguacccaccuguuuccaugccacuguucccuguccuuucccacacuguccccugugugggucauauuguuggucugggccuguguagcucuuugugcuuggcagggugugugugugugcagggugugugugugugugugugugugugugugugugugugugugugugugugugugucucagagucaaugcacaugccugccaggggaccuguguguguuggcauccugcauuaaauguaccaucuauaauuugcuccaguaccuuggagaaaauuuuaugaggaaaagauacuuucauaaauaguugaaauuccagauucuucugguuggaaacccaaggguuaaugaugacuguuguuccagaaagguuggagggagaggagacaguuuaucucauuucccucuggugaauaaggccauuuacugauggggcccaaucaccuaccugggacuaacaauaagacccuuguuguugacugggcagguuccacagcugauacuccggcugccuugagcaauaccaucaggcagaucuggggcucagcccuguccuuacccagggccucagagcacuaauauauuuuccuuuuccucacuccagaugucuucccagugacucuccuuggggccuggggaaaccacaagggagcuuggauucauucacccauugcugccuugcugugugccucagaggggcucagagguggaaaauaaauaugaaaaagcauccuugucuucuagaaucucgucggcugcugggaagaccaaggggccagccaucgcagggagcauaagcacugagacaggcacacgugccugcccggcuaucguagccaggcuggcagccuugcaacucccuggggaagaacaaucuaggaacauucugggguguggagcaggaagggagugucacaugcaaaaggcaggaucagccaaagcagaggggcugaagaagcagugauucccccaccuaaugucagaaguaaaaucaguucauggugaaaauuuggggaaacaaaaucaugcagcaaaauugccuauuaaaccccacacggagguaaaaaucgguucauauugugguuauguaucuauucucuuaugauguguauuuaugugcuuauguaagaccuaaaaacaauaauuuuuaaauaaaccaguuauuuuuaauaagaauauucuggccaggcauggugguucaugccuguaaucccaacacugugguaggccaaggugggcggaucgcuugaagccagggguuccaggcugcggugagcuaggauugcacuacugcacuccagccugagugacagagggagacccugucucuuaaaaaaacaaaacaaauucuaucucacaauuccuuuccuauccuucuaugcauggucuuuaauagcuacaccccauuccauuggguggcuguauuugauuccuuuauucuguacuuucggacauccaaguuguuuucagauuuuuacuuuuuuaauaugaugcuucagagaacauuccuggaaguaauguugccagugcagaggugcaagcauguuugagacagcugauaguuaccucuguccagaacuggcucacucccaacagcagcaggaggcacccagggucucucacuuuccuuucaauuuuccuuucuccacauccuacccccagauuugucugacuuuuccagaggcuauugagagaagcuuuuugagugaggcaccacacagauguuuaagacuaaguuuguggucuuugagaaccgagguagccugacccauuggaagccugcagauaauugaaaaaaucuuauuuuagauccugugucauucuucugcuaucaaaccagagccagcagcaaaggaagcugggggugaugggccuucauccaccugccauguugccucccugcgcugcuucugccaagagugggcugcuggggguguccugcuggggccaggcaccaggguuccaaugccaaguaguggcauucacgcaccuuuugauaagcgaggaaaccgcuggcagcaggaagaaagguaaagcagcuccagggagcucagcgcucagccucaaccucuuuccccagaaccugcgccugcccacuccaccuccaaggccccucacucuccaccacccauuuggccuuuuggaauugggacuggaauuguuuccagcuccagaaggccccugccugccuaauucccaugucucuaaaaauaucugcaagccucuucccacccaggccuguccccacagagcccacuucucucccccgacccucggcuaggggaggaaaugagaucucccucucuugacaggauuagaacggaauaaauacgaaaggcugaguuuccagaguugaaaggguagggcugccuuugucggguccggagggcuggcguggcaucggugcaggcccacacucggaggagggaauccaggagaaagaaggaaggggaaaagagcaagaaccccuuucuccccucugcauaugggauggccaagagaagccaggcccugcuguggguccccggugggaaagaagcuggcucccagggcucccaagccccagccacgccuggucagcacaggcaaaaggagucugugggaagccuccaaccuccaggcugccugaggccccuggagcuuucucaggcauuccuagauugggacagagccucagaccccucccugccccaccccccagcauuggaugccugccuaauagaggcuuuauuuaucuccacauuuucccagcucuguauaaagagacaagcacgugggugaggccuacagauauuccaaaagcaggggguaguggggugggggaugaagaauacgcaaggaucugcuuccaccauccccuagaggggcuuuggagggaggagggugggcuagggcaaagggucgaugugcaaaaggcuucuuuucuuucauuuuccccuacucagaaacccaaaaauagccaugucaaaggcacauacauugcaaauagcagccgagaagagccagcugaaagccauuugcuucucccucccuccucccuggacacacuccccguccucugcaguccccuucuuuccaggcucuugcugggccaaccaguccugcagccuuguaggguccagcaccucccuauaggguuacugaguugcaucuaaauucacuuaauaggcggucacagcuuuuugugaaaacccaugaggaaaugugaaaaguccuccuuugguucacuuuucuugcaacuuugaauuuuccuacuaagaguccuuaaagugaagcaaaccuguagcuaaaauguagacaagagccaggcacagugacucaggaggccaaagugggagagucaguugaggccaggaguucaagaccagccugggcaacauagcaagaccgcugucucuacaaaaauuuugaaaauuagcuggaugugguggugcauaccuauaguccuagcuacuugggaggcugaggccagaggaucgcuugagccugggaguuggaggcugcagugagccuugauugcaccacugcagucuagccugggagacagacagggagaccccaucucuuuuuuaaaaaaaauguagacaauaaaaaauauauaaagauuggauuugaucucaagucaagaggaguggucauaugcaagagaguagaugccaugaaaauggucugcugucccaaguguuuuucccaauuauaaaacuaacauaugucuuguacaaauuuuguaaaaauuauacauuuugugaaaauagguaagcacaaagaucaaaagauguuuuccaggaagaaucagaugggacaucuccaccugaugucacucguggcaggcaaggggacacuuauccuugugugguggucuccuccugggauggcgcuggguggggaggcccaccuuuuggagguccuuugguggcucugaccaggcuccacccugcacuauagcuguccuggacggcggguugaauagaaggguacagauuuagaauugacuuggaaacacguuaauuuggaagccuaccuuccccauuccaaagagauucugacuugagauccaagguuuccagagcgccucaaugcccuuccugaaucaccaaguucagucuggcuuggagagcauggcacggcugacccagugaguccaggguacagaggccagacucacagcucauuucaagcugggcuuuuucccccuugucgaaccagucaaaacaaacgaaauuggauuagucugucuucaagcacuuugucagaaaauacaugaauugguguguguguguguguauuucaguucugccaucuguuggcucagggguccccagugcccaggcagguccauggcuuauuaggaacugggcugcacagcaggaggugaguggcaggcgagcuagcauuacugccugagcuccaccucuuucagcauuagauuuucauaggagcgugaagccaguucugaacugcacaugcaaggggucuagguugugugcuccuuaugagagucuaaugccugaugaucuguuacugucucccaucacccucagauggcaccaucuaguugcaggaaaacaagcucagggcucccacugauugauucuacauuauggugaguauguaauaauaauagaaauaaagugcacaguaaauguaaugcgcuuaaauaauccugaaaccauccauccauucccuguggcccuggaaaaacugccuuccacaaaagugguccuugguaccaaaaaguuuggggaccacugcauuagcuaaccuugaacaguuuugcaaucucacuaaaccuaaauuuccucaucuguagaauggggagaauaagaacaguuuuuuaggaugacuguggauuuaaaccagaacucaguggagcgcuauauccugucuucucugccacccuucugcuucacucagggaauuuaucuuaagaguuggggagaaggcaggggaaccuucugccauguccugcuaugcuuguguggcccucugagcaagggagagccuugcuucacccucaauaaaguaucuuccuggucucaggcccagugacaccugccaacugguuaagaagcagaguuuaacauuucaguaauguuauauccggauauuaagaaagaaaaggccgggccugguggcccacaccuguaaucccagcacuuugggaugccaaggcagguggaucaccugaggucaggaguucgagaccagccuggccaacaggaugaaaccccaucucuacuaaaaaauacaaaaauuagccagacaugguggcaggcgccuguaaucccagccacucaggcugaggcugaggcaggagaaucgcuugaacucgggaggcagagguugcagugagcugagauugcaccacugcacuccagccugggcaacaagagugaaacuccaucucaaaaaaaauuuuuuuuaaacaacaacaacaaaaaaaauauauauauaguuacuucaaagaaaaaccuucagcaacauuaaacaguaguguagacagcagugaggacuucaguuguguauauauuuuccugccuggggaauuguuuccugaggguagaguucuagaaauagaauggaaaaggcccguaggguagguacugcuauggcuccuguggcagguuugcagacugcucaggcagcugcaguucaagugcccuuuccaggccaugggcugccuucaagccaugcccagaaagccugccugccuuggcucuacauccugauguccaggaggucaggcuuggccuaaaagagggcuggcuuacccuuggcucaaaugucacccgcagggagcugggggcugaggaagaggaaacguccagguggguguaguccucuggcuucuaggcuuuccuuuccuaucuucauuuuuuuuuuuaauuuuuuuuauuuuuuaaaaauagagacaggaucucccuauguugcccaggcuggucccaaacuccuggacucaagcaauccuccugccucggccucccaaaacgcuggaauuacaggcaugagccaccgcacccagccucccuuccugucuuuaugggccacuccugucugcguuacccauagucaaggccaggccuugggccaggaagggggcuauaccaucagcuccccaaguguacaaggcccuugccucuccuuuggccuacaugagcaccugccuuguacucuauguugugccaggcauugugggagaugccaagaaagccaaucccucugcugccccuucagugcugagacaccugggccuccaaagggcuggugcagugcggagcugucaggcuuucuucucugccaggucauugugauggggcaggugaucgucagggcacguguggagugugcgagcagguccacccaugacuaguggagcagccuuggcuaagccacuuucucaccugugcaguggugacagcccccuccucagggucauuaaggagguagugagauggccaugucucaugucccaugcgcuugguauacacacccccaagagaggccaggccugggcugacacagguaccccucacucuguggcccagguggcaucugcuggcagcacacccacccucccugucuucugcaguuccagcccagcuaguggacaccuguccacagaggacucugaaggaaacaucugaaagguuagggcccugcugggcaacguugaggucgacacuguggacaggcagcuccauguaauucuucuuccugcccuuacccagccaaaccugcacccuucuggggguggaccucuguuugucccguuuguaaccacuucugucuggcaugggcuccaagaguugaugcugcaugcaggccucauguacuuugacacaagugugagagugcuggggguuggaagacucaugugugccagccuccagguacagcuagccuguuuccuccaugccaaggccuugucucccuugaggcagaguggugugguggagcgaguacuggacuaagucagaaggcccaggcaguucaggcagccacagauuaagucacuuccacucuggccauggggucuuuguaagaugaggagguuaugucagaugcgcucuggugaaaguauggaaaaaagcauuggugacguguggagcuaaggaggucaggcuugucaccaggagcuggcccuguccccagccauguguccccaucagcacugcugggaaagcagcucagaccccagggccggcagccgugaggguaucuugcaguggcucuuugggagcagcggcugcuauuuuuaguaagcugccuaauuggagguccugguggagcuuaaccagcucaccuugugcuuugauccuucuguuuggccuucucuuuuuacguggaaagagcugaaguucaugcccugaccaaagcagauuuguuuuugcaggagacggaggcuuuugcuguuaaaaaaaacugccccuucccaggccccugcucugucucuuaaguaauuuccaguggguugucagcauugauguugguuccuuccuaauaagaucucccccuuuuaucugcuauaucaggacaucaggggugggggcugaaaagaguauugaaaaagauggaagcauuacucucugcaggaaaacagauugguuuuaaaaaugcuguccuacauccugccucagaugauggcccuucgcacaugauuucucucacuuuugaugcccucacuuuauuuuaagccgaagaaccaaaccuucgaguaaagccucuuuguuccuuuuuagcagugagauaucuccuaggaugggagaccagguguuuucucgggaacagucaucauuuagcuuuuucccaaaggaaaggaacucugugugucccugguggcucugggaauggcgugugagcccauuuccucaggauaaaacuaagaugguaaugaauaaugucuguuugauuugugucagauauucaugugacacagacacuaagugcucguaaacacucucaguuaauucuugugacagccuuuagggaauaggccucaugcuuaccuccauuauacagaugaggaaaacugaggccuagagagucugagucgucccacugcuaugugaccaugugccugcaccaucuaacauggugccagcgcuccugauguguggacgugagugucuguuuucuggaugugcauacagcaguguaccaggcugcaugaccguggggugcugcugcauagaaccuuuggccaugagcgaguuuuuggugaacuaacagaauucauuguccccuuccugguagagaauugcuucuguguccugaggagauguggcaugaagggugggcaaggauuguuccugccagcuggguggccgugucuuucauccuuccuuccucccgaccaguccacggcuguguucaagccugguggggagccgugaaggcagaaccguuucuccguccuuccuuuugucccugucaccuuccccuggcugcuagcagaguaccuguccugugucacagagagacagagccccaauuguuuucuuuccgcugcgucugcuccuugccucccccucagccacccacgaggucucagugcugugccagcuagcuugcugcagggagccgcugccucccuucggagcacccacgcuuccagucucccuuccaucuuucauaaaagcaugggccuguggcucagugguaugggccaccagcuuuguccuuaagaccccucuucauuauuucccugagcccacucuggggcccagugugggcacuuguucagguuucucuguugggauucuucuugguuuagggagggugguuggcaugugguggaguugagaggggccuuguugcuuccaggugcuuugguagaguggucccagguauccacugggcguguuugcugcuuucuccugucuucccugucacaguccacuuuaggguuauauaaaccacacacagaagccuacaaauagacuuuuguuguucauccucaaguaggcacuaauuccauucgauggaaccugggaugggcaucgcuuucucccagggcagggagcacugccugcugucccacagcaugucucacccacccucgugguggggcaggucgagggcccaacagggaugcucuugggcuuuuucacugcaggccucagccagcacccccaggcagccccuguugcugcucucuggccaacagucuccuaagaguccaggguugcccauugcuauuguggggucacauaucuuucuacauccauacuccuagggaggcggagucggucuugaaacuggguggggaccccuccauucccccgugcuccucuugacuggggcaguacuguucucgcccccuaagaaggagguagaggugaggucccuguucaccuugucuuggagaccagucaagacaggaaagcucucaccucagagauggaugggucccuuggccacugagucaggccacugaggcagaggagggcaggcagucacucacuggugguggugugagagacgcugucucugauuauccgacguccuguaaugagauacuuuucagugagggcuguucccuggaaacagugugacuccaggacuaugggaagggggucugauuugggcccuaauuccagcucagccauuaccagccugguggccuaggcagggccuuccuuucaaggauuugaucuuuauaauaguuuugaucuuuauuuaggguuaggauuagguuaagguuuugaucuuuaaaauaguuuuuccuaccccauauaggacaucugccacucaaagggaggcauguuaaagaaaccuuuuauuguggcaagccguaagacaaaaaaacaugugcaucccagguucagcuugaugaaguuucacagauuaagcacaccuguguagccaguaccaugaucaggaucuuccugagucccucaguggcuuugagggaucucagagcacggcaucuccaggugggugugggagcuuguccagggcgaagugucugcaguguugcagugaggcacgggguggccucaccaccaugucuuucucagcccugccggcguccaacacagcagaggugcucaguaccccguuuucuacugagugacugaaugggugaaaggcaacuggauuccuacacucuuggucuuuuccagggagucugugucuugguguuucugcugcuucacucuuuguggucgacuuguagaagccccucugcccagaggacuugauccugggcaggcagcagcaggaacacaccaugccuggcgugggcagaaccugugaucuugaaagaguugagccuccaccacuucagagagagggcagcaagagcgcucuggagccugcccuccacagagcuuggugcuuugagaccuggacagugcccaccagacagaauccacauaguguuuccucuccuccuuccagaaccggaucuuccugagucccucaguggcuuugacuggugaaggcuggccaggccugcuggagagauccgggaugcagagcuguuuagucugggaggcaggucagucucagaggaugggugggucagggcugaacacaaggaaaaaagacgccacacauggaaggaaaucaccacuaugccaucauaacugaccaacuacauuuucccaaccuuggaaggacaagguaggaguggcaggcuagaaggauaggucuucaaacaucacuguugaugcaaagcucccauaacaaguuggauuucugagaagcagauugggaauucccagugggagagaggcagaugagagcauccaagauaacgacuucuuucccagaugcuggccuuccuggaaugcuggcagaggaucucaguucuuaauaauuauuuuauuggguggggaagucuuuggaagcagaaaauaagccaaagaggaacuuaaugucauaccccuuucucaaggaaaguuuuaucuacaacacauuuggucuauucuuagcuucugcuccuguccuuuggaaacguagccuggagggugucgggauuuaaugggcucuagcccccugccccucccuuuagagugaggggguggauugguguuuguggguuuucucugugaaucaguucugagaacaccagagagcuucuuucaggguucuggacuuacugccaggaggcccaauuccucccagugacaaagucacugaagacaagagucuucaggaaggagccucagagccugggcagggcggggacuucaaggcugcugccagguuuggguagauguggggagcaggagccagacagaggcugggugcuauucagguugcuccggcaucuggcauuugggcacaagaccuguccuuagaaggcuuggggcuggcaggugccuugugagccugacacuguuggugcagggagacaccugcaucaucucacgcagcagcuuccucuggaguucaguguccuggggcgcaacagggagggcuguggccuggccuguauucagguggauuuggcacacaggcccaggcugguccugcacauccccugcuagagagcaaucccuacccuccuuuguccccuucgugucugagacucugauggcgggggaaacccagagauuccuguugugcauugagcucguucuugaguucccaucucucuagcugguuuggaaucuuaaguuucuccccagcaggugauuugaaguccuuugggcuuccagcuugcauggguuccucugugccugccugcugcccucugugucuguaagugguuggcaggaaggugcaugugugagaaccuaugguaugcccgcuuagggccagggcugcagagguugcucgcugcucaggggccugcccggagcccuggccacaugucccgccucacauaccugcaagggccauuucccuguagauagagcaguugccugacacagccaccaccucucccuuuuucccaggccugcuggagaaggauggcccucccuccugccuugucccucaggcugccugaggguuucguuuucuuguggcuggcauggccuuucaggguacuguccccaagcacuuuaugaaucauaaucgcagcuccagcauguccauucacccccacugccagcaggcucuuuacagcugcauuuugucuccacacucuucugucuuucuuugcuuucaucaggcccucuuuggcccagcaaaaagcuguaagugacuuaauacagcuggguggccagccugggacagacagccaucggagccaagccucuggcaucaaauauagaucaaggucucccuuugaggcagugguucccagccuuggcugaacauuagaaucacuagagaagcuuuuaagaauuccuaugccucagcccuacaucugagaauuuaaaucugagucucucucugggcauagaaccucuauuuugaaaucuucccaggugauuacauuauucagcaaaaguuuggaaccauugcuuuaagcucuaaaaccuuccauuuuaagccagcuggccuuugucucuagccucuagagaggucugggcccccugaagcugcuucucccugcuguagaucccucaggggugaccgggagggugcuggggguggggccgggugaauguuaugggccucacagcugcauugcuuucagucucacugcagcaaacagcagcuuguuuucucuagaucugccuggcaggccuuugggcagaaaaggcaguuacaccauguggcauggcagcgcccucucccucucaggcucaggcagacuuggagaccaggcaagcugggacacaggaagcuccaucugaagccaccaguggcagcacuccgcccaccuguaugcuagcacugccucuucuccagugcaacuucucccgccggcuguggugcgcagauuucugaaagcgcucaaacaggcugaagggcccuuagcccccuucucucccuuuccuucuguguccucuccuuacccucgccacuuuguuccccucccuucuuauccaaacaugccuuggaaaggucucaaaaacucaugcugaagguauaaaauauucaaucaguauccguucugcccacugcugagcucguggguauauggggcaccguugcagguucuucucugagaauucaccagagggacuuccagacagugguguaaaagggagugugcacuuuugcaguagaguggagucugcaagccaagaggccagaggagccauacauaggcucugugugcaagggaaagcaguucucucacacgaguacugacacuuuugagaccacaaugccuguguacugggauucaacaguuaaguaaauggacggcagguggcaggagccacuguugcacacagugacaaggaacaggcaggcaagggaaggaggcuagacugauccacggaggugcuaguguguuuaguugauagagacuuuaauaaagauacauaaggauacagagagaaguguuuauagauaugugguaugcccagguuauauacaccucuauuuccuuguuccauuagcggagagggccuagaagcugugagacccgcgaaacaaugagcacaccugccauccagaucuugauuuuuaauggcacuuuccaauaaaaguaaaccagggcuucuggaggaaaugaucaauucuagggcuggggcgggaaauauacccuaaagguacaugaagcaccuugcaaugccaggaagugcuuugaggcugcacaggugcacaugcggaugggggugugucagggggacaugggagccggcugaaaagcucccaguguccaaagcuggaacacuuugagcaacaaaauaaauacuguaauguuggauuaugguguaguguggauguuuguccccuccaaaccucacguugaaauguguuccccaguguuggagguggggccuaguugggaggcguuugggucaugagggcagaucccucaugaguagaucagugcccugcccugggcggggcagcaaguggguucuugcucuguuaguuuccuggagaccuuguuguuaaaaagugccuggcagcuuccuucucacucccgcccuccucucugaccaugugaucucugcacacaccagcgcccauuugccuuccacccugaguagagcagcacaaggcccuccccagaugagauccccaaucuugaacuuuccagccauccagaauugugagccaaauaacccucuuuuucuuuauagaugacccagcuucagguauucccuuauagcggcacaaaacagacuaagacaagauauaaaauccacaaguccguauuggcauaaggaaaucauuuaguaaagaaauaaauaaaugggagagaagaaacaaaauguccugugcagaauuccagguuauuuaugcagcuacuccuuacuuaaggagauggccauagcuccccacuccguguugaguggugacuuccuuccagagagcacagggguggggagcagcucugcagcagagaaacugacaggcacgaccccagccaggcacuuaaggucaucaucaacagugaucagucgugaagccuuggaaggaugggaagagaagggguaucaccucuaugguuguccucccuuaaacacauaaccacagucuagucgugagaacaacgucagacaaacccaaauugaggugcagucuacaacacaccugaucagcacuccucaaaaccaucaaggucacccaaaacacagaaggucugagaaacuguugcagccaaaaggagccucaggggacaggacacuuaaugugaugugggguccugagugggaucuuggagcaggagaacaguagaugcaagcugaggccaccugaaucaaguugugcugaaugaggugugagcuuuaguuaauaacaggucaguauugguuuauucauuguagcaaaugcacugcacugauguauuaauaacaggguaaacugggugagagguguaggagaacucuucacacacucuugucuucuuuucuguaaaugugaaucuauucugaaauuaaaagguuauuuuaaaaguuuaaaaaaaaaaaccaaaaaaaaaagaaaaaaccucuaggcacagugucgugggagagcccuguuucacaagggguagucccaaaaaaaaaaaaaaaaaaaaaaaaaaguaccauagagacucgaagagagaggaagccacuguaggccaggcugcuaagaaggaccuggaaagcaggugccaguggccuugcccuugaaggacagggaagaccagcacccuggccaugaaggccccagcagguguccugaggcaggaccagggccccaggucaugagaggaaagcuaggaagugggggcucagcagggagccucaccaggggcuuuuucccaucuccccugcagccugggcaccugccugcuggccuguguguccaggggggucucuguuuucugcuucugcugaggagggagaccuggcaacggguggccccugagagaccaugcuggggaacagcuguggagagugaagccagcgucccucuugggaccgcauguucuguuguaggacuuguucagacucuucugccuguuaaaccgaggcagcaggaccaagugggaacugcggacugacucagcuguuacgggcgguaccaacagcaggcagucuccuaccuuccugagugugaugucuggucagaccugugcccagucucccucaagcgggccgccuuccccagcacugcccacucacucucuguucccaggaggccuuucccaccauaucugcuggcuucucaccgaggcccuuccccacaugcuacccacccuggcauuuguuuagcuugcccgacugcuuggaagggcaaccguccaggccagguuucaucaguucuguucauugucgcaugacagucgucggcaccccacagagcagguguuggguaaauauuaauauuuacgaggugugcgggugcugugggcagcgugguccaccuugggcaugcugcugcgcuuuuccaacuggugucccuguguaugcgauggcagugauacaccucauacuugcgggacagaacaugccugugugaaaggccuggguaacggcgcuuucuuaucuccagcugagcucugucucugcccucccacuccuugggccuagcucucucugucgggaucucccaggacaagucucgagccuugugccuggggccaccuuuaagacaucugaauccuccaaacccggccuccuugccccugcaucccacaagugcccaucucacagcagcuauguaugcccucucuuccccccguaucaugaagucuguggcaggcaccaugucuuccucaucacugugaccccaagccugauguccaguagaugccauggaguuaaaggauuugggggaugguggcccugccccgcagccccagccccuccccagcugccccuguccucuguacguggaacaguccuggcuccugccgucugcuccugcagggcucacucaggaccgucaucugcaugguucaucgcucccaugaacugaguuccacuuacucccagccuccuccccucugccccuuuaaggggagcccagcucugcgggaggaggacagccuccugaggacagggcugcaacugggcuguggguuggugccacuggacaaagguguuucagcgcagccgguggcguugagggggagggagggaggaugaggcggcccucaggcugugccuguacugcguuccauccccacugaguagcacgcgggccuugggagaggcuaggcauuucugcuggugacacagccaacucacucuguccuuucucccuggccacaggaggccagugaggcauccucagcccugggcuguuucccagcgguccuccgagcucagacagcugggauggaacuuggggucucacuagcucccaugagcuuugggagcuguccacuuggggacuccccaggguuggggcuggaacuguuucaugcccugggggguggcaacuugaggcugcccuugcagacggcuccuggcccugcccugcagucucuucuuccacugauugguaucccugccugcccuccccagcugaguccaucacuagugguauagcucucaagggucuguuuucuaugaagacagggacagaaaugccagagaaagguagcugggguauaggucagguacagaauuuuugaaaagaaauuugccaguagcuguucucacccuggcaaccaccauucuacucucuaugaauuugaguacuuugggugcuucacauaaguggaaucauacaguaucuauccuuuugugacuggcuuauugcacuuagcauaguguuuucaagauucauccauaguauagcacauaccagaauuucuuuccuuuuuauggcugaauuauauggcaguguauauacauacuacauuuuguuuauucaucuaucuauugguggacacuggagcugcuuccaucuguuggcuauugugaauaaugcugccaugguacguggguguacaaauaucuguucgagucccuguguucaguuccucuggguauauaccuacaaguggaauugcuggaugaaacagcaaaucuauaaaguccaguuuaauuuuuugaagaagcuccauacugcuuuccagaguggcugcaccacgguuccaguuacuccaugaccucaccaacacugacaguuuucuguuuuuuaacuuaccucuacccuagugaaugugaacuagcaucucauuguggcugaugugauuugcauuuucuuuucuuuucuuuucuuuuuuuuuuuuuuuuuuuacuuaagagacagggucucacucuguugcccagacuggagugcaguggugccaucacagcucacugcaaccucgaacuccugggcucaagggauccucccugcucccaaguaacugggacuauaagaguacaccaccacaucuggcuauuuauuuuuuaauuuuuauuuuuagagaugaggucucacuaucuugcccagguuggucucaaacuucuggccccaagcaauccuccugcuuuggccuucugaagugcuaggugacuuucauuuucuaaugacuaaugacgucaggcaccuuuuuaugugugucuuggccauuuguauaucuucuuuguauauucacauccuuugucuauuuuuaauuguuuuuuguuguugaguuuuaggagcuguuuauucuagauacuaauacuuugucagauauaugauuugcaaguauucccuucccuucccuagguugccuuuucgcucucuugguccuuagauguacaaagguuuuuaauuuugaugaagucuaguuuaucuuuuuuuuuucuuuuguugcuugugcuuuuggcgucauauccaagaaaugguugcuaaauccaguguuacagggcuuuuuuccuuggucuucugugcauuuuauagccuuuguucuugcauugagguaucugcuccauuucaaguucauuguugcauaugguguagugucacccuugguugguggauccugcuagcugaccauuguggugggugagggggaugaaaagcuguucuuccccaguucccaugccucuccuaccuucuucccaucuaccccccgcccacccaccaccaguuuuaggaggaaggugggccuuaacugggugagggcucccaagggaagcuccucuggcagagggcccuuggccauuuggcgggggcccugguaucucgcugcccaggcagcggccgaagccagcaggccagccuggcguagcaggugugaggaggaacuuccuggucuuggcagcaagugaaaaagguccuuguuuucuuauuuucuccguuaaaaaaaaaguaguuuagugguucuaacuaugccccugggaaagcccugaacgggucauuuccucagcaucccacaaagucacuuguagcagaaggcccagcccacgcacugcagcaccaaggcuggggcgaggcccacacugcauuguugcugcuggcauuagcagaugcugcacaucuuggaggcccccuccugcuaauccacgaaugccucagaaagcaugcacugucucuggggccagagcugaaucuuagaagagggccuacuugggaugggagcgguagcucugcgucuguggugacacccacugucacauuccaguagagggaaggaaagguagggccucgggauuuuggcccugacugcaugguuccugcuucuucugugauggaggcggcaugcuguggugggcuaggaguuaggaagccugggccugaguuuccacguccagacguuagggagaggugggguguagagggccuuccaggccuggguuggcagggaggcgagcucuuucucgugauggagccaugaaggccuguuggaaggccuggccugcuugcugcugagccugugguuucucccuguuaucugugcaguguucuguuuuguuuuguuugaaguguacaggucauugucuuugaggauauucacgugguuauacaaccaccaacacaaucuaauuucagagcauuuuucaucaacccccaaacaaacccugcaucccuuagcugccaccgccacuccuccccuccugcuucccaucuuuaucgauuggccuguccuggacgcuugauguaaauggagucaugcagcaucaucucacaacuuuaccaucugcugguugcagcagagucauuggcccaaggcuggggugguggcuucagaccaacaccauggacuugguggccuaggugcugaucaugcaaaggccauuccucaggggccugcaucucuuuccagacagcuucucuaccucaugcccugcagagccugccacugucuggucuuugcacacgugucauccuguuaacccuuaaugaauaugggauuuugguuaaaaugaugguuucuauuuuauaaauaaaacguaucuauuacauauauaaguaaaucaaauauuuauauuauaauuaaaucuauaauauaaaucuagcaggguuggcuuguuccaucauucagaaauguuuacugaagcacauauuggaaggugcugaccuagguguauagaguaaauacaaggaguuuuaucaggcaccuuguggcuuaguaugcagagcaguugggcagaccuguggaugggccauggccucugcacaggggcucccuucagggagcacaggacaaugauccaggaggggagaugugccaggcaggccucuccggcaggacagugauaaaggaggcugcucugugcagcggguaaccgugggucucccaggccagcaaguagguccaggaggcaagguggggcaauuggugcagggagcagagcuugggcugggagcuguuggagcaguugaguuguggguuggcuuggccggaucuauguucaugaagaaugguucuggggcuguuccuguugaaucauucugaggcucccagcacugcugugccuaggaggguagaacccaugggccucuucacuguguaccagguguucccagcuggccucaucuagccaagccucccacggaacucccagaaucacaggucugaggccuccguccugccaguccccagucuguauuggugggcagugggaaagggccugccccgcaugcaucugcagcuggggagaggggucagaaauguuuugcagguagugucuggggccaggugcugucagccuggggcucagcagaggggcagacccugcucuccccuggaauguggccugggaaaccagccucuggugcuccccagggccccaaggcaagggccagagaggcacagggagaaucugcacgguacucagcugccuuuggauugacccuucggcuugguccauuguuuucaagagcccuuaucagccaucuuagcacaaguagauggccauggucucugaguagaggaugugcccccuccccuugcagaagacgguggcccaugaugcccagagcuccucaguccacugagcccugccucucugccacaggguagaagacggaacaugcccgacacuguccucccuccuucccaaacauucgaggaaaguuguugaacccaucgucuucugaccaccacccuugcuugguaggagaguggugaugugcacugagaagcagcaggcggcacgggugugccaucccgagccugagcucgagucccgcuucagcugugcaguaucguuuguagucuugugacagaaggggguagauuaucaccccaaagggaaaucucuaggccaaaacauuaggccacuucucauuccccuccccuagccccuggcaaccacuccucugcuuuuucucuauggguuggccuuuucugaacauuucaccaagauggagucacacaguguguguccuuuugugacuggcuucauucacuuagcgugauguuuccaagguuugcucauguuggagcaugugucaggauuucauucuuuuuauggcugaauaaaauaauauuccauuguaugaauauugcauuuugucuauccauuuguccacugauggacauuugggcuguuuccaccuuuuggcuaucgcgaauuaugcugcuacgauaugauuuguguauauguucgaguaccugucuucuguucuuuuggguauauauccaguaaucaacuuguugggucauauggaaacugucuguaauuuuuugaggaacugcuaaaguuuuccacaauagcuacaccacuuuacaaucaaaacgaggccuauauuuacuaccauuuuacauuagggaaacugaggcucacaauuugcgacuugcccagaaucacagagcuagugagugcagagcuaggacuugacuccaaggguaggcucuucuuggcuagagagcucugaaaacagauugcuuagagucuaccuuagaucucagaacuucugcagagggaaacagcugggagagcagugguuuguggcuccagcucuuccuccuguccugggcugauggaagccccaugagcuggucucccuggccugugcuguagguccagccuagguagcccuggcuggccaaagcugccuaagguccugggagucucacgggggcuguguggcuagcccaggucaugggguggucucccggcccuucuuucugcagccaaacuacuucuaggagccugaucuaacaaaucacaagccucucuuuugaggaugugcuggggaccaccccaaaagccaucggguguagaaugggcauccaacucuuggcccaaagucccucugggguugcaggacccucucuggggucugccagguuguagcaugcagguuucaugugggacaccugaaggguggggaagagugcagaaucauggcucccuucccaaggaggugauaggaccuggaaucagaccugacaccugaggacaggcauugggaugagggcucagcccagccuaggggcuguuccaugcagcuucaggaggcuacaguguggaggaugauuguggaacugcccuuugaaccaugaggacuguggaguacaccaggacuggcggugacgacugggaagggggaagggaguucugccugguggguaccugcuaggcccauugucagucccuaggcgugguuggccuaacacuucucugaguuguggcacagaggccaggcagaggcuuugcuuacucugggccugcaugggaucaugaccccuuuucugcggcucuuuccaguuuccucagaggacuugggcuuuggggauaucugucuguggagagugcugcucccuggggaggucugcagccccagagggacuuugggccaagaguuaagugcccuuucuacacuugauggccuuugggguagucaccagcaccuccucaaaagagaggggcuugugauuuguuagaucgggcuccuagaagcaguuuggcugcagcaagaagagccgggagaccaccuuugaccugagccagccacacagcccccaugagcccugcuccuguguugugccucccaggauguggguuccaggggcgccuaggaacucagcuggugcuccccaagggcuguguuccuuccugagaaaacucuggagccaauguccugaauuccaaagaaaggaaggaccucuccuuagaccuggcucgagcagccagaccaugucugcagcacagcccaccagcccaagggaggagggaggugguguuccugccugggcgcugccuaaucaggccauagcucagugaagugccaggcugaaggcaggggccgugcugggcaagucuccacgugguccaggcuggguagcccugccuacaguuucucugauaaacuuaggcaugaccuugugcaaacaauuguuaaguccagggaggaaagaugccaaggagagaggggcaagggugccagucagagaggaccacacuuguucuggguggcccacagagugccacgucccauaaucacuuggagccccagcuuguacauuugaaagucagaacaaugaugugccugccuccugaagcugucaucaguaccuguagcuacucagggccuggccacagugagcacccaggaaguggugaauacacuuccugcuucuacugcaaggcaauucccuguguccucccuagaacgugccgagcugccugucccugccagagugcagaugagcaaggcgaccgcucagccccaaaguuugcagacaaagcuuuucauacuccuuaagugggucacagugcauaugaaaaaauaauaaauacagugcacaugguagaaauacugacucaccguuuuccauuucaugugcaugugugcacuugugugugugcucaucauggugugaaugugguguuccaugugggccuugguuggaugaguuugugaaacaugcugucucaggaccucagguguggggggaagucagguuucaccuugaaauccccuuucugaccuugagauuuugggaguaauucuuugcccuaggggaaagccuuuguuucuugggucucuguuuucuggucugaaugagggauugggggauaaagggaagacucccacccaggucucacgugcgacugguucuguaacagcagcugccuggaaggaagguccuccugaugauaacgccaaacagccucucaccauauuucugcuuacuuuccucuuguuucccucuggcucuuagaagcuugccuucccacacucauggggucaacaagaaacaaaggccuguuuucccaaaagugcuucugcuugggccaggggugugguggagaguccccgguuggagaggcugcuauagcaguauuauccuaacccaggaaggucacucuggccucugacaagaugcccuggcugcagugcacagagcuuccagccucccaugggccuguggacagaggaccggcaggaggagcagggugugcucaucucuuuggagagaagccugaguccuguguccuccugccuaaacaaucugcagccuguagcaacucugccccuuagcugggguaggguggagcccagaagaggaccagaggcuccagauagcuggagggcuaugugggggcugaacccauaacuuggugacauagcagagucgauggccuacagagggccgucucuuuuuuuggaaaaugaaucaaacaaaacuaggugaagcucagccuccuaggaaaccuggauuccugaccucuggagguauagaauuagggcaggaagcucaucagaguugcuuugcugacagcguuagagcugaggcguuccuucuggcuggauuuggguuacagccuagauauuugcccuuacucucgcagcacaagauucaggccuacccagacacagaugguuguauccugcccccuaggcagaggcaggggaggggagaggugcuggcugaggggcucccuggagccauugguugagucuguucagucuggaaaugcugcugagugcagagcagcagggggaccagcucuggaaccagagugccuggguuugaauccugacauggcuacuuccuagcauugugaccuuaaaucaaaauuacaguucugcguuguuuaaugacaggcacacauccugagaaauguguuuucucaggcaguuugguccuuguguaaauauucuagagugcacuuacacaaaguuagacaguacagcuuauugcacaccuaggcuuugugguagagccuauugcugcgaagccauaaaccuguacagcauauacugcaauaucacaagcaguuauaacacaguggcaaguauugauguauccaaaccuagcaaaacauagagggagcuguugacuaacaucguugugcggugcaugacugcaccuagcuucuuagcagucugcuuccuugucugcgggaugagagugacaguagugccugccucauaguguguucggaauguucagugagaggacacgggaagaguuugcagcagugcgugguauucaagggcaugggcgcaaacaugagcaccauugugcccugcgccugugcuggugcuguuguugcugcuuccccaucggcagcaggggaagggggaacacugcacuacugagacuuggagggagcuauuuucuuuuucuuuuucuuuuuuuaaguucaggggugcaagugcagguuugucacauagguaaaguugugucauggaaguuuguuguacagguuauuucaucacccagauauuaagccuaaugcccauuaguuacuuuuccugaucuucucccucuucccacccuccccacucugaaaggccccaguguguguuguuucucuccaugugucuauauguucucaucauuuagcucccacuuacaagugagagcaugugcugugugguuuucuguuccuguguucguuugcuaaagauaguggccuccagcuccauccaugucccugcaaaggguauuaucucauucuuuuuuaugacuacauaauauuccaugguguauauauaucacauuuucuuucucuggucuguaucauugaugggcauuccgugucuuugcuauugugaauagugcuacagugaacauacauaugcaugugucuuuauaauagaaugacuuauauuccuuuggguauauacccaguaaugagauugcugcaucaaaugguauuucuaucuuuaggucuuugaggaauugccacacugucuuccacaauggcugaacuaauuuacacucccaccaacaguguauaaguguuccuuucucuccacaaucgaagggagcuguuuuuuguuuucauuuuguuguuuuuuuguuuauuuguuuuguuuuguuuuguuuuugagauggaaucucgcuccaucacccaggcuggagugcaguggcgcaaucucggcucacugcaagcuccgccucccggguucacgccauucuccugccucagccucccgaguagcugggacuauagacgacugccaccacgcccagcuaauuuuuuguauuuuuaguagagacaggguuucaccguguuagccaggaugaucucgaucuccugaccucgugauccgcccgucuuggccucccaaagugcugggauuacaggcaugagccacugcgccuggccaaagggagcuauuuuauagcagguccucaguacguaccuggaccugucuuccaagagugcugguuagaagcaguacauaaauacaauuuaaaaaguuagucccaaacccucacgcagugcuagugggaaugugagauggcacagccacuuugggaaauagucuggcagcuccucagaguuaaacauauaguuuccauaugacccagcacuucugcuccuagguacacacccaagagaaaugagagcacaggagcacuguacaggaaugugcacagcagcacuauacacaguagccaaaaaauggaaacaguccaaauguccaucaacagaugaauggauaaacaaaaugcgguauagccgcacaauggaacguuauucagcuguaaaaaguauugaaagacugacacaugcugcaaugcggaggaaccuugaaaauaugcuaaauccuugaaaauaugcuaaauggaagccagauuuuuccauuuaugcaagguauccagaagagaugcauccacagaggcaggaagcagguuagcaguuguugagguggggacaggugucaaagggaagugacugcgaauggcuuuucagggggagauggaaauguucugcacuugauugcagaacagcucugugaacaugaugcuaaaagccauugaacuguacacuuuagguaaauuguauguaaauuauaucucaauaaagcuguuguuaaaaagaaaaguuaggccaggggcgguggcuucgcgccuguaaugccagcacugugggaggcugaagcaggcggaucaguugaugucaggaguucgagaccagccuggccaacauggugaaaccccgucucuacuaaaaauacaaaaauuacuauaaaauacaaaaauauaauacuaaaaauacaaaaauuagcugggugugguagcaugcaucuguagucccagcuaguugggaggcugagacaggagaaucccuugaacccaggggauggagguugcagugagcugagaucacaccacugcacuccagccugggcaacagagcgagacuucgucucaaaaaaaaaaaaaaaaaaaaagaaagaaaaaacgaaaaguuaauaccaggauuaaauaaaaaugagaucaucugauuaagagcaggaaguuuuuuuucccuccuccauggaaauagauugggcucuggaguuaaaauauucccuucuuugauaacguauuuacccccauuugcucuccuuucucugugugugauaggguuaggugaugcccgccucacaguaaguaauauugaagagggcauaaaagggaguguaacugugaaaucuugacacacagguaguuaauacaugcuaauuuccuucaguccuggcucagcuugguauguuuuugccuuuuauuaaugcuucugaaauccuuuuuggaaggagauagaacccucacuuugcacaugaggaaacugaggcccagagagguggagagguggaaggcauugcuucauacucauuuggugaggcugagacacaaccacguucagcagcagagcaggggcuuuguucagcugggggccaagugcccaaacaauuacugcguaagagggaagagugggcuucagggacagugagcaauuuggugacacugaacccuggaacaguggccucaaaguggggucugugccuccagggggccgguggaugaucccuugagaagaaaacuuuggaauuucuguugauauauuccaucuaacauaugucucugugugugugugugcacacgcaugcacacucauaauagacuggcaccaugguauggauacacagcucauccagggccuguacugucagcaguuugagaccacggucccaaggaccagggugggagucaaagaccagagaggaagggccaccuuaggaaagccccucugccuccacagugguuccuucaggauggcuucugacacucuaguaacgagugcacuggccacuuuaccauuucaugucauccaguccucacugugguccauggaguuuccucagcaaacaagagaguccaccucagagagacaagaugccuugucuagggagguggagguggggugcgcuuuugcauggggguguugggcucaagagggaagucagagcaacccuucauuugcccagaggguucagacaggcaccugcacuaugccaggaugcccaggaugagaauuucugucaaauagaguaaaggggcuggagcuggagagaggagauuaggaaagccaggacccccaccuugggcaggaaggcccaccuguccuguggcuguggccauagcacucagugugggucuccccaaccagaagguggcaggggcuuggauccaggcuuccuggacuaacauaaagauggggucugaggcugccuccuguacccucuccuucucaagaaacacccacugcuugguugcagagcaacccuacccaucucccuuuccuggcuccuucucaaggacccuccaagagugucuggaagagacaccugcgggccacuccacugauggagagcacugagcugggcuugaauguggcuccuccucguguccccccagggucaguguugaggcaggaugccaaugguguaugcugaaagggugaagccacugaaggaggcuucccugugagcccagccuccaucccaccugcugugccaccucccuucugagcuggacccacgggggauggcugaguccagagaccccacaaggaaaggcuucuuggaccuggacauuuaaccauggagaaaagagccagcagccauguaggcaagggcucugcaaagccagcagcccuccggucugacuccugcaggcaggcaucaagggguguagaaagagguggcaaguaggucagaggaaguaacaggaagaucacaggagcuugagguggagggacaaggagguugcaccuaaccuguuucugaaaggaagaaggucgggguguggagagugguuggucugagcucagcaugggcaccagacccagcauccugcucuugagaccaagcccccauugacugucagcaaggagcuugaggcuggauggccucuggguggaaggcagcccaacugcaggccaccccucagauggaucagaagcaucuucugcuucuucaagaaugagaacaaggaaauggugggcuguugggggugcucaguggagaagccagcagcuguccauuagugggguggagucaguguggaguguguuaaggacaggggcaccccugguguggugguaaccauggcaacccaucugcucucccaaagcauccuuacguugggagaguaagaaagaggccagaggguacagggcuaaacaagucaucuccauaaagguccucuugccuagcccuuugccucaguagggauuucuuaaaggcauccuuuccugcuuuugguuuucugucccuaauuucaguguguaacaguuuuugcuguaagaaaaaaaguuacuguuugccaugccagagcugguguggcagccuuugcugggcucugcuauggcccugggaaggugccgugggccaggcugccgggcgugcuccuuggccgccucuaaagaaggcacagugcacccaccccacagccugcucucaaggauguggcuucucucuggcccccuccuugccucuaaaaauaacccugcuauuuugaaacugccuccucuggagcuuuuucuugcuucucugugggaucagcagcccuucugagaccaggaucucagcugccccugucaccgcagcuguccccauccuguccuccccugcauauccccuccagugcaagugggaugucgcucuccacguaggagggauguuuagcuggguguccucuggagaaggccaggccugucccuguccucccugggaugggcacaaaggaagaggagcuggggcuggagugagggagagcacuccuagaggccccacaggcugggagggucaggaauggccuggggcuguacgacaucuguggccccauuggcuggccucugggugacucucugccgccuucuuccagcccacgacccuuccucagggcaccaucaacaugaaccagugcacagaugugguggauggggagggccgcacgggccagaaguucucccuguguauucugacgccugagaaggagcauuucauccgggcggagaccaaggagaucgucagugggugaguaugcuggcacuguggaacaaggcaccaccaccugccacagggccaacaccagaugggccgccugccccuguggcagugucgauguugucuacuuccccgugugccucuauucuugggcucugucucuguucucaacaccgcugugugcugagcacagcagaaaucaggacauucaccauuccaccugcagccucuggggccccucuuugcucuggccaccuuacccuccucgggccuccccaccauugcacucaccacacccccaacucaccugccccuccaccuggaaggggaucagucccugaaucauaugaccugggcacgcccucccccagucugggauggcugcuccuccuuccagggcuggugcugggcuccaccaccuaugaaagcgccagguuaucugcuguguccacgugugucucugucagugguggugggggugggaggugucucagucacauccccagcaccucacacccgagccacucugcugccacugcacagauugguuucugugaguggagagaauggguaagugucucacucacccagguccccugagaguggcgaacuggcucagguugagagagcccacaguccaggggccugagcgcagugcugagcccagggcagcaucugccuucccagagcucccagucuagcagggaauucuuugcuacccacauggccugggccauggugaaaagccguacauaguccgugcaggugaacaggcucauugggccugacaggagcucacaaacuggaucuccgagaaucccugucuugcuuaaggcugagaaggaggcacaugagucuaagaagcucugggagaaaguaaaccuggggcuugcugggccaggcugacuguagcaguacagaguagagggaaucaggaauacgaagcccuugaguuugaacacacagaugacucggagcaccagccuuucuuuagccucucagcugcagccuggccaagccuggugagugagcacagcuggaaguccagggccacauggcaaggcguccaggagccagugcugggucccgggggcgcucucugcgggggugugcucuccccuagaguccuccccuggagagaggcagguuugcauuucugagcaccuggagccgagcuggaggagcacuucugucucccacaaucuuaauccagaaccauaugaucaagaaugucaagggccucugaagaacccucgugguacagucgaggagacccagggccuagagacaggagccuggccaggggcaccuucugcacuuucuggcucacaccuguuucugcuguuggccgggcagcacacagccgaggcuuccucugcccagguggcuucccuaggaaacccucacccuuuccacaggagcugggucccagggaggguguggguaacaggugggauggaugggaguccugggucuccagggcaagcuggggagugucuggagcaggguugguucuaggaccagcacauagagguauguguuguaccaugugguauuaggagagggugauguuuagcauuuggacugccuccagcaggcagcuuaaguccugccagaaguccucacuccaucccaagccccucuccugggucacuucucugcucucuucuguugcauauucaggcuugccauacccaugcagcuuggguagacaagaucguuaauggaccaagguaccgggugcacaugccaucugggcccuacgugugugguggcucaguggcguauccaaagccagaauaagcugccugacgcucuuccccuuccccucgcccugguugugggccacguuaguucguguccaacaggcagguucucacguggcauaaccucgugauccgcccucaccuucccacaagcugggaugcucagcugcgugagggagucagguguggccuaugcacccuggggacaagugcuuuugccuccuucucccauuccucugucuccugcccucgcugacagcccccuuccucugcucccucucuugccucccucuguuucccauuauaacuccucuucccaguaaccucaucccuaggcucuggagcgccauucugggucugagcucucuggucacaucaaagcuggucccuaagaaggugcagacacuuccaccaggcagcugggagcuggguggguuggggacagucccacccagucuucuucccaggucuucucugcauagcccugacagcugcgugggcugccgggucucuccugggccuggguagaggaaguuggcagcucuuuccaguucccacuuccaggauucugggccacacuuuacauagcucuuuuagacgagguggguuuggguaggaguuggcaagggagcucuucugugcucucagcugggugaagucuggacuucccuucucccugcccugccuuuuaaccuuacccacuccccuguucucacucauccgggcucugccgucccuauccggggagccccagcaccuaccagucccauauucacaccccucuccucucuucuugggguuuguuuuguuaacauuuauaacacaucuggaugauguuagacgcuuccuauugggcuuccuugagaaauccaagugcagaggacacauuccaucaucuauuccuggacccugcaucucugcgacuccagccacagacugcagucugaacagagauuaaguugcauaaugggacugaggccacaugagacaccugcuguccugacuccucccgaguccuaggcuugcuggagccagcccaggagagcucagcagcuccacguagucagcagagcaccugcggugcagccuucuccccuccccuccagguuccauccugcaaggccauuagucauugcugacugauggaaccugggccagucugcaggggccugggguaccuggcaggguucugcaccuccagcaugcuccacaccuuggugaaguuuuaagugcagccuucugcaggcacagucccucagaguggucagaagaaguggcagcugccauggcagacuggaaaggcaaaccucuuuaaucccauagggcuugugaacaucccagguuguaugagcgaggcccucuccugggaccucugcucccagccagccuugaugagaagugugaccagggaggagaggggcucaggacccucagaaggccugccugucugcuggcuuugcagauagucacagccuccuuucuuguuuuggggccguggaggaaugacccacaggaccuguggcuuggaucucuggcauugcagguguuuauucauucucucagcaaaucgagcaucacuggcugugggcugagcugggcugaggguggccccucagcucuguugcugugguuccgugcauuaagccuggccucugccgccaccaccugucaacagcacacccauccugaggcugucucagaagccagugauugugacugacccuuccuuugucuguuugucccuccuucccuccuuucuucauuuucuccuucccucucuuccuguccuccuccccucccucccuccuccccaugcucuuccucucuucgcuccucuaucccuuuucccccuccccuccucuccucuccaccucaaauuaaagaaauaccucugggcacagaagacucgagcccuucuccugccccaggcucagugugcugcugggugcugcacccgugugaucucuagcaggauacagcaguacagacccccccauccccaacccugggcccaggcugccagcaggcccagcguggacccuggugcugaaagaagaccuggagcggugucuucugaggcuccuuccacucuggagaggacacuagggcugcccuugcacaaccaggcccagggcuggagcuggggcuucagaggcaggaccuacacugcccuccgcuccucccacccccgucgucuagcccccacaggacugacaggcagcucuggcaaggcaacugcuguugguuccuuugucuguuguaaaauucuauaugguggaaguaguugugccaugaucugaucuagcuccugauuucagaaaugagaagauugaagcuccuaaggggccaggagccacccaagauugugcugggauaguggcagaaccagauccagagucguccugcuggcagcgccugcuuuugcuguguucccuugcugcaccccuggugucuauccagagugaacuugccacacacaaucccugaugggucccugggcagcucugcccagccuuccucaaagccagggugcccagcacccucccucugcagggacugugggaguucagcaaccccccacacccuagucccucaagaguacccauugugggaacuugaccagcacagcuccuagauucuggccucagggccagcaccugccucuguugcccuaaaugggcacagcucgucuguacucucaccaagcccacucugggagagcaguguuagggcaauuccaggcccuggagacagggucaguaauggaaguuacacauccuaugcucugaggccauggccaggccaggccucucugccagcacggagucugugucguguccugagccugcuguggguguggcagggucauuguccaggcuugcucuguggcacuucuggccccagcguagcagucugucacuggggacaaugcccugcucuacuccuggaccacccggcaagggccagggcuccuaguccccgagugccagggucuuaccugguacuugucuccuuuucucuucccagguggcuggagaugcucauggucuauccccggaccaacaagcagaaucagaagaagaaacggaaaguggagccccccacaccacagguaggcaguggguuugccagauggcauccccucaguggagccagggcuugggaagaagugagggcucccugagguuagagggugaggacacagucaggccagggcugaggcagucaccaacucugcacauccuugcuuugggcugcaaucugcaagauccucacugagccacaggggaaccacaacagggacaggguggccugcuagugugcucuggggcugcccaagggaaguuuccagccagcuagcaguacacagcugugaccccuccccucgcuauccugcuggcagcuggggaggggcagcacgggcagccugcagccacagucaaaaggacucugcacccacagauggcccugcaggcagccggaugcaguaggauggggaggagaauucuggagugguauggcccauaaggagcucacaggggcccuugcugcaacucccaugugaccugagcagggcguggcugacugggguggucccucaaggcccaguccuuccccacaggccaugauccuccuucccucccuggccagugugcaaggcuuagggcauagaaggguccuacaccgccuuaccacacuccccacguuccuggggccaugggggaaugagguaaccuuuuuugagccucaguuaaucaacuugcaaagcaggccuguugcugccuaaucgccaagauuguugugagcaugaaaggaaguuuuggaccuauuauagguucucaguaaauguaauuccuuucccucuguaccauacgcuacucuucccaaguccugagccucauagucacccgagagggagcaggguggggaugggggucccuugggcaucacaaggccagaggcccacagaagugaagagagccagcccacgggcuacagaggucagggagcaugcacuggucugggucccuuucucuccucagccccuugggcugcccuuggauauaccugcccugggcugcuguauuggcccuccugcugauggagucagccugggccacucucagcccauggucauccacccuccauccuggggucagggaggcaggugggggacacccaagccaacauccgcuggaaaggagaugucgcuagcaagaagucagcgaaaaauacagagugguuccugggacugaaaauggagcuuccugcuggggaacagcaguuaauacguaaaucccccaaagcuucccaguuggagagaaacaaaaaaaucacaggcagaauaacagcguuuaggguuacacugcguuuccauggugaugccuuggaaacagugcagaagcggagcuccugccucuaauaagguaacuccaagugcagaagccgcucucagcccaguccagggaacuugcuugcucucccucccucaugacacccagcuccccaaaacagcuacccaugaccaaguuucaacuuuuuuguugguagaaggagccacaugaucccaggguggguagguuacccacuucacugagggucucuuagagucuggagcacaggguuccuagccuucugcacucaggccccuccuaagacaaccuugcggggucucuccuuucuacccuuuggucccgagagcaucccauuugaggcugcuuguuuccagaagcuuugaauuguaaucagaggccaucucuuugucaagucagucuuguggggugacgugggggcacugcagaggagcagcaggguccaugguugagaugggaucuuuggucaggccuccccucugcaugcagccugaugcuaaaggcauucucauggccuaggguggggcuggggguaaaccucacaccuucagagcaccuggagaggcgagaacccaagacccuauauuucuuucuccauggcccaguguuggcccgggagaguuucagauugaaccaguggagagcuugaagcguuggcugccuguugugcccaguaagaaucagcuucuccccuuaaggaacucaggugggaccuucuggaagguucugcuuccagaaguuggggccaaggaucgcacugcgggagcagcagacagccuuucagcugagggcgggagucucaauagagucuaggccugggagaagagaagggcuuggcccugacaagaguuuccaaagccuguggccugagaggcgugggcuccaggcaauaaaggaaaaagccuggagcagaaggaaacgaugacccauguaggugugaagggcggaaggauggagaugguugggaagcccagagcuguguuuccagccaggugugcaggccccgggucuccacuccucugguggagcugaaggaggcccgcuccuccaucucccagccccccagguucuucugcuuuucucuggcuuucuucugaguucagugugagcccagccagcaccaccaggcccacaugugugucuccuuccuuaagaauccuguuuuuuacugggaugucuacugucacccccacuccaaguuagaauucuuccuucccguugguugccaugcuccguguuccugcuagggaaguggggagccuucugaaacugcugcagagagaggcccugcuuggcaagcaaggcucuagagcaacuugugcuuuggggaagcgcugcugccggggugggcaguuagggugguucugcccugggucuucuucccagggcagcacagcugcugguuucccauggguaagcagcccaggaugcugugcuuggugcagggacaggucguccuggggcggcauccccuugggucauuggagcccuugggaaacuugucaggagaaaccuucacuguuugcuuccgagaagcuggcuucuucugaggggagccuucagccugggagucugucugcuggcagcccuaagcugaguagguggucaggugugcguccugggucugugggaagagccucccugcuuuuauccuguccgugaggccuggaauccuugcaaaagugccaacagcuuuggacccagagccccacccaaggcagugccccaccaccccauggccuuccugcuucuggagcacgugguggaaacacucagacccccaugcugccccucacuggcugugugcgugugggccugcugccucuucugucagcgccugcggccucccuugggaggugggugggugagacuggauguauggaucccagccaggcuauugauaaauagucugguggugaugcugcaucugcaagugugcgcacauacaugcauauaaagaaccugugucaucugcaagccucuccaagggcccaagccagagagagacuaaggugguuuucuaaaaaugaggcuuggccaucaggaugggagugggaagugggcacuuguauaucaugcucuugucuuuugcgagagagcugagaugugcuucacuuuuggagaggggccaaagccauccuguuggcagcccucugggcaggguuguuggggcccaggaugugaccuggcacugcggagcagcugaggaucacagcccugcuguugccuggauucuguguuugcagagucaaguuaggguucucugcccagggacugccucugcaucugccuaaaugccugccccacaaacacuucucccucggagcuaccacuuccagaaccauggagagauuggggauugacaccuuuuccaucugggcuacuggcuuguaucuagcuuugugugugagcuugugagugugagagagcaagcaugugcacaugaauguguauaugcauuugugagugugugccugugugcagauucaagugggguauuuggugucuuuguguguucugucugcuauaauaaaauaccacaggcuagucagcuuauaaauaauagaaauuuuucucacagcaggcugguuaguccaagauuaaagugcuaguauuuugggugucuggugagggcccccuugcugguccucacauguuagaaggggcaaggcagcucucugaggccucuucuaugaaggcacuaauccuguacaugagggcuccacucucaugaccuaaucaccuccuaaaggccccaccuccugauaccaucaccuuggggguuaggauuucaacacaugaguuguggggagacacagacauugaaaccauagcauuuaauuugcaucugacgacucuuuccuucacauagcgucugggcacuccauuuuagcuucuuaggggcaaaaagcagaggguggguaaggccacagggcuggcccagacuugggcgcugugaacuuguucuugcauucacuguaaggagcuacagaugaugcuggaccugucucgaggguguguucucuuuccuuacucuguucugucucaccuuauuugagucuuggaugucuaggaaugacagacuccaaagcaacuacuguggucucacuguuuuggggcaguaucugaagauuccaggccccugacauuguguagcuggcccgggugcccccuauagcuaggcagccaggaccugugacccaaccugagcugugugcuccugcaccuucacagacaccacuuucuccuccuccaggagccugggccugccaagguggcuguuaccagcagcagcagcagcagcagcagcagcagcagcauccccagugcugagaaaguccccaccaccaaguccacacucuggcaggaagaaaugaggaccaaggaccagccagauggcagcagccugaguccagcucagagucccagccagagccagccuccugcugccagcucccugcgggaaccugggcuagagagcaaagaaggugagcggaggccaggcuggcuuguaugcacgggaauggcccucccucccaucagagcuggcccuggggauucagccaaggccuguagagcccagucgcaagccuggaccucgauucccuuuguccaucagcccuggggguagcaccuggccugguauguucugagauucccgggcuccagucuuggccuugccccuucuagcucuuaaaucccaucuuuaaaggaggaagacagcuccuguucugucagccccaguugcuugucaggagaaucaaaaacguuuugcagcagggucuguggaugggaaggccucugucacugcaccaucguguuucuuucugugugcauccugccccaagaagcugcagucagucucaucccucucaccauccgcauucugccugggccccuggcagaaggaggggaaggggugcuggggaggcagcaguuggcauccucgugcccugucuuuuagcacuuuggaauuaccugagcaggagcaggucuuccaucuuugucugucuuguucccaggcucuagagggcucuguaagacacaggcuggguuuucccaucuguauuuugucuagauuguuaaaaauaagugagcagcaggggccagcccagcucgcucugucugcaucuucuacaugcacucuggguggaaggugucugaaucuuccucucaggccuauccauucaaaaaucuauucacucugucucacuucuguagaaguccccugccccuucccaccaccagaaugcauuaaaagacugaaggggccgggcaugguggcucacgccuauaaucccagcacuuugggaggcugaggcagguggaacaccugaggucaggaguuugagaccagccuggccaacauagugaaaucccaucucugcuaaaaauacaaaaauuagccagaugugggggugcacaccuguaguccuagcuacuugggaggcugaggcaggagaaucacuugagcccaggaggcagagguugcagugagcugagaucacaccacugcacucuagccuggcgacagagcgagauugcaucucaaaaaaaaaaaaaaaaauacugaagggcuuguuggcugucagcuucccccuugauguuggugagaagcgguugguggugggggucuugcguccugagguacagaucugaucuuccagccaagcccccagacuagaacugcagggccugccugccagucuggcugagaggcagccagcugcaggggagagauggaugagagaaaaaagcaugcacgaaauauuucauucccauccaugguucuuuccgucucacucugcccuugaguggggugugcuggauguuagagacgggagguggagaaggccccugcuuggauccuacaugggcuuuaaaaaaaaaaguccucaaagcaaagcugccagcaggcugagugcgucuccucccucccacugucucuuccagaggagagcgccaugaguagcgaccgcauggacuguggccgcaaaguccggguggagagcggcuacuucucucuggagaagaccaaacaggacuugaaggcugaagaacagcagcugcccccgccgcucuccccucccagccccagcacccccaaccacagguacaguugccccgagucgcccucccaggagcucggugguccucuuccuuccccagguccucgacucccccaccaaauggucugcagcaucucccucagcucccuggauguggccagccagccaccugccuacguggacucuggcagcacuagggggcgggggacagagagacuggggagcgccuuugccuuuaaagccagcaggcaauaugccacccuggccgacgucccuaaggccaucaggaucagccaccgagaagccuuccagguggagagaaggcggcuggagcguagaacucgggcccggagcccuggcagggaggagguggcccgucuguuuggcaacgagcggagguaaggagcagguuagaggguugaacacccaggcccacacacaugcacuuccacccacgcacauacacucauacucucuguuucucucacauacaguccccaagccucccuuggcggagcaugcuuucuguucagagcauagggguauuuucccucugggcccagaacucagcucuaguagccagaaugcagaauuucugagcaucagaggucgacgccaagaauagcaguuuucacaucagugccuccuaggacugggaccuuaagguucccugauggguucucagcugccugguccuuguggggcuggaucuuuuccuccugggccauuucuauucucugaaguggcauggaggcagggagucccuagagcuacauguggugacagaggcgcuccucacccuggcagucccagggugggcaaagggcacugagagguucagaggcagacaggcaugcccaggaaggugggggcagcacagguuccucucucaaggacaugcucccuggggagccacagccccaggaaaccugaggcaaccugugaagcagcugagcaccaaauagcauugcuuuugcccuccaggggagcauugcuuuuugcccucuaagacuuugacuggcuggagagagagaaaguuuggacauccgggccuagggcagggaccaggggcacaggugcagaacuugacugcugccgaagaagaugagggcccaugcccugcccugcccuuguucuccagaguuuccuggagaacuagagaaagaguuggauguccucugaggccuccaagcccaaauccagacgcaagugcccaagcacgccuucaaucaggcuugcaccccugcaucuguauacugaggcuuugccuugacagcaggguuccucagccagguuuauggauagacuuacagacuucuggagguccaugaugaccugcccccucaauaaaacaauuucacaguauucuucccagaagagaguuaggguuaggcacucuucugggaagaagacccauaguuuucauuagguucccaagguucacuguccagaaaagagguucaaaccauaguucuggaagucuucucagaguguccucccuuccccagccacaaccuggagcucagaguuagagacgcuaccaggagggacaggugaaggcagccaugggcucccgugccucgaagggcagguggagggaagugucuuuacauccugcccccuuuucuucugagcacccaccauuggcugacagcccacccacucuuccaaacgucccagaugaaaaggccugugagccugcagguuagucuccaggauaaggaagcaucucccagagauacugcuggugagaggaaaaugacacguugacuuccuagggaaaggaagggcagccaagugguucccagccccugccuagugccccagggugcucugcuaagcacuuggcugccuuaauguuucauaguagccugaugaggaucuguuacuaccgcccccaguuauagaugugaaaacugaggcucaggaguaggugacuucucaacaauggauagcuggugcagaucccaguggggccuuagccaggaagucccugcucccauccugugauccaggacugaugccaaggaugcucuuuuaagcaauuaagaaaauauauaaguaaaggguuuugcuagagagaggaggaggccagugggugggcaggggaggcuucaugcuggcuggcaagcaggcugugugucgugguggcuccagagcaggaucagcuauguccugguuuagcgccagaccacagaauuagcauucagcacaccugcuuggcuuggcuucuucucggagagacuccuuuugaacucguucuugucuccugucgccugggacaggugcagucucuggggcuuuguacucugcaugcacugccacacggggauggguuuucaccuggugcuggccccaccccccaccaguucugcauacuaauacugcagcaucccuuucuccugacccuggugacaucugauuggcugcugucgcuuucugaggccugcucacuggaucccuaguagcccacccugugcuugguuggauuccuguccccugguugauuagagcagaaucuccaaauuggcaagagauucuuggccacaccuaccugaaauggcagccacaauaggugugcccaggagccagacugcugggaccacaggguugguuuuuugacaagccacagucaucuaggcaagccuaucugaaccugaccgguucugggcuucgauguguccguuccucagacuuccagaguguuucuuggauagugagucaccucuggcugcugagugggggaaguuguuuuccugguuggccugcuggugacuggcagcaaggacagcuccccauguagcccuaaccccccugcccucagcacagcgguuagugcccugggaacccuggagcugcagggugcaggccccguuuucugugcugaccaguaaggugcuugcugucccaccugcagcuuccagggcaccaaguaauaacuuuccaccucgcccaguagaucagggcagccagugugcgagccuguggucuuacaggaucuccccaggcccccaugcagagugacuguagcaagugccuuuccucuucuccaccacgacuccucugucuggauccccacaguaccacggcaugcgauuugcaugagguuaaagcccagcaguuccucacugcuuuccuggggcuuucuaggccccaguguugggcagaggagcccucauccuggaaguggccuguuggugagccuugaaucucaccaagaucccaccacaaucgcucaagugugguggacgccuggcuugcacuuaccaagcuuucccuggguguccuggaacuccagcagcuuccuuagcuuccugcucucacaaugccgcggccucugcugcuccccuaccccagcgccugccuccgcugcugguucuagcaggcuggcccggcacaagcuucuuuccugaggaagacacuuugugucuaagcacagggaggaagcugagcugaggaagacacuuugugucuaagcgcagggaggaagcagagcccggggcccucgcccuccucucuccgggggugaagacgccuuaggcagccaguuuucccucgcacucccugagaagcagcuggccucuugggggagguggggucucaggaauugaucuuguuuccucucuuccuuguggagauaauuaggcuuccaggcuugggagcccuucacccacuuccucuggguucuuauccucuuguccagagcagcagugacacccuccccgccagguaacuuaggugccccugggagaacaggcccggcccugugagcugagccucagcuggugcgucccccaccucugaccccaccagggugacuucuugcagcuggaggacaaucauggucucucucccucuucagugauuaccuuggguuuuugcuucuuuaauucuuuggauaauuuugguucaccauuauuugauuugaaaaagcagcgcucuuccauguauucauuucccagccuuguuuucuuucaggucuugccucugcgcucuccugcugugccgcuggguggcgcugcgccuccuccacccgcuucgcccccaucuaagcuccgucuccggccguagacagccugaggaggccgccagcccuuucacaugaaaucagccugcuuuguuuuuguuuuaauuuggucuuugauuccuuuuacuguuggcagaaacaauguuaauuccugggccucuuccuugcuaaauuuugggguggggggugcacugugauccaugagggaugcaaugagaauggaggcugccuuccgugguggugguugccuuuugaucaugucuguggcucaggagaggcugccgggugccaagcugugugaaugccgagugggucagcaccacagagccugcagggccucuagcgcgggggcagaggguaggggcaagcgcaggccugaugggagggagggccguggaggggugcaggcagagcucgggucagcugagcacgugucuagacaaccucggugcugugcaagccugaggggaaucaggcccgggccaggccgggcaugggaggagucggcucacugccaccucacagcucaccucacugccaccucagggccucguguccucucuugcaggaggucccaggugauugaaaaguuugaggccuuggacauugagaaggcagagcacauggagaccaaugcaguggggcccucaccauccagcgacacacgccagggccgcagcgagaagagggcguucccuaggaagcgggugagcuccuggggcugggcagcaccucagggguggcucgggggcgggucagcaugcaccccaugcgccaaguccccuccacacaggccugggaugugcuccugccaggcuucucuccaaccaccuccucugcauagugacuucuugagagcaggccugucuccugcagcuucauaucagagccuucuccgucucugcugaaggauauucucaugcauuuuagaucccagauuuaauuaggaucacucucuuccuaucugagacagcccagcaacaaggcugaaugucacaccuuccuaacucuuucuuucaguacaacuacaccccucguuucuccacucagcccaagguagacucggcuucugaaauccuccugggcacccgccugcugcuuuuguagccggccaagucuaagcucaucuucuccuggcuucucucuuguucacaaggugccuagugccuacugucuggcccacagcuugccaccugccaccacagagcccagggcucuuccuucugugacccagagaagcuggaggaugggguggggccaggaaagugacagugacugggaauccaaaagaaaaggcugcucuaucaaccagggcaucucaggacccggguccuguccuggcccugcugcagacuugcuaugguggcuaggcagaucacugccccucgccaggagcaaggcccuggcggcucuuggagggguggacagcaccagcucgucccucacaugcccacauugcccugggcugcacugaccagcggcugcucucugccacaggacuucaccaaugaagcccccccagcuccucucccagacgccucggcuuccccccugucuccacaccgaagagccaagucacuggacaggagguccacggagcccuccgugacggugagcccaggcgccgcguccuccggaggccgugcuccucugcuucuggucacucugaggcgcugucuguuucugucuaugcguccaugccagcugucccucugugcacaggcccucguguccgugagcacccccacccaccgacccacaggccgucgaacacagauucuguuucuucccuuuucuggucccagcagaaccaagggcuccauggcauccugagcucugggaggaggcccugcggaggaggccaccucgggcuaggcagacucccgacucuaggcggcagggcugcagcagggacccuccgcuccucuggcuuugggcauugcuuuuuguggcacuucggaggcagaggccacgucuugcuggagcuugucucguucuccgugucaugccucaaguggaagagcaggccuugcaccagguucuccaugggccucagagcuaugacaacagaggugcggaaggaguggucaggguacaggagcaaggccaacucagcaugcugacccagcuccuacccgcucugucuucagccuccaggggagccuggggccugcucacugccucuugucuccuccuugcugccugcacagcagcucaccaugggccuccggccugccccagggcuugggggcugccaaccacagauugauguguaacauggagugugaggaggaguaagguuuggguuuuuccuucagucuggguuuugcuucaggugucuugaacaaaacuccuuguuucucuguuaacuuagcugggagcgccuuccccaacagagaacaccagcagggaacccaccugcauaggccuugccauuggggucagauugcaggcuuggcuucaauggcacaaccaugauauggaaauuacgaguuuuuguuaaagaucugcaagcuaggccgggcacgguggcucacgucuguaauccaagcacuuugggaggccgaggugggcagaucacgaggucaagagaucgagaccauccugaccaacauggugaaacacugacucuacuaaaaauacaaaaauuagcuggguguggugucgcgcuccuguagucccagcuauuugagaggcugaggcaggagaaucgcuugaacccgggaggcggagguugcagugagcugagaucgcgccacugcacuccggccuggcgacagagcgagacuccgucucaaaaaaaagaaagaucugcaagcuaagcaggcugucagagagggggcagguggcagucccacgucucagguccugugccgcaauggcaacuacaagcuugcaggagaggaccucccuauuuaagggcuacuugggguaggguguccuaauuucacaguguugcuuuugauugggugcuucaaauaacucuggcggcaaggacaguugcacagcuuggcaggacguugggguugaaacagggcucuguagagggacuucuuaucuaucugggucagucuuggccagaccuaggcagcagcggacugugguuccuuccucacuccucagagacaggguucugagcagaggcucccagagcgcuuuguucugguaguuauccugacaauucuugccuguucucacucucacuccuuggaauaauacaaacagacaucaaagcuagcuucugcucagauggcuguagaaaagagagcaccucggaccagagauaaggugacccaugucucuguggggccagccaggugggcuguagauggcagugcugucucaggcuguuccucagggcccaggugugucugggcggcacagguggaggaaggacaagagcgcugugccugggcgcugccccccugucugccauccugcuucuugugggggaauacaggucaagccuauuccugguggagaaauggccugagggucucagcggggcugcagcugcugcuuccucaacaccgcacgucucuguuucccaggcuuccuguggcuucugcaagaacuuuugaaucaauucuccuuucagccuucccugcagauguuucccuucaaauaaaauguucugugacucuucaucugggcuuguuuucugccucccagauaggcccugugcagugggcccuguacaggccggagcccacacugcucacagggcaaugagaccauaccuucucuccugccagccugccaagcccagcaucuccuuccucaaggucgcgugugccuacagaaggcugguugcaggcagcacccaccagggugagggggcugcacaggcuugucuggcagguggagaaaccccuuuccugguacccgccucaucuggacagaaauacuggccccaucagacacucaugacacuagaagaguuuccucugagcuguucuuuuuucucccuuucucagcccgaccugcugaauuucaagaaaggcuggcugacuaagcaguaugaggacggccaggugagugugcaggguugccguggccccugagggaucuggggacagggugagggugagcuguccuuguccccagccagucugcaagugcuggcuccaugccuuccuccuccaugccccuugucuucaugaccagggcuguggcugagacucccaucugcuccuagaagugcaggcacacagccuucauuucugcaguggggggugcucuggaggggcacucgguaggccugucugcugauggcaagcggguguuggcccggccuuagggaugccuuguaacacuagcccccaccuggugaucuuuccuaaaaguuguuuaggggccuggcuuccccagggacaaagaaacucucuggcugugggauuggcuuguguuuccaugcaagccagccaaguagacaguagccuagcacugcaagacucucaugccagagaccccucagcugcaguggcaguguuagcccuggaaggagcaaacaugguacauucuugccaucagacucaagcaggaagagccaucugaggcuggaccugccagcccaccuugacccugugccaugggcuggaaggccaggccucccaaggaggcaugaagaaaagccugcuggguccuuaccuaagaggcccugaugccuagcccauccucacucccuuccugcuuccugagcugcuaucccaagacauccucuuuauuucuccuccauaucaaaugcccuuggccuggcaugaagacucaaguucccuuccuuacugcucacagugaagacuuggucucuagcugguuaguuaccccugcugguuaggaggccacauggccauggcuugcgggcugccaccugcagguggagaugccauuucacagccaccuuuccguucugaugggcccagccuguugucugcagccucuguaguuacugaggaccgcacggccuggccaccagccacaccauuggucauagagcccacagccaaggccugcucagcugucugugcugccucuucacuggagggucacagcuuagugagcguccugagggugugagcgcauggcugccugcaguccgagcagaguccucuguaugcugucaagggaggggccagccuguccccugcuuucccugugcucugggagggccccacaggcucuggcugcgcaccgccguggcguggcaggcaugcuguauaggaguugguagucgagucauuuuucuuuucuuccccuuuaguggaagaaacacugguuuguccucgccgaucaaagccugagauacuacagggauucaguggcugaggaggugagugucugggcuuugccucugcuguggagacagcuggagggguccaggcggcaucuggggcuaguagaucugcuucccccugggcuaauguccccacuucugaggacagcgcccuucggugguguuaccuugccgaagguauguccauguugcccucuuggguuucccagucccgaccuggugggaaggugagcacaagaccagccuuuguccuugugaucauuuuccuggcugugaugcugggcuucgucaaggccuugaauuaagugcccagugcaguggguuugggcagcuuuucuuuucucuguucuuugaaaaacacugaaauuugaaaacucaggaugaacaauuuuguuuuuuccacaaagagauuucaugguaaauggaguuggaagaauugaacuacaucuugugcccugccuucuggacaaggacaggauaggauagaugagcuuuuuugggccccuggacaguccugauucuguggucaaggaccaaauagaagggguucuuuuuuucuucaccuacaaauaaaauaaccucuucuaaacaguuuggcaagucuccuuugccuuuuccccaguaguuucacuccaggaaucccucagauaacucccacauguggaaaaacgucuguuucagguuagucauucccacacguuuguaacagccagaugauuggaaagagccuaaauacccaucauuaagggccgggauauguauuaaauacucugagccagucuuuacagacugaaggagaaaaggugguagugauaagaaguagggguaggagagugugggcggugggccucuggugguguccagcguuggggaaguaaggagccuauguaaguguuugguugcaugugcauagaagagcacuuccgaguguggucuguagaccucugggggucccugaggcccuuucaggagagcaguggugguuaaaauaauuuguaauauuaagaugucauugacuuuuuuuugcgugugaccaucugcacugauggugcaaaagcaaugggagguaaagccacuagcacuuggcacagccccaucuguagcaacaggcuggaccaguggucacuggauucuucacugccauacauuuuaaauaauuaaucguuuuaaaauaaauaagguccuugaaagagcagcagaaguuacuaauuuuaugaagccucaaucuuuaaaugcccaucuuuuuaauauucugugauuugaaaugggaaguaagcaucgccuggcugcauacuagagugugcaggcuuucucauggaaaggacuugugugauugaguugccagcugaacuagcagcuucuuuuggagcaccacguuuacuugaaaaacaacugauaggcaaaacuguggucauuaauuuuggguguuuggcauauauuuucaugaaaaugaaccaaguuggcucauuccucuaaggaaaacaacugacagaauuuguugccagugauauaauuugagcuuccaagcaaaaauuagaacuugggaaaauuuguauucaccaucaugaacuucccuuuacuuacacucuccugaugaaauagguggugguauuagcaaaggcgauauuuuaauauuacauaaugaaauguguagacaauuggaagcugugcauaacaauauuuuccaugugaccaguaccuaauguuacaaaagcaugccuggguuuuaauguaacacaguacagagaguucaugggcaugauuucagauaccacauugcaguuaaccuuuaagagccuacugcuugucaaagaacagccacaacuaccugaaaaagcuauuaaaaauacuuccuuuguuguccgggggcgguggcucaugccuguaaucccagcacuuuggaggccaaggcaggcggaucaccugaggucaggaguuugagaccagccuagccaacauggugaaacccugucucuacuaaaaauacaaaaauuagcugggcuuggugguggucaucuguagucccagcuacucgggagacugaggcaagagaaucacuugaacccgggaggcagagguugcagugagcugaaaucgugucacugcacuucagccugagugacagagcaagaccccaucucaaaaaaaaaaaaaacuuccguauugaacagauggaaugcagaaacaagaauccagcuguccuuucugaagacagauguuagagagauuugcaaaaauucaaagcaaugugacucuuaucacugauuguuaaaucagauuuuuauuuuaaaaugaauuuauuuuauucucaaaugaacaaauauauuuaaauuuuacauuuauauuaauauauauuuucauauauauuuaaauguauaaaauauauuuuauaauauauuuuaaaauauauuuaaauauuuuuaaauuaaaauuuuuaaaauauuuacauuuuaauuucuaacauaguaaauaccaucaauagaugaaauccaccuaacagaagcucuucuagggccaccaguuuuuaagagugugaagggauuucaacagcagcauguuugaggaccacuggcguggacuaucuuuggcuggauacagggacagaugguggugugauugcacccagugaggggccugggucaugcaguaguaggauagacgguguccucacuugucaguguguauacuauuaaaaguaaagucagugcagaaaaucacuuacggaaauuugcucaucuaggcauugguucuacuuccuaaaaaucucaagacauucucacuucccucggcaggcagccgacuuggauggagaaauugacuuguccgcauguuacgaugucacagaguauccaguucagagaaacuauggcuuccagauacaugugaguccagggauggaaguggggccacaggcuugacaggcagggaugcaugucagagugccuaaugucugggcugggggcacuucuggacaggccugaugcagcguguauggucagcacuuagucuuucccacuacccuugacaccucuguccuguggcaccugacccuauuccccaauuugugaugugaacaguacauuagacguuaguaucuuuuuucugaagacugcuuaaagcuuuuuuguuucugaagguuccuuuuuucuuuuguuuuuuguaaugcuggaguuggggcaauuggaaggaugugggguauggggaauaagaaugaaaguguuagucaauuauuuacauccgcuuuuuacucacuuauucauguguuuguucauucauuuacuuacaaggcuauuuuuucccaaaaucuugugagguacucagaugagcaaggcauugcacuguucucaaaaaaaaaaaaaaaaaaaaaaucuuauugguaggacaaaaugguucuuauuggcuguuucuucaaaacuguguggaucaaggacugccugcagucagccagacuccagguuaagagcacaguccuccugacugccacaucugccuccauuucuuuuuuuuucccccaagacagggucucacucucuguccaggcuugaguguaguggcacaaucauggcucacugcaggcucgaaauccuagacucuaacgauccuucuaccucagccuccagaguaacugggacuacaggugcaugccaccaugcccagcuuauuauuauuauuauuauuauuauuauuauuaucauuauuuagagagacaggguuucaccauguugcccaggaggguuuugaaccccugggcuccagcgauccacuugccuuggcuucccaaagugcugggauuauaggcaugaaucacugugcccaguccugcccccacuucugacaccaguugugaguccggagguuuccaaaaccaccuucaguuucaaaaauucacuagaaugacucacaggauucaggaaaguacugucuuuacaaugaguuuuauuauagagaaaguauguaagucagaaccagccaagggagagccauguggaguagaaucugggacugggggagucacagaugccaaaaguuucugcauccuuggggacacgguguccucuuagcccugauguggggcagugcgcagagcauugcccggaagcccaccugagccccgguguugaguuuuaggaggcucuguagcugcugugguugauggaguuguuguccucauaguugaacuccaccuaaagcccuucccgccaugguuggcuacuuucacauggcccaaaccccaacccucugauuuaauggguuuccucuaauuuccugcuucuggccaggccagccucuacccugaguugucuugucagcaugaaguguuagguggggucccaggguaccaccaugaguaacaaagacucuagucauucaggaaauuccaagguuuggaaguuaccucccaggagcuaggacagaggccaggccucucuuuggguaaaguuaguucgucacucgcaagggcuuuaagauggguggagagugugaugaguagagagcugcccccauggggcugggcccuggcccugggacuugguucucacacaaggcuagacucuggugggcucaccuguagcagggucauaccuucaaauuuuggggcccagaaacucaauuuuauugcuguguugagaguugauccaguauuuggggcucacucaguuuggcccaacuuagaggagacugaaguauagacccaaaggccaguguguucauuuacuaagaaaauccuggccgccagcccacugggcugcuggcuguggcuuccugcgugcaggcaucugcgagaggagcugagucacaguuggaggcuacacugacagccuggcaccagggccgggugugaguugucugcucuuaguggccugcacugcccaaguuucaaggcuccucuguccucauccgcugugggagggguaggcgggcauagugcccggugagccuccucuccugccguccaccucccaucuucaugagcagcuuucuccaggcagggcacaccugaagucugagaacucaccccgcucuccuagugacaaaugagggcaucagccacucucacccacugaucaaccccuccucacuucacccugguagggcuuauccugaugacuuucggugauccccaacuacugagaguucuaaggaaugaggagaugcuuccaguguggagaaggcuuccugggggaggcuuccuggagaaggaucccucaaggcucagcaggagggaugagugugaaagcaugucccagacuggacuccagaccugguggcacagagagcacagagccagucuggggcuagagugcuggguggagagucagguuggcgcugguccagccuuuguggagagcacugaaggguguuagaagaugccagucaguugugcguucaugauacaugucuggcgggacaugcagguccauuagaaaggaaccaggcuggcacgguaaagcugggcaagaaaggaaggagcagcaccugggaggaagaggugagggcagggccaggaccuggcaagaaggccccgcccacugagaagccagcagaagagcugacuucacagaagcagggggauccccuggaauuccggcugugauccauuugaggcaugaugggcucucagagaacauuaggcagccgcugggaaagaaaauucagcuggagaaaacagcuguauguggagugcugaggccaaacuccagcaacgcccacaccuggggguggagaaggauggacccaggagaaggugguacccccccaacucagcucacauggauaugagaacugaugaaggaggaccgagcugggcagugguggugucuugaucgggcauguggaggggcaggucaggucccucccagcugugcuuuguggcacgucaggccggugcgugaucuccuguuuuggcuucuggccaggccacuagcacccauccgaaaaccauccucaugauugcauccugccgucagcuucccuacugaccuggcugcugagucugcuugugagcagcucucgguucaaggcugcagcccucgcuucuguugggcaggugccuguaggugcagaagcaggccuccagcuccaugcaggccacuggcccuccccugccugguacccaggcaggucugcucaggggcgcaguggucaugucccagagccaugugcucuuugcugcuuuguccuaccugcugccccguuccucgcccaaaacaggcuccuccccugcuaccuugcacaagcaccgaggacaagcccuagacuccaccucauccaagcaggagucuagggcuugucuaggugcuccccaacccaaccagccagacgcuguucauaccccuuuuguuacuucugagcugcccuguccccugccaucaccuuaauucucaucacuuggacagcugcaguaaccacccagcaggucucccugccuuuucucagugccaccaacaagacccugauaccccuuguucuuaaccacucccugggcccaucaugccaugugccugugugagugcagacugcaggugccacuccccacgcccaacacacacgcccuuccggauuccccaccuccaccacugcucagcacaugcugauucugcccuucccccgaggcugggaacuccuuaaagaggggugcagcauccuccucugucugaguggacaggcugcuggugcguagugggugcucaguaacugugagcuuguuacugagagaagauaccggauuuaccauugccacaaauacacgucccucccacagcuuugacgucuccugcucuccagcucccucaugucccaguagugggcacauguggcacuccuagaagggucacccagucacagccuuucucccugugggacuuuacccagugcagggagcuucuuuggagauggagggcagcaggcacccuaggggacagucacugauggugccucaucuuuucucuguagacaaaggagggcgaguuuacccugucggccaugacaucugggauucggcggaacuggauccagaccaucaugaagcacgugcacccgaccacugccccggaugugaccagguaggauggugaagacaccagggagcccuuugugccucuugugggugccacucccgccagggcagugucagacucaggucugaagucugagaccugagcucagugcaucccagucugcugcuccuuccuuccuguguccuucuguugcucagguuccugucccaaguaaucagaacaaacauuucugguucuuuucucuuguaagcccaagcguuucaucuugcagguagcaugugugcuggucauuagaacugggcuuugguggagaaucuuccaucugugucagcaggcacuuggccagaccagccugagccccgcagucggugcucucaggccuugggcucugcugcucuaaggguggccccaugugcggcauccauaggccacccagugcuucuuugucuuggccuucuuuucaccucacuccuacgucuguuugauuucugugcagccaauuugaaaaacccucuccuguuuuugcauucugugguucaugugucucagauuuugcuuugggcuuuuuuccuccugcccugaagguuaaagaccuaguucucauuuuaaaagauggagaaucagaagacucagacauaucuaaaacaaaacaaaacaaaaaaagcagagaagauuccagugugggggcugguccuuugauggccagaacucugcuguccccaccuucagagccuccacgcaucugagcaccucuggugccauuucucaggucaugugauguagauuacaucucgaauguguuucuugugcuguggguuaggcugcuuggguguggcaaugucacagcgggggcuguccauggaagcuuugaccuaaaagcguguucuuuuuuuuuuuuuugagauggagucuuguucuguugccuaggcuagagugcaauaacgugaucucggcucgcugcaaccuccaccucguggguucaagcaguucuccugccucagccucccaaguagcugggauuacccaccacacccggcuaauuuuuguauuuuuaguagagacgggauuucaccuuguuggccaggcuggucuugaacucgugaccucaggugauccacucgccuuggccucccaaagugcugaaauugcaggcaugagccaccacagccggccuaaaggcacauucuguauccaaaccuuugccuucuuccugcggacuccacaccucuuuacauaagaaggaaagaacuccuaaauugauuucuuuauaguccucuuuucugugucugucauuuguucaugacuucauuuauuaaacaaacacugucuaguaaggccaagaggccgugaccgggacagguugcccucugucucucaggauccuaugcagagagcuggcuuguugucuagugacaaguccucuuugugcacagccagcaggaggcacccagagcugcagcaagcucucccacccuccaggggccacauccugugguggccucagcuacugcuuccauggcucucccaucaggagcagacacccaagcuugacaagcuaagugcucuuuuccaagcaccuuuaggaagccaccagagcaaagugagaaaggccucagcuucuuugcccaagcuauuggcagcagacagagcuuaucacggggguccaggauggggaguggugggcagugcauauggguagcuggccugagguccucuccugccccucuucccagccaggccugggcucggugcuguagauuggcaauccugucuggaagaagucagcuuugggaugucccagggcagaugucaggaaugcaccugugcacaugccugugccugcacacagcucaggagaggcgccuccacgcuugagugccugcuucccugcgugcaggggcuaugggcccaggggaaugaaugaggagacaaggguuuggcucucacaugaaaguugaccuggcaguuggccuccugacuaagaauuacuucauaaccuagcauaucugcauagucugguagagugcucacccuccaccaguuuguuuucagcauuuauucuuccucuguguaggcuuuuauuauuugaggaaaaaugugaguuuuuuagugcugccaggcaaaaucucaaggaggcaugaaaacaaacugcagucucagaagcugcuguccucguccugcucucaucgccaucuugaaguccugggguggggaaguugcagggugcuucccgccuuuggcacuagaggagccuuguggggagguuucuccuagggagugcggccgguucugguguggcugugacuuuggcggcugucagggccaggcugggggccuccaugcaugcccugcccuaugugucauccugacacucuccauggccaggagcucuuaguucagugacgucacaagaucugcccugugucguuuucauccagauguuagcgugcucuuacaguggacaccugcagauccuguugcugugaagcacuuugccucucacucgauugcugccuggacaggugacccuugcuccagguggugacggcaaccauuuccucuuuuccuugguucucucucuaaagacuccuuuccuuuuggcccuaauugaaacacaugugcucccuggagcuccuccuugggcccucacuguccucaggugggcuugcaacugccuucugagggccugggugagauuaggggccccucagucagccucggaccagcuggcagucuguggggccuaucucuagagucuacaaaccuuugccucaaacacucccagccuccuugacaaauugccaucagcaaugucccugucccugcccuacugcagacgaggccuccccaggaaucucugcuucuagcagauggggacuagacauggauuccucaggcagaccuggcuucacuccacuuacugcagggcagguagcagcaccaugagcacgaccugcgcagcucaugucccguugcuggcugccgcuugccugcucaagguggcagguaacccaguguccuucuccccuucugccuuccucuccaagccucuggcuacugcauggugugaacucguggccaccugggccuccuguuucccucacccuuaggaggucccagucuuucauacugauccaucugucaugccagcagcuggauugggcuuuuaaaacauagauucaggcugggcacaguagcucacgccuguaaucccagcacuuugggaggcaggcggaucaccugaggucaggaguuugagaccagccuggccaacauggagaaaccccguuucuacuaaaaauacaaaauuagccaggcaugguagcgcaugccgguaaucccagcuacuugggaggcugaggcaggagaaucgcuugaacccagcaggcagagguuguggugagccgagaucgcgccauugcacuccagccuggguaacaagagugaaacuccaucucaaaaaaaaaaaaaacaaaacauagaucugaucacguuaccugcuuauuaaaagguaagcccuucuagaaagugcuaguuuucccucauucugucaccacuguccaguccaggggugcacagggcccaggccucaccuggcagguacgguggcugugcccaggugcagccuaauguaguucuuggcccugagcaaggcagggcuggcccguccugccucugaggcugugggaguccugggacuccccuggcuccauacccuggcaacgggaccaccacagugagccccucacagccucuucagucaagggacccccccagugucauuaugugggaaaccucagcuuucugaggcucuuuucccuuccuuuccccuuccccuccccgucccccucccccucccccacucagaaccaguuugggaagggaugugggguaaaggcagaguauuccuguccucccugcacuuaggaagcugggauuaggauagaaaaaggauguggugcucacaggggcuggguuguggcucagcauugccagcuucugccuggcaggccacaccagagccgccccugacaggcuauguccauccuccugccccacagcucguugccagaggaaaaaaacaagagcagcugcucuuuugagaccugcccgaggccuacugagaagcaagaggcagagcugggggagccggacccugagcagaagaggagccgcgcacgggagcggaggcgagagggccgcuccaagaccuuugacugggcugaguuccgucccauccagcaggcccuggcucaggagcgggugggcggcguggggccugcugacacccacgagccccugcgcccugaggcggagccuggggagcuggagcgggagcgugcacggaggcgggaggagcgccgcaagcgcuucgggaugcucgacgccacagacgggccaggcacugaggaugcagcccugcgcauggagguggaccggagcccagggcugccuaugagcgaccucaaaacgcauaacguccacguggagauugagcagcgguggcaucagguggagaccacaccucuccgggaagagaagcaggugcccaucgcccccguccaccugucuucugaagaugggggugaccggcucuccacacacgagcugaccucucugcucgagaaggagguaauagccugggaccagauccccacccugcucccagcagccuuuccagagcaucagcugugcccagcuguggccugagggguucaucuagacaguccuacccgcgagggacuugcagaccccuaggggagacagacgcauagaugaguccucauaguugaggcagaccugagagcugugggagcgugccagugcaugcagggcagggaaaggggccuuccaggcacagaggaauucuuccgauggugggggccccugccauugagaggcaagcggcguugcagggccuagaugguuuccucguucugacucccgauggcaggaggggcgcgagcagggcaaggcuuuugcauuacgcagcccuggcuuggacaggucaaagcuguaggcagagaccagccccaggugcucuuacaguggcuuggggacggccgaucagaucugaagccaggggcauccagcaggagaugacagcuggguccuaggucaugaggauaugaagcagaagacaguggugaggcaggguaggcuguggaugaaggcugcccugugacugucacuccuccacgaggccuucagugcaccuagguacauagaugaacaagcuggcccccgaacuauaaaauaagauguucuuucauggaaauguaugcagaaauccagucugcagaacuucagugguagauugacaugucugggcagggagucucguagcuggggagguguagcguuacaguuuuuguagaacucccuguuucacucuccauuuagggacaguuuucaacacuguguuucaaauguguucucuuacguaaguagcuuguuaaagauuugccacuuggguaugccucaagcuucucaucuuuuuuguauuuuauuaacuguaugaggcugaguuaccaccagcacuaauacuuguacuuuuucauuuuccucauccauuaacaaguaacaaaggcaagaugaaauaaaauaacaguugaaacucacauuacuucaggcuaccaaaaugggccagccagcaggcgacacacuggcucaacaaucuggggggucagucuucacuguuuaaaagucaggggucggcugggcaugguggcucacgccuguaaucccgguacuuugggaggccgaggcgggcggaucacaaggucaagagaucaagaccauccggccaacauggugaaaccccgucucuacuaaaaauacaaaaauuagcugggcaugguggugcauuccuguagucccagcuacuuggaaggcugaggcaggagaaucacuugaacccaggaggcagagguugcagugaccugagaucgcaccaucguacuccagccuggcgacagagcgagaguccaucucaaaaaaaauaaauaaaagucaggggucuccccgccucucacagcacagucugucagcacccugggcggcacuggccugacuguccaccacacacacagcuccauucagcacgagcucugggagcagguuggguagcccugcacauggccaggcaucaggaggcaccugggagguguguagggaagagguggauggaugaaugaguagcugaagcuguugaaagcaagaagaguguaaaauagcuuacucauggguauccacaccuuguuugagggaacugcgggaacucuuuuugcaaacagaacuuuguggaauccaucauguaaagcuggucaaauggagugguuucaguugagaccauagugggcccuggagugaggccugcuuggggccaccacucacaguggucccuguagagccuagccuggccugugugaccagcugaggacacccaaaggaccccauggggugcuuccuccagaugcagaugcaaaacccuuguuccccaguggacacauuccccuucucagaaaugaacaccccguaugggccuuggcaccuauauagggcgugcauguuggaaccuugagcaggugugggaaguaugugggcauccaggggugccuggaguagggaaggacaagguagucccuuggugcccauaagguaccaagucugccauuguuacugauggcuugcauuggaaccuucacuuccaaaugcugcugguaaaggccauaucagcacaucugcugaaauguggagacuccaaaacucuugggccacauggaagaccagugaaagagucugugcugugcagcugcuuuguuuaucauugucauuuugcauaaaagugugugucuuuuugccaacagcuggagcagagccagaaggaggccucagaccuucuggagcagaaccggcuccugcaggaccagcugaggguggcccugggccgggagcagagcgcccgugagggcuacgugcugcagguaggguggaggggcugcuguggcccauggugcgcucaggagcuucagugugaaggguucaugcucaggcaggcuaggagugugcaaaacuuggcugagcaggggugucucccaggagcucaugccccugggcuuuucugccacaggacuggacacucaaugugcuugggggggucuguuuguuuuucccuccugauaugacauuuuggggaaucucccugaaaccucuauaucuaaggacuuuuuuugguaauaaaaugauuuuggugaccuuucccuuugacucugaaaguagccaauauacauuuauuguaaauaccauacauuugcaugugauuucucauaguuuucacuauaguaauauuggaccuauuguacagauugaagacauugaaucacacagcaaguccagugccugcuuacaaccaacagcaagucaguggcaaagcuaguacuggaccccauucccaucuguuucuauaccacaccuggcaggcagagcuggggcucuuaccacuacuagcccaaccccgggauaccuccacugagauccuguaccacagagcccugauauaggggugucacaaggcuggagcuagccuggcccaagggcgugccuaugucugcugacuuuccugcagcgugccaggccuugugccagguauugggcauaaaacagauauacucuuguccccauugagugguagaggagauugugauaggaagauugauauauaaauacugcaggagaagugaagugggguaccagaacagggagccuaaguucucggcaaaggcugaggguauaacauuagaaucaagguccuagguucaagacuuggcccugcuacugacccccaaagcaagugcauguguccccuccucuacagcggcagucugcugccuguguagacuuagacccagugaucccugagggcccuuccggcucuuagaccccgagucucugucacguauugucuacauuugcagaccgcagugcgcugaccuuggucugaguugucccaggcagcagauggaacaggggcacucagcuggccucugaccauagucugccucuuugcagacucucugcuguuucuucuccugugugcucccugggccuucucuuucuuucugccccacaugcccuagacucuccucuccagccucuucugccauagucauugccaugcccuguucagaccuggugaacagggccucccugugggccucccugccaaggucauuugcgcuugcccuccagguuugaggagcaucuuuuuaauucuugauugggccucauccuauaagaacuggcuucaaaucagguaguaaagauaaaaguucagcaucccaaauucgaaaaucugaaaugcuccaaaauccaaaacugaacgcugacauuaugcugaaaggaaaugcucacuggagcauuucagauuuuggauuuuuggauuggggaugcucacccaguaaguagaaugcaaauauuuuaaaauccgaaacaguucuugucccaaguauuuuggauaagggauacucaacuuguacuaagcagcggacuuugcacauugcuaaccuaggaaccuaccucugucuaacuugcauaauugcaugagccuacacugaagccccuguuggucagcacugggcaaagcuggucuuuaauaccuuuucccuaagucuaauaaccugugacuucucaccacccuuuaugcuuuggaaaugcuuuuaaucacgacucagaaugagcagggggucugugggguuaagggucaggagccagcuacuggggugggugcuauacuaacugcugggaggagcuugcaugauuuggacauugagugugaaguguaacuugaacuuaacauaacugagugucacaucuguggcuuccccggccagcagaccgagagggagccauaggcaggccagauucuuaggcugggcucggcucacucuuguuuguguuguuuuucccuauauuaaugaguucugucucugcaugccuuucaguguggggaguuuuguuucauuuacguuguguuuuguuuuugcaugcuucacuuuuucuuauuuugaacuccacaaagguuuguuuguuuuguugauuauuguaucuuacuccaugguucccguuccccccucguuuugacuucuuacagguagagauuaguucuuccuguuacucuagaggacugacuacacuuuccacaggaaaauguuuggaugucaccuugcugacaucucccgaguguuaccuuccuuccuucuccuccugucuuagaaggaaguggcaucauuuaccuacaccuuguguccugcgcuuguuuaggauuuguugucaagacugcguacuuuuuguuuugugaaacaaacagcugcaggugcugugcuccucccgccugucccucuuccuggcgcucucuuguccuuuagucuuuguuuugcuucuuaguguguuccauuauucaguuuuguuugguuuauuucuccuagaagcuguuugguuaaagcuguuuucugauguuauuguccauguuuucuguuuaccuggaagcagcuacuuacuaaaaaaaaaaaaaaagaaaauuuguuggauuuuuuuaaugggaaaaaaaaauaaaguuguacaaaggauaaaagccaaagccaucaaggagcuuucugugguuguuccuggccagaggugugacacucagaacugggaggcccgaguguuacuaaccaguauuuaaucgguuuuuuuaagacugaaguggccgccuccccaucgggugccuggcagaggcuccauagagucaaccaagaccuucaaagugagcuugaagcccagugccagcgccaggagcugauuacacaccagauucagacccugaagcguagcuauggggaggccaaggacacgauccggcaccacgaggcugagauccggagccuucaggcacggcucagcaaugcggccgcugagcuagccaucaaggagcaggcgcuggccaagcucaagggcgaccugaagcgggagcagggccggguccgcgagcagcuggaggagcggcaacacagcgaggcggcgcugagcagccagcugagggcuagcgagcagaagcucaagagugcugaggcccugcugcuggagaagacgcaggagcuacggggccuggagacacagcaggcgcugcagcgggaccggcagaaggagguccagaggcugcaggagcgcauugccgaccucagccagcaacugggcgccagugagcaggcgcagcggcugauggaggagaagcugcagagaaacuaugagcugcugcuggagagcugugagaaggagaagcaggcauugcugcagaaccuaaaggaaguggaagacaaggccagcgccuaugaggaccagcugcagggucaggcacagcagguggagacccugcagaaggagaagcugagcgccacuuucgagggcagugagcaggugcaccagcuggaggagcagcuggaggcacgagaggccagcgugcgcaggcucgcagagcacgugcagagccucugugacgagcgggaccuccucagacagcgguuccaggagcugacagagcgcguggccacguccgacgaggauguggcugagcuccgggaaaagcugaggagaagagaggcugacaaccagagccuggagcacuccuaccagagggucuccagccagcugcagagcaugcacacucugcugagagagaaggaggaagagcuggagcgcauuaaggaagcacaugagaagguucuggagaagaaggagcaggaccucaaugaggcuuugguuaaaaugguugccuuggggagcagcuuagaggaaacagaaauuaagcuccaggcaaaagaagagauuuuaaggaaauuugcaagugaaucuccaaaggacauggaagagccacggaguaccccugaagagacagaaagggauggcacuuugcucccaggccaaccaguccaagccacuagggcaccucuaggccucccacacacaaggcucgaggaugaggacgaggaccugggggcuccuccgggggaagaguacggugauggcagccccaguagggaagacagcauggugcccccaaagucaguggaagugcuugacagggagggccaucagcagggcacagccaaacucgaccaaggggcaccugguguuaaaaggcaaagaauccgguucuccacaauccagugccaaagauacauucaccccgaagggucugagaagaccuggaccagcagcacaucuuccgacaccagccaggaccggucacccucggaagaaagcauguccucagagccugcacccaguguacugccugcaacuggcgacucugacacguaccucuccaucauccacucccuggagaccaagcucuacgucacagaggaaaagcucaaagacgugaccgugaggcuggagagccagcagggucagagccgugaggcacugcucgcacugcaccaccagugggcgggcaccgaggcccagcugcgugagcagcuccgcgccagccugcuccagguuggcgcacuggccucccagcuggagcaggagaggcaggagagggccaggaggguugaagggcauguuggagagcuuggggacuuccaggucaagaauagucaggcccugaugugccuggaaaauugccgagaacaacugagaucucugccuagggccagccaggaggaugagcaggacgcacgcgcagccucccuggccaguguggagagugcacucgucagcgccauccaagcccugcagcacuggccggccccagcccauggcggggcccgugcacagcuggagacagguggcaccgaggagaaugggaagccugccucccugcagcagugcucccagucugaguugacagagcaggagcaggugaggcuucuuucugaccagauugcucuggaggccucgcugaucagccagauagcagauucccugaagaacacaacaucagaugucucccgaaugcuccaugagauuucuuggucaggacagccaccgauggaaucugcuggggcccccguagacaccugggccaggaagguccuaguggauggugaguucuggagccagguugagucucugaggaagcacuuggggacacugggaggagaggcagucggugccucaggagacgggcagcaaagcaucccacagggccuggcccccauccuggccaaugccacaugggucagggcagagcucagcuuugccacacagucagugagggagucguuccaccgcaggcuacagagcauccaggagacccugcggggcacccagacggcccugcggcagcacaaaugccugcugagggaaauccugggagccuaccaaaccccagacuuugaaagagugaugcagcaggucuuggaagcccucaggcuuccagcgggccaugaagaugguguucagcuguccugggaccugagccccuuaggagaaguccugggccgagacucagacagcucucaggagcccuucgaugugucugaccagagcccuggggccuuuguugcuauucaggaggagcuugcccagcagcugaaggagaaggccagccucuuagaggagauagcggcugccuuaccaucucugccaccuguggaaucgcugagagauugccagaagcuucuccaggugucccagagucucucguauaacacuuguuugggaggccucggucaguauucuucauuguugguucaggaugccauuauucaggcccagguuugcuaugcguccugcagaauccggcuagaauaugagaaggagcuccagcucugcaaggaguccuggcaaacccgggagcccuccugcucagagcaggcacaggcagcccgggcccugagggaggaguaugaggagcuucuccgcaagcagaagagcgaguaccuggaugugaucgccauuguugaaagggagaaugcagagcucaaggccaaggccgcccagcuagaccaucagcagcagugucuggaggaugcagagagcaagcacagcaugagcauguucacccugcggggcagguaugaggaggagauucggugugugguggagcagcugaccaggaccgagagcacacugcaggcugagcgcagccggguccugagccagcuggaugccucggucagagacaggcaggacauggagaggcaucauggugagcagauacagacccuggaggacagguuccagcucaagguccgggagcugcagacgauccacgaggaggagcugaggacccugcaggagcacuacucgcagagccugaggugccuucaggacacccucugccuccaccaggggccacaccccaaggcccugccagccccugcccccaacuggcaggccacccagggagaggcugacuccaugacggggcugagggagcgcauccaggagcuggaggcccagauggaugucaugcgggaggagcugggacacaaggaccuggagggcgacgcggccacacugcgugagaaguaccagagggacuuggagagccuuaaggucuuaacgccccauucaauuugcagagcagaucuuccuugauaaugggguggguguggggacgucuggcucagcuaccgugcaggcagaauugaggggauaugcugcugucccucuacuugcuagccaugguguggucucagcagggccugggccgcaggcuuagccucuuguucggcaucccccaguguccuccaccaggaggagaacuagcaggagggccgccagggucccuggugggagaggagcacguagucuucccagcacuucccugccugccuaaugcggccucuccguguuccugagagcagcccccaauccccuugccagccuugccuccuuccugccccugccccgggaaccccgucuggcccagucccagcccaaaucugaggcagcugccugaggacagccuuguacucacagcaacaccccggagagccagggcccaguuggagggcagucuccuccugauugcccuaggagagcacagucgggcggagggucccucucuggaacuggcauuugaugugugcucuggugagaagaacuuucccacggagcacagccuccagccacuccuguccccuuccccaggaccuuuacaaguagauuuuccccagaacuguccugcauccccgccccugagguccuggagcacaaaggcgaaaugccaggcccuggaggugguggugggcugaguggaggcccagcugucuggccccacccuuuguagcugcaggccacacccaccauguguggcugucaagcaucaucccuuagacucaaaaguuuaccaugauaccugugcccuuauguuccuuccacucaggaagcugccccaguaaaugacuaggaugacuaggccccucaaaagccauguucagguggugccuuccacgcucauguggcagagccaggcgcgcacacagccagcaccauugugcugcaagcuccugacucccagguggcugccacugcuccugccuacacauccucacagccacugucuagcaggacaccuguuuuucccagcccguuacuccuguagcucugaauggaaacagcagcucacaugucaccucugugugacggacucggccccacccagacacacaggugugguugucagcgagcaccucaggagaacugagaagcucuuuuucaccauucuuuccccaaaucagucaaaaccuuuuaaaaaccauuaugaguugugagaagguuucaacagcuauguuuucaaaguguguguauaugauggcacuguggucaguucaccaagagcagcacugagauggguggauccaggugcaccuugaaaaguuaauugcacaaaccuuugcuuugaccccaaauacgcuugcuagugcccuucccugcagcuucccagacaaucagcaggguccaugggggcagggccugggcacagcaaugcccugcuuccugucugcauccauaagaggccccuccacaccgaggcugcuuuagguuagccaaccaggugcaggggaggccccaugcaggugccauuauaccaacagugagcaagaaaucagaaaaaagaggacugccuuauguugagaacugaccagagauugugcugggccagugucacuaggagggagaaacagaugaugcaggucgggaugaggccccucccaggggcuuggacacuguccacucccugcugccuuagcugccguugcauaguguccccuccugugccugggagcuucuagcccaggugugguguucucacccaccccugcagacuuacagaacuuguaaauagacagcaccuugagauuucaucacuuuaugcagauuuccacuugggucguuggggacagggucuuggccuaacagccguccucugacauccacaggcucccaccacaccacgauugcagucaucggggaacuucuuuuggugucaggaaugauuggcuuaaauuaacauuuguuugcaagaucaauuauuuuuuagcauauaguuucucuccaaagaagcaacuaggucuuuaaagaugucccagugcuucuguuagauuuuugacucuuaccugcauaauauuccaaagcacucagaucaaaauaagacuuuucccagcaaguagacucaaagaaaaaaaaaaaagacuuaaaagaucuauuaauacuaguugugcucguuuuagcagcauauauacuaaaauuggaaugauacagagaagauuaguauggccccuuuacaaggaugacacacaaauucaugaaguauuccauauauauauauauuuuuuuuuuuuuuaauuaaaaaagaccuauuaguuaaauguguuaacugagaagccacauacaaacagaagcgagugggaggaagaaagaagagcucaaccuuggggccugaggaccaggagcuccagagcuccgagcuccugcagccguccugaggugugaggguggcagaaagagacagaugcuuccagguggagccgcugggagaggggaugggacgccuaguuaauaguggcaauagcugagacauucacccagagcagcacauagguugcagucaaguccagacugaccacgaguuuggaaauacugccugaggcucucagaguuggccaucaccaaaagugggcccagagaaaaaugcccaggcaugcugauaggauuucuugguauccuuucuugaauccacaugcaagaagauuaaccaaguggugcaggcuaucagcccagaguggggaaacccccacacuugaauuuggaauggaauguggccacguucuuccaguuuuuaaaacucagcgagaggcccagucccuucucugaagcagaccacuugaaggauuuagacagaaagugugugccuccgugcucaaaauagcugcacacccacccuucccggcagcugugcagcacgcucaccugcuuuguuagugagcacagcucugauaaccaggccugggcuuccugguguggcuugcucccauccuggggcaugccuaugucgcucuagggaggcacaggagaguuuggaaagcaggucuccugucauguacuuguuagaguuagcagaggugcuaagucauuggugcccuucuuuaagaaaagaguaagaaagaagacacaggcuagaaggaaggggagccuguagccugaucuuacucccucagucaacaccugagcauuaagugaccagcuggagguugucagcuggcuaguggcagagucccaacccccagcucccagaaguggacucuauguacccccaacccacuguggguugagaggcucccagcccggugcccgccaggccacucccuauauguggaauggccuugguucccuccagcagacaagucccucaucccuguuuuacgggccuuucaccgugucccuccagaccagacacagccagccucugcccacgugcucucucuuccuuccugugggucccaccuggcagcaacgcaggaagguccaggguuggcugguuuccauuucauagcagccuguccccaccuaccauaccaacuucucccaggaagaaauggggcacaguacagucacagaaauaagagguagaguugacugguaacacccuuuucugaaugcucugauggcauugcugagaauccccagacagccccagggauccuguucagggcgcccaugguggagcaagcucagugaaugcccagucacagcugggccuggacagggugggauuccuggcuccuuuauuuaaaagggcccccaacuuagagguaaagaaagaagucgaugaagucccuuuugcauuuugcaggccacgugcgagcgaggguuugcagcaauggaagaaacgcaccagaagaagauugaagaucuccagaggcagcaccagcgggagcuagagaaacuucgagaagagaaagaccgccuccuagccgaggagacagcggccaccaucucagguuggggggugggguaacccugagggcaggguggguggccagcuuuuuuugagcuagacacacaacucagaggaauggcagccuuuaaauugccuuuuggcugagauguaaacuucauuguugaaggguucuuugacuauucacucugaggcaaaggccaauuuuaggucccuuuugagagcuuguaaacugagagcgcacacuucgaccccugacagccccgucguggccggcugcacacaaggagcugucccaaccugugacuuuccaguuccaacaaguagacugaccagugucaguccagccagugacuuucccccugacagacaccugucaacgugggaccaccucuggccagaaugccccugccgucagcgugaagauauguagcuucaccggcagguggcccuaaacaagcacguccccuccgccuugugcugccuucccuuuauguaaucgccaccucagugguuuguuaauuuaguuccaaggaagaaaauacaccagcacaaaagcuugcuuguuuuauaaacucauguuggaauuuaacaaugacauuuauuuaaucaguuugguuuucuucuaacaccaaaaaaaaagccaaacgugcauuccuuccagggggaguucaugaagaauucucccagccugcacccaccucagagaauugguucaugaggggccagccugucaugcaaaauccaacugcugauugacuaagcaagcaucagcaguggcaggcgccaucccauuguguggagcuccccacccccaccccugucagcaggaagggcguggucccucggugcugaggccguguccuugccugcagccaucgaagccaugaagaacgcccaccgggaggaaauggagcgggagcuggagaagagccagcggucccagaucagcagcgucaacucggauguugaggcccugcggcgccaguaccuguaaguggcugggccugcccaucugcccuugggagggccccucuggggugcugaccaggccacagcugggcccuuccugugucuuugcagaggccuccagaaguggggccuggggccccugggugcugagggcagcucagaugcccucuuguccagugcaggauauggcccaaguggggccuccuuuauucagagagacuguuccucgaaaugccaagaacgagauguaacaaacgaaaucuuaaacuccccucuuguccagggcugaucccagcaacugcccagauguguucuucgacagcugcccugcuagcccaccaggagccaggcagccgggcuuggucguacagggcagaagugagaacuagcacugugguuuaaaaccacacgugcugauucccucugcacaggcaggauagaaaaauaccagaaaaacugcuguagacuuuuuucacuugguagaauugacacagccagaagcccacagauuggccaccaugagccucacggcacucaggcucuaccaggagccuuuauagcauagccgaagccaggggcccugccucaggagcuggcagcagucagcagcacccuguagaggcucacgcugaccuuggucagagcaggguggcccaccuggaagccccucaucccugguucaccugcaggaggacggcccuccuggauccaggguggcagaacagccucaggaagcuuggguuuuugggucuuguguagagccugguccuggcugucagacacagauggcuucaaaaguggguuuacugaaaacaaauucugagucagaagagaguucuagaaauggggguucuguguggcugcagacuggacucuguccugacuggcauccccagagaagugcuagcuguaggacugucagacugugagaaaggaccagggaggggcgugaggccaucucuguaagggaucccuuacucuguaugacccaggcugauuaagacaacagacugugugggccugaccugugcuuggcugugucuggugucaaggagggacaccggccucugagaggccuuguccagaagcaggcagaggagugagugcugcccucuccccagggaggagcugcagucggugcagcgggaacuggagguccucucggagcaguacucgcagaagugccuggagaaugcccaucuggcccaggcgcuggaggccgagcggcaggcccugcggcagugccagcgugagaaccaggagcucaaugcccacaaccaggugagccugcagccaggugagcccaagguuagucaggggcacucaaggucagguagacccauagucaggugaguccacacuggagcuggagccaggccucacccucaaaguggcaugaaggucccugaaccacagagugguuaccugccccagggcuucucccugccacccagcguggccaucuguguugucagaaacaucaccgcggauagcuagagcaacgcuguacugccacgugcaccaccugcuuacacaugacaucacucuugcuuugacccuuucugagacucucgggugucuuggugucuucucugugcuccucugaaccucuggcucacuguuucugggcagggccuggcagggucaucccaauccuccaggauccugucccccagggauugagcugacacuucucagggucaggcuuacggcucacauuuauuuuugucagauuuuuuuucuuaagauuugcuugcucuguccgggcgcgguggcucacgccuguaaucccagcgcuuugggaggccaagacgggcggaucacaaggucagggauugagaccauccuggcuaacauggugaaaccccaucucuacuaaaaauacaaaaaauuagcugggugugguggugggcgccuauagucccaucuacugggaaggcugaggcaggagaauggugugaacucgggaggcggagccugggugacagagcgagacuccgucuaaaaaaaaaaaaaaaaagauuugcuugcuccuuaguuaauuggggugcauuuaaauccuggcuaauggaaagguucaagccaggauucguucaauauuggcuuuucugugggcaccaaauuaaaacagcccucuaugacccugcccugcacaaacacccccuggggcugggaacauagucccuuucucaccugaggccuucccaaggggcauggcugcugcacagggcuguguaugaggcugcucaggcaggacuggguccacucacugcugcuguggcuuaaagauuaccccacaggagcucagaugggaccagccauggaacagauugacacuaguuauugugacagaaaggaauuaaggguuaucgauuggauccugccuacgcaguuccacagauacacaaagaaccuagggaaauggccuucccggguugugucaugcgacuuggccccaggcagcucuggagugucacuguuguguugcugucccccaggagcugaacaaccgccuggcugcagagaucacacgguugcggacgcugcugacuggggacggcgguggggaggccacugggucaccccuugcacagggcaaggaugccuaugaacuagagguaccaucaggagccaggcccugccugacucagcucugcacccaggaaccccaggggagugcagcauggccccugucuuacaggguugugggaggaacagaccugagacagcaggagucacaggguccaggaagauccaaaucacccgaaggcggcgaggagcagugagcugccagguggcaugagagccacuagccgaguggagcccucgaggggcuguggggauccugaccccaucucacuccacccacuccccuccauuucugcuaugccacaaacacugaccacucaaaaggacacguucuguagccauguggcugcugcagcucaggucagggaggcucgcuuuauguuagaaugauggauucuggaguauaggguguccuuuuaggaaggcacuuagauuucuccacauucaauuaaaauuucacccuaaaaugugcuaaaauuucagcacucagccagccagagcucacccagcugggcugguucugguggcuuugagcuuugucucugucguggagccgccuccuggcagugacacugagaggccaaggcugggagggaccagugcuuggugugaucagcuccugccccgaguccagguguugggccgcugucugcugugccugugccuuguacuaaaugagugcuuuaccaaaagggcgggcaagagaggcugagugagucugacacaagugucagugguaacauuuccugauucucgcgggcuugguccccagagacaagcaggucuaguucacagcaccccaggcugaggagggaguccuuggcacugggaggaaucacggccauuuccuuccucuuccuguuucuguaugugaggcugaagcugugagcgguguuuaaacgaugcuugcccgcauugggcaccacgaggcugcccugcucacuggugauuggagagcccucugcacgcuucagccugcuguggagacucuggagguuucuuugcuccugaauauuggucccugaucucucugucauuuuaggucuuauugcggguaaaggaaucggaaauacaguaccugaaacaggagauuagcucccucaaggaugagcugcagacggcacugcggguaaggccaccgcaccacaggagggcggguacgggaacaggcucuaggugacaugcgccuccugaacucaggcuggugcucagcgcgggcucuucugaagcagauuuuacucuugugaggaaggagguuuccaaaaucaagcccucuuaaaagaccagccugcaggcaggugcugugggaacguggacaugagcaaccugccuggccuggcuccagcuucaguguguaugugcuuuuugugugccuugggaggaauguuccagagaaaaggccugugaagugaggcaaggcuugacuuccauuugagccgcccccuggcuuccaccagccuccuccagggacuccuggagucaggggagaugacagaaucauugguggucacucagucaccuagggaaucuaggacacagagaggauuuccaggcugaagcccacaagggaggggccugggcacucagggccacaccaggcuggucgggcaaucccggaacugccuccugcacucaccgggccuggagauuauccugccauguccugauggcugugcccguguccuuaggccccgugguuuuuccucucuguccacugucugccucuagaagacagaggugaacaagccuccucuuccgcccacagcaagccucccuaccguguucaguccccaggaagacaggccauguuguaugugcuccucuuuccuggauguaacuaccauucucugucauuucacucccaaggacaagaaguacgcaagugacaaguacaaagacaucuacacagagcucagcaucgcgaaggcuaaggcugacugugacaucagcagguugaaggagcagcucaaggcugcaacggaagcacugggggagaaguccccugacagugccacgguguccggauauggugcguccucgggucaugcccucucgguuauugcuggggggcuuauggggguuuggucguagagguuucccggugcuugacuugaagcagaagagucccagugaugcuuguagacccaggcaucccaguggagcaggagcaccagcuucacacggcugccccagacaggccuugcucuccccaucgcagcaguggaugcugugcugauugcucuagggagaacccauaguaucagcauaauauuuucgaaauaauaacaagucuuauuuuucuaaagaacucaaccacugggcagaaguagcucucacuagcugcuugauccuaggauuugacuauaauaucuguaaaaggccauagaguggagaaugggagggagcucccugcuuucuggaaugaacaacagaacuggcccuuuuuuucuuggcuaaaaacauuuagguacccuguaaaaaauagauggcaggaaggaugaaagaguuaacauuuuaucaagcauuuucagcucauacguaauuuuuuuuuuuuuuuuuuugaaacugggucuugcucuguugcccaggguggaaugcaauggcgugauuucacugcagccuccgccucccaggcucaaggauucucccaccuuagccuccccaguagcugggacuacaggagugcaccacaaaacaccuggcuaauuuuuguauuuuuaguagagacagaguuucaccacguugcucagacugaucucaaacuccugggcucaagcgauccagccaccuuggccucccaaagugcugagauuacaggugugagccacugcaccuggccagauuauacauaauuucauuugaccuucaucuugauuuuuuauacagagacgcacaaacaggaaaagaugugcuagcucacuaauaucaaaaaagaaaaaaucaacuuuuuuucugucaggcaaggaauagugauuauguacugacagaugcugggaggaagacuucauuuuuccauaaauaccuugaguagucaggcuuggugguaggccuggcuacccaggaggcugaggugggaggaucacuugagcccaggaguucuaggcagucacacacaaagcuaagucgaucagguguccacacuaaguuuggcaucaauauggugaccuccugcgaguaggggaucaccagguugccuaaggaggggugaacuggcucaggucaaaaugaaagaggucaaaacuccugugcuggccaggugcaguggcucacaccuguaaucccagcacuuugggaagcuaggugggcagaucacuugaucucaaaaguucaagaccagccugggcaacauggcaaaacccugucucuacaaaaaauacaaaaaaacuagcugggacugcuggcaugcaccuguagucccagcgcuacuugggaggcugaggugggaggaucacuuaagcccagcagguggaaauggcagugagccaugauuacacugcugcacuccagccugggugacagaaugagacccugccucaaaaaaaaaagaaaaaaaaaaccugugcugaccugugguggaaucacaccugugaauaggcacugcauucuagucugggcaacacagcaagaaucugucucuuaaaagaaacagagggcgggcgugguggcacccgccuguaaucccagcacuuugggagguugaggcggguggaucacgaggucaggaauucgagaccagucuggccaacauugugaaaccccgucucuacuaaaaauacaaaaauuagcuggacaugguggcacaugccuguaaucccagcacuuugggagguugaggcggguggaucacgaggucaggaguucgagaccagucuggccaacauugugaaaccccgucucuacuaaaaauacaaaaauuagcuggacaugguggcacgcaccuguagucccagcuacucgggaggcugaggcaggagaaucgcuugaacccaggaggcagagguugcagugagcugcugaguuugugccacugcacuccagccuggcgacagagcaagacuccaucucaaaaaaaaaaaaaaaaagcaaaacaaaaaaccccacacaugcacaggaugugugauaugacucaguaucuguuuguguuacagguacuuaaguagacauuucuaagaagccuaaaggacugcuaucuggguggguggacaaugagaaggccuuggccuuaucaucuugcuuuagacagcccugugcuaccaggaggaagguagagaaucauggauaauggggguaggggucugcucagcauugaggucccacaccagagugaggggaccaagucccuuugaagggaaugcuguugugggcuacagucacagugcaggaagcccuggcggggccccacauacacauucucccauugugcugguguuuuaugguggucugaagagaucuagcauguuuuaugguuauuggcuuugaauucccuuagaguuguuuaaggaauuguccuaaguaugcugcaguaggaagcuugggaaauguuucaggauuuagucugguuccagaggguuuuagaaagcaaagguaacaggucuguuuguuuucauuauauaccgcagauauaaugaaaucuaaaagcaacccugacuucuugaagaaagacagauccugugucacccggcaacucagaaacaucagguccaaggugagucugggguccagcccccuggugggaggggcuugagggacacuggggagaguagcccaaauugaaguaugagugcucccaugggccacagcugccaaagccccagggcccagcacugagccagcccgagcucacccugcugggcugguucugguggcuuugagcucugugucugucuuggagccaccuccuggcaaugacacugacaggccagggcugugaagagcagugcuuggcaugaucagcuccugccucgaggccagguuucacccagcccugcucaugucggccugcugucagcugugccuguguuguuccuugcacaucacuguugugacacuggugccgccuccaagagaugaugcugccugcucuuguuccccagccaggaagcaguacaucuuuagugugcuguccagagccagccaugcacaggagggcgggcggaggugggagcggcaccgcguguguuugggauugguugugugucucaugucugcucucuccucugacaguccguaauugagcaggucucgugggauaccugaaaugcacccgcuucccggcccaugcaggagguaaaccgccucucccaccgccugcaugcacugcucacacccccauggcaaacgccugugucaugguuacuuuauuucaauucauccugcuccaacaaacacauaccaaauccaagugagguuucuuuaaccugcucuggggaguuaauuggcacucuaaccucuuaacagagaugacccuggcagugaggugcuccucuagccuggugggcaggcagagagccaggcacccaucagcaugcauguuggauaaucugugcacaacggcugaacucacuccacccccucaggggacacuugucuugcccucugucacgagguggaauuuacagauguccacacuggcaagugaagucuaccgucaccaaaggccucgcccaccuagugagccacuuaguggccucugucugucaaggcuaacaggguggucauucuaggaauggauaaaccaggacuagagcuuggugaagaugguucagaagagcgugauaacuacaagcaauaggggcgaaauauuuaccaguauuuuuuuuuuuaauaaaacaaaagcuucucacuaggugccauugaaggcccuaugccagagaggaggugggggagggcccauggugggagacacccugagaaugaguaguugccggcucaguagcuugaucucguucaucccggaaugagaacauggaggaaagcaagaaccacgucuuccuccccaugcuggcccuuucucaggcacacccacagcaccccgccguccgaaggacuucauccugaggcuugguuaaagaguugaagguuuuaagccuagucaguuugguuuuauuuuucuacaguucuaaguccccuauacccaaauaugguuuaggcuugauugaaaacuuagcuugggcauuuuucuuuaaacauaacguuuuguuuagcaaaaggaaacuuguucuuuuuugguucacgguuuucuuacugaagauucuacuacuuauuugaggcuaaacuguagcuaguaucuuugagcuuuucuugaaggaguuugaaguucacuauuagugauuugggcuuuuggaccaugucuauaagugacaugggaccggcugucacugacaggacccuuccagggaggcugugcaacacccacgggccccugacaguaacucugugcagugagugggugggggccucucacaguggcugggaaccagccagagcagggaugagggagcagacugucugggccccagggcagacugaaaaggauggagagaaaccccaggaugggguccuccuccuuauguguuuuuaaguugauguuuggcuuggcuggguuuccguaauaaaaauccuuggagugcagggcuaguccugcuggccccagcagaaagucgaggacuuccuagaugucuguggugcaacagggcaggauggggccguguucgcgcucccaggagacauuaggaggcacaggcaugggugggugucauccuuuuccucaacuguaucugaagacuccacccaacccuucaagaagauggaaaugcaguugcccagaaaccguacuucucagugguguuuuuugauguggcaucugaugugcacugaucugugucuuuuguucuguucuguuuuucuguccugccucgcucgaaaggaccgcaagucucagcugcuacaaaaucaaagacagcaaguugcuuaggagcagcacagccuuuucugggauugagaccagagaaugcuucccucgggguucuuaaggggcccccgugucuguggucagcucaguauguggggcuacaggaggcacucaguggagacaacagccuagggggagaugaaccccagagggagcuggcugagccuugggcugagcagccaccgggagagaauccagaggacguagagagagaaacagccuccugcagccagugugggaauaacguaggggauuucacuuacuucccacccuuggaauuguagcaagcccagcaucaccugagccugagcucugcccuuugucacuggggcaggagccaguagcgagcaugcugggugcuguggcugucagggcgcuccccuccccugggccugcuguagcaggaaucuggggcuucugacgcagugccugcaaggagcaaacccaggccuuaggagugaucaaacucacuacaguccugacagaaaguccccaacaagcaggaaccgggaugucagugacaucccccagccaugcuccggggccugccucugaguagcacuuaggcucagggcugccugccuggcuuggccccagccccuucaauggugaccagaugucuacccagguccucugcaagacugacugcugugagaacccugcacucuguggggagggaccccccaagggcaccuggaagcaggcauggguguugagguacaucugggcucagaaugggagauggauuuuccccccauucccccagccacucucuguggcaggcuuccaaagaaacccucucagaaacacacaauuaucaagcugugacaacugcuugaggugaggcucaccuggaccagugagguuguuuguuuguuuugagacggagucucgcucugucgcccaggcuagagugcaguggcgcgaucucugcucacugcaagcuccgccucccggguucacgccauucuccugccucagccucccauguagcugggacuacaggcgccugccaccacgcccagcuaauuuuuuguauuuuuuaguagagacgggguuucacuguguuagccaggauggucucgaucuccugacaucgugaucugcccgccucggccucccaaagugcugggauuacaggcgugagccaccgcgcccggccuggaccagugaguuuuaaaaugcuuagcagcagaacccuguauuuaaaaaucacauuguuuauuuauuuacacagacacauagcuccagaauauagcaaacaagcaggucuguucuggguagagcuggguggggugggggacaguggagcucccccuucccuugagcuuuggagggagccucaagcugaccagcccaugcucaguccccagucuaucacaccagagucuccaggacagugccagagugugccugagccuaagcuggcgacuucccaguagaugggguacagccugcaguuucacguugcucagguuuuugguugaaacugguagaaucaggcagacccugagcuagagcccaucccuucagcuuccaguuucucaguaaagccuguaccugcaccagcucuggcaaggguaagccacagggagucagcagggcugagugugauggcgacacuuagcgugaagagggagauaagugaagagccacagcacuuuccagucaguacuggaaugcccuucauuuccagucauucucugaaaagugcucuuccuuuucuuauucagaaauuaaaucauugaggaaagucuguaagaaugagaugggaaauacucuguccccuaguuaguaagaucucauucaucucuggacauacagauuuaagcuuuagcaagauuccacgugaacagaguauugguuuuauguuuugaaaaucuuacuagauacguuggcguguucccacauccccauaacacucacaggccucugaugagggaaugccagaaaugggucugagggcagcaggugcugcggaggcacuguaggagcgaggcccugucccgggacacccauccugcuggggauucccuggagcaucugguccuccucagcugaggcugucaggugaagaaucucuggagcuggauguggacaaauccauucacaagacaagacacggggaugggcagucuccuugcucauugcacuguuuucccuggcuggauucguuugaucacugcuucucuaaagagcccuaagcucagaauuuagcugcuuaaacacauggucuugucucucugauuuuuuuuuccuuuuucauccaaguaauuuugugaaggggaaaacauccuccaauaacagcauuucccggggacucuccuccuggcaugcccacuaaccgcaccugcacccggcucucugacugaugccggcuccaccagcgguccggucugguccgguccgguccagugcagggggucuaacgguguguuuauuuucuccuccugcucugucucuacccagagucugaaggaaggccugacggugcaagaacgguugaagcucuuugaauccagggacuugaagaaagacuaggugugucccauccaaguugagcacgcgccuuccccagcuugcagcagcacaccccaagcgcugcuuuucaccuguaccuuuguuuuauuauuauuauuauuauugcuguuguugucaucguuaacugugggcauggaaugcgugaggcuggcuucuggguuguccacaccacucucugcuguguugacuuccuguugucuucaucaaagcuuuuuuccgugguauucuaaaauuaggccagcagugggggcugggagggcaucuguguuaguccuuuccuggcugugacccgccacacucacugucaguauuaaggcccagcagccuguugauaagcuacccugucucaccaugugcugguguggaaacggggcccagccagcacgccucaagguagauggaauccccacuggucagagaaaaagcuaugcggacacuccagcuuggccugggucacagcacugacuccucacccgcuagucuggcuguuaagaggagaaagugcacugccuuccagcccaggaggaggacagcauuuuguauuuguuccacugaugcagcuuagaaccacaccccugagagucguggcaaaccuuucacaaccuggaaaauguugaaagcaaccauuccuauuuuuguuuguuuuuuauuaaaucuugcacaaaauccccggccccucuccuuccuuccuuccuuccuuccuccgcucguuccuuucuuggucuccaguaacccuggucuuuucauaacugcucgagauuguugaccugcagcccagguuucagacucugauugcaaaaaacaaaugaauuccccccaggaaucauucaaaaugggggaagguuuggggguuuggguuuuuuuuuuaccuuuuggaaaagaaaccgucacauugcuuuggaaaagguugagaggagaccccuguuaagucaagaagaaaguacagaggaugucagaaucugaugagaacagcacauuaguguuuauugagacuccgaucuuaacucucauuuaauuaaucugagcucugaaaaccuaucuugcagcauuuaucuuuaaaagagccugguuaaaguaaaccuauacuaacaauuuugcuuuuucuaacaguuugaggaagaccuuuuuaaccaccacaaaacauucuauggcaauucuugaaaaucucuuaaauuggagucuauuauggccccaugaaaaccauuaaucccauuaagauagggaguauaaaccccuggcugguggaacagguucugcuacuuuaggagcaagguggggugugaguagaugguuuucaugccaagaacaugcuuucacuuuguauucaugcuuguguuggugugauggucucuguggguggguggaugcuuugggcguugaaaucuagaaauccuguugcucaguuucuagaugaagucaugagcaaggccaucaguggagcucuggccccgcccccaaugugcagaagggccgggagcaaggccuggaguuuucauguguuuucagacccagguuuaggugcucucuucucacugaaauaacuaagugcucuccacuggcaucgagcccuuuccacaaguuuuuaaggcucuuaacccacacuuucacuccucugcuacuagucuucaguguuguuaacagcaagagaaaauuggguuuguuuaaaaaucuacuucucugagguggcacaguugcguagcuguagucccagcuacucaggaggcugagguaguaggauugcuugagcccgggaggucgaggcugcaaucagucaugaucgugucacugcacuccagccugggugacaaagcaaggccccauaucagauauagauauacuuaucagacccccccugaccauuuagauuggcagugcuuugagaaaugcacuaugaccuuucugugucaaugggaauauacagaaggaacauucgggaccccgcugucccccacagccucauuguugucuccaggacacugcugggucacacgaaugcuccaggacagacagggaccuggagugcaucaggaucugaccagauaggaguuuuugccucgugucugggugcuacgauuuugugccguucucugagguccaccaccugcccuuccuggcaugguuuccuucgugaccaucccugcugccccuggggguggaccccacuggcccuucugcagacagcucccugccuucugcccuccaggggguucuggccagaguccaugcuuggagacaggaucaucugccuucagcccucacagugcuuuaaauuaaagcaaguuugcccauaggacaaaagagcauuugauucccuuuuuucugucacauaucccuugaggcuggacuucaggaauccuggaaaauuaauaugagugcagcaugugaggggucagagacaggccagcagggcgucugcauuccucccugccacaggucucuccccagaggcugguuuaguguaggguauugccaggaaacggacugaggcugcuuugcuaagagcuccugaaaaugcccugggccuguccuggcguuucugaagagcccucauacagggacagccaccaucugggucaaggaagucuggguucccugcuggugggcuccauccugcgauggagugaaccaggcgagaaaggaugacgauguucuucauguugcaccuggacaugccccaggaacagagacuugcccagguggcaacacuggcacagauguugacggcugcccaacuggugccacacugagcagggagccuugugcugcacagggcugggcccucucuccaguuuccuuccugcaggcauccaaauacccuggaagggauuuaaccccugaauuccagagggaagaaagaagaacagugaagaaguagaacugguuucuguauggggagaggaaagucuuagggacagcugcaggcggggucucaggcugcuccuuggcaccagcuacacaguagugagcuuucccagcuuuaccgaugaggaagaaguucaaauagauagacuucagcauuuuaauuauuuuccuauaaauguauuuauguguaguaugcuagcaccagccaguaagcugugccacacauaugaaugggaaagcgaggcaguugugcucgugugaguuucugcaggcuuguggguaauuaccuugugugcacgccugcacgugcagaauagucacuuucugcuggucaguuucuuuauccacccauggugccccagccccaggcagguguggagaccagcauuucagaggacgcgcuguccacagccucccgggucugaguggaucauugggcagggguggagacagugcgcugcccucugagcuggaagccugugcuucagggagucauaaugggccugugcuaagugggugaugcaguggacaucccagggcgacuagagguggcaguaucgcgaauuugcagguuuauugaacaagagguaacaucggagaggaucuugccuucggauucagcaaguaugaaggcagaagagcauggagagcaaggccccacagccugcuuagugaguuggaaggcccagcaagaaccuguuucugcagcagccaccagcucccaucaccccuugacccuccagcucaugcuggagaagagggaauuuuggcuguuuaaagaacacaguugugaaucucagaaugugccugaaaggaauacugacagauaaggccggaaacaaaacugauggcuugaaaaacauuuuuauggaauguauuuacuaucauuuuguuuuacuauagagguagaugggacucuuaacuuuuggguacauggaaacaugcugaaaacugaacacaauccugaucaucacuccugccuggcugucuccugggaggcugccgggugccacggagcugggacacagcagagcccgcuagguguugcagggcccuggaggccaaggccacccuguguggggucccuguuggcagccaggucccuacacaaacaaguaauccuguuuggccuccuagguuuugcauaugaccugcagccuaauuugggguguaggggaagcucugcuggccccugcuccuuuguauguugggugacuuuaauggcuggccacauaccccuuucucccagcuacucauucacugacuuggguaaguucuaagacaguucgcacuuagaaaagaaugugacacaucaacauuaacuuuuccugaaaagaagaguuugccuaacaugguccuaaagaagcuuggaauuuauaagacuuuccuuuauaagauauaguggggguuuuuuuggguggagggggguuguuuuuuguuuuuuguuuucaagacagagucucgcucuguuguccaggcuggaguguaguggcaugaucucggcucacugcaaccucugccucccagguucaugccauucuccugccucagccucccgaguagcugggacuacaggugucugccgccacgccuggcuaauuuuuuuguauuuuuaguagagacgggguuucaccauguuggucaggauggucucgauuuccugaccucgugauccgccugucucggccucccaaagugcugggauuacaggcgugagccaccacgccuggccuauaagauacgguaaaaaaaaaaaacugugaccccuuugucacuaagggagaaagaaauuaaguauugucaaaguucuauaaagaauggaaauguaugauauuauacuucaaaggaauuugauguugaaauuuuaaagaaaauuugucauguugaugagaagcuucacuuuccugggaacuucauucguuuuagggcaugagauaaaaguccuggcuaggggagccauaggucuguuguacaaggaauuugcuuucuaaacaaguuguaacuugcccuaaggucccuguuggagcacuaagaggugacacaggccagagacaacguuucguuuccccuucccugcaagcugggaucagcccuguguuuucuccuuucagcugaagugagcgaagguucucagugcuggcaaaagagcccacuuucuaaaaggacuugggaagaaagcugcugggaacuugcuuauuaaaaaguuccuuagaauuaagguaucuacccacuguuuucgcaccuuucaccuuccugggcuuuccugcccuccagcauucuucucuagagagguuccuagcccgcucagcgcgagcgucuccaguagguaauagcagcugaacguggguuuuccacggacuucaggcuuggaggugccauauacaagcacacuucuuccuuccccuggcuucuccaugccaccacccacuuuaaagauguaaacucaguagauuuuucauccagugaacggucaucuucacaucgaaaggugaaggccaccacuguucucaaugccaagcaacagaacguucugagauggccguucuuccuugcacagcagcuacggcagguuguucugcagccaccccuuagagggggcucuucguuuuaccuuuguacaguucuuguguuuacacauuugggccaaacagcuuucagcaagggcauguguccacagcugaugggcaguuaagaaccagccugagcugaaggcuaguaauaccgugcuguaggcucuuuaaaaggaaagccuggcauaaacccagcauggaaaggaacauuaucaguuaucucaaauuuugucugccagggacaagacccuguucauucuuuugcccuuuucagaacugugagcuucaaguauucuugcuucucuguaaagggaagacaucucccuucucugaaauccuucaacaaaagaaaaggcucuuggcaggguaggggagucaguagcucaacacuagaucaucccuagagauggggcaaguuucugucugaacacgucuuggguccgaguccuuagguguucggaugcaguacuuugugaauacuuaagcuacugcaugcuugguguagcuugcaauuucucuguauuuaaaagcagcuguguuuauuuucuucaaaauaaccuguauauuauuuagagcaagcaauguaaauauuacugagaaguuacugcagggauuuuugugacagaguuuguauggguuuuuaaaaaaaucuuagacaccccuuuuuaagauggggagaacaggguugacugcaccguugaagcccgcccagcauuauaaggaaauguuuuuaaugacugcugcaucuuuguaaaacguuuggucaucuaacagaugguuuuaaaguguacaauauccaaaauaacgauagcccuguauccauacauuguuucauugaaagaauucucuauugccucuucuugguagagccagaguccuuaaggaaaaucaggaaaauuaagaaaaugauggugccaucuugaccagacuucugcacaguaauuuaacgcuauccuagggagacuugguugaaggcacaguucugggaucagggucuaaaugugcaguuucugagaaccuucaagaccacucacugggcagggcucuguggagcacuggagcuguuuggauuccccagcccuuuggucauauccuggaauuccguggaggcugcagaacuuagaugcagcuguuuuuuacagcaccuauuuuugucagauugguaaggaaacacugagucacagaauacuuaagaauuggagacuccaguaauguaggauggccugagaggacguccaagucccaagggguggacacggcauguuccucgggcacagccucagugggggccuuccccaggcgcagcucggccaccugaggaaaggguguuucggaggcgcagccacacacacagcgcuggcagccucacggucacgcccaucacucccugccccccacugcccuugagaaguuaguggugucacauccuuaguuuuauagacagcuaggaauagauugugaagaacacucaguucacuacuguguuacauuuauaucacaagcuucaauuaaaauggauuuuaaaggauuuuaggauuuaccuuuaguauuaacaacguaucuacugacauacuguuaggauucaaaaccaguuaaguauaagaauuacuucaugugguuuuccuaggguacaauuuauaaaagguagaaagcauccaaguggcuccucaacaauuacaauucuuaaugauuuuucucacagcugugcccuucugucagggucagugucaaaauucguuaucaaaggcaaaaccuacugugccaagcuggggcgcuauaugugaacggaguggaaaugcuucagucaccucugccgcagcuugugauuccagcaguucucacaaacguucugucacaugaugaaaagaagcagcuuguauaauuccaacugguguuucauuucuguucuaaugcuaagugguaacgcuuaacaaacagacuaaaagcugugugcagaagaaagggcugaaugaguaccgccucccuagguuccagcacagcgcucgggucuaagaaguagagccccgggguagggugggccauccacugucaggccagugucucaagaaagccugaccagcugagcugcugcuuuuuuuuugggggggggggggggaggggcgucuugaggcuuuuuuuuuuuuuacaaaguuaguuugugaucaacgauucacuacaauugaaguguuacuuugucagaauauuuauuccuuugugugacaugcuagauucccuggauguagcugaucauuuuuauuuuguaaauauuaccuaacuuuacauaaacuauaucauaauaaacuauuuuugcaucacccuuugcaugcuguguaaugagauuuuguuuaguugagagacaucugcaaaauaagcacgcaggucaaaaggcaaacugaacaguagccuccagcucuagaguggguugauuucaguuucauuaccuccuuuuuuuugagacagucucacucuguugcccaggcuggagugcaguggcaggaucucggcucacugcaaccucugcccccgggguucaagugauucuccugccucagccucccaaguagcugggacuacaggggcacgccaccacgcccaacuaauuuuuuguauuuuuaauagagacgggguuucaccguguuagccaggaugcucuccaucucaugauccgcccgccuuggcuucuuaaagugcugggauuacaggugugagccaccgugcccggccuuuauuuuauuuuauuuauuuuuuuuggagcagggucucacucugucacccagguuagagugcaauggcaugaucuugguucacugcagccucugccuccuaggcucaagagauucucccaccucagccucccaacuagcugggacuacaggcaugcaccaccacacccaauuaauuuugcauuuuuuguagagacgggguuucccuguguggccaaggcuggugucgaacuccuggacucaagcaguccucccaccuuugccucccaaauugcugagauuacaggcaugaacacagugccagggccugauuaccuccuuuugaauuacaguggauuuuuuuuuuuuuucuuuuuugagacagagucuugcucuguugcccgggcuggagugcaguagcgcgaucucagcucacuacaaccuccgucucccaaguucaagcgauucucgcgccucagccucccaaguagcugggauuacaggcaugcaccaccacaccuggcuuguguguguguguguguguguguguguuuaguagagaugggguuucaccauguugcccaggcuggucucgaacuccugaccucaggugaucaccugccuuggccucccaaagugcugggauuacaggugugaaccacugugccuggccaguuuucagcauuuuagaauuacgguaguucacauaaaaauuuggauuuuaccuguucacacacaagccauuguaagaaauacuuuacaugcagaaucuaauuaagguacacugccccaguuaaagaagccuucaggggcuaaagggacaacgagaagugcuaaugguggugaugcuuuuauuaaucaaggucuuguaauuccccaucccugucccucuuauuaauagauuuauuuacaauaaaauuuuaccuuuugcuuaaaaaagaaacugcauuuuacaucaugacccaauauacacacacgccaacaaccugaaauuuaacaaaauaaugcacccuuacuauauauacuuugaugauuucguucacuuuuaaaaauucugauugugacccacuaaauaaauuuuaaauaacaaacaacugggauuuuuagguugggcgcaguggcucaugccuguaaucccagcacuuugggaggcugaggcagguggaucacuucaagacaggaguucaagaccagccuggccaacauggggaaacccugucucuacuaaaaauacaaaaauuagccaggcaugguggugugcgccuaccuguaaucccagcuacucaggaggcugaggcacaagaauugcuugaacccaggagguggggguuacugugagccuagaucgugccacugcacugccaaccugggcaacagagcaagacccugucucaaaaaagaaaaacuggguuuuuuaaacaauauauucacaaccuuuagaaugaaaugggugaaauuugugggaaucuaaacuuuuauccagauaacauugaaaaaaaguugauucuaccaauaaaucaauuuaagaggccagguaugguggcuuacgccuguaaucccaccacuuugggaggccgaggcagguggaucacuugaggucaggaguucaagaccagccugaccaacauggugaaaccccaucucuacuaaaaauacaaaaauuagcugggcauggcgguacacacuuguaaucccagcuacuggggaggcugaggugagagaaucacucgagcauggggggcagagguugcagugacugagaucgcgccacugcauucuagccuggacuacagagugagacucugucucaaaaaaacaaaacaaaaagucaagaaauguauaaa

SEQ ID NO: 16592 - RNA, 17222 nt, Homo sapiens
ggccuguacugucagcaguuugagaccacggucccaaggaccagggugggagucaaagaccagagaggaagggccaccuuaggaaagccccucugccuccacagugguuccuucaggauggcuucugacacucuaguaacgagugcacuggccacuuuaccauuucaugucauccaguccucacugugguccauggaguuuccucagcaaacaagagaguccaccucagagagacaagaugccuugucuagggagguggagguggggugcgcuuuugcauggggguguugggcucaagagggaagucagagcaacccuucauuugcccagaggguucagacaggcaccugcacuaugccaggaugcccaggaugagaauuucugucaaauagaguaaaggggcuggagcuggagagaggagauuaggaaagccaggacccccaccuugggcaggaaggcccaccuguccuguggcuguggccauagcacucagugugggucuccccaaccagaagguggcaggggcuuggauccaggcuuccuggacuaacauaaagauggggucugaggcugccuccuguacccucuccuucucaagaaacacccacugcuugguugcagagcaacccuacccaucucccuuuccuggcuccuucucaaggacccuccaagagugucuggaagagacaccugcgggccacuccacugauggagagcacugagcugggcuugaauguggcuccuccucguguccccccagggucaguguugaggcaggaugccaaugguguaugcugaaagggugaagccacugaaggaggcuucccugugagcccagccuccaucccaccugcugugccaccucccuucugagcuggacccacgggggauggcugaguccagagaccccacaaggaaaggcuucuuggaccuggacauuuaaccauggagaaaagagccagcagccauguaggcaagggcucugcaaagccagcagcccuccggucugacuccugcaggcaggcaucaagggguguagaaagagguggcaaguaggucagaggaaguaacaggaagaucacaggagcuugagguggagggacaaggagguugcaccuaaccuguuucugaaaggaagaaggucgggguguggagagugguuggucugagcucagcaugggcaccagacccagcauccugcucuugagaccaagcccccauugacugucagcaaggagcuugaggcuggauggccucuggguggaaggcagcccaacugcaggccaccccucagauggaucagaagcaucuucugcuucuucaagaaugagaacaaggaaauggugggcuguugggggugcucaguggagaagccagcagcuguccauuagugggguggagucaguguggaguguguuaaggacaggggcaccccugguguggugguaaccauggcaacccaucugcucucccaaagcauccuuacguugggagaguaagaaagaggccagaggguacagggcuaaacaagucaucuccauaaagguccucuugccuagcccuuugccucaguagggauuucuuaaaggcauccuuuccugcuuuugguuuucugucccuaauuucaguguguaacaguuuuugcuguaagaaaaaaaguuacuguuugccaugccagagcugguguggcagccuuugcugggcucugcuauggcccugggaaggugccgugggccaggcugccgggcgugcuccuuggccgccucuaaagaaggcacagugcacccaccccacagccugcucucaaggauguggcuucucucuggcccccuccuugccucuaaaaauaacccugcuauuuugaaacugccuccucuggagcuuuuucuugcuucucugugggaucagcagcccuucugagaccaggaucucagcugccccugucaccgcagcuguccccauccuguccuccccugcauauccccuccagugcaagugggaugucgcucuccacguaggagggauguuuagcuggguguccucuggagaaggccaggccugucccuguccucccugggaugggcacaaaggaagaggagcuggggcuggagugagggagagcacuccuagaggccccacaggcugggagggucaggaauggccuggggcuguacgacaucuguggccccauuggcuggccucugggugacucucugccgccuucuuccagcccacgacccuuccucagggcaccaucaacaugaaccagugcacagaugugguggauggggagggccgcacgggccagaaguucucccuguguauucugacgccugagaaggagcauuucauccgggcggagaccaaggagaucgucagugggugaguaugcuggcacuguggaacaaggcaccaccaccugccacagggccaacaccagaugggccgccugccccuguggcagugucgauguugucuacuuccccgugugccucuauucuugggcucugucucuguucucaacaccgcugugugcugagcacagcagaaaucaggacauucaccauuccaccugcagccucuggggccccucuuugcucuggccaccuuacccuccucgggccuccccaccauugcacucaccacacccccaacucaccugccccuccaccuggaaggggaucagucccugaaucauaugaccugggcacgcccucccccagucugggauggcugcuccuccuuccagggcuggugcugggcuccaccaccuaugaaagcgccagguuaucugcuguguccacgugugucucugucagugguggugggggugggaggugucucagucacauccccagcaccucacacccgagccacucugcugccacugcacagauugguuucugugaguggagagaauggguaagugucucacucacccagguccccugagaguggcgaacuggcucagguugagagagcccacaguccaggggccugagcgcagugcugagcccagggcagcaucugccuucccagagcucccagucuagcagggaauucuuugcuacccacauggccugggccauggugaaaagccguacauaguccgugcaggugaacaggcucauugggccugacaggagcucacaaacuggaucuccgagaaucccugucuugcuuaaggcugagaaggaggcacaugagucuaagaagcucugggagaaaguaaaccuggggcuugcugggccaggcugacuguagcaguacagaguagagggaaucaggaauacgaagcccuugaguuugaacacacagaugacucggagcaccagccuuucuuuagccucucagcugcagccuggccaagccuggugagugagcacagcuggaaguccagggccacauggcaaggcguccaggagccagugcugggucccgggggcgcucucugcgggggugugcucuccccuagaguccuccccuggagagaggcagguuugcauuucugagcaccuggagccgagcuggaggagcacuucugucucccacaaucuuaauccagaaccauaugaucaagaaugucaagggccucugaagaacccucgugguacagucgaggagacccagggccuagagacaggagccuggccaggggcaccuucugcacuuucuggcucacaccuguuucugcuguuggccgggcagcacacagccgaggcuuccucugcccagguggcuucccuaggaaacccucacccuuuccacaggagcugggucccagggaggguguggguaacaggugggauggaugggaguccugggucuccagggcaagcuggggagugucuggagcaggguugguucuaggaccagcacauagagguauguguuguaccaugugguauuaggagagggugauguuuagcauuuggacugccuccagcaggcagcuuaaguccugccagaaguccucacuccaucccaagccccucuccugggucacuucucugcucucuucuguugcauauucaggcuugccauacccaugcagcuuggguagacaagaucguuaauggaccaagguaccgggugcacaugccaucugggcccuacgugugugguggcucaguggcguauccaaagccagaauaagcugccugacgcucuuccccuuccccucgcccugguugugggccacguuaguucguguccaacaggcagguucucacguggcauaaccucgugauccgcccucaccuucccacaagcugggaugcucagcugcgugagggagucagguguggccuaugcacccuggggacaagugcuuuugccuccuucucccauuccucugucuccugcccucgcugacagcccccuuccucugcucccucucuugccucccucuguuucccauuauaacuccucuucccaguaaccucaucccuaggcucuggagcgccauucugggucugagcucucuggucacaucaaagcuggucccuaagaaggugcagacacuuccaccaggcagcugggagcuggguggguuggggacagucccacccagucuucuucccaggucuucucugcauagcccugacagcugcgugggcugccgggucucuccugggccuggguagaggaaguuggcagcucuuuccaguucccacuuccaggauucugggccacacuuuacauagcucuuuuagacgagguggguuuggguaggaguuggcaagggagcucuucugugcucucagcugggugaagucuggacuucccuucucccugcccugccuuuuaaccuuacccacuccccuguucucacucauccgggcucugccgucccuauccggggagccccagcaccuaccagucccauauucacaccccucuccucucuucuugggguuuguuuuguuaacauuuauaacacaucuggaugauguuagacgcuuccuauugggcuuccuugagaaauccaagugcagaggacacauuccaucaucuauuccuggacccugcaucucugcgacuccagccacagacugcagucugaacagagauuaaguugcauaaugggacugaggccacaugagacaccugcuguccugacuccucccgaguccuaggcuugcuggagccagcccaggagagcucagcagcuccacguagucagcagagcaccugcggugcagccuucuccccuccccuccagguuccauccugcaaggccauuagucauugcugacugauggaaccugggccagucugcaggggccugggguaccuggcaggguucugcaccuccagcaugcuccacaccuuggugaaguuuuaagugcagccuucugcaggcacagucccucagaguggucagaagaaguggcagcugccauggcagacuggaaaggcaaaccucuuuaaucccauagggcuugugaacaucccagguuguaugagcgaggcccucuccugggaccucugcucccagccagccuugaugagaagugugaccagggaggagaggggcucaggacccucagaaggccugccugucugcuggcuuugcagauagucacagccuccuuucuuguuuuggggccguggaggaaugacccacaggaccuguggcuuggaucucuggcauugcagguguuuauucauucucucagcaaaucgagcaucacuggcugugggcugagcugggcugaggguggccccucagcucuguugcugugguuccgugcauuaagccuggccucugccgccaccaccugucaacagcacacccauccugaggcugucucagaagccagugauugugacugacccuuccuuugucuguuugucccuccuucccuccuuucuucauuuucuccuucccucucuuccuguccuccuccccucccucccuccuccccaugcucuuccucucuucgcuccucuaucccuuuucccccuccccuccucuccucuccaccucaaauuaaagaaauaccucugggcacagaagacucgagcccuucuccugccccaggcucagugugcugcugggugcugcacccgugugaucucuagcaggauacagcaguacagacccccccauccccaacccugggcccaggcugccagcaggcccagcguggacccuggugcugaaagaagaccuggagcggugucuucugaggcuccuuccacucuggagaggacacuagggcugcccuugcacaaccaggcccagggcuggagcuggggcuucagaggcaggaccuacacugcccuccgcuccucccacccccgucgucuagcccccacaggacugacaggcagcucuggcaaggcaacugcuguugguuccuuugucuguuguaaaauucuauaugguggaaguaguugugccaugaucugaucuagcuccugauuucagaaaugagaagauugaagcuccuaaggggccaggagccacccaagauugugcugggauaguggcagaaccagauccagagucguccugcuggcagcgccugcuuuugcuguguucccuugcugcaccccuggugucuauccagagugaacuugccacacacaaucccugaugggucccugggcagcucugcccagccuuccucaaagccagggugcccagcacccucccucugcagggacugugggaguucagcaaccccccacacccuagucccucaagaguacccauugugggaacuugaccagcacagcuccuagauucuggccucagggccagcaccugccucuguugcccuaaaugggcacagcucgucuguacucucaccaagcccacucugggagagcaguguuagggcaauuccaggcccuggagacagggucaguaauggaaguuacacauccuaugcucugaggccauggccaggccaggccucucugccagcacggagucugugucguguccugagccugcuguggguguggcagggucauuguccaggcuugcucuguggcacuucuggccccagcguagcagucugucacuggggacaaugcccugcucuacuccuggaccacccggcaagggccagggcuccuaguccccgagugccagggucuuaccugguacuugucuccuuuucucuucccagguggcuggagaugcucauggucuauccccggaccaacaagcagaaucagaagaagaaacggaaaguggagccccccacaccacagguaggcaguggguuugccagauggcauccccucaguggagccagggcuugggaagaagugagggcucccugagguuagagggugaggacacagucaggccagggcugaggcagucaccaacucugcacauccuugcuuugggcugcaaucugcaagauccucacugagccacaggggaaccacaacagggacaggguggccugcuagugugcucuggggcugcccaagggaaguuuccagccagcuagcaguacacagcugugaccccuccccucgcuauccugcuggcagcuggggaggggcagcacgggcagccugcagccacagucaaaaggacucugcacccacagauggcccugcaggcagccggaugcaguaggauggggaggagaauucuggagugguauggcccauaaggagcucacaggggcccuugcugcaacucccaugugaccugagcagggcguggcugacugggguggucccucaaggcccaguccuuccccacaggccaugauccuccuucccucccuggccagugugcaaggcuuagggcauagaaggguccuacaccgccuuaccacacuccccacguuccuggggccaugggggaaugagguaaccuuuuuugagccucaguuaaucaacuugcaaagcaggccuguugcugccuaaucgccaagauuguugugagcaugaaaggaaguuuuggaccuauuauagguucucaguaaauguaauuccuuucccucuguaccauacgcuacucuucccaaguccugagccucauagucacccgagagggagcaggguggggaugggggucccuugggcaucacaaggccagaggcccacagaagugaagagagccagcccacgggcuacagaggucagggagcaugcacuggucugggucccuuucucuccucagccccuugggcugcccuuggauauaccugcccugggcugcuguauuggcccuccugcugauggagucagccugggccacucucagcccauggucauccacccuccauccuggggucagggaggcaggugggggacacccaagccaacauccgcuggaaaggagaugucgcuagcaagaagucagcgaaaaauacagagugguuccugggacugaaaauggagcuuccugcuggggaacagcaguuaauacguaaaucccccaaagcuucccaguuggagagaaacaaaaaaaucacaggcagaauaacagcguuuaggguuacacugcguuuccauggugaugccuuggaaacagugcagaagcggagcuccugccucuaauaagguaacuccaagugcagaagccgcucucagcccaguccagggaacuugcuugcucucccucccucaugacacccagcuccccaaaacagcuacccaugaccaaguuucaacuuuuuuguugguagaaggagccacaugaucccaggguggguagguuacccacuucacugagggucucuuagagucuggagcacaggguuccuagccuucugcacucaggccccuccuaagacaaccuugcggggucucuccuuucuacccuuuggucccgagagcaucccauuugaggcugcuuguuuccagaagcuuugaauuguaaucagaggccaucucuuugucaagucagucuuguggggugacgugggggcacugcagaggagcagcaggguccaugguugagaugggaucuuuggucaggccuccccucugcaugcagccugaugcuaaaggcauucucauggccuaggguggggcuggggguaaaccucacaccuucagagcaccuggagaggcgagaacccaagacccuauauuucuuucuccauggcccaguguuggcccgggagaguuucagauugaaccaguggagagcuugaagcguuggcugccuguugugcccaguaagaaucagcuucuccccuuaaggaacucaggugggaccuucuggaagguucugcuuccagaaguuggggccaaggaucgcacugcgggagcagcagacagccuuucagcugagggcgggagucucaauagagucuaggccugggagaagagaagggcuuggcccugacaagaguuuccaaagccuguggccugagaggcgugggcuccaggcaauaaaggaaaaagccuggagcagaaggaaacgaugacccauguaggugugaagggcggaaggauggagaugguugggaagcccagagcuguguuuccagccaggugugcaggccccgggucuccacuccucugguggagcugaaggaggcccgcuccuccaucucccagccccccagguucuucugcuuuucucuggcuuucuucugaguucagugugagcccagccagcaccaccaggcccacaugugugucuccuuccuuaagaauccuguuuuuuacugggaugucuacugucacccccacuccaaguuagaauucuuccuucccguugguugccaugcuccguguuccugcuagggaaguggggagccuucugaaacugcugcagagagaggcccugcuuggcaagcaaggcucuagagcaacuugugcuuuggggaagcgcugcugccggggugggcaguuagggugguucugcccugggucuucuucccagggcagcacagcugcugguuucccauggguaagcagcccaggaugcugugcuuggugcagggacaggucguccuggggcggcauccccuugggucauuggagcccuugggaaacuugucaggagaaaccuucacuguuugcuuccgagaagcuggcuucuucugaggggagccuucagccugggagucugucugcuggcagcccuaagcugaguagguggucaggugugcguccugggucugugggaagagccucccugcuuuuauccuguccgugaggccuggaauccuugcaaaagugccaacagcuuuggacccagagccccacccaaggcagugccccaccaccccauggccuuccugcuucuggagcacgugguggaaacacucagacccccaugcugccccucacuggcugugugcgugugggccugcugccucuucugucagcgccugcggccucccuugggaggugggugggugagacuggauguauggaucccagccaggcuauugauaaauagucugguggugaugcugcaucugcaagugugcgcacauacaugcauauaaagaaccugugucaucugcaagccucuccaagggcccaagccagagagagacuaaggugguuuucuaaaaaugaggcuuggccaucaggaugggagugggaagugggcacuuguauaucaugcucuugucuuuugcgagagagcugagaugugcuucacuuuuggagaggggccaaagccauccuguuggcagcccucugggcaggguuguuggggcccaggaugugaccuggcacugcggagcagcugaggaucacagcccugcuguugccuggauucuguguuugcagagucaaguuaggguucucugcccagggacugccucugcaucugccuaaaugccugccccacaaacacuucucccucggagcuaccacuuccagaaccauggagagauuggggauugacaccuuuuccaucugggcuacuggcuuguaucuagcuuugugugugagcuugugagugugagagagcaagcaugugcacaugaauguguauaugcauuugugagugugugccugugugcagauucaagugggguauuuggugucuuuguguguucugucugcuauaauaaaauaccacaggcuagucagcuuauaaauaauagaaauuuuucucacagcaggcugguuaguccaagauuaaagugcuaguauuuugggugucuggugagggcccccuugcugguccucacauguuagaaggggcaaggcagcucucugaggccucuucuaugaaggcacuaauccuguacaugagggcuccacucucaugaccuaaucaccuccuaaaggccccaccuccugauaccaucaccuuggggguuaggauuucaacacaugaguuguggggagacacagacauugaaaccauagcauuuaauuugcaucugacgacucuuuccuucacauagcgucugggcacuccauuuuagcuucuuaggggcaaaaagcagaggguggguaaggccacagggcuggcccagacuugggcgcugugaacuuguucuugcauucacuguaaggagcuacagaugaugcuggaccugucucgaggguguguucucuuuccuuacucuguucugucucaccuuauuugagucuuggaugucuaggaaugacagacuccaaagcaacuacuguggucucacuguuuuggggcaguaucugaagauuccaggccccugacauuguguagcuggcccgggugcccccuauagcuaggcagccaggaccugugacccaaccugagcugugugcuccugcaccuucacagacaccacuuucuccuccuccaggagccugggccugccaagguggcuguuaccagcagcagcagcagcagcagcagcagcagcagcauccccagugcugagaaaguccccaccaccaaguccacacucuggcaggaagaaaugaggaccaaggaccagccagauggcagcagccugaguccagcucagagucccagccagagccagccuccugcugccagcucccugcgggaaccugggcuagagagcaaagaaggugagcggaggccaggcuggcuuguaugcacgggaauggcccucccucccaucagagcuggcccuggggauucagccaaggccuguagagcccagucgcaagccuggaccucgauucccuuuguccaucagcccuggggguagcaccuggccugguauguucugagauucccgggcuccagucuuggccuugccccuucuagcucuuaaaucccaucuuuaaaggaggaagacagcuccuguucugucagccccaguugcuugucaggagaaucaaaaacguuuugcagcagggucuguggaugggaaggccucugucacugcaccaucguguuucuuucugugugcauccugccccaagaagcugcagucagucucaucccucucaccauccgcauucugccugggccccuggcagaaggaggggaaggggugcuggggaggcagcaguuggcauccucgugcccugucuuuuagcacuuuggaauuaccugagcaggagcaggucuuccaucuuugucugucuuguucccaggcucuagagggcucuguaagacacaggcuggguuuucccaucuguauuuugucuagauuguuaaaaauaagugagcagcaggggccagcccagcucgcucugucugcaucuucuacaugcacucuggguggaaggugucugaaucuuccucucaggccuauccauucaaaaaucuauucacucugucucacuucuguagaaguccccugccccuucccaccaccagaaugcauuaaaagacugaaggggccgggcaugguggcucacgccuauaaucccagcacuuugggaggcugaggcagguggaacaccugaggucaggaguuugagaccagccuggccaacauagugaaaucccaucucugcuaaaaauacaaaaauuagccagaugugggggugcacaccuguaguccuagcuacuugggaggcugaggcaggagaaucacuugagcccaggaggcagagguugcagugagcugagaucacaccacugcacucuagccuggcgacagagcgagauugcaucucaaaaaaaaaaaaaaaaauacugaagggcuuguuggcugucagcuucccccuugauguuggugagaagcgguugguggugggggucuugcguccugagguacagaucugaucuuccagccaagcccccagacuagaacugcagggccugccugccagucuggcugagaggcagccagcugcaggggagagauggaugagagaaaaaagcaugcacgaaauauuucauucccauccaugguucuuuccgucucacucugcccuugaguggggugugcuggauguuagagacgggagguggagaaggccccugcuuggauccuacaugggcuuuaaaaaaaaaaguccucaaagcaaagcugccagcaggcugagugcgucuccucccucccacugucucuuccagaggagagcgccaugaguagcgaccgcauggacuguggccgcaaaguccggguggagagcggcuacuucucucuggagaagaccaaacaggacuugaaggcugaagaacagcagcugcccccgccgcucuccccucccagccccagcacccccaaccacagguacaguugccccgagucgcccucccaggagcucggugguccucuuccuuccccagguccucgacucccccaccaaauggucugcagcaucucccucagcucccuggauguggccagccagccaccugccuacguggacucuggcagcacuagggggcgggggacagagagacuggggagcgccuuugccuuuaaagccagcaggcaauaugccacccuggccgacgucccuaaggccaucaggaucagccaccgagaagccuuccagguggagagaaggcggcuggagcguagaacucgggcccggagcccuggcagggaggagguggcccgucuguuuggcaacgagcggagguaaggagcagguuagaggguugaacacccaggcccacacacaugcacuuccacccacgcacauacacucauacucucuguuucucucacauacaguccccaagccucccuuggcggagcaugcuuucuguucagagcauagggguauuuucccucugggcccagaacucagcucuaguagccagaaugcagaauuucugagcaucagaggucgacgccaagaauagcaguuuucacaucagugccuccuaggacugggaccuuaagguucccugauggguucucagcugccugguccuuguggggcuggaucuuuuccuccugggccauuucuauucucugaaguggcauggaggcagggagucccuagagcuacauguggugacagaggcgcuccucacccuggcagucccagggugggcaaagggcacugagagguucagaggcagacaggcaugcccaggaaggugggggcagcacagguuccucucucaaggacaugcucccuggggagccacagccccaggaaaccugaggcaaccugugaagcagcugagcaccaaauagcauugcuuuugcccuccaggggagcauugcuuuuugcccucuaagacuuugacuggcuggagagagagaaaguuuggacauccgggccuagggcagggaccaggggcacaggugcagaacuugacugcugccgaagaagaugagggcccaugcccugcccugcccuuguucuccagaguuuccuggagaacuagagaaagaguuggauguccucugaggccuccaagcccaaauccagacgcaagugcccaagcacgccuucaaucaggcuugcaccccugcaucuguauacugaggcuuugccuugacagcaggguuccucagccagguuuauggauagacuuacagacuucuggagguccaugaugaccugcccccucaauaaaacaauuucacaguauucuucccagaagagaguuaggguuaggcacucuucugggaagaagacccauaguuuucauuagguucccaagguucacuguccagaaaagagguucaaaccauaguucuggaagucuucucagaguguccucccuuccccagccacaaccuggagcucagaguuagagacgcuaccaggagggacaggugaaggcagccaugggcucccgugccucgaagggcagguggagggaagugucuuuacauccugcccccuuuucuucugagcacccaccauuggcugacagcccacccacucuuccaaacgucccagaugaaaaggccugugagccugcagguuagucuccaggauaaggaagcaucucccagagauacugcuggugagaggaaaaugacacguugacuuccuagggaaaggaagggcagccaagugguucccagccccugccuagugccccagggugcucugcuaagcacuuggcugccuuaauguuucauaguagccugaugaggaucuguuacuaccgcccccaguuauagaugugaaaacugaggcucaggaguaggugacuucucaacaauggauagcuggugcagaucccaguggggccuuagccaggaagucccugcucccauccugugauccaggacugaugccaaggaugcucuuuuaagcaauuaagaaaauauauaaguaaaggguuuugcuagagagaggaggaggccagugggugggcaggggaggcuucaugcuggcuggcaagcaggcugugugucgugguggcuccagagcaggaucagcuauguccugguuuagcgccagaccacagaauuagcauucagcacaccugcuuggcuuggcuucuucucggagagacuccuuuugaacucguucuugucuccugucgccugggacaggugcagucucuggggcuuuguacucugcaugcacugccacacggggauggguuuucaccuggugcuggccccaccccccaccaguucugcauacuaauacugcagcaucccuuucuccugacccuggugacaucugauuggcugcugucgcuuucugaggccugcucacuggaucccuaguagcccacccugugcuugguuggauuccuguccccugguugauuagagcagaaucuccaaauuggcaagagauucuuggccacaccuaccugaaauggcagccacaauaggugugcccaggagccagacugcugggaccacaggguugguuuuuugacaagccacagucaucuaggcaagccuaucugaaccugaccgguucugggcuucgauguguccguuccucagacuuccagaguguuucuuggauagugagucaccucuggcugcugagugggggaaguuguuuuccugguuggccugcuggugacuggcagcaaggacagcuccccauguagcccuaaccccccugcccucagcacagcgguuagugcccugggaacccuggagcugcagggugcaggccccguuuucugugcugaccaguaaggugcuugcugucccaccugcagcuuccagggcaccaaguaauaacuuuccaccucgcccaguagaucagggcagccagugugcgagccuguggucuuacaggaucuccccaggcccccaugcagagugacuguagcaagugccuuuccucuucuccaccacgacuccucugucuggauccccacaguaccacggcaugcgauuugcaugagguuaaagcccagcaguuccucacugcuuuccuggggcuuucuaggccccaguguugggcagaggagcccucauccuggaaguggccuguuggugagccuugaaucucaccaagaucccaccacaaucgcucaagugugguggacgccuggcuugcacuuaccaagcuuucccuggguguccuggaacuccagcagcuuccuuagcuuccugcucucacaaugccgcggccucugcugcuccccuaccccagcgccugccuccgcugcugguucuagcaggcuggcccggcacaagcuucuuuccugaggaagacacuuugugucuaagcacagggaggaagcugagcugaggaagacacuuugugucuaagcgcagggaggaagcagagcccggggcccucgcccuccucucuccgggggugaagacgccuuaggcagccaguuuucccucgcacucccugagaagcagcuggccucuugggggagguggggucucaggaauugaucuuguuuccucucuuccuuguggagauaauuaggcuuccaggcuugggag

SEQ ID NO: 16593 - RNA, 1961 nt, Homo sapiens
agagcaagcggccugugcccagauccugggagaaccccagccgagcccagccuagcccgagcccagcccgagcggagccggagccccaagcccgagccgcgcccagcccgagcagagcccuccagccgcucaccccgcgugccaccccagcgacccucagccgcucucugcccuucucucggccccgcgcccgcccucgcggccccucugcccaaugaaacuggccgcgaugaucaagaagaugugcccgagcgacucggagcugaguaucccggccaagaacugcuaucgcauggucauccucggcucguccaaggugggcaagacggccaucgugucgcgcuuccucaccggccgcuucgaggacgccuacacgccuaccaucgaggacuuccaccgcaaguucuacuccauccgcggcgaggucuaccagcucgacauccucgacacguccggcaaccacccguuccccgccaugcggcgccucuccauccucacaggugagccgggggccgggcaggugcgggagggaagggcggggaacccucggccagggcgccccgcgagcgccgguccggcugccgcgcgccgaguagugcgcuucgcgcuuagagaggcuagcgcgccccgcgcggccucaaagucagcccgacuuguccccugggcggccacccucaccuucuccuuuucugcucucugugcccccucuaggagacguuuucauccugguguucagucuggacaaccgcgacuccuucgaggaggugcagcggcucaggcagcagauccucgacaccaagucuugccucaagaacaaaaccaaggagaacguggacgugccccuggucaucugcggcaacaagggugaccgcgacuucuaccgcgagguggaccagcgcgagaucgagcagcuggugggcgacgacccccagcgcugcgccuacuucgagaucucggccaagaagaacagcagccuggaccagauguuccgcgcgcucuucgccauggccaagcugcccagcgagaugagcccagaccugcaccgcaaggucucggugcaguacugcgacgugcugcacaagaaggcgcugcggaacaagaagcugcugcgggccggcagcggcggcggcggcggcgacccgggcgacgccuuuggcaucguggcacccuucgcgcgccggcccagcguacacagcgaccucauguacauccgcgagaaggccagcgccggcagccaggccaaggacaaggagcgcugcgucaucagcuaggagccccgccgcgcuggcgacacaaccuaaggaggaccuuuuuguuaagucaaauccaacggcccggugcgccccaggccgggagcgcgcgcggacuggcgucuccccucccggcgauccgcccccagcacuggggaggcgccacugaaccgagaagggacggucaucugcuccggaaggaaagagaacgggccaagacugggacuauuccccacccccggucccccauugaggcccgccacccccauaacuuugggagcgagggcccagccgaggguggauuuaucuucucaaagaccuaagagugagcgcggggugggggagggaugugaaguuauccagccucugcuaggcuucaagaaaccgucaugcccgcuugagggucaggacccacggggcauuaucuugucugugauuccggguugcugugacagccgguagagccucugcccucccaaaacuaagcgggggggcgugggucaaaucauagccaagugacuuguuuacaugugagugaaacugcacaaaggaacacaaaacaaaacuugcacuuuaacgguaguuccggugucaacauggacacgaacaaaaccuuacccagguguuuauacugugugugucugaggucuuuaaaguuauugcuuuauuugguuuuuuaauauacaauaaaauaauuuaaaauggaaaacc

SEQ ID NO: 16594 - RNA, 1599 nt, Homo sapiens
gucaagguuucaggaaauguuuuuccaaggacaucugaggaaggaccauaggauagaagugauuacaggccacuaccccaucccuccaugaccacuggaggaaaaugaacucugcuugugcugcuucuucaucuccaggguaaccuaugaggauccucaggcugucggaggacuugcuucugcacuagacaaucgaaaacagaguucagaagggguaggucuuuaacccuguuuuucugccuggagucuucuggagggaaagucaggugguuuggcaaagcuggcuggguaauucagcagaaacuggcuugcacagggggcagggacacccugggggagagacccacgggggacaccccguggaacccagguagugccucauugagucuucaccucaccccgugagaugaggccacacaugagcuucccaauccacccaagagaaaacagucccaggcaggugggagacaggcugagacacccagagagcagacagcaagcugggguuccaauccuaggauuaguguccauuuccagaaccccugcuguuccuaccacaguggccccaaguucuccaggcacaagucuccuauggucaccuguuacagugccacaggguggucagugcucugauaaaaccauggccugcaccaggaaggacaaugcugacccgagccacaucucugauggccauuugucacuggccuagcagagcaguaccaaccccauuagaaggcacucgagagccaggguuuguuuacagagcuggugcaguugggugguggcugggaggguguccuguggcggugagggggugcggcacagugaaguggagggaaugguauguguuugggccuccccaaacauaaccaugcuuucuguacaauuucggauuacugaaggggaaagaaugugugucuuaaugcuucucaugagauuuuuguuuuugccuaacaaagaaauguguaugaaugcacgucuguuugcaggggcagggaggaggaggguccuuggaauagcugccgacaacagcuggaacuccugucugggucccccagcugggcuagagagggcagugaucaucuguccacuggacaggaagguuugcaaagggcuguuugcuuacugggucccaauuuuuagccuucugaagccccuguccaaugggcccaggcaggcagcagugcugguuuccacgggaugcuccuucuugggggaagggacucacucccucauccaugcuggucuucaccugguggaucugagggcaugcaucccucugcacuggucaccagagggcgcagaagagccagcuggcugccuuggguccucagugccgugccuuuccacaggagugggcagugccaccugaaccccugagacugggacacucaaaaucaaugcagugcucauggcucugauucucccauuacuuagaauguccucccaccugccccagcgugggcauuagagagcccagccaggggccuaccaggauacugccuggugaggacauccccuccucguggccaacccuggccugcacugggagcagcccuguugugccccuaugaggcugaccucauuugucccucacuc

SEQ ID NO: 16595 - RNA, 33783 nt, Homo sapiens
cauggaaagagaggagaggaggagccaaggccagaagagucuugaagaaaagcuuugagugccaaauaaagcaggggaacuuuauccugggagacaugggagauuuuccagcagaucccccccgacccccauuuguuggagcccuccagugcauccugcacggcuacgccuuuuuguuuuguuuugcagcucugucgcccaggccggagugcaguggcgccagcucggcucucugcagccucaauccccugggcucaagggauccucccaccucagccuccugaguagcuaggaccauaggcgcgcgccaccacgcccaguucauuuuuaaaaauuuuauuguagagaugggguugccauguuggccaggcuggucucaaacuccugggcucaagugauccgcccgccuuggccucgcaaagugcugggauuacaggcgugaggccccgcgcccggcaacgccuuugcugacugcuucaaaacuuuuuugaauugacuguagucauuaucuauagcuuagccuuagccuugcgcccguucguuuccuggaguuuucuuccagaguccccguaggaggugcccccacgcccaucuccagcaccaaggaggcucgacgccaaccccagcgcgcccccacgcucgccgucaccgggacgugacucgugaaacguccgcuccgggcggcggcggcagcggcggcaggcuggcuuguaccccgacaacgcgcgucuggcuucugccggacguuccuaucuggguucagaacuggggccgggugcugcaggucccgcagucugagaaguuuucgcggguuucagaaguuuccuuaggcguucuaagggcuuuacucagguggagucuccauucaggcacuuauuuaaccacccauuucuccuuuagggguccucgcugcucgcccagccgcuaauuaagugacggacacaguagcuaaggagacugccugauugacacgcaugauuaccaaccgacuuccggaaacuccagucagggccugcccggcgcguggcccacggcccaauuaaagaaguggaagcgccaaagggggagguaacggagcggccuacguuguggcgguucccuggugaaugcgcccugggguugaggcgucugcgggcguucggacgaugccgugacgcggcacggcgacacuguuggcaauaugagcgcaccccuguagagggagcccuucgguccuggaggcggcgcggcgugaagacagguugcuauuugagagcguucccuugaagccccucagagagugggggaggggcggcggacggcaagcgguuccugucugcgcuugcgccggcgccucugccgacccggccugcacgcacgcgcaugcccguagcgcgcggagccgcgguggccggcagcacugcgcgugcgcggugaggagcccgcuaaggagcggcgcuggcggacgucgggcuggcugcccgugacgucgugcggagagcuuuaaagugcgggccgggccgggcguccgagggucuggucgggagucgggccgcgucuccgcagcagcccuccgcggcaugaggcgcugccggcgccccugccccgcgggacguggagaagguggaggaggaagaagccccguugucgccaccguugcaugacccgccgcuccugaggcccuaccccacgcccggacccucgacgccccccgccgggucccccacucacgcauggggguucggcgcuaaggaccccccucccuccgggggccccggggcgcguccccuuagagccaugcccggcugccccgcccgccccggaggacccuagagcagcgucgugggggccauggcggccgccagcggcuacacggaccugcgugagaagcucaaguccaugacgucccgggacaacuauaaggcgggcagccgggaggccgccgccgcugccgcagccgccguagccgccgcagccgcagccgccgcugccgccgaaccuuacccuguguccggggccaagcgcaaguaucaggaggacucggaccccgagcgcagcgacuaugaggagcagcagcugcagaaggaggaggaggcgcgcaaggugaagagcggcauccgccagaugcgccucuucagccaggacgagugcgccaagaucgaggcccgcauugacgagguggugucccgcgcugagaagggccuguacaacgagcacacgguggaccgggccccacugcgcaacaaguacuucuucggcgaaggcuacacuuacggcgcccagcugcagaagcgcgggcccggccaggagcgccucuacccgccgggcgacguggacgagauccccgagugggugcaccagcuggugauccaaaagcugguggagcaccgcgucauccccgagggcuucgucaacagcgccgucaucaacgacuaccagcccggcggcugcaucgugucucacguggaccccauccacaucuucgagcgccccaucguguccguguccuucuuuagcgacucugcgcugugcuucggcugcaaguuccaguucaagccuauucgggugucggaaccagugcuuucccugccggugcgcaggggaagcgugacugugcucagguaacccacccggguggagggggcggcccugcgccugcugccuuagcuacccacccuggcccagaaagcagcagcccguaggagucugcguuuuuuacaguucugaccaguucuucuguuuguagauuguagggagcgagagaaggguuuuguguuuaagauaccuauagcaagaaaauagggaaccgauguggaaauccuguccccgaaggcagguuugacgggaucacugacuuggcugagaauucaucgaaagccaucuuuucagaaggcuguucccuuugauuuuuuuuuuucccaccauccauuucuuagcauaagucccuuugugauuuuccgguuuuccauucuggccuuccauuuacaaaucuaugcuuuaaaauuuuuuuuuuuuuuaauuuaucuaaaagucuuucuuguucugccauuuuuggauuccuuaacagagaaaguagucacaggcaaaggccccagagauuauuuaauugaagcacauucuccauucccaggagggggagugacuucccuggaguugaacagauuagugguugggccaggcauacagagcagcacacucuuaaaauucuucccuccuggcugcagaagagcccaucaguucuuuguaagaacguguuacuuguagucaggacugaauacaacagaauacagcuggucucuugacuguuuggccuuacaguugcgugagcagcagaacuuaggcuuuuggccuauauucgguucccagauccugcugagaauuagcucagugcccuggcccccagaggagauugccauugggaacaccuuugcuguuuaugugaagugaaaauuuauuuggaagcggccuccuuccaguccugaaaaagguaaaccuaguaauguaauucaguaauacccaaaacaucuuagguuuagaccgcagcuguucucagagcagcuugguugaccaccaccaaauacaagguugaggacacacugggcuuuugucgugagcagcccagguucugaagugagucaguagggccaaagucaugaggagaagcagggucccuggagccuucuugauaugagauuaggucaucuguuucauuugagucuaacagcugaggcugcuuccauguuggggauggcagcagagccuuguaauguccaagacguccuggugggaaggugggaagucaguaguagcagaagcgauacuuuagcucuuuaggcaucugaaacuuagaggacagccuagcugucagaugccuucuuauaaugggcuucugagcuucucagaucuucauggcgcuccuagauggaugucuuggcaaaaugcuuuaagaugggauuuccaggacacacccucuccgggugcuugcuguguaaggcagguuggggucugaccccauugacggguucucagugcaaaaauuaccucacacaaggaccauuuggucucuuagcgggauauuaauuuucugcguagucauuggcccucagggugguugucaggaggucuaguaguggucuggugcuuaaugaggggaucacaaggcauuuuuuuuugguuuugggacuacuacucuccuuaacacaugcccacccuguauuuuaagaacagaaguuucgaguucuuaguaugcaggucuguuagugaucagcaacaggauugcaucaucaggaaaauucucuucaucuuuuccucagaauaguaaaguccuaaagcuuucccagucccugucaacccuuucuggauucagacuuggcugugguguuagugugggaggcucagccauguccugaaaagugcugccccaggcuuugaauccagcuuuucucucauuugcuuugggaucuuguaggcguucucugagcuggcuuucccaucuguaaguggggaugaugccaacuuccaaagccuauuagaauuaaauguggugauuuguugucuaagauagggccuggcacaggguagguacuuaaaugggugcuugcuuucauauacaaccacucagugauccccugcucucucacuggggaaggaacuagggauuugguggagccugaaacaugacaguuucccuucguguaguucaagccccauggaggccucagacaggaggauaaguuauagcccaggaagguaacugcagaagcacacugaagggggacaucuuuuccacuuuggaguguuggaaguuuaggggaggaaaugaacuggaaugugaaaagugacuaggaaugagccaagcagagaaagguggagaaauacacaacagcagugucuuuggcugcaguagcaggaguagccauagguaagaggggguggauguugaugggaggcagauggaguucauuaguagagacugugguugagggugcucuggugaacucuagaucagggcuucucaacagugcuauuguuauucagggcuugauaaugcuucauuguugaggcuguucgugcauuguagacuguucagcagcauuccuggcuucuaucugcuaggugccaauaguguuuuuuaugacaaccagaaaguguccagacacugccaaaugccgaggcaggggaagugcagaauccuuaguugagagucacugcucuagggucuggacccuuccacuaauuaaaucuucuugcaccugcauacuuagcuuaccuugguaugcaggugggugaacaccugccuauuaguagugcccgucgucaaauccugcauauaaacugguaagaaguggugcuuucucuuuuccugguacagauccuagcccagaggugaugagcaguaaagcugcagauuggaagggaggggcuggugaaaacaguggugcggugcagauggggagggauucuaguaguaggcaucuuagacuucaguugguguugguggcaaugguaucuguaccccucuaagaccgcauggcaagaauacaauuuuauauuuaauagugaucagcauggauguuggugcgucacaaacauugacucagcagugucuaaaccugggcauuuagaacaaggccucacagaaucuucuggaagugcuucaaacuccuuuccaaaccuagucgucaguuguuuuuuguaaccuucccauguuaggccuggguggauccccucuuaaggcuguacuuuagggaaauauuuuuuaucuucauaucacuuuaucugucauucauucuccuauucccuguuggcugcauggggcagauuaaaacagacucugauuggacuaauuagaauaauuacuucaaggcuaauugcuuacuugcugcuaucuuuaaucacugcuacguggucuguggugugguggccacaugcccagagacccaggccuaggccagccgucuggaaaugacuguaucacccaggcacggggcaugcacuggugagcucagccugugacucuuccaguuaacgguugguauuggguggagugggcaccccugucaguucugggauagucugaucuuguucagcugguugaaagcaaaauuuagcuuucuggcuuaaaauaguugggaaaguagggcagauagguccugggccacaucucuuguguggacucuucugauuccacuggagggggaggaaccacaggaugaagucagggcugugcaccgucaggaggagcucugggccagggggguuggcugcccuugcugcugccagagccugacaaggcagagggcaguaaaagaaaggaagcuaacagugaaccaugguguuaaucaugaagcucagagcaagcagagaauaaauaggccauaaaaauuucagagcuggccaggcuuaguggcucaugccuguaaugccagaacuuuggguggccaagguggacggaucaugaggucaggaguuugagaccaaccuggccaacaugguaaaaccccaucucuacuaaaaauacaaaaacuagccgggcaugguagugugcaccucuaaucccagcuacucaggaggcugaggcaggagaaucacuugaacccgggaggcggagguugcaaugagccgagaucgagcccuugcgcuccagccugugcuguagagugagacuccgucucaaaaaaaauaauaaaaaaaaaaauuucaaggccgggcgcgguggcucacgccuguaaucccagcacuuugggaggccgagguggguggaucacgaggucaggacaucgagaccauccuggcuagcauggugaaacccugucucuacuaaaaauacaaaaaacaaaauuagcugggugugguggcgggcgccuguagucccagcuacuugggaugcugaggcggcagaauggcacgaacccgggaggcggagcuugcagugaaccgagaucaugccacugaacuccagccuggcagccugggcgacagagcaagacuccgucucaaaaaaaagaaaaagaaaauucagagcuggcuggccaguugguggauagccuucacugauacagugcuagcucucugggggauauagguucaucucugcaaaucucuuucauggggcuaguggguguacgugugcccuuuggugaggccagcaaggcccccuggacaggcuugcuaccaggaaacacagaugggcuuuucuuccuaccgccuccacaacaaaauccagaaaguuugacagcagacuugguuggaguuacagcaccaccauuuuaacucguugacuucggggaaauuaagcuuuuugaggccucaguuuuccucaucugcaaaaccagucuaaugaugcuauagaguuguuauagaaaguugaaucuuugucaucuauugaaugcuugaaauuuagcuaaaagugucucaggagaugggcuaccuucuguguuuaguacugucuaucuugguguguacagaauugggacuuggcagguugaccuucccucuggauucagaaagccccaggacuucuuauaaaguuaggccaugggucgucuuggaggcuugggucugguaaauaauugagccugagcucacaauccugccccuggguccagguggcuggucugcugcccccaaaagccugaccuucuugguccugugggucugucaguaaggcagguagccauagcuggagagagacagucaccaggcugggaucuuggacagucccuccaucucugguucauccuggccuaggcagggcauggaguagauggaaaaugguggccaucuuggaaaugugucauaacaacucaguuuccaagaccguccccuagaggagagauguacaguccugcauaguuucuuuaaagaauuuuucagggccaggugcgguggcucaugccuguaaucccagcacuuugggaggccagggcggguggaucaccugaggucaggaauucaagacaagaauggccaagauggugaaagcccgucucuacuaaaaauacaaaaauuagccgggcgugguggcaggcaccuguaaucccagcuacucgggaggcugaggcagagaauugcuugaacccaggagcuagagguugcagugagccaagauugcgccacugcauuccagccuaggcaacagagugggacucuguuuccgaaaaaaaaaaaaaaaaaaaaaauuucagacaccucauuuaauuugcaccuaaucuucugaggaggggcuugcugugaucuuuguuuugcagaggcagaaacagguucuaagugguagaauaguucagcucaacacacauuucauuuaguguccacugugcagggaugaguaaggccuuugaagagcuuugucuugaagggaagacacaauuuccacaaggccagauggaauagcaaagaggcaugagagggugugguugagcaauguagggggaacccagccugggcagucagggaaaggcccccaaaagaggagauagacaugucagcuccuucgagagucacucugagguauaggacuagugggugacauuugcaacauauacuggucagugccucuggggcuggggcugggggcucagcccagagagggagcaggcaagccagauggcauaagguuauuuccucuucuccuuucccugugaaaacaaaaaagcaggagguccuggaacuuuucaugccagcaguagggcuggacccaagggcauauuaaguugcaagcuggccgacugagacuuucagacaauuuauuuuguagcaaguagguuccuuaauaguaaauaauacccuguggucucugcucgacauuuugugagauuggccaggagagcuucccuuaaucaggacuuugagcucauguugccagagcagccggauauucugaggaaagggucagugggcugugucauagcugcuaggaaguucuagaagaccaguacuaauaagccuuccagguugggucagugccaaagucauuuuugugggccugugcagcccuaccuccauacuaguucuuccaaggccugggcuccguggcaggaaccugacauggcuuauuguuuguucuagagcccuuugggggauggggucagggagcaugcgggcagucaagcuuugacaaacaucuggauuugcuccagaacugcauuaagaaaagugguuccuuguuggagaugggaagucagggcccuugguuaugcauauagccaagucaaacagauugauaacacuugucaauggcagggaagguugccuguagccagcacugcagauucaggacuuagaaacgugccucuggggccgagcaugguggcucacacuuguaaucccagcacuuugggaggccgagguggguggaucacgugugaucaggagaucgagaccagccuggccaacauggggaaacagucuucacuaaacauacaaaaauuagccuguagucccaguuacuugggggucugaggcaggagaauugcuugaaccugggacguggagguuacagugagccaagaucaugccacugcacuccagccugggcaacagagugagacucugucuuuaaaaaaaaaaaaaagugccuuugagaccuuugacagcucuuugggaaaguauugugugucuauaugggacagucuugcagucuagacccccauucccccaguguggaaugauaaaagcaugggaugagaacuagaguuccuagcucuggaaauggggcccaggcggcccccacuacuggcagaucccugcagggggagcccagaccaugucucuuuggcagaugcugaauccagggcucuggcuugccccaggauaguccagggcccucugacuuuugucagagugcuuaguaaagauuguagggugucaggcacccugcauuaucugacuuaauucucgcaauaccccugcagguaggccucucaccaccccuuuccaggagugucaaccaaguagucauauaaugcuguuuuucugccuggaagggaggaggccccguuuuuaaaaucuuguaaucuuaaaaacuuuaaucuuguaaucuuuaaaacuguccccauuuuuaaaaucuuguaauauuaguagcagcaaaagaauagcuaaauuauaaagcauaacaaaaugaauacccaagaaccuacuguucuccuuauuacagaugaagaaacuguacagguuuuuagguucagcaugugauuuaacaaaggucacaaagcuaguaggagacaaagcucacauuugaacccaggucucuucaacucacuaacuccugugugguacuucucacugugggcugauggguauuaauagguauuaugagagaagguucuuugguaagugcucaaagucaguggguucuuuugcuguaguaauucucaugugcuuuaaauauauuaaugcuuuuugaaacucuaaucaguauuuuacaaauugauuucacuguagacauucguccacugucuuuuucuuuuuuuuuuuuuuuuuuuuuuugagacggagucucacucugucacccaggcuggagugcaguggcacuaucucggcucacggcaaccuccaccucccagguucagcgauucuccugccucagccucugcgauagcuggaauuacaggcaccugccaucaugccuggcuuauuuuuguauuuuuguagagacgggguuucaccaugucggccagacugguuacgaacuccuaaccucaggcaacaugcccaccuuggccucccaaagugcugggugggauuacaggcgugagccaccgugccuagccugucuacugucucuuaugggacugguguucauggagaaaauuuugaaaaauucuugucuaggagcagcuugagggagaagguggaucuauaaaauaaagguuugggccgggcgcgguggcucacaccuguaaucccagcacuuugggaggccgaggcuggcggaucacgaggucaggaguucaagaccauccugaccaacauagugaaaccccaucucuacugaaaauaacaaaaauuagacaggcgugguggggugcgccuguagucccagcuacuugggaggcugaggcaggagaaucgcuugaacccgguaggcagagguugcagugagccgagauugugccacugcacuccaaccugggugacagagugagacugucucaaaaaaaaaaaaaauuaaauaaaauaaagguuuguucuauccccagcaugagcucaaaucagauuuccaaaucagaggugcuuccuuaaggcugagccugaagcagucuggcuuuuuaucucuuguuggcucuugcauccaguuauuagagcugagguuuggccagccuggccaucuugagggguccuucccaggccugcaguguuuuuaauaguuaaguuugugucuguacaacuagccuuugagaagggagcugaucagcagccaugagagaaggguuugugguacagggccagguagggaaacuaagccauacuuguccuacuaggcuuguggcugaguuucuggguguguagaacugcugcagcucaguagaguaacuuggagugggaguaucuuguggcugccaugcuuccagugauagcaugugagggguauaggaagcucagagcuugcuuccagaguuucaaauuggaaugacgcuagcugagaagaggacagucaucuacccacauuaguuggucucugagcgguuuuaaaagucauguaacuuguugaaaauaaacagauaucugaguaugauggaaauccuuuuuuuuugggcggggggcagggggugggggucagugguggggacagagucucgcucuguugcccaggugcagugggcgugaucuuggcucacugcaacuucugccuccuagguucaagcgauucuccugccucagccucccaaguagcugggauuacaggcgcccaccaccaugccuggcuaauuuuuguauuuuuaguagagaugggguuucgccauguuggccaggcuggucucgaacuccugauuucaggugauccgcccaccucggccucccaaagugcuaggauuacaggcaugagccaucacgcccagccggaaauucuuaaaauauucaaacacaacugucuucaaaauuuuggauccccccaaauggagacuucauguagauauucuauuuuggaaugaggcaguccuagcucucccuggugacucagugcuaucaguggcugccuuggcuuucucuaccugcuaaauggagggagaaugaggaggagcuacaguguacucucuggaguacccuuuuaaaaaaggguuccuggccuguucagggagagucuugcuuccagccucugccuuaaguggccaaggggucuccuuugugucauaccagguuuuuccuugaguauuacagucucuuggcaaaagcauccuggaacuuaauaugauauucccuuccauguagauccuugaaacucucaaguaauggguagagagcagccguaagaccuaggccauguuccuguccuguuauaucccccaggaacuuugguugucugucuacucuucauggucacauguucuguguuucuuuucaguggauaugcugcugaugaaaucacucacugcauacggccucaggacaucaaggagcgccgagcagucaucauccucaggaaguaagugccuugaugucugaccuucugccucaccugcaggccugucuggagauguagcucuggguccacuuagaacucagcuccuauguaucaguggcauggcagaguggagagcagaacuguuaaguucucuuuuuauuugaauccugugaggauaaaguuguuuuguuguuuuaucagaaaauuaaguacucuauuuagggaguuuaggacugagcaaaagcauauacgcccaauauuuguggguauaaucuugagacaagauuugggcaacauucuuccaaaccucaccccaccccuuagccucuauuccucaccuccuucguucuuauuuguuacacguacucuuggugauuauuuuuagacugugccuuuagcagccugcuuuaaaaaugccuggguuuucacugcuggaaggaacagggagugaagagaggagacaagggugggagguuaggauguaguauucggcagaaucauggcuuguggcucuucucuggggagggaaucagggaugugcuacuuaacaucaacaaaccuggcuucaccagcauuuauuucuuucacggggugaguggaagaagccauagccucacagacauuggaucaagacaagccuugccccacuguccacccaucuugcucaggcuggaaugcaguggugccaucauagcucacugcauccucaaaguccuggacucaagcucucuuccugcuucagccuccccaguagcugggaauagaggcaagugccaccauaccugguucacgccuaccuuuugaauagagucccagagaagauaggugauugcccagagucauagaagucagugagcagagcaaaacaagcacguaaacuuaggcuugacccauaaaacuugcugucugucgucuucuuccuuccuuccuuuuauuaaacuuuauuuuuuagaauaguuuuagauuuacagacaauugugauaguacagaguucucauguacucugcaucccauuucuccuauuuguuaauuuuuuauugguaugacuaaaguccauacuuuauuuagauuuccuuagguuuuuccuaauguccuuuuucugucccaagaucauccuacguuacauuuaguugacauaucaacucagacuccucuuagacuccucuuggcuguaacaguuucucagacuuugccuuauucuuuuuuuuuuuuuuuugagacagggucucacucugucgccuaggcuggaauaggcgggaaugcaguggcaccaucucggcucacugcaaccucugcgucccagguucaagugauuucgugucucagccuccugaguagcugggacuauaggcgugugccacaacacccagcuaacuuuauuuuuucguacagaugggguuucccccauguuggccaagcuggucucuaacuuccaaccucaagugguucaccugccuuggccucccaaagugcugggauuacaggugugagccaccaugcccagccugccuuauucuugaugauauugacugguuagguauuguauagaaaaucucucaauuagaauuugucugauguuuuuaugguaaaguguaugccauuuuuacuacauaaccaagaauauauacuaucaauguaacuuaacacuauugauauugaucaucuggccaaugcacugucagguuuuccacuguaaaauuacuguuuuuccuuguccauacuguacccuuaggaaggaagucaccaugcaugcccacaguuaaagagugugggaguuagcaccaucuccuugagggggagcaugcaggugaauuacuuagaauucuucugcaggggggauuggucuacucuccuucauuuauucaaucauuuauuuauauaaguauauuuuuuauguaaguauggacuccuaggaauuuauuuuaugcucaaauucuuccagcuuuggucauugggaauuuuuucuggugcaucaacuuuagucaguaaacaauaacuuuggcauccugguccuuugggcccauaacuccagaauauuguaguggugaagucucuuugguauggcuuugccacuuugccaagucaaaacuuuuagucuguuuuaacuauaguagauggguaugauccauaucugugggacaguccuaugguacaggcagagcagugaacacgugggagcuccagaaacuugggucaacuuggugggguuggcagccucucuuuucuagccuaagacuguucccagaauuugucagaggaagggaagaguuuuuaucugccuuguacuuuauuuuucugugauaaccagcauaggcaagaacucggaaacaauggaguccagaguguagcacucuuccagccucuccuccagucauuucuucucaggcuguaccugguaccuccaacugcagccagggauggguggccugcccaggccaggaaccuggagaggaacuucuaauguuacauagaaccagagcaguaacuucccaagaguuccucucaucuucccauaauagcuuauuuuggggaaaucuuaguuggaugugcaggugguaguggccauagcuggagugucagucuuccagcugcuacucuuuuauugaauggugacucccauaccuggccgcccaguccaacugagucagaugcuccucagcacagcuaggagucugcaccguuaaucagcucccugggaagcuuuucagccagcuaggucccugccaguggccugaccuugggaauggcuguuacugggugacugaagcucuucuaccuucugacuucagugggcccaggaaccauucacagacugggcuggagugcagaagcacagagcugugguguaaggggacuggagaagagugggaggaugucccagcuuccccagguagcugagcuggggaagugcacagcuguggggaacucuaaaguaucugcagcuccuguuaugguuuauggauuugugccugggcucuuguggcaauguggccuccauugggcauaccuucucaucuaacauguucauccucugauucauaucccaacuccccaaauaaaccuacaugauaaccaacuccucagauaaccuagucauucuucaucguucagauugaccauuuugacaugcagaaagcaucauauaaaaagcccuuuagcuuuuuagcaucaccuaaagcccuuucagcacacaugcagacacauacacacaccccuguuuggacugucacagcucauacgcuugccauugugaauuuucaaaucugcauucuguaggaguaaggagaucccuguucaucuggggccuagcaugaggugcagcccagaggaggcaucaacuaguguggagaacaauucaggccggugaggagcagcuccagaguagcuacauggguuugucuugggaaaggacggguugugacaaguuuaaaaaggggagcaucuuggcccaggcauugcccggagauaaguaugauguggccuuggaagauaccuggcugguuugaugucuucuggugagguuguguuacaguggguagaaucugggcauugagccuggcccugauuaugguagaggaguuagagccgguccugccuucucauaaguucagauaaagauugcacaggcugcugguggagacccugggagcucugucaccagcucaggucagucagagcuggaaaggucuuucuaagggccucacggaaggaaaugggugggcagcugccaagugcuuucugguuggacagaacgcagcuucugugaacauggguggugccaagucuucaugcacaugugcccuuguuucuuacggggaggcuggaaguaaccuuuuaaaaaagucuccccagaguggaauccucagacugucccuugguguuauaauguuuggggucacaacuuagccaguaaauggcugagugacaccuggaaccugggucuugugguucguuggugguuugcacaguggaguaccccaaguccugcccuuucccccagugugucguugggauggaugcuuugaguuaggaaacuggagcucagauauagaagggcuuucuugccucugcugugcaaguagagaguugugcugauuggggagaauguuaugaguauguagggggcacucuacagagaguggggugaggcagcagcuacaggcuagucggcucuuugaggugccucagcacccccaaacuucccugaauguuacugucucccagccgaccgagggcaagcugccgcagcaugcaagucuuuucucuguaaucguugguaacccuggaaggggaggcuggaccuaaccuuacuggaggugugguuaaaguucuaaauuacuaguuagauaaccaagaggcugacaaacuucugggguauaauaauucaucugugaggggagucuuccaguuuucccaugauucccuagugcuccugcacuagugcacucugugcuucugcuccugguaggccuugcuagcugcccugugccaagcauccacauauuaaccuugaaacuagaagguaugaacucuguuuggaaaggggcucagguaggaagugagcugccucaggucauugcuaguuggaauggccuuugagcagggauuucugacuugagggaaacaucaaguaucuacuauguacaaggcacuugaggugggcaccacaggaaauuuagugcccccuuggugcuucacauguaauaaguuugcacuuugccugccauuccaacacaaagcagagugaacacugguguaaaagcacaggguauucucugggagcccugcaaaaaaaaccccaaaaacccaggccggucgugguggcucacaccuguaauccagcacuucaggagggcgaggcaguuggaucaccugaggucaggaguucaagacuagccugacuaacgugaugaaaauucuaaaaauacaagaauuagcugggcauaguggcaggugucugugaucccagcuacuggggaggcugaggcaggacaacugcuugaaccugggaggcggagguugcagugagccgagauuguaccauugcacuccagccugggagacagagcgagacuccaucucaaaaaaaaaaaaaaaauuuuuuuuuuuuuuaaauuacauccagcuuugcgggaggaaggguaaaggugagcuugguagaucuggccccugagcuagaaauugcuggccaggcagaaaugguaagcucaaaggcuaggaggcagggaaauauaggggacuucuguagaugaggaaugaaagagggaaggaggccuuaggucaacauuugauucucaagagauggcuuaugggucuucggggccuugaguuggugacuagggcacccaaucccuugguuuuuaggaggcccucaggauugcacugugagacuuguauucuugagauugguacucuccaguuaaccagauaaaguggcacaaagcaguauauauagcccauuuauuugcuuuuggucaaguggaacucagcucagaguggucugaagcugggaaaugcagcuggagaucccuuugccaagugguaaccuaagcuggugugugcuaggcucugugcuaguacccggaaugggguuuguauggguuccuauucucuuuuguccuuugggaaaaggcagacauuuagcaucucaacaggaacuggucaaagaaggcuuuccagauaagugccaccugaagguagucaaggaugcuuggaccuuagccagcauagaaugaggcucaggggcaaagauaguucagucagaagagaugcucuuuacagaggcuuggaguccaggaacucuguucuggaacacagaauagauaaggaguggaggacuugauacaccggccuaagacagcaaaagcuucacgcugugcagagaaauguuaagcgcgcuggggagccguggaggcaugugagcaguggggugagggauuugcaugugagagauuguaggaagcgaagcucaauagcuuacuuggucauuagauccacagaguucgaggagucaggagaccuuccaugagagcagagcaaucugaaugugaggcugaguggauggaugagcaguggaaggaaguggaggucucauucuggaccucguuccucagcaguggggugagggguggcuagcucuuaguuucucugaccagggcuugguguugcuccuuucuccaugauuugugucuccugugguuagauuuagcuuacauuuguucccugguucaguaagucuguguccacgugcauacacccugcccuuuuggcagccugacuguucugaugugucuguggccugcccaaggaauauggguacaaugggaucaccaggaaggugacaaacuugggcuucugcccuggcucugccacuccucuccaaaugcagucuuaucugcaccuguaaauugggcaguugugguuaaacuugugaaugcuagguggucuucuaaacucuuccuggcugggugcgguggcucgcacuuguaaucccagcacuuugggaagccgaggugggcggauugccugagcgcgggaguuugagaccacccugggcaacauggugaaaccccaucucuacuaaaauacaaaaaauuagccgggcgugguagcaugcaucuguagucccagcuacuugggagaaucgcuugagcaugggaggcagagguugcagugagccaagauugcaccacugcacuccagcuugggcuacagggugagacuccaucuuagauagauagauagauagauagauagauagauagauagauaggauagauaagauagauagauagauagauagauagauagauagauagauagaugauagauagauugauugauugauuuaaaaaaccaggugugguggcauauaccuauaguccgagcuacucgcgagccugaggcaggaggauugcuugagcccaggaggucaaggcugcagugagcuguaaucccacccgugcacuccaggcugggugauagaccuuguuucaaagaaaguaauuaauuggccgggugcggugguucacgccuguaauuccagcacuuugggaggcugaggcgggcggaucgugaggucaggagaucgagaccauccuggcuaacacggugaaaccccgucucuacuaaaaauacaaaaaaaaucagccgggcaugguggcaggcgccugucguugcagcuacuuggaggcugaggcaggagaauggcaugaacccaggaggcggagguugcagugagccgagaucgcaccacagcaccccaaccugggcgacagagcgagacuccgacucaaaacaaaaaacaaaaaacaaaaaaaaacagaagucugauguuggcagggggcugguggaagauggguggggagagucccgugaggggaguggguacuacugcaggagagccagcaagguacagaccugagcuuugugggagucugauucucaaaggugcuggagcuuagaccuuagcucuagggacccagguuacuaaauaggcaagagggugcuuggacaggcccacaauacuggucucugccucgcuuuguuggaaagccaagcuuuuagcacaaggaugccugguaaagguggugccagacguuggagaguaguugguagcuggcuggggacugcccucgcuccagagucaucguggccugagugcggucugguuuaccaucuucccagaaaugguggugcugccaccugcaugcacaguguucucuugcacugaggagggcccaccugcacuuuauuuuuuaauuaaaaaaaaaaaauuagggccgggcacgauggcucacgccuguaauuccagcacuucgggaggcugaggcaggcggaucaugaggucaagagaucaagaccauccuggccaacauggugaaacccugucccuacuaaaaauacaaaaauuagcugggcaugguggcgugcaccuguagucccagcuacucaugaggcugaggcaggagaauugccugaaccugggagguggaggugcagugaaccaagaucgugccacugcacuccagccuggagacagagcaagauugucuuuuaaaaaaaaaaaaaaaaaaaagaguuuaaauagggacaaggucuuacuuuguugcccagguuggucugaaacuccuggcuuuuaaguaauccuucuaccuuggccucccaaagugcugggauuacaggugugagccacugugccuggccccaccugugcuuuagaggccaucacagaguaguagguaguagcuuugugacucaagcuagugauuugcucugggauuuagcuuugcucuccagucccuacagggagaauaauucaccccagcagcuucucuggaggaccuaggauaggaucaacucccucccuucccuucgguucacacuuuagugcuacagccauccuuuguugugaccucccuugucccugcuuuguccugacacgguagguggccgcucuggguaucacggucaaccucacaugcccgaggucacaugcccgaggugcuuugcucugaccuuugaauacugacucaucuguaaggcaggucuucauuccuguugccaccugaggaggccuggguccagaccuuacugcuagaacugagccuccugaauccagauuugugacucucugcuaaacccugaggaccuggccuacgccaugagaguugguugccuuuuaacaggggcauguucugaaguuaagcuacuggugggcacugggcuuggagucaagcucuagccuggcauccugcagcuuggugaauuuuuggaaguguagggagggcaggagcuucuccagcuguuaugagauguacuuauaacagucccaggggaugugucaagagcucucaucuugguggcucugcuuuucuccuaccauccaucauucacccgaagaaacaacuccagagugcccccacuagggcuucacuggggcuuuuggggcacacaggggccuuccuucccugaacaugggcucccuggcaccuauagagucuuagcuuuauggguaccagaggagggacuuucuucaaugaggcccuuagaguccuuuaagucaaguauaaaggcuaacauuuuauuuagucugauuucugccaccuggaccucucaacuugaugacacgaagccugguaaagaaaaggucauugggccaggcgugguggcucacgccuuuaauuucagcacuuugggaagccaggacgggcagaucaccugaggucgggaguucaagaccagccugaccaacauggagaaaccccaucucuacuaaaaauacaaaaguagccaggcguuggggugcaugccuguaauccuagcaauucgggaggcugaggcagaagaguugcuugaacgcgggaggcggagguugcagugagccaagaucgugccagugcacuccacccuggacaacaagaguaaaacucucuuaaaaaaaaaaaaaaauagaaaagguaauugggccaggugugguggcucaggcccauaauccuagcaguuugggaggcugagaugggcagaucgcuugagccccaguguuugagaccagucuggcuaacauggugaaaugcugucucuacugaaaauauaaaaauuagccgaguguggcagcggguaccuauaaucucagcugcuugggagguugaggugggaggaucgcuugaaguugcaaugagccaagaucccgccacugcacuccagccugggcgacagaaggagccccugucucaaaaaauaauaauaaaaauaaaaagcucaucuggagccgggcuugauggcucauaccuguaaucucaacacuuugggaggcugaggugggaggaucacuuagaagaguuagagaccagccuaggcaaaauggugguacccugucucgccaaaaaaaaaccauuagccgggcaugguggcccaguccuagcuucuugggaggcuugggcaggaggaucccuuaagccuaggaguucaaggcugcagugaguuaugaucauaccacugcccuccagacugggcgacagagcaaaacacgaucucucuuuaaaaaaaaaagaaugguucuauucuauuucacauacucaucucugguaguugcccaguaccaccucuacccagagaaucccagccuugaaggaggcaacuugccuucgauuccuuagacccucagcgcaaagaagccuuagagcuagucacauuucuuucuuuugcucagauggggaaacugaggcccgaggagggauggugacuagcuuggacucugaauggcagugccaaaacuagaucauccuccuguugauguuagguucugcauccaugagucuggaggaguccagaguggagucugagacugaagagucacucacugcagcugggcccuacuggcaucccccucugcaaggccaacccaaagggauggggaugccuguccuaccugccuacccaccaguuugggccugaggcaucagaacauugguucccagcuggaaggaaggagaugccccugcugccuuuaggagagagauuuccuacccacguucagaguaacucuugccugucaggcuugaagucucacuuuggcuuuaaacuuucccccgugacuugcaggaugcaugacuuacugccuuucugauccuucccaucuauguacaguaggccagccaguggaauguggagaggcagccauggggaaugggggaaacugaggaccagaugcaguuguuaccaaggaugccaagcagccuagcccaaggcaguucuuggauuucccuccugcuuacuucuccccagcauccucuaguauccuuagaguccugcucugacugcagccccuacuccuucggaacuaaguuacuacuuugugucuagcagacccuggaaaaggugccuucagggucucugcuagcuauguccuaucgcuucccacccagucuauuacauggguccuucugcccuuugcucccaccugccugacuugccagccuucucuguaccacacaaggagccugagggcuuugagguuuuccaugccagcucccuucuguucuggcuucauaaaggacuuggaucacugcccugaguuaccgcuacccagcuucuccaucccccucuuccucaucuguauuugugugccuucccuuuacuaggcaguguauuccuugaaaccuauggcuacaccugcugcuugguggggacugugccuucaaaagcccucuggccuuuaccuugucagcauccugaaaugagcagaaacugccagaugacugcucaugguuguggagugggccuggguucccuacccuggcucugccacucagucucagcaucccugucugcacagugagaagauaggguagcucuggcucucuuucucuccagccccucuacaggccuggaccagggauccuuccuguguugggacccaccaguggggccguugguccucuggcaaaugaaguagauggccccagagaaccuguggguccaaguggagugaggugaggcugcuugguucagcuaagagcgagcccugggaucuugccccuaggguagcacagccugucauugggaguuuccagacagaaguguucccauuccuuacuccuaaagguggacuugaggagggucuuugaaagucagcuagaccaaucucuaguugaaccucaaggagagugagguacagagcagagacugcuggcuuccaggucuagcuggcucccacuuggccuggccagagaauuggucugauggugcccacaccuucaccggaggcccuuuggugaccccaugcauguuuccuuugcaggacaagauuagaugcaccccgguuggaaacaaagucccugagcagcuccguguuaccacccagcuaugcuucagaucgccugucaggaaacaacagggacccugcucugaaacccaagcggucccaccgcaaggcagacccugaugcugcccacagguacucaguuuaggacccucagcaaaggcuggcaaaggccuggcugcagggugagaaggguggagaagccugggguaggcuguuuaggagccuuggcuugcucacccuuucaaaaccuuaugucugguuccucuggguugguggcauuggugacauucccaucuaacccuggccaacugccuguacacccagagagaaggggucaggcagagacuguaacagauggcaauaucauggcuuucccaugacuuuccuuguucagucucacccagacacccuuguggaauuauacuuagaugucaggagggaaucuugggacuuggauaauagugaaccagggacuuauuucaaaaaggauuggauaaaagguauuugaggagauaauuuuuuuuaaaggaaaaaaaauguuuuggccggcacaguggcucacgccuguaaucccagcacuuugggaggccaaggcaggcagaucacgaggucaggugaucgagaccauccuggcuaagacggugaaaccccgucucuacuaaaaaauacaaaaaauuagccaggcgugguggcagguaccuguagucccagcuccucgggaggcugaggcaggagaauggcgugaaccugggaggcggagcuggcagugacccgagauggcaccgcugcacuccagccugugcgacagagcaagaauccgucucaaaaaaaaaaaaaauauuuuuuaaguguuggggaagguuuccaaggagguaauguuuaaguugauuccagaaggauaaggaagacauggaagagcauucuaggcaggaaauacuguaugagcuaaacccugagauacaaaagagcuuugugguuucaggggguaaugggguuaguaaguggagaaggggguguugggaggcccaagagagagaaaguggguagagcugggaaguaaagguagauggcagaaccaugcagagucuugaggcugugguagggaagaccucuguccagcagcccuggcagugucccagggcaccagacuccaagccaggcagaccccacaggguaauugggaaaugucccaaagacugggauggucacuggcacuuagugggcaagaaccuccgauaccagggccucugccaggacuacccuucguugaggaccacugagcugaagugacccaucccaaggaugagacgagguacagcgguaaagccaggcgccuccugccagccucucagauaacguccuaccucccuuuccuugcaggccacggauccuggagauggacaaggaagagaaccggcgcucggugcugcugcccacacaccggcggagggguagcuucagcucugagaacuacuggcgcaagucauacgaguccucagaggacugcucugaggcagcaggcagcccugcccgaaaggugaagaugcggcggcacugagucuacccgccgcccuccugggaacucuggcucauccuuacguaguugccccuccuuuuguuuugaggguuuuguuuuuguucauugggggguuuuuguuuuuuguuuuuuguuuuuuuugauucuauauauuuuuccuugguuuuguugccuguuagggcugaagaauagaauuggccaggaccuagguucucauauucuugguauuccuccuggauggaaaggcuguuggcaucaauaggggacagaggcugaugcuggaguggccaguagaggugguggagcagagcagccaucuuuuaaguggggcuguaucaggcuggguuuauuuaaaagcaacaaaauguuuugguuaagaaaauuauuuugcuuucaguguaaaucuucgcaguguucuaaacaaaguucagucuucugcucgccccuuucccucacugaugucugcacuugguugaggucuccuggagccucacaggcucugcuguucuccacuucucaccugccauccacgcccugcaagcucaugcaaacacccuuucuuccuccugcggcagaguuguucagguugccugggcaggggcuuaaacagugccagccccugccaucccaaagcuauuguuaagccccccaggcguccuccacccacgcccacuagccugccauguccacaguuccuugggcugcugaggggcuagugcagugguccugaccucucuuaucaagagcacacuucuuugcugguugcuccuuuugagcauaugcgugugauuauuuggaacaguuagacuugccacguugggucaguuuuagaaauuguuucuagcuagagggacugguguccuuccaagucuagcauuugggguauggaaaauuguuguggugugugguaggguuuuuguuuucuuuuuugaguuuuuuuucccccuuuagucuccuggcuuuuuccuuucccuucccuucuccacuggccagcuugggccucauccucaugucauccuucuaggaaggcgccugccccaucuugucugccggcagcaugcauccaaggccagagcucaggccugcagacugggcuggugccuccuccgcuucaggguaugggaguuggugaaggggcuuucaaaaaauaauaaggaaaaaaagguaaagucuuugguagcuucuauccacucagauccuggaaggcagcaagguuuuguggaucuagauucauuaggaaugucuucuugucagccaggccaggacccgggcuugccaagagcagaggcccucccagcaaccaggauaccaccacuuugggggcuuuguguacagagguccgggucugagaccucauaggcugcagaaaucuggggcagccaccaucaagaagccccucucaggggccagaacuccuuugccagcguggauuucucaagucgggacugcauaauuaaagcaguugcaguuuuauuuuuuuuacagcuuuuuucccaaaaaugauuuguaguugugugugcagcacuucgcccugauaugugugcucuacaauaaaaaccaaaucuaauauauuuugaaacaguugucugauguuguuguaagagagggcuugccuuuggugcuuccuuaaucccuuuacuuucuuaaacuugaaacagggguuggggaggcagagcuagcucauuggccgccagcgucccagaggaguugguuggucuuggacacugggccuccugugugccuagccuuggguuuauggcugaagguggacuugcccucaccccacuguccuuucucccacuccaaggagggugaacuucauaaaccacaauguccaggugcccagggaccacaccuucuggaguucuggaagucccucuuuuagauaugaucacugagaggcuggugcuggugaagggggagauggcaggcacaaaagcaagggagaaccuggcuuuuguggaaaauaugcgagugauuuugcucauuaaacaaauacuuggccaggcacgguggaucaccugagcucaggaguucaagaccagcaugggcaacuuggcaaaaccccaucucuacuaaaaauacaaaaauuuagccaggugcguuuagcuguggucucagcuacuagugagacugagacagacaagaauugcuugagccugggaggcacagguugcaguaagccgagauugugccauugcacuccaaccugggcaacagagcaagaccuugucucaaaaaaacaaaaaaaaaaauucuugaguuccuauuguauaccaagccacacugggaccccaauagugagcaaaacucuggucccuccuuucaagaugcucaugauaguguggagugcagguacuggcaugaagcagauguuuuucaauggguaaggcuggggcccagagggcuuuagucccuccagacuucagaccuggcucccuaugccugguaaagggcuucuaucuagagucucuuacucuguucuagugcucagagcuagucugcuuggccaaauucuugcuguggaaacuuggauaagcugcuuaccuccacauuuaccagagaagagagacuccagaguggggcaaguaacuggcccaggcuuggucuaaaaacuagugcgagggucugaagagagaggggccagagucucaaguguggucuggggcuaguugggccuggagggguagacacugggcuaggcagaguggaccuuggauccccuggagaaggaaacaccggaucugagagaaagugacuugcagaaugucauccagaguauaaauggcagaaguaagcaucccccacuccaugccugagcuucugacucuuggggcaugggauaggggcucagagaagggcugggggagugcgaggaaccgucuuuguggaggacccuauuuuccauugccauuaaaaagucagacuucuggccaggcgcaguggcucaugccuauaaucccagcacuuugggaggccgaggugggcagaucacgaggucaggaguuugagaccagccuggccaacauaguggaaccccgucucuacuaaaaauacaaaaaauuagcugggcaugguggcgggccccuguaaucccagcuacuugggaggcugaggcaggagaaucacuugaagccaggaggcgaagguugcagcgagccgagaucgugccacugcacuccagcccagcggacagugcgaaacuccaucucaaaaaaaaaaaaaaaaaaaaaaaacucccagccugaccaacauggugaaacuccaucucuacugaaaauacaaaaauuagcugggcguagugcugggcgccuguaaucucagcuacucaggaggcugaggcaggagaaucgcuugaacccgggaggcggagguugcggugagccgagaucgugccacuggacuccagccugggcgacagcaagacucagucucaaaaaaacaaaaaaaaaaaaaagucagacucagccaggaacaguggcucauaccuguagucccagcauuuugggaggccaagauggaugagcccaggaguuugagaccagccugggcaacacagcaaaacccugucucuacaaaaauacaaaaauuagccaggugugguuguaugcaccuguagucccagcuacuucagaagcugaggugggagaucacuugagcccaggaggucaaggcuguaguaagccgagaucgcgucacugcacuccagccugggugacccugucucaaaaaaaaaaaaaaagauucgggccgggcgugguggcucaugccuguaaucccagcacuuugggaggcugaggcaggcggaucaugaggucaggaguucgagaccagccuggccaacauggugaaacucuuucucuacuaaaaauacaaaaaucagcugggcacgguggugcgugccuguaaucccagcuacucaggaggcugagacaggagaauugcuugaaccugggaggcggagguugcagugagcugagaucacgccacugcacuccaaccuggaugacacagcgagacucugucucaaaaaaaaaaaaaaggauucagccucuucccaaucccugggugaaaaaggcccuucacccuguaguauggagagauaggaggacuagaggagggggcuuuggcccuagcaguuccugcugucucucuaccuguacaguagcacucuaucucuguaacauaauccucugaguagucccuagaacucuacaucugauucuggaucugccugaucugauucuggaucugccuguucccagccaucuccuagggccucaggccaggugcugagucccaucaaccccugucccuagcccagucuucuacacaguagaugcucuaacagcuggugccaucccucaccccgcuaggaccccaucccauuccuccaacccuuuuguguggaaggggaaacugaggcccagagaaguugacuggccagaggucacguucacgcauucaaaaaauagugucuggccaggcgcaguggcucaugccuguaaucccagcauuuugggaggccaaggcagguggaucacuugaggucaggaguuugagaccagccuggcuaacauagugaaaccccaucucuacuaaaaauacaaaaauuagcugggcaugguggugcguacccauagucccagauaacucgggaggcugaggugggagaaucacuugaacccaggagguggagguugcagugagcugagauugcgcagugcuggagauacaagacagaccuaguauaugaugucauauacgcauaaaguuauaaauuuuacugaugugaaguauagcauauaaauauuauuuuugagauggagucuuguacuguugcccaggcuggagugcagugaguggagugaucuccacucacugcaaccuccgccucccggguucaagcgauucuccugucucagccucccgaauagcugggauuacaggcaccugccaccaugcccagcuaauuuuuuguauuuucaguagagaugggguuucacuauguuggccaggcuagucuugaacuccugaccucaugauccacccaccucggccucccaaagugcugggauuacaggcgugagccacugugccuggccagcauuuaaauuauuaaaacauauauauucuuauaaauuccauauaaccaaucuuuucucacagaaaucuauuuuaguuuuuuugcugaauuacuguauuuguagucugcuugugcuuauaauucagccaugauaugacaaagggacuugcaucauaccugcuuguaauaguuucccguggcugccauaacaagucaccacaacccugguggcuuaaaacgacaaauuuauuucucucaaauucugggaaacucaacaucacugggcuugccugucuaguggaaaaccuguucuuugccucugacagcuucuguuagcuguuaacauuccuugacuugggaacgggcagauucacgucucugccuccauggucacauggccuccuccucuguguaccacaucuccucuuuuuuuuuuuuuuuuuuuuuuuaaagacagagucucacugucacccaggcuggagugcaauggcuggaucacagcucacugcagccuugaccugccagguucaagcaaucuuccugccuuggccucucaaacugcugggauaacaggugugagccacugugccuggcuucugccucucuccuaauaggacauucacgauuggauuuagggccccucugucacccaggcuggagugcaguaacaugaucucgacucacugcagccucaaacuccugggcucaagugacccuccugccucagccucccaaccucaggugugcacacaccacuacacccugcuaauuucuuuaaaaaaauuuugggccaggcgcggaggcucacaccuguaauaccagcacuuugggagguggaggcgggcagaucacgaggucaggagaucaagacuauccuggcuaacauggugaaaaccugucucuacuaaaaaauacaaaaaauuagccaggcaugguggcgggugccuguagucccagcuacucgggaggcugaggcaggagaauggcgugaacccaggagguggaacuugcagugagcugagaugcgccacugcacuccagccugggcgacagagcaagacuccgucucaaaaaaaaaaaaaaaaaaaaaaaauuuguaggccgggcgugguggcucacaccuguaaucccagcacuuugggagaccaagguggguggaucaccugaggucaggaguucgagaccagccugcccaacguggcgaaaccccaucucuacuaaaaaauacaaaaaguuagccaggcuuggugggcgccuguaaucccagcuacuugggaggcugaggcaggagaaucgcuugaaccugggaggcggagguugcagugggccaagaucgugccacugcacuccagccugggcgacaagagcaaaacucuguccucaaaaaaaaauuuuuuuuuuguagaagacuucacacuguguugcccaggcuagucucaaacucccagccucaagugauccuccugccuuguccucccaaagcacugagccacugcacccgguccccuauguaaugauguuuaauuauauucgaaagacccuuuuuccuuaugaggugacauucacaggucccagggauaaugacccgauauuuguggaggccauggaucagccccuacaugcccuucucccaguaaaguuauugccauuaaaucugauauaucaucugcuuucucauccucaaauauuaguuggauuaaaauuucucagcuauagcaguacuuuuaaauuuaaucugaaucauuaauauuuuccuucacuuucucuuuuuuuugagacggagucuugcucugccgcccaggcuggaguacgguggcaugaucucggcucucugcaagcucugccucccgaguucaugccauucuccugccucagccuccugaguagcugggacuacccgccaccacgccuggcuaauuuuuuguauuuuuuaguagagacaggguuucaccguguuagccaggauggucuugaucuccugaccuggugaucugcccaccucggccucucaaagugcugggauuacaggcgugaaccaccacauccggcccucuucaucacuuucuuaaaucuagaccuguguucuucaguacagcagccacugauacuuggcuauugaguauuugaaauguggcuaguuugaauugaaaugugcuuuuaguguaaaauaccagaauuugaagaguuaguaugaaaaaaacaauguaaaucauuaagaacuuuauauugauuacuuguugaagauacuauuuugagcugggcaugguggccuacguauaaucccaucacuuugggaagcuaugguggauggauuacuugaagucaggaguuugagagcagccugaccaaauggcaaaaccccgucucuacuaaaaacacaaaaauuaggugugguggcgcucgccuguaaucccagcuacuugggaggcugaggcaggcuugcaccuaggaggcagagauugcagcgagccaagaucgugccacuacagccugggugagagagcgagacuuugucucaaaacccccccaaaaaagaagaaaaaaaaaacuauuuuggacauauguuaaauuuggacauacuggguuaaauaaaauaggcugaggcaggagaauugcuugaaccugggaggcggagguugcagugagcccgagaccgugccauugcacuccagccugggcaacagagccagacucugucucaaaaaaaaaaaaaaaaaaaagcuauuuaaauuaau

SEQ ID NO: 16596 - RNA, 19964 nt, Homo sapiens
aguucaccauugucuggccaacaggggcggggcgggcggcacggcgggcucgcucacuggucgggcggcgcguccgucgcgcccggcgcccacccccgugcaggcccggccccgcgcgcccgcgcccgggccgccuggcgccccgcccgcgccuuaggacccgcggggccgcgcggcgcauccugcgggcggcggcggcgggcgaggcgccugcagccgggcgcaagaugaugaaguuucgguuccggcggcagggcgccgacccgcagcgcgagaagcucaagcaggagcuuuucgccuucaacaaggugcggcggcggcccgggcccgggcucgggcgggagggggcgggacgggggccugggcugggggcccggggucggagccacgucgggcccggggggcgggggcuggcaugcagcgcggcgcggggcggggccgggccgggccgcgcacccccucggcgggccccgcucuggcucggacucugggugggucugggucuccggccgacuuuccgugucugcuccccgagucucugcgggccgcucuggcccuggcucugccagucugugugugugggggucugucucugagacucuuugccugucucugggucucugucccucuuucuccgccgcugaccggcugucucgccccaguugugccuguguguguggugggggugucucugccucugccccuuccuaucucugccugucucccuuuaucucucugccucucauuucucuugcugccugugcgucucugagucuucuuugccugucucucccugcgugucucucucucugucucuguggagucucucgaccucugucgcucacuucugucucuuuauccuuuuucuuaggggcuccauugcgucccugcucggcccuugggacagcccuggggcccgguuuguuuugugcuuuggcacccaggagggugagagaguuagugggggcgaggcagcuguggggggugcggcugggaaaucccuucaaggagccucuccuuccuucccccacugcuccaggcucugccuugcccugcucugcccugcccggggcuccgaguccaggggacaugccuggcuguguacuacacugcacuucgcaucguggggccucaguuucccuagcugugaaaugaggcuacuuuucuccauacugugggcccuggcucccucugccacaugggccagcuguccugccuuucugcaccaagguggagugagguggaggcuuuuccuuccuuucccggagugggacacuaggggccagggaaaggggccgccucagcccccgccucccucugcacugauguuagagcagggccucagcccacuccuggcucacugcucuggggacguugguuuuguccucauucuuaccccagagcccacugauggcagagccucucagugcucuucgaaauuagaguuaucuucaaaauacaggugagaaaauugagguucugagaggggugacggcuugcccggagucagagugagcugcaccaauaucuuucuugaguucuugugucagugggguuggauuuuagccuugaggggcagggauuuuuccaaggggcugcugugguccugggccaguguugugccaggcgcccugggcugccuugaggagacacuugucuuggaggaggcucugggacggcuggaccuggaguaguggaggcacugggaugucucaggguuucccugccuaggucugcagugauugccgaugagagcugccaggacccucacacgguggcugagaaccugcuaggaaccugagaggggcccagaagggaagcuggugcuccgugguccccagauggcaccuauuuucugugccggggaggcugugagggugaggugagaggagaauggcccuucagggaaaggcagcaacaggcacagggcuaaaugucacuuuuuuuuuuuugaaauggggucucacucucacccaggcuggagugcaguggcacaaucacaguccacugcagccucacaacucccuggcucaggugauccucccaucucagccuccugaagcugggacuacaggcucgugucaccaugcccggcuaguuuuuguauuuuuuguagagaugggguuucaccauguugcccaggcuggucucgaacuccuggguucaagcuaucuauccauccauguuggcuucccaaagugcuaggauuacagacaugagcugccaugccuggccuaaaugucauuucuucagccagugaauuggggugugcagugggggcuggagacagaugggggugaagcucagcccacucuggcuagccuugggguggcggaaaguaagggcccuccgcugaggaugaagcgugggcagcagugguggaaagugggguggucuuggggaagggacuuagucaccuaaguggguaauaggugaucgcuagggaauaggccccugauuccugagcuuagggggugggagacaggucaggagugagcagggacuuuggacucugagucuuggguucaaaucccaguccagcccacacaucgccuguggaaugugccuucucuguuaauacugagccccacugugugugaggucuccaaggugcuggggacaacaguaguuaccaaaaaggacaaauaccuguuaacucagguggcugauauaguugugcaggagacagugaaaagccaaaacaaaaaaguaaaauagacuguaguugggaugguagccagugcuguggaucaaauaaaguagggcgagggggugagagguguggccagggcggcugcugcagccaggguggccuugggaggcuucucugaggagauuacuccugagcgacaggaagugcuggaggaagugcguuccaggcagaggggcaguaggugcaaaggcccugaggcacaagccucccuuagcugggagccccaggaggauccugagcaggggagggacaaggaucuggcuguggcuuucauaggaucccucuggccucugugggaacagacuguagugaguaccaauccaggcacgugacgguggggccuggagcagggagggaggugacuucuguguguuuugaaacugaguugauggggcucagaaauggacuggacgugggguaugagggaagcagaugcuggacagugcauguaaccuccuuuccucguuuguaaaaugggaaggcuguggggauuugcgaugcagugucccgucucuggacccugguuguagcgagggacuggcuagacaaggucaggugcagcaagggcgugguauuauuggugggagagagaagccccagccaaaucgccaacucuguccuuaggugggcuuacugucccaagggcccagaugagagacugaagcuuggagaguacugagucuuggagaguacugugacuugcccaaggccagacagcuaggccgugaccaaaccagcugcccagagggcucaguccccaccuggaugggcagaggcaggcagggagggagguucgcguuacaggcugggaacugggguuucuuacaaaugugcaucuuccugaggcagugggucaggaauuaccagugguaaaagugaaaaauaaauaacaacaacaagauaaaaggaguuaccaguggcccacguggguguccugcacugguguucaggauggggcuggagcucagcugugcaggcuucccagggagggcacagccaggccaaagacaggagacuggugcagaaagggugugcugugaaaggggcaggggagcggguggggagcuguuucaucgacacucugggcacacagacccccuuaacaccaucuccgccccugaugguuaugggagucauguugcccagcuguuggcagguggggaggugggaggaugccuucgggguccaggcagaaagcuaccccucucugggccucugucucccugugucugggaggagucaaaagccucugccuagcugauccuggauguugucccuugaccucugaccuccacucaggccuguguuuggggagugucauggucaucuugcgggacuccuccgcaagcuuuagucugugccucuaaaaauggggugcagagcccuucauggagcagguggggccucaucagugccugcaccucugugagccuugcuucaccuguuuguugcuggagccuccaugcaguggggcccacaugagccugugugcauugaggggcacaggggcuuggcaaagggcgggccucuguggacuaugcacgcgguacagucaugguggaggcuagggguuuagccaccuccccaccaacuggaggcaugauaacccauuucacaguugaggacgcugaggcacagagcaaguagaccugccuccuacccccagugugucagcugcagacccuggaggcugccuuggggugggccucagggugggccauggcagaggugccugggagugcuuacccccagcagcccuccccuccuugcagacuguggagcauggcuuccccaaucagcccagcgcccuggccuucgacccggaacuucgcaucauggccaucggcaccaggucuggggcugucaagauguauccuuugcaggacagguguucagggucuguucaggaccaccugccuguaguucccugugcucuggggucccagucuuggcaguguccagcucgagaggaggacagaggugcucugaugggcaguagugggggcuucugcggagguuggcguggcuucuguaccugagacaacugugcagagaugaugggguccuuuugcugagagacgggugguggggggucaguuugcaguagcacagcugucccuugcuacgugucagccagccaguuaccuaggcgacccugccaucgucccagcaacucuggggaggccaggcagaaggcugggcuaugauacccauggaggguggcaggugggcugggggcccuggugagcugaugcacacaugugugaaugugaagacacauguguucagcaaaggggccugggggcagugccaggcucggcauggugagcacagcacggcccccaccuggauacuggcugcugcacaaugggcugugugagccacacaaagcgggcauuuucccugcaggccuggggugggggugggggcaggccggcagcucagugucuccuugccagcccuggagaaucccaccccaacugcucuuggggaagccgaggugccagggucuggcugauggcggcuuggugaggggugcugaccccuaccccuccuguguggccuucuggguuucaguauccugguuucagacaucaguucccagaaaaugugucagugcugggaaaggggagggugugggaugggggucuccucaccccaggacugggggcacugaucaggcagggaugggacucugagccugugguuugugagcucuuugccuacucuggggaguguggaugggcugagauguccccuucucucccauggccccagcggccucuguuggugaguguggcagugcucugggccccacaugcuccgcugccuggccugcugcucccacuccugugggugcugcgcugcgugcgcacaugugucccugcagccuucaggugucccuccuguguuggggucuccagugcacuuguccucaggcucaaaaagaaccugaagugcagaugaggagacugagccucagaaaggaggcuggagcccgggguccucuucccuuuuuccccugacugccacugccuggagccccuuggguugggaaacugaggcuggagagggccagcccuggucacuagaagcugccccucccccugccaggccagccccaucuccuugacgacccugguucccgcccagcugcuccuguccccucuuuugucccuucuucggaguuucucgccaggcuccuguagggaaucugagcucaagcuccaggcaacggcuccuguguugucaccggggcaacguugcugacuccucccugcacccucugucauggggcccccucaggcccugcuguccaccaucagcccuggaguugccgggacucaggcacugacacugggcacuucaagcaggucauccacccccuccaagucugugugcucaucugugaaaugggcaggcuggagucucuccucccucaugauggcaguuguuggcugccugcuuuggagggagguggguuuuuuuuguuuuguuuuguuuuuuugagauggagucuugcucuuuguugcccaggcuggagugcagucgcacaguuuuggcucacugcaaccuuugccucccggguucaagcaguucucugccucagccucccaaauagcugggauuacaggugccugccagcaugcccggcuaauuuuugcguuuuuaguagagacgagguuucaccaucuuggccaggcugguccucaacuccugaccuugugaucuaccugccucggccucccaaagugcugggauuacaggagcgagccaccgugcccagaggagguggguuuucuuacccauggcugaaguuuggccugaagcugugggaaaaggcagccuggacucuucugcccccuggcuuucuuguccaggccuggccuugcaccucuggccugccugaucccauccggcaaggcgcagcucccagaacccauagacacacggagcugaaguggagcggagccccauccucucaccaggcugaggccaagccugcuggguguguuuauucucacuugaucugcaacaguccuguaaagugggagucacuggcccaauuuacgggaagugaagguccuauagcagcaccugacuugcaggagugaguggagccugcacacugaucuuggggauacuguaggggugcagagugggagcuuuagggagggggccuccguucuucagggaggacuccuggauggucaggcccaugccggggcccacuggaauaguccgggucaaggaggagccuugggugucuuccucacugugguuugcuggucuaugccuauuuccaccuugaccugccacccucagcuauggugcaccuggcguggaguucacaggccugcaccgggaugcagccacugucacacagaugcacuucuugaccggccaggugagccucugcuucccacuagccagcucccuguggcccccauaucuacucaucccccuaggccagccuaguuuucaucucugcucacacaccagggccgccuccugucccugcuugaugacagcagucugcaucucugggagauuguccaccauaauggcugugcccaccuggaagaagcacucaguuuccagcugcccagccggcccggcuuugauggugccagguacuggagaacuuggcuggggccagccaccgggcagggaggaucugggggaggcugugggaaccugcugugcaaaggcagcauggagaugggcagcgguucagggcgggaugccuugagcugggccugggucccaggcugcagcuguuggacccugcuuuacugagguauacucugaacuuuucagguuaaaugggagguuuggguugaguccgacgugagcagguaauuaacauugugagcagcaggagguacaugcauuauaugccaaacuucuaggaccugaggccuggcacuacacuuacugcaaugaugggggugucuagggguuuggggcagggccuaagccaguuaguaacaggaaggguccccuggccucuucaguugugggugggagacaggccuuucugugcauaggcaggguugagggcaaggagggucccaugggcugugcuugguaaggcgcuggcagcaugccccagcugagugagaguguggggcaucucucuccccagcccugccugaaauagcuggaaaaggggaguaccaacccagggauggauuccugaugccucccagcuucugcagauggggguaucuggggcccuccugcgaagucaggagaugucugagcgcuggcagcgggauuccuaggaggggcucagcggggagcuccugguccuggcuugggcagugcccugguuccugcuguccucuccuggugggugggaggagcugggagcccagucugcaagaccuagggacccuauuuuuauccaucucccugcugacauccugaugaauaauugagcgggcugaugaugaugcaugucuuccugggguggcucuguaaguaggcccuggugagugcuguggggccagugaugaguuaucagcaguggcccagccccucacaccccaccugagcagguggaugggcuuguacccucacucccuuccccuuguucccugcagugcuccgcucagccuuacccgagucacagugguccugcugguggcugccagcgacauagcagcccugggcacugagggcagcagugucuucuuccuggauguuaccacccugacccugcucgaggggcagacgcuugccccaggcgagguucugcgcagguaagaggccggugggcuucccagcacccacugugugcccgggaaguucugcuggcucaccugccuuccuccacagcgugccagacgacuaccgcugugggaaggcacugggccccguggagucacuccagggacaccugcgggaccccacaaagauucucauuggcuacagccggggccugcuggucaucuggaaccaggccucgcaguguguggaccacaucuuccuggggaaccagguauguaggugaggccuguguccccucagccugggccccuugugcaugcccaccauggcucaugccugccugccugccugccccugccugcccgcagcagcuggagagccuaugcugggggcgugauagcagcacuguggucagcucacacagcgauggcagcuaugcugucuggucuguggaugccggcagcuucccaacgcugcagcccacgguagccaccacaccuuacggugagugcuggggacaccuuagccagaggguggugaugggagggggcaccacugagccaagccaaacuggcugaggagggacuuccccgaggggguggucugggggcagugugucucccgccgacuucccggggaggcaggaggcagcuguaagguagagagcaguggagggcagagcaggaauggcagaauugcuaagaaccaccagugagucuggucugacgcugucccaccccucaggccccuuucccugcaaggccauuaacaagauucuguggcggaacugugaaucuggguaggucgagggaguggguguccgaugugaguugggucuggcuagggggcuggaagggugggcucucccuagguugugcaguaugugcucuggacccaagugguucauggcucgcacaccucccucugcacauaggggccacuuuaucaucuucagcgguggcaugccccgugccagcuauggugaccgccacuguguaagugugcuucgagccgagacauuggugacgcuggacuucacuucccgcaucaucgacuucuucacagugcacagcacacggcccgaggauggugcgugcccugccguacccuacccuuucccagccccaccuggugcccucugccaccuauggcugugcucaccccauacucccuccgucccacagaauuugaugacccccaggcccuggcugugcugcuggaagaggagcugguggugcuggaccugcagacuccuggcuggccagcugugccugccccauaccuggccccgcugcacuccucugcaaucacuugcucggcccacguggccaguguccccgccaagcugugggcccgcauugugagcgcuggcgagcagcagagcccccagccugucuccagugccuuggugugugcggcgaucaggggggucuuacaggguggagucuugaggagggggagaguuucaguucuaagcccggaggucagaaugugccauacucggggugagagggagaagauguucguccuaaccuugugcauacaucucugccacccccucccagagcuggcccaucacugggggccgaaaccuggcccaggagccgucacagcgagggcugcugcugacgggguaggugugcgugcuuaugugggugagugggccccuugcuguugggggagagcccauccugggccuggugggugcagaggugccaggagacucaggccuggccccuggugggaccagguaguuccuccuugcccaaggugguuuggaaugaaaccucccuggaccuugguucaaggugcugcccugaucugccuuuuggccuggaacugagcucuaccaaaccccagggcuccacccgcccagccugccugcccugggacuggaaaaucugggcuggcccacgcugagcugcccagggaaggugccagagagcccagcgugggccuggcgggcgcugacgugcccagugacucaggucucaacuuccugcccugcccccacucccgccugugcugggacccucaggccucugacucuggugugcccuucccugcugaagagcuugccguggcuuucagggcugcuggaaugagucucaaccacccccacagucacacaccucucacgcccuggcucugggcuuucaccaccgccuggggcccugcuuggacucugcagcugugucccaaggcugcgcccuagauuugucuacuccuuccccugcccccucccugcuuucucccggccucuguagucuuccugcuccuccaccuacguggcugccuugggccccaugcagcuccucccccgggaugccccaugcucuguucugugacugccuuacucuugaucaccucugauggcugcuccagugcaggcagaacccccaaaguccucuguucucuacaugucccccuuugccaccuccuguuaaucaggguggucauuuccaccuuguuugguuuaaaggcuccaggugcauauggugcauguggccuggccuauaacaggugcacaguguaccugugcugucuacaguaggugccuauuguuuuuuguaaaaguaggauuccggucaguguuuggcacgugcaguaggugcuuagugagugguuaucagaugagugaauggaggggcgugcaggccucccaggaacucggguagcccugacaucugcccucccugcagccaugaggacggcaccgugagguucugggaugccucggguguggcgcugcggccgcucuauaagcugagcacagcuggccucuuccagacagacugugagcacgcugacagccuggcccaggcugccgaggacgacuggccacccuuccgcaaggugggccccuccccuggcccugaugagcugguccugaccccgccuggacucauuacuccuucccaucccucuaggugggcugcuucgaucccuacagugacgauccccggcuuggcgugcagaagguugcucucugcaaguauacagcccagauggugguggcuggcacugcaggccagguagggcuggguguccccuggguuggagaugucagggagggcuuucuggaagagaugagcuggagggucugguggaaagggagauggacuggcacaggcaaaagccaaggugggaauagggcucuggguggggcuggcuggggugaggacagaugggaagugggccugucgcugggggaaccacaguguugagaggagggaacucaugucagugcugugcuccggcacucacaugacauacaggaggugcucaauguguccuuauugcuaaaugggagauagaggcucaggguaaggguggacacuuugcccucagagggcagggacuagugugucuuggucaccacuguguuccuugugcucagccagggccuugguauacaguaggcauucagugagugcuuguuuagcugaugaacugaagacaguccuagaaccaccuuggugguggcuggggcugcuucagaggcuccaggcugaguggggcccagggcggccccuccccugcgcugaugcucccccugccuggcugugggcucaggugcugguacuggagcuuagugaugugccgguggagcaggcggucagcguggccaucauagaccuccuccaggaccgcgagggcuucacauggaagggccacgagcggcugagcccacgcacggggccgcugcccuggccugcuggcuuccagccccguguccuggugcagugccugccgccagcugcuguaaccgcugucacacuccacaccgaguggagccucguggcuuuuggcaccagucauggcuuuggccucuucgacuaccagcgcaagagcccugugcuggccaggugugugggguggggccggcugggcaguuggagcccccagcgagauggggucugggcuuccguuuccaccucuaguguuugguguggcaaaggccacuaaccuccauugcccuauaagaaauaaccuggcagcuccaagaaggacauucucaguaccaccugcagcuggguccauaggacugcgccagaggggcugugacucccugaccugggugccuccacaggccagcaggagugugguggcugccccaggaggcugcucuauagcacgacuggacccugucuucccccaggugcacucuucaccccaaugacucccuggccauggaggguccgcucucccgggugaagucucucaagaagucacugcgccagucuuuccggcgcauucgcaagagucgugucucuggcaagaagcgggcugcuaaugccagcagcaaggugagcuggggugggcugcacaggagcugugccuguguccugugccuuggccuggcucuggccugggaccccuggggccugcuuagcucagugcuccucccucggcagccccugggcccuccagagggaugggugaacuaagcugggugguagaggaaugguaacagaacguagggcgcaaagcaggaugcaagccacuggggugcuagggagacaguguucaggagcccccgcccggcaguugcaggaagccaaugcacagcuggcugagcaggccugcccccacgacguggagaugacgcccgugcagcgccgcauugagccccgcucugccgaugacuccuugucgggugucgugcguugccuauacuuugccgacacauuccuucgagaugguaaggcaggggcaggggcagggacagggcaaggguugggggggcuggccucaauuggccaccugggagaugggugguggcaagggagguggugggacugcaccuuccaggagguggcugggcacgguggcucaagccugugagugaucccagcacuuugggaggccgaggugggcggaucaccugaggucaggaguuugagacccgccaggccaacauggugaaaccucgucucuacuaaaaauacaaaaauuagccaggugugguggcgggcgccuguaaucccagcuacuugggaggcugaggcaggagaauugcuugaacgugggaggcggagguugcagugagccgagaucguaccacugcacuccagccugugcaacagagugagaccuucucagaaaaaaagcuuaccauccagcucucccagggggacugcugggucacccccagucucucugggggagcuggaugguaaaggauuuuugagugagcugggugggccucucagaucugagccaggagaagggagguugaggccugguggaugacggugaggggcaccagccagugcccaggccccgagccgggcaugugugugggcagcugcccagccacuuggcuggaguggagcaggugagggucgaggugugugguucagggagauacugcugcuggccagaggcugaggaccuggcuuugauucucaguggccugggagcccugggaagguccuggauuuguugauugagucacugauugauuuugaacuuguacaaugggagaguuucaaacauacacaaaaauagagaggugcaaaguugucccacauaccucacaugccugccaccagccaugugccccugcggauucugccccccuccuccacauucuuugcuguuuuuuuugccgggguauuuuaaaugaaaacccagauacaaguacuucagcauguuccugacagaugucacugacagccacugcucacaucaugcccuguagaaccaaugugaauuccugagugucaucugcuuggucuacgagcucagcuuucugaugccauuuauuugucgagggucuuugugcaguggauuuucucacugucuggauguggcgggugcagcugggggugggggguucuuugacuuuuuguuuuuuuugacuacaaagaccuagaagaggagagccugggguuuuuaacuuguuccacuggcccgagaaggccgauggguucauguucauggccggcugggguuccuguugggcauguuuugaguugugcagacacuuaaugccucaggauccaucgggucaucagggagcaggugccgagucugcucuugcuucugcugggcugggcucugauucuccacuaaagcuugucacccagagguucaguucacacaggcagagcagggucgauggauggucguccuagguguccccaggcuuggcggcuuccucuggcugccacguagggagcacacugaagacagugggggugaagcagggcuaagacaaggcacaccugucgacaggacuagcaaggggacgcagggguggagagaggagucggggucuuguggggcuuggggccugagugaugcuaggauggagcugcguuuacugagaugggggcugagggugcagugggauggggcuggaggucugguuugggugcccaucagcauucugugcagaugcgcuacagcuguucgggccucugcaggagggcugcauccugggcuccgacugcagucagcagcauagagcuggggucucaggccucgaggcuggaggucaccagggaggcauggggcaggagggaaucagcccugagucccagggugucauaguuaggaagcagggcuacaagagaggcagggagggaccugcagucugugggaagaccccaggggagaugccuggcccacagggagcacccuccuacgcgcuuguuuucugcaggggcccaccacgggcccaccaugugggcuggcaccaacucaggcucuguguucgccuaugcacuggaggugccggcagcagcaguggguggugagaagcggccugagcaagcgguggaggccgugcugggcaaggaggugcagcugaugcaccgggcgccugugguggccauugccguguuggacgggcguggccgcccacugcccgagcccuacgaggccucacgggaccuggcgcaggcaccugacaugcaggguggucacgcugugcucaucgcaucugaggagcaguucaaggugagccacugugggcugugggggacucugggggacuccccuccaggccccaaccucauggacaccauuggacccucaagaaacccuuccugccuguaucccccacuguugggacccuaauucccuugcaccccagaaaacacucccagccagcagagaacuccuacccaagaacccugaugcccccucagccugcugaguuccccugggagggcaggaaucuaguccuaucucacugugccacacaaggcuccuguacugggcccagaccccugagcccaguccccaggggcucugccucgaaagaacucgagguuugauggggauaccagcugcauaaccuuggcauaacucugugauugauuuugucacagaucgagagagggccugggagguuucuggaguacagugugaagucuggaguuuaguggggcagccagguguacaggcacgggaggccacguagcaugcagcugggcuuuguggugggggcuguugggucagcagccacgagggugaggggcccuggggacgaggacagggccaggcuuugugcucaccagccaccugcugucagguguucacacugcccaaggugagcgcgaagaccaaguucaagcugacggcccaugagggcugucgugugcgcaagguggcacuggccacguuugccaguguggccugcgaggacuaugcugagaccugccuggccugccucaccaaccugggugacguccacgucuucucggugccuggccugcggccccaggugcacuauuccugcauccggaaggaggacaucagcggcaucgcuucgugcgucuuuacgcgccauggccagggugaggcggggcagaggccgaggaggccuuccucaggcgagcgaacugagugggaccaguacugcuugggagcaggaagggcacuccaggugggcacaggcccaggccacggaggagcugugguuggugguaucuucuaacugcacuccucauucuucugcccacccaggcuuuuaccugauauccccaucagaauuugaacgcuucucccuaagugcccggaacaucacagagccgcucugcucucuggacauuaacuggccccgcgaugccacccaggccagguguguggaggggcagcuccuagccugggggaccugugcccagggccaggucucaucccacccccgagaucugccuucccugggcucaggagugggagggcaaggaucuagcgugccagccucaagucauccaccuaugguccccaucauggccccaucucugcaguuacaggauccgagagucacccaagcugagccaggcuaacgggaccccaagcauccugcuggccccacagagccuugauggaagcccugauccagcccacagcaugggaccuggugaggggggcaugaaagggguccagacccuggccccacggugcccugggggagggagucgggacucacauagcucagggaucgggcaggcuucuguaggagaugggugguugugugcucacuggugccaccccucaccaugggcugccuuaugggucugugucccuaggcccccaggugcagagggugcuaaggguccugguaggggcugaugacuugcucccuguagacaccccggagccacccgaggcugcacucucacccauguccaucgacucagccaccagugcugacaccacgcuggacacgacaggggacgucacaguggaagaugugaaggauuuccuggggugaggcuggugggcagguccacagggggggcugcccuguccccuaggccuccguccccagggcugccaggggcucccccgcccccaccccugagcaccauccccaucucgcagcuccucugaggagucagagaagaaccugaggaaccuggcagaagacgaggcccacgccugugccauccugaucaaaugaggugcugcagggguggggcccugguccucaccacuggugacguccacccccuucagcccgucuggguaccauuuggcccuggucuucuaccugagacccuggcaggcccaugugauggcacucucugaaaccuggcugccuuccauggagugccucaauuggggacuucuggugcucacacagacaccagugucaugguuggguauuagaaaagcagggccagccccucagcccuugcaugugacagguggugguuaggacaagaccagauuuguuuuguuuuguuuuguuuuguuuuguuuuugagacggagucuugcucugucgcccaggcuggagugcaguggcgugaucuuggcucacugcaaccucugccuccuggguucaugccauucuccugccucagccuccugagcagcugggacuacaggcgcccgccaccacacccagcuaauuuuuuguguuuuuaguagagacgggguuucacuguguuagccaggauggucucgaucuccugaccucaugauccacccgccucggccucccuaaguccugggauuacaggcgugagccaccgcacccggccaacaagaccagauuaaaccacuuagagguggcaguaguuuggggcuugggagcugguuuggccagccuguuucauagaugagaucacugaggugcacgaggucaggucucaucgguugggcccagcaaguggcugacuuaccccugccugagucuguggauccucaccuagauguggggcccauagaucugcccagcgcauuugcugccucauguucccaggcaccugacuguaggccauagccucacccugcacaggacauggacaccucccagcucuuugucuggugccucucccuggccucaguggggcauauguggccuggcgcuuggauacccaucuggagacucagcaagcccaucucagguggucacugaagggccaugccugcccugcagaggagacaguggcagcaccuguguggucuggccgcuguggcaauccaucugcccuuuugcccucccucaccuucugcugauaccucuucucucccucuuccaggaaggccagaacuaucccgaccuccaccugcccugcucggagcuggagugcuggaucccuggcaccugccuggccccuuaacauagaaccacgccugcuaaccuguaggcuccacugggaccugcuguccugucccgccugacccugggcccuggagcagcaccagccccagggugugggccugggaccugggccagaacugagcccuccugcaggcauuuggcugcccugggggcccacugccuagggaagaggacagguggggcccagcaccugugccaccucccccccuccacacaccauccuucccccucacuuugcagaguauuuuuccuuuuuuuuuuuuuucuuaaagacggagucuugcucugucgcccaggcuggagugcaguggccccaucucugcucacugcaagccccgccuucuggguucccgccauucuucugccucagccucccaaguagcugggacuacaggcgcccaccaccacgcccagcuaauuuuuucuguauuuuuaguagagaugggguuucaccauguuagccaggauggucucgaucuccugaccucgugauccacccaccucagccucccaaagugcugggauuacaggcgugagccaccaugcccagcccugcaaagaguauuuuucuagcgccugggcuggacaguuguuucuaaaacuaaacuauuuugguaccugcuucugggccaguccccagccugucaugagugugugugugcgggcauggaugugacugggagcucugcugggcacccacaucuggggccuagucagguguguguguccggcggggggggggggcaggggggggggucaagaugaguuucccuguagauuguaccuugggguuuuuuucugucguuuuguuaaaauuagcgccauuuuaauauuaaaaauacugauuuuuaauauugaaaauaaaagcauuuaauaucucuuaaagggcauccacaucugcuuuaucccuagcggaagagugagggggcuucacacgugcacucacacuguggagagaguuggauuucccagaccccugagggcaccugucagggucauccccauuggugcugcuugaggcuacuggggacuguggcacuggacguggcuggagcagguggugucaccugaguacauucuuugcuagcagacaguggaugaggccccuuccucuuccucaccaagccuggggcugugccagccugucuuaggccagggccuugcagaaggcgcuccaggcguggaagcagcggguaaaggcgugcugcucauugcccuugcggaccaggcgcagccggcgcggccgcucauguuccuuggaccgcaugugcuggauauauaccuggcaaggggacagcgagccuugggugaugacccugcccugcccacaggcccaccucggcccucccuccacccagauuaccuggcaggccuucaggcucagcuugaucuccaccuggcuagucuggguccccacccacauguagac

SEQ ID NO: 16597 - RNA, 13970 nt, Homo sapiens
aggggcggggccggcgcuggcccagcccgcggcuccccccagcgcccucgccccggcgcucccuagcccggcgcggcccggcagcgagagcggcgccauggaggccaccggggugcugccguucgugcguggcguggaccucagcggcaacgacuucaaggugagccgggccgggcgcgugccgggccucccugcaggccuucucuuccgcccggcccgcuuggccuccgcuuccugucccgcucggcuccaggcccugcgugucccagggacugcggccggggcgggguggggcucuccccuggccaggaauggaccuccgaggccuccgcccagugccuguacggggagaccgaggcugggcaggccggggacggacgcuugggcucggagucccgccgggggcccggccgggagcccccaccccgcguccguguucucggucuaggcuggaugguggccuggggaucgggcgagccuccccgccccucugaggucacacgcccaagccaggcccugacucagggauggcugcccggcugcccaggggcggguguggagccgacucaucacugcccucuccccgccaccgccacccgccauacugugugauccugggccucucagaucacuuccccucucagagccuaggcuuucucagccggugaaggggcuuaaaagucuccuccuuggacgcaaggaguauagugagauuuguugguguggagagugugucaggccggugugccaggugcuggguggcaguugucugagcagcugcuggacugagagaaaagggaccggagcccagcccuccgcagccaguggguggggcggcggggugguuccaggacucaagaaugagacaggcauugccugaccaaaggggaagcagagaaagagagggagggagagcuggcuggagggucagccucaccuucagggugggugacuggcagggucggccuggguuguuggucuggggcuggggccgaggaggcagguuuuuccugcguuuaccugccuguguacacaccuuugaccccaaguacaaguggcuacaccacuuuucccugaccccauccccaccacccuaaccugggguccccguuccucuuugcugaacugggagaguccgagucaccagcugggaauguggcgcuagggggaaaggaauaucagccgcaggcacugaaggcaccuacugccccagacuuggugccacaagggcuggaggugccgaggugggcguucacacaccaggggagugcagugaugcuggccugcccugcaggguggggagccacggucuccgcaagcaaggguuugacccuggccgugaguugccagugugcugauggcaggaugagggcacagguggcgccuuugcaaaggcuuggaagggggaucccccaccccaggcagccagucagaguguggaaugcuaggugaaggaauuugagccgagcuaaccacagagccggaugcugggcuuucaccugaaacaagccaguuuuguccuggcccuccuggggcccagaauccaguaggagagacaaaucuuaggccaacacuuuugucacgggggggcuuaaaauucccauucuaugggugaagaaauugaggcacaaugaugaaaugacuugucuguguucucacagauggugagaguugguucuguggcuccccaaaggcucccaugggcuggaggagccauagaagguggugagcaggggcucugugcuucaccuugacauccuucccccagggcggcuacuucccugagaaugucaaggccaugaccagccugcgguggcugaagcugaaccgcacuggccucugcuaccugcccgaggagcuggccgcccugcagaagcugguaaggggguuugggcgggcaggggagggucccuguggaugagccaggugggcagagccuguggagaaggcagacaacuucuccagagagaggaacaccgacagcuaugagcagagcuggaagaaagggagugggcacccuguccagggaggugugcaagaagaggccgggugagugagggagggaagcugcagggguaguugggccaguguggcugaggccuuccuggauggugcagaguuguggaggcaggcagggacucuggacaccccacccacccugcugagccugugcuccccauuccggcccaggaacacuugucugugagccacaacaaccugaccacgcuucauggggagcuguccagccugccaucgcugcgcgugagugcuggccgggaggccaccgagcuugggguuggggccaagguccggucagggacgugaagccugggcuagacaccaagcugggccagcauuucugcccaccuccgugucaggcucagaggcucaggugucacagaggggcccucucauuagagguuacagcagugcccuguguaaaguaacccauguggaucagagaauuccaucaggaaaaagguaaagaaauccaaaaucuuaccagccguuauggacaauaacuacaguaauaauagccaagacuggcugagcaauguucccacuauucuguuaggauuuuuucauaugcucuagcccuccacuaauguugcagaagagaaacuuggccaccaaggcagauuacuugccccaggucacagagccaggcagugguagagcugguguugagugggguuuggccgggagcaccguguaccuucuacccaagacuugaacgucccagaacaucaggcccuuggccagacccuguaggccucaacgagggccaucccaucugaagucagagcccuggagauguuuagggcacagcuucugacuuggacucucugaguucaaagcugggcuuugccacuuccuggugaugugacuuuguacaaaucgcuucuaccuucugggccuccucugcaagugcagugguugggaggggcagcagugaccccgugaagcagcagcagggugccgcacaggcauucagacuggagaaguggcggggcagcuccggugacucccguugucacuuggagucacgacaccauucucuggcccuguucccucaugcucaagcuuucugcaugucuguaagguaugaggaggugucagucuuaaguuagggagagaaagcagacuuccucuccauccagauucugauuucucugugguccacuucucucccucuguucugaaaacccugacucagaccuuaccccuaucucaccuucuggaauuaagaagaagagaaaugguuugaacagaaaagguucccugagggcccugugcuggggcuccggggcacauuugagcugggcuuugaggcaugaauaggagcucacugggaggcuaggaagagcgcuccaggagagggagcuauuugaucaaaggccagaggugagagaguccucaggccuggccucuggugagcugccugaggaggugucccucucuagacucuguuccuuccugagaguggaagccaggaauuauagacucuuaugguuuauucccaggccaucguggcccgagccaacagucugaagaauuccggaguccccgaugacaucuucaagcuagaugaucucucaguccuggucaguggcuacccacucaccuggccccugugcuagccggaccauucaauccccacucacuauaaaagucccuggggccauuguuaucccauuuugcagaugggaaaacugagucuuggaguggauaauaccuugccugaggucacuuuuggagucagaucccuaacacaggcacucuuccucccaagucccuggcugucucccuuuggcccugaagcccccucaucuacccccacacccaacucagugcccugccugauccccaagcuuggcagacgccugguggggaggagacuccccugaccugggucuugccccuucuacccaggacuugagccacaaccagcugacagagugcccgcgggagcuggagaacgccaagaacaugcuggugcugaaccucagccacaacaggugccaggccaguggggggcagggggcaggugggcccugugggguggcuggugcugacucagguggcuccugcuccccacccguagcaucgacaccauccccaaccagcucuucaucaaccucacugaccuacuauaccuggaccucagcgagaaccgccuggagagccugcccccgcagaugcgccgccuggugcaccugcagacgcucgugcucaauggaaacccccugcugcaugcacagcuccggugggcgcccccucggaccgcacuccugcagaagccacccugaggagucuggccgggccccuucacuucccagggcccuaacccuucucccuuaggcccagccaucccuccgugcaggcagcaccccucaguguacaaccuccuaaguaucauguccaccucucaguccugucuucccgcuuacacaccccgcaaccacccuugggcuugucccuucaaccagaugugaccucacaccuacccucugggcccugugcuuuugguccugcccugccaagccccacccuuaacacucccuaggugggcccuggcccugaccacucacgucacccuggcaggcagcucccagcgaugacggcccugcagacccugcaccugcggagcacccagcgcacccagagcaaccugcccaccagccuggagggucugagcaaccucgcaggucaggcagccccaggagccccucugagcucgggcccccucugggcccucuugcuuccuuggguggaagggguugaacccugcucuucggaccaauacccagagggaaaaggcuggaguuauguuacagugacuuuugcgauuaugaugaugccuuaacacugacuuuaugccuagaaaacucccccgcaacccccaugugagggaguuuguccaaauggagaaacuugggcgcacagcaguugucacuugccuaagccacacagcucagagguggcagagcugggguucacacuagggcuggcugcccuggcaccugguguaugggccccagcugaugcaccccacccugcaccccagacguggaucuguccugcaaugaccugacacgggugcccgagugucuguacacccuccccagccugcgccgccucaaccucagcagcaaccagaucacggagcugucccugugcauagaccagugggugcacguggaaacucugaaccugucccgaaaucagcucaccucacugcccgugcgucugaggcccucaguagggggaugggaggaaggccgugagccuggcccugaccucccaccccugcccguucccccuccagucagccauuugcaagcugagcaagcugaagaagcuguaccugaauuccaacaagcuggacuuugacgggcugcccucaggcauuggcaagcucaccaaccuggaagaguucauggcugccaacaacaaccuggagcuggucccugaaagucucugcaggugcugggcagggcuggggcuagcagaggcacuugcagcacagagaaccccgggaucguagucagagcccaccuuguggucugugcaagucagacaaaaugaagauggguuaauucaccuuuucuuuucuuuucuuuucuuuuuuguuuuugagacagagucucgcucugucgccugggcuggaauguaguggugcaaucucggcugacugcagccucugucucccagguucaagcgaaucuccugccucagccuccugaguagcugggauuauaggcgugcgcuaccacgcccggcucuuuuuguauuuuuaguagagauggggucucaccauguuggccaggcuggucuugaaugccuguccucaaaugaucagccucccaaagugcugggauuacaggugugagccaccacgcccggcccaguuaacucaccuuuguggaugaagaccacagucccaugccagccauucccaacuugagccccugagagcacccuucggggggcacuguuagggacaaggccacaugacgugggaacgcaguguugcuucucuccccuucuggagaucacagugcccguaacauggucucuuggcucugagaaguccuucaggcagagaauggagacccccgccaguuccucugacccuaccugccuccccuccccaggacuagggguuuucuugcccacuuccccuugucugucaccugccugaggcccuggcuggcccugucuucacaggugcccaaagcugaggaaacuuguccugaacaagaaccaccuggugacccucccagaagccauccauuuccugacggagaucgaggucaggcaugcuggguuugagagggcucaagagagacaagcaaggggugugcccuggagcaagggggacccagcagaggccuccugagggagguggccagugccagggugcccguggggagaaggugggccccaccucccugcauccagaguacauuccacagucucauuuaagcccccagccagccccagaggugggugggaggagaacccaguucccugaccucucagcccuggcggcugcagacaagagcaagaaacuggauuggugugucugggagguaggacccaggcucagugccggcucugcucacccuauggggcagguccuggaugugcgggagaaccccaaccuggucaugccgcccaagcccgcagaccgugccgcugagugguacaacaucgacuucucgcugcagaaccagcugcggcuagcgggugccucuccugcuaccguggcugcagcugcagcuggugaguggggaaaggucuggccugggaacgggggcuccucuccaggccucaaaugacacaucuguaaauuggguggcauacagcuuucuggacccugguggguggaguuggccccugguuggucgcaugcccaagggggcagcaggcccagugagggcucagcuguuugccccuccccuaagcagggagugggcccaaggacccuauggcucgcaagaugcgacugcggaggcgcaaggauucagcccaggaugaccaggccaagcaggugcugaagggcaugucagauguugcccaggagaagaacaaaaagcaggaggugagccaggccaggguugggacaaggcagggagccuuagcuucugcugaaggccgacccuggccuugacccuggccaagagggacggggggugcugggcagaaagaacagcugugcaaaggcccugagguguggguagcaaguaaagacuggccugaguggcuucacagagucaagccgugcucugugacucugcccccaggagagcgcagaugcccgggcccccagcgggaaggugcggcguugggaccagggccuggagaagccccgccuugacuacuccgaguucuucacggaggacgugggccagcugcccggacugaccaucuggcagauagagaacuucgugccugugcugguggaggaagccuuccacggcaaguucuacgaggcugacugcuacauugugcucaaggugagggcugggcaugcuguuaggggccauguggcccaguaccuuccucuaagauggcucaguccccaacuccagaguuuuguucagggaggccaggugggaggugggcaggcugcaggaggugguccaggcacaggggcaguacaaagccccuggggcugggaagccugugcuguucagaguggcgucuccgggguggccggaagaccaggaugaaagcugauguggccggugccuuggcuuccagaccuuucuggaugacagcggcucccucaacugggagaucuacuacuggauuggcggggaggccacacucgacaagaaagcuugcucugccauccacgcugucaacuugcgcaacuaccugggugcugagugccgcacuguccgggaggagaugggcgaugagagcgaggaguuccugcaggugccagcccguuaaaauugggggugggcagagugggguucccagggaacucuggugcaggggcagugggcccaaggcagguaggcagaacaggugggcaggcagggagcugggguuaaaggggguggaucaacgauacugugcgggaccuaaggcagaccgcagggugaggucuaagguggccaaagccugggucagcaaaggagaguucuggaacgcggggcagaauucagccgggcaaggauaaggguacaggcugggcaugggagcuagaccagugggcugacacaggggagcugagaguaggguggaagggguguugccaagagcagugagaaggcagggccaaaaccuguuauuaggaggcaaggacacaccuggaugccaaggagguggggccaagggcgggaccagaguccagucuugaauaaauuacugagcaguguuagccgccagcugguuacaccuagacauauguucgcauguacacacacguggaguuuaugcacacaccccacccgccccgaguuuuuuuuacccacauucacccagguuuccacucuuccaugaacccacuugcuuguguacccugauaugcgugcaucuaaacaugcugcuggcaucuuuacaaacgugggugaacguguccauauuuuucauacaucccaacaccccgacguguguauguuuauagacacagauguguauguuuuauuuuagacagacucucgcuuuguugcccaggcuggagugcaguggcacaaucuuggcucacugcaaccuccgcccccaggguucaagcgauucuccugccucagccucccaaguagcugggauuacaggcaugugcuaccacgccuagcuaauuuuuguauuuuuuuaguagugaugggguuuugccauguuggccaggcuggucucgaacuccugaccuuaggugauccacccgccuuggccucccaaaguacuaagauuacaggcaugagccaccgugcccagccagaucuguuuuuuuuguuguuguuuguuuguuuguuuguuuguuuuaagacagaguuuugcuguuguugcccaggcuggaguacaauggcacaaucucagcucacugcaaccuccgccucccagguucaaacaauucuccugccucagccucccgaguagcugggauuacaggcaugcaccaccacgccuggcuaauuuauguauuuuuaguagagacaggguuucuccauguuggucaggcuggucuccaacuccugaccucaggugauccacccaccucagacuccugaagugcugggauuacaggcaucauagauuuguagcacucaauucaccuguaugcaacucuguacccccaccugaggggcagugguuggugggggagggggcagcucagugaugaagaaccacacccucacacacacagguguuugacaacgacaucuccuacauugaggguggaacagccaguggcuucuacacuguggaagacacacacuaugucaccaggugagggugugugggcagugggggguauggaccuggagucugcuggcaagggguggaggggaggguguuggggcuaaguuaggcccuuggugccuacacugagccacucuugcccugcgcccaggauguaucguguguaugggaaaaagaacaucaaguuggagccugugccccucaaggggaccucucuggacccaaggugagccccaacaaugugaggugggggugcuucauccucagccuccuccccaccagugggggcaggugugggccucuuagaagaggaggcccucuagcaauuccugcccacgagcuuggcggggggucccuggggcuuacccagaaaccccauagugagggauuuuuuuugguggggucaggagcauggggugaccauugccccaugcaccaucacagcuccuuccugccccuucuuguccagguuuguuuuccugcuggaccgagggcuagacaucuacguauggcggggggcccaggccacacugagcagcaccaccaaggccagguacaaggacaccguggggucuuuugugugaaggaaaggggugugagccucgcugaugacuuugcauccugcucucaggcucuuugcagagaaaauuaacaagaaugagcggaaagggaaggcugagaucacacugcuggugcagggccaggagcucccagaguucugggaggcacuggguggggagcccucugagaucaagaagcacgugccugaagacuucuggccgccgcagcccaagcuguacaaggugagcccugcugcugaggcccaccuuggccucccaaguucacccaccgacugggggaauggacuacacaccgauguaguuggcuuugggcuccaucucgacuuugguggggagagggugccaccuucuggacaaggaacaguaugagcaaaggucuggaggcugcuuuugagaaguagccucacggagucuuuccaggaugguggggccguaggggagacagaagcaccuagugccagggcugggaaccuuggcucaauuaucuagauucuugugaacaggaaagggacacguuaauuagaaauggcaugaagggccuggagagggcaggcagggaaaacuccauuuaaaagcccuucugaaaggauaucccuaaaaagaccuugaaggggagggggaaacagaagcagucagugagccacgcugcagggcagggcugguuccagagcagagggcugugugggugagguuccugucuccagaucccuucccugccaugcucauccuuccugccaggugggccugggcuugggcuaccuggagcugccacagaucaacuacaagcucuccguggaacauaagcagcgucccaagguggagcugaugccaagaaugcggcugguaagagaugcaggaggagggcguggggccagaucccuccccguuggcugggcuuugaccuccagacucccgguccgcagcugcagagucugcuggacacgcgcugcguguacauucuggacuguugguccgacguguucaucuggcucggccgcaaguccccgcgccuggugcgcgcugccgcccucaagcugggucaggagcugugcgggaugcugcaccggccacgccaugccacggucagccgcagccucgagggcaccgaggcgcaggugcgcuugcagcuucggaggccccuccccaggauccuucgcacccugacaugcccugaccccuguggcuucacuaccucccuacagagcugggcccaaacccaccuccucuuugcugacucugcccaggccccgcccccucugcaagcugccccuccuauuccuaccuccguguccgaggccccgccucccaagccccgcccuagaucucccuugggucccgccucaagccucgggcuacuuccuccaacucuaaucaugccgcaccccucaugguuaguugauggccucccuggcagguguucaaggccaaguucaagaauugggacgauguguugacgguggacuacacacgcaaugcggaggccgugcugcagagcccgggucucuccgggaaggugaaacgcgacgccgagaagaaagaccagaugaaggcugaccucacugcgcuuuuccugccgcggcagccgcccaugucgcuggccgaggugggggcagggccgggaccggggcgcggggggggggguggggggcaggccgagggcggggccuaugcgcagagcgcgcucagaccugccgcggggcgggucccucucaccugcaggcggagcagcugauggaggaguggaacgaagaccuagacggcauggaggguuucgugcuggagggcaagaaguuugcgcggcugccggaagaggaguuuggccacuucuacacgcaggacugcuacgucuuccucugcagguaccaccucagcacucccuuccccaagucccuccccuggugcugggggcucgagccccugcucacaaccuuccaacccggcagguacugggugccuguggaguacgaggaggaggaaaagaaggaagacaaggaggagaaggccgagggcaaagaaggcgaggaagcaaccgcugaggcagaggagaagcagccagaggaggacuuccagugcaucguguacuucuggcagggccgugaagccuccaauaugggcuggcucaccuucaccuucagccugcaaaagaaguucgagagccucuucccugggaagcuggaggugugccuggcagccccgcgagcccgaggccaggcggaggggugugguggggcucagacccagcgaagguuaggcucccgaggggcagguggggguccagggagcugccccuaacacuuccacauccccaggugguacgcaugacgcagcagcaggagaaccccaaguuccugucccauuucaagaggaaguucaucauccaccggggcaagaggaaggcgguccagggcgcccaacagcccagccucuaccagauccgcaccaacggcagcgcccucugcacccggugccuggcugggggaggacgcaguggcgagcaagcgucagggagccaggccugaauccuugcugaugccccaucccuuccacaggugcauccagaucaacaccgacuccagccuccucaacuccgaguucugcuucauccucaaggugggguugugggugugagccaggacuccguggaccaaggggugggguguuugggggcugagucagcugcgaacacccccaccccugcacacuccccagguucccuuugagagugaggacaaccagggcaucguguaugccugggugggccgggcaucagacccugacgaagccaaguuggcagaagacauccugaacaccauguuugacaccuccuacagcaagcaggucaggaggcgggcgggcaggcgggcacacacagaggagccagggcaggcaggggcccugggcuggacuggccuuucccgcagguuaucaacgaaggugaggagccugagaacuucuucugggugggcauuggggcacagaagcccuaugaugacgaugccgaguacaugaaacacacacgucucuuccggugaggccagggcccugacccuccccucaguccuggcacugcugcuuaugaccucuggccucaccuugacccuugauucccaggugcuccaacgagaagggcuacuuugcagugacugagaaaugcuccgacuuuugccaagaugaccuggcagaugaugacaucauguugcuagacaauggccaagaggugugauguugccacuagcccugcccauccaaggaggcgcccauagacuuacuuacaaaugggaauucucgggccaggagcaaggggcuguucccaggcacccaugcaaccguaucuccccugcugcccccacaggucuacauguggguggggacccagacuagccagguggagaucaagcugagccugaaggccugccagguaaucuggguggagggagggccgaggugggccugugggcagggcagggucaucacccaaggcucgcuguccccuugccagguauauauccagcacaugcgguccaaggaacaugagcggccgcgccggcugcgccugguccgcaagggcaaugagcagcacgccuuuacccgcugcuuccacgccuggagcgccuucugcaaggcccuggccuaagacaggcuggcacagccccaggcuuggugaggaagaggaaggggccucauccacugucugcuagcaaagaauguacucaggugacaccaccugcuccagccacguccagugccacaguccccaguagccucaagcagcaccaauggggaugacccugacaggugcccucaggggucugggaaauccaacucucuccacagugugagugcacgugugaagcccccucacucuuccgcuagggauaaagcagauguggaugcccuuuaagagauauuaaaugcuuuuauuuucaauauuaaaaaucaguauuuuuaauauua

SEQ ID NO: 16598 - RNA, 5207 nt, Homo sapiens
cuccgauuggaguuagggccugcuugucugcgugcugcgaaguccgcggcugcccccggggcccuagucguuggguuccaggguccuucacguuccauucccaggcuggucugagcuccggggccguggucccgcugccuccuccggucgucgugcggaagcugcgacgcagguacagcuggagcgcggcggggcggcccccagggucaccgggcucggggcuuggcgcgcgacggaacgcagaucgggggcguggcccgcgaucaccgcuggggaaggcggggaggggaccuuugggggaccaagggcagcguucgaauccuagcccagcccccuuccccucucggucucuugguuuauccugcgaacggggcgucacccgcccaccuagggcugcugcgcggccugcuccgcccgggcccagggcaggcagguuuggcggaggagggaaggccaaacggccuccagggccccgcugcgcaaacuuggguuauuuucagccacccgugcccuuuccugcuucucggagcuggaaggcuguggacugaggccugcgcgaccccgccagagauggggcugagucccaauuuagacagguugggaguauuuaaagcgcuuuacaguuugcaaaguagauuccuggucucucugggggcggguggcaguauugauccccgagucaccgaugaggagauugaaaccggcccuggggccguggcgggucacccgguuggccugggaucgccccagagaccgucuuauuuuuagucuggggcgaaugggcggguguacggggcugagucacacagcgcuucaggcuucagcuacuccaggcaucuggucaccuggcaacugggccccuggcacccacacucuggcagggcagguagaaguccuuggugcccgggcaggcugugaccucauggucaucugcucaggccuccccgggagaguucugcuuggugucuaacugauguccuaaggucccagcccuucucagcucccagggccugagggcagugucccccucgcagaacgugaggaauguggacugggcccuaggagaucuuugccuccacuucccaagugcuggcccccacccagccacacacuucaaggcugcccacaucugccccucacugcugccuaugccaucuuacaggugagcaaacaggcuggggcccaggccuucaccuuacuuucuguguugcuuggccuuccggcaguugagaagcaucacccaccacuaccuacacauugucccaagacugagaggcccagagagcccccuguacagaggcacugggcagcccuuucugcccugccaaaggggcuucaacccugacaagcacaucugcauuggccugccugggcagcuugggccgucuuacucugcccgugcucugacuugguagcucugccucuugggcuacccugucaagauuuggggguaacuggucccaguggucccccagacuggcuggggccccaaauuguuggucuucucuggacuuugggcucuucugaagagguuaucauagagggcugcugugcccucuggguaggaaccuucagaugaggcugcugcugaggaccugggcaccuggcacagggagaauccgucagacucugugggcggaugagagucuggaggccuugcagucauggguuggagaccuuaccacucacuugugagcuggcagccuguagcucuguaacauagggguagugaugaugacacccuggugaugucagagguccuggagggugggcuccagggagagaggccccuuccuauaccugcacaagccucagggccuuugugagcuucuuuccaggcagcuuugggagaaggggcuuggcagcucccucaucuccucaugagagaugggggcuugggaccccaaaacccaagcucauaucccaucccugcccuuucucagguacuuuacgugauuucccagggccucgguguccuccccuguggauggguggccccuuucucugagaaauucucagaaagccccccucaugggcucagcucuguuacccagcauaaggacagcuagagcaccuguccacagcagccccucucccagccuggccaccugcaccugagcugccccuucaccccuggcucucuuacaggcagaccauggcagaguucucccagaaacgggggaagcggcguagcgacgaagggcugggcagcaugguggacuuccuccuggccaaugcccgccuggugcugggcgugggcggggcugcugugcugggcauugccacccuggccgugaagcggguaaggccaagugggcgggucaugccugaagcuccuagaggaggacaacaggguugggcuuuucagaggggcccuggggagggguggggacugcccaaggccuucaugggagcccagggcaccugcuucuccacccagcacgcuggucugcuuugcccugggcuuugcuaugacugcccagauuucauauacacugaucugugugacugugcuugcaguucauugacagggccacuagcccgcgggaugaggaugacaccaaggcagacagcuggaaggaacugagccugcucaaggccacaccacaccugcagccccggccuccaccugcugcccuuagccagccaguguugcccuuggcccccucgucgucugccccaggugaguggcacuccuuccccucuuuuggugucacauucaagagacgcagcccaggcuuugcccugacugacugugugacccugcgcgagucccugcuucucucucgguugugggcuccucagauauuuaaugggggugguguuucuuugcccuguuccuggagcaaggugguagcguugugaugguggggagcuuuagauggggaaacugagguccagaggggcgugacauaccuaccuacucugcaugaagcuguugucgccaggguguuggacucuggggcaaugagaacucgucaccaagagcucacuauaugugaggaucugaacugagugccuucucaggugccacugcaggugagaaaagugaggcccugggacaucacacagcuaguucucgguggcguuuucuuaacuaaucacaggcuguuccgacauguuccccgccccuucacucugcagaagggccugcagaaacugauccugaggugacaccacagcucagcuccccagcaccgcugugucugacacugcaggagaggcugcuggccuucgagcgggaccgugugaccaucccagcagcccagguggcuuuggccaaacagcuggcuggcgacaucgcccuggagcugcaggccuacuuucggagcaaguucccggaacugcccuuuggggcauucgugccuggggggccgcucuacgacgggcugcaggcgggggcugcggaccaugugcgucuccuggugccacuggugcuggagccgggccuguggagccuggugccgggcguggacacuguggcgagggacccucgcugcugggccgugcgcaggacgcagcuugaguucugcccccgugggagcagccccugggaccgcuuccuggucgggggcuaccucuccucccgcguccugcuggagcuacuccgcaaggcgcuggcugcuucugucaacuggccggccauuggcagccuucucgggugccugauccggcccagcauggccucggaggagcugcugcucgaggugcagcacgaacgccuggagcucacuguggcugugcuuguggcagucccuggggucgaugcugacgaccgccuccucuuggccuggccccuggaggggcuggcggggaaccucuggcugcaggaccuguauccaguggaggcugcuaggcugcgagcccuggacgaccaugacgcugggacucgccggcggcugcugcugcugcugugugcugucugccgugguugcucggcucuggggcagcuaggccggggucaccugacccaggugguccugcgucugggggaggacaacguggauuggacggaggaggccuugggugagcgcuuccugcaagcccuggagcugcucaucggcagccuggagcaggccagccugcccugccacuucaaccccagcgugaaccucuucagcagcuugcgugaggaggagauugacgacauuggcuaugcgcuauacaguggccuacaggagcccgaggggcugcucuagguggguggaaacgggugguugccauguuuucuaaugcuggggagcugcacccaccucccuuccagggauuugaauagugguuuuucucuagcuuuuugccagaacaaaggaggguacauuacuuaaacccagggcaucaggaugugcuugggcuaugguggccauaaacccugagcccagagagcuugggucacugucaccugagugcagcugggcugccucaggcagcuuggagugccagccauuccugcaagcaccguuucagcucuuggggccaaccccaggaccuuuggcucuguccaucaccagcaaccaauccaccaacagaaugugguuucugccauccugggcagaagcugaaggccagcuucacauuucugcugagagaaggugacuuaacgccuuuuccggcccuagcuccaggcguuuugaggcgucuggugccugaugguagguaugguguguuuguucugucccccaggggcuggagucaccuggugccccugaaggacagauuuuuggcuguuaaaggauggcauuuuccugcugucuucugugcguuuaguuuucuugcugagcgggagcucaguaugacuugccacccaccugauaccucagggcaaggcccuuuuucccuccagccaggugaguguuuucuucaggcagcugaggguccugggggagcugaggcucugugcugcacccccagcccacagcuggggcaucucacuggagcuguuccaggccccacuggagagcagaggaccugaucccccacuagagagguccggugugcacagccggccucccagugugccaaaaugaacugcucucagcugauggcuguauucugacuuugaagccuguuaagagguagcaagggggcuagaggagggagauuccaccuccccucccaagugacccuccuccugccucugguauccuuccuuuugaaacgaagcucagcuucgaagaugugaacaagaauaaaaggaaaaaauucuaaug

SEQ ID NO: 16599 - RNA, 5207 nt, Homo sapiens
cauuagaauuuuuuccuuuuauucuuguucacaucuucgaagcugagcuucguuucaaaaggaaggauaccagaggcaggaggagggucacuugggaggggagguggaaucucccuccucuagcccccuugcuaccucuuaacaggcuucaaagucagaauacagccaucagcugagagcaguucauuuuggcacacugggaggccggcugugcacaccggaccucucuagugggggaucagguccucugcucuccaguggggccuggaacagcuccagugagaugccccagcugugggcugggggugcagcacagagccucagcucccccaggacccucagcugccugaagaaaacacucaccuggcuggagggaaaaagggccuugcccugagguaucagguggguggcaagucauacugagcucccgcucagcaagaaaacuaaacgcacagaagacagcaggaaaaugccauccuuuaacagccaaaaaucuguccuucaggggcaccaggugacuccagccccugggggacagaacaaacacaccauaccuaccaucaggcaccagacgccucaaaacgccuggagcuagggccggaaaaggcguuaagucaccuucucucagcagaaaugugaagcuggccuucagcuucugcccaggauggcagaaaccacauucuguugguggauugguugcuggugauggacagagccaaagguccugggguuggccccaagagcugaaacggugcuugcaggaauggcuggcacuccaagcugccugaggcagcccagcugcacucaggugacagugacccaagcucucugggcucaggguuuauggccaccauagcccaagcacauccugaugcccuggguuuaaguaauguacccuccuuuguucuggcaaaaagcuagagaaaaaccacuauucaaaucccuggaagggaggugggugcagcuccccagcauuagaaaacauggcaaccacccguuuccacccaccuagagcagccccucgggcuccuguaggccacuguauagcgcauagccaaugucgucaaucuccuccucacgcaagcugcugaagagguucacgcugggguugaaguggcagggcaggcuggccugcuccaggcugccgaugagcagcuccagggcuugcaggaagcgcucacccaaggccuccuccguccaauccacguuguccucccccagacgcaggaccaccugggucaggugaccccggccuagcugccccagagccgagcaaccacggcagacagcacacagcagcagcagcagccgccggcgagucccagcgucauggucguccagggcucgcagccuagcagccuccacuggauacagguccugcagccagagguuccccgccagccccuccaggggccaggccaagaggaggcggucgucagcaucgaccccagggacugccacaagcacagccacagugagcuccaggcguucgugcugcaccucgagcagcagcuccuccgaggccaugcugggccggaucaggcacccgagaaggcugccaauggccggccaguugacagaagcagccagcgccuugcggaguagcuccagcaggacgcgggaggagagguagcccccgaccaggaagcggucccaggggcugcucccacgggggcagaacucaagcugcguccugcgcacggcccagcagcgagggucccucgccacaguguccacgcccggcaccaggcuccacaggcccggcuccagcaccaguggcaccaggagacgcacaugguccgcagcccccgccugcagcccgucguagagcggccccccaggcacgaaugccccaaagggcaguuccgggaacuugcuccgaaaguaggccugcagcuccagggcgaugucgccagccagcuguuuggccaaagccaccugggcugcugggauggucacacggucccgcucgaaggccagcagccucuccugcagugucagacacagcggugcuggggagcugagcuguggugucaccucaggaucaguuucugcaggcccuucugcagagugaaggggcggggaacaugucggaacagccugugauuaguuaagaaaacgccaccgagaacuagcugugugaugucccagggccucacuuuucucaccugcaguggcaccugagaaggcacucaguucagauccucacauauagugagcucuuggugacgaguucucauugccccagaguccaacacccuggcgacaacagcuucaugcagaguagguagguaugucacgccccucuggaccucaguuuccccaucuaaagcuccccaccaucacaacgcuaccaccuugcuccaggaacagggcaaagaaacaccacccccauuaaauaucugaggagcccacaaccgagagagaagcagggacucgcgcagggucacacagucagucagggcaaagccugggcugcgucucuugaaugugacaccaaaagaggggaaggagugccacucaccuggggcagacgacgagggggccaagggcaacacuggcuggcuaagggcagcagguggaggccggggcugcaggugugguguggccuugagcaggcucaguuccuuccagcugucugccuuggugucauccucaucccgcgggcuaguggcccugucaaugaacugcaagcacagucacacagaucaguguauaugaaaucugggcagucauagcaaagcccagggcaaagcagaccagcgugcuggguggagaagcaggugcccugggcucccaugaaggccuugggcaguccccaccccuccccagggccccucugaaaagcccaacccuguuguccuccucuaggagcuucaggcaugacccgcccacuuggccuuacccgcuucacggccaggguggcaaugcccagcacagcagccccgcccacgcccagcaccaggcgggcauuggccaggaggaaguccaccaugcugcccagcccuucgucgcuacgccgcuucccccguuucugggagaacucugccauggucugccuguaagagagccaggggugaaggggcagcucaggugcagguggccaggcugggagaggggcugcuguggacaggugcucuagcuguccuuaugcuggguaacagagcugagcccaugaggggggcuuucugagaauuucucagagaaaggggccacccauccacaggggaggacaccgaggcccugggaaaucacguaaaguaccugagaaagggcagggaugggauaugagcuuggguuuuggggucccaagcccccaucucucaugaggagaugagggagcugccaagccccuucucccaaagcugccuggaaagaagcucacaaaggcccugaggcuugugcagguauaggaaggggccucucucccuggagcccacccuccaggaccucugacaucaccagggugucaucaucacuaccccuauguuacagagcuacaggcugccagcucacaagugagugguaaggucuccaacccaugacugcaaggccuccagacucucauccgcccacagagucugacggauucucccugugccaggugcccagguccucagcagcagccucaucugaagguuccuacccagagggcacagcagcccucuaugauaaccucuucagaagagcccaaaguccagagaagaccaacaauuuggggccccagccagucugggggaccacugggaccaguuacccccaaaucuugacaggguagcccaagaggcagagcuaccaagucagagcacgggcagaguaagacggcccaagcugcccaggcaggccaaugcagaugugcuugucaggguugaagccccuuuggcagggcagaaagggcugcccagugccucuguacagggggcucucugggccucucagucuugggacaauguguagguaguggugggugaugcuucucaacugccggaaggccaagcaacacagaaaguaaggugaaggccugggccccagccuguuugcucaccuguaagauggcauaggcagcagugaggggcagaugugggcagccuugaaguguguggcugggugggggccagcacuugggaaguggaggcaaagaucuccuagggcccaguccacauuccucacguucugcgagggggacacugcccucaggcccugggagcugagaagggcugggaccuuaggacaucaguuagacaccaagcagaacucucccggggaggccugagcagaugaccaugaggucacagccugcccgggcaccaaggacuucuaccugcccugccagagugugggugccaggggcccaguugccaggugaccagaugccuggaguagcugaagccugaagcgcugugugacucagccccguacacccgcccauucgccccagacuaaaaauaagacggucucuggggcgaucccaggccaaccgggugacccgccacggccccagggccgguuucaaucuccucaucggugacucggggaucaauacugccacccgcccccagagagaccaggaaucuacuuugcaaacuguaaagcgcuuuaaauacucccaaccugucuaaauugggacucagccccaucucuggcggggucgcgcaggccucaguccacagccuuccagcuccgagaagcaggaaagggcacggguggcugaaaauaacccaaguuugcgcagcggggcccuggaggccguuuggccuucccuccuccgccaaaccugccugcccugggcccgggcggagcaggccgcgcagcagcccuaggugggcgggugacgccccguucgcaggauaaaccaagagaccgagaggggaagggggcugggcuaggauucgaacgcugcccuuggucccccaaagguccccuccccgccuuccccagcggugaucgcgggccacgcccccgaucugcguuccgucgcgcgccaagccccgagcccggugacccugggggccgccccgccgcgcuccagcuguaccugcgucgcagcuuccgcacgacgaccggaggaggcagcgggaccacggccccggagcucagaccagccugggaauggaacgugaaggacccuggaacccaacgacuagggccccgggggcagccgcggacuucgcagcacgcagacaagcaggcccuaacuccaaucggag

SEQ ID NO: 16600 - RNA, 1718 nt, Homo sapiens
cugcuguugcuggagaaggaauguggggggucucggugccaagacuggggauagcaaggaggugagugggaaaugcaaccacaggccagccagcgcccgugcauggagucaaagggaggagucagcauggugaccacugccccugcaccgggggaggaaggcauggggguccuggugaaccucucccuguacugcccagagcccagccugacuccccccgaagccggguagggaugcaucacuccgacuaacaaaugucucagcccuaaagggccccuggcuccaggucacccuccagcucuacagaagggcagggacgaaucugauccuuguuagcacugacacaagagggcgggaccugagucagccccaggggaagccagcaugcccuggaaaggcuggucccaccaaagcaugcuagugugucucccaggcugcacccaggaaggcuggguuggggaggagcccagggccagaugggcagcaaaguguauccggcuguagccagccacaaaagaggacacugaugucuggcagcagcacagaaaccccuguggcugauguuucuuccucuuggaugcugagggugguuuuuggagaauagucagcuucacucccaccccagccccaaggcaucuccucggagaaggcucaggcagguggccaaggccagcaaggggcgggccugcagcugcucaggcccccuuggaucuccuccuggcagacagggguauaggggauagcagcccauggggauggggccuugguuuccugcagaaccuacacgagaggccaaaaaaaagauggggguaccaaggagaggaaaacacccccggcacccaccaccagcccgccuguagacugcauccuguguguucacaugugugaaccgcacguacgguugagccuggccagugcucaguccuucacucugcuggucucugucagggagagcugacccuuuccagggcccugccugcacugggcaugggggucugagaaaggggcagcaccgcuggcagguggggucuggcacugccacccucagaagcuggcacacgagguuucuuauugcuccucuuggcucuggagcacaccuucuuaauuuccagaaaggacacaggcccaggagagguggcagcaggggucccacacuggcccuccugcugaucuccaaguggagcccggugggcaggaugcaggcuggcucuagccccuacgugugacccacaggccucccacgaagccgcuggucucugcagagugagaggugccgggacuaccuggccuccuugccgccucgguuaccgggucaccgcccaucauuggucagcugccuccagggaucuggacguggggcacagaugaguguccuuacaaaaauaacucugagucuguucccagugggaccagguuccugagagcacguggggccaggcaaaggccacguggaagaguccggcagggagcgcucccgccugcaggccaggguuacggcugcaggcgcuccagguacugcggcaggggguucuccuugacguacuucuggauguaccagcaggugagaugggccuucagguccuccuccaccacgaaguccagggcggccugggagccgggcagagaggagaguggucagggccugcagccggcaccagaagguagcauugucugcugccuccccaggcccggcucccuggccacccuuccacuuugcc

SEQ ID NO: 16601 - RNA, 30574 nt, Homo sapiens
cggccggggucuccccggcgcugcccagucugucuccggcgccgcccgucgcggacucguccuugcugcagucgccgccgcaguccucgccgcagucgccgccgccgccgccgccgccgccgcugcuccuccgccuggccugggccgucugcccgcagccaugagcgugcucggccccgguggagcccgcaguccucuagauuagucuccaccgccguccaggacccacuugcagcauggagucgcccgccucgagccagcccgccagcaugccccaguccaaagguaggcgcucccggccgggaccucggccugaccccgcgccuaaucuggggccgggcugcaaaccccgaccuuucuuuggucccaccccauccuguucucgaccuggcagcggcguccggucccggaaccccuuccuguucggggucccgggaccagcccccgccugggcccucaccuggacccccacguuaggccuugggacugcacucaggcccgagaucacccaggcuggacccagacuaggacuuuguucugcucaccccauccaagucaggagccucauucugaccucauuugggccuuauggcugcagccuggacaugaacucucccagucuucucccucagcgggacccaggugagauucacacuggccuucaccuggguccuugggcagcacccagucccauuucuagcuucgggucccagggcuguauccagguugggauuuaacuugagucuccaucugggccccagagugcuccuguuguugcggaccucacuguacccccuaugcgggugcucuggcuacaccccagcucggaacuccccguccuucucucccccagcucuucuuauccuuauaggcccuauguugccccuucccuggcuggccugcacccuguccugcagcccugggcucccaggaaccuuccuuguccucccaccccucccuaagguacagcccccucucuaccggccucucucugucuugaguugcaagcuucucccugcacuggggguucucaccccaucuuauucuuguccuggcugccugggaucugggccagccgccaggccagggugcuggcugugcaagggauuugcucuucuccaaguagcuggccuuccuggaaauuuuugugagguggcagcagcaggauuugucaugcggagggggaaggaugaaacucggagggcaaaaggggaauuuuuuuuuuuucaggaagaggaaaggauguuuuuggugcgucggaguuucaguaggcuggguugugcgagagauuuccaaaccggacauagccguaaugaaugggcugccuccuggcuuucugaaccugcagcugcuucaccccagcaagcucccuggugucucugggccucaguuuccuuuucuguaaauuggaaguaaucgcaccugcuucuguggacgugggaguguggugugggguggugaauaguaaagagcucugaggcguucucucagcguagcaccuggcgcagagccggugcucaccaggguacacuggcugcacacaucucgcuauuguuuccauucuucuugcuggaaaggccuccacugcuggaagugcagccucagagugagcaggaggaagcaccuagcagcgggcaccuagugggcacuucaucaggggucagccgcucuucuguucuggagggugcaggccaaugggagcccuaugugggccuggggagggcaugggcucuuccuggccccugcugcuggcugcuaugguggcuggagccgggugggcuggauaauuaugccuuacauaagugggaggccggaucccugaccauugcccaaccacugugaguaacucgggaggcacucgacgggggaggugucuggggagggacuugcacugcacagaccucguggagcuugggaaccaggaaaucagacacuucuccacucuggagagcucggggaaggguaggaagcacuguuuguuuuggaggcuuuuuagcucuccaggcagagaaugccucaucaaaauaaaaguuccaguugcagaguugugaaaggagaggggucauagaugcagugagaaugcugugagagggccaaaaugaacuucuagauguggacccagguccuagaugagguugagggggcuggauggagggucagggaccucccucaggcccagggacucuguagucucuuuggggucuggggaaggaugugguggcagagccacaaugcccuucaccaaaaacccuaugagcuccuucuuuuuuuccaugugccaugcauuuucucauuuauuccucauagccccauuuacugauaaggaaacugaggcguuaagugccuugccugaggccacacagcugugacaggcggagcuaggguucccccuaggacuguguuuccacaguggccuuccccgugcuccccuaugugccccucccaugcuggaugccugagcugagcugguggggugcccccaccccuggccuugcucagagcaugugcagugggccuguccucauggccacgucagaccuagaggacagacugaggcagaggugaugccucuccugugcacagcgcuuuacacugggccuguugcauucucgcugcaaaaucccacucauuugacagaugcagaacucagcuuggauggaggaguggccggacugcccccauagguggagagccucacucugugcccaccccauccugggcacugggccucccagcacugaucccuucuccaccuucucaaaggaauuugaacaaagcagggaguggcuggcgcuugaccuuacuggagcuuuaccuuugagcuuccugccuggcagcaggugcccugcacuguuuccaugccaugggccuggggaguuuucuaugagugugugaggcccucaggcccacagcucugcugguuuuccccuggccuccuugcccacauggccaucucuggcugggguuagaggccaaguggcuggcgcuggggccagugggugggggcaugugugcaagccacauuuguccuuggaggguaccacacguguccuguugucguucagaacauggguucugccccuucugcccuaagagugccaccugugggagcacuucauggcuaaucuucacacagcuuggacuguggcuguaggacuccugacugcccgauggugacacugagguuucauagagcacuguuguauccuagcccugccugcuguggccacccccccaaccccuggcugucggaaagacuggagguggcaccucggggacuucccccaccccucuugugacgcacaggaaacucucugucagccaacccauggcccagcgcccaaagggagcaaaguucucaguuggcccgugugaggagaaggccggggcagcggaggcuuccggcggugagucagcgggcacugggugcugacucacccgcugggcaugccagccggcugccuacagcuuaaaggggcgaugccugccagccugguggguggggaggggguuacguguccugcagguggcaccuagcccugagcuggggcacuggagguggccccuuccugggccucggacugggcugggaaccccugggcaggcccucugugccccacccaggaacuuccucuauuaggcaaggggcucugcuuccucuugcucacagagcaggagcagguggcagugacuguuuaccacccuuggcccaggggacaccucagguucagcugugcagcugggacucagggagggugaggagcagagguggugcagggucggcuggggugggacccggccugagcuccuggaagauggugauguggagaggcuaagaccucaguuuccagagccugacugccuggguccaaaccccagcucugucccuuuugcgaugugacgugggacaaguugcaucugguccacucucugcacucuguaaaugauuucuguccccugggcauggcccagcucucagaggagaagcuuccauuuccucaucugcagacugagaauggggacccugcuugucuggauguagacaguuccauuccacacuugcuaagugucaggcacaagucauagugagacugcccucugccugcagagaacccagccgaggcaugccucugucaggcaggaagccggggguccugggcucugcugggauggcccuggguucgaauccuggcuccacuacuuccuuaccugggcaagucuugugcccucuuuagcccucagucuccucuucuguaaagugggaguaaacaugcucccuugcaggguaguggucgagauugaagauagcauuuguuaagugaauggcaccuguuauuauuuuauuauuguuacuuuuguggguguaguucauugguagguggauaaacaguagcagggcuucgugacaaugugcucguaggcgcugugacaugaggccucuuggcuguaggguccuuucacgcaggccagaauuuaccaggcuuuagggccucuuaacccacugguccccaacguggggcuggggacugccccuggccuccugggccucccuugggagggugaguggggaacagagagcuggggccugcuccugcaggccugcccugccccuggcuuuggcaugcagcauuaacaggacgaauauggggaagguggggugggacugggaauuagaacucaggccccugggccagcccgggaagcaagagggccuggggucaugguucuaggggcucaguccugagucagggguguugggggguggugggccaagcugaggggagcaacugggugccagugucuugggagggucccagaggagggcugcugggcagcagcauggaggacacagcauuguggcagggccccacgacugaugcccacaugccguccacgccugcccuuguccgcgccuccuggcgcugcccaccuccaucaggccugugugcccaguggcuucugcagaugccuccccgaagcaguggcccuggaaaccucaaacagccucuugccaggggcaugaaggccauacagggccaggggaggcagaagcaguuuguugggccccuugcagcuuccagauaccaagccugacugcggcagcuccagagagggccccagacuuucuuccccugaccccaguccugggcacauguccuugucaccucccugcccugcacuccagggccaccuucccugguuucucuggggaggccauguccagcugucccucucccagcugguccccugcccaggguggccggcaccaccuccugccauguggcccauggccgggauugcaccuggcucugcugacaccuccuggcggcuauaucgagugcccugacuguccuugccugcaucacugugcugaugcccccaagggcuuccaaggcccgucccaagguuuacaugugccagugugugcggugaugcggugacaggccagggggcugccucacuggggcagggcugcgaggggcuguggaugccagcgguguguucagaccuaaucaggaggugugugggggcuggggagcacugcugccugggaggguugcuuuggcggugucaguuggcagcugaggcacacguuggaggccugcccaggacggcucuggguauggggauggagacagcucccauccccuugucauucugcucuugccuggcuuagccuucuggucaacccauagccuccugccguuggcauggcacacggcaucccggauggcuggggcagaccccaggguggcgcgggcagacacucguugggaaagucugcagggacuuccagguggcagggcugguucuaggccagcucccuaccuaccucucagggcugcuguugagggugaaugagaccuggcaaguccagggagccccuagguaccagacagcacugaauuugaaccugaugucugugcuagcauuuccaucaccaagaaccccguuuuugguaugucucaucaucaaucccaugcuuuguaagauuuuaauaguaaugauaaaucccagccuuugggaggccgagacaggaggaucauuugagggcaggaguucacaaccagccugggcaacauagggagagcucaucucuacaaaaaacauaaaagauuagcugggcaugguggcacacgucuguagucucagcuacucaggaggcagaggugggaggaucguuugugccugggagguugaggcugcaaugagugccacagcacuccagccugggugacagagugagacccugucuguuuaaaaaaaauagaaguaggccaggcacgguggcucacgccuguaaucccagcacuuugggaggccgaggcggguggaucaugaggucaggagcucgagaccauccugucuaacacgguaaaaccccgucucuacuaaaaacacacaaaaaauuaaccgggcgugguggcaggugucuguagucccagcuacucgggaggcugaggcaggagaauggcaugaacccgggaggcggagcuugcagugagccgggaucgcaccacugcacuccagccugggcaauagagagagaaucgucucaaaaauaaauacaauacaaucaauacaauagaauacaauacaauagaauacaauacaauagaauacaauacaauagaauacaauagaauacaguacaauacaauacaacacaacacaacacaacacaacacaacacguagugauaacagugaagcacagauggcguuuguucagguuuguuuuccguucugcaggagcagcagcacuggccugucgacagugcagguggcuggcaauggccuugcugaccucgagccgggcccacguggggaccuuuggagcacagccuacgauccuggugcaaggaaugucccauucuucugaugcucugggagggcugagcaucacuugugggucccccugcccugucauggccucuuaaagccugagcauggggccugccccacagugugggagccuggggccagagucccaccgaucugaccccuuuugugcuggggauuuugugugcauggacuuguuuggucuucacggcuacccagcaaccuggguguguugucaucaaccccaucuuaggagugaguaaacugaggccuggugggauagugaccugcucaaggucacgaaggacuguccugggagcauggcuuugucuuuacaacuccggacccuugcucauccuuucccagaggucauggccccuucacccguucauaggacgucaaaggaggaaaccgaggcuugcacagagagggaguguggcucgcccccaggcuggcacgggccgacgcuguggugguuucuccacugaggugcggggaaggcaggagcugggacccaggcugggggccugacucugcugcugcccuggugcgucaccucaggcguguccuggggccccuggugucagcaucugcacuggacagucucuggggcacccuccagccugagcagccugcugcgggggcuguacugugcucagugagccuggcugccccuucagacagaggagagugcuggggcuggcuucaagcaggccucuuuguuucuucuuuucuuuaaauugccugcacuugaguagccuuuaucacacagugcaggaaucucaaagggacaaaaaggcagucucuuguuucuccucggaauacucugcacacuccagcauuuucuuuccuucuucuucucauuuuuuuuuuuugagacagugucuugcucuguugcccaguggcacagucauggcucaccacagcucagacgauccucccaccucagccucccagguaacugggacuacaggcacgcaccaccacgcccacuacauuuuuguuuuguuuuauuuuuuguagagacaggauuuugucauguugcccaggcuaguauugaacuccugagcucaaggaauccacccaccuuggccucccaaagugcugggauuacaggcaugugcuaauuuuuguauuuuuaguagagacaggguuucaccauguuggccaggcuggucucaaacuccugaccucaaguaauccuucugccuuggccucccaaagugcugggauuacaggcgugagccaccucacauggucugaccggcauuuucuuucucacacugcuguacuccugcugcucuuggcucuuccugucccugggaggccacuccucgcauccugcugaggaccugcaggauccucaccaauuccaugugccagccuuuugauucuauaaacccugggccucaguuuccccaucugcagcauggagaucacauuaguaccugccucaagggguugcugagaggaucaaaugagauguaaugaaagaaauuugcauaggccaggcacgcagaggacaccccaggacaccccagcacauaguagguauucacuaaauguuaguggguguuguaguguggggguaagcugcucaacguggaauuucuggaugcagaagaaugggcauuuugauggccauggggcauggaggacccagaccggugaggucuggccaugggaggccaggcugcacccugaugcccgcagccaccugcugugggcccccugucuuucacgugccuugugccccagccacucugcccgggguccucccguguugccuccuucccucuccagcgaggcccgugccucuggcccuucccuacguccuucccuccaaagcacaagugguuccauguugcaggcgggccaugguugucucugcugggcuguuggcauugggcgggaggacccucuggcagccaugguugccccugugcagcugagcaucuggccuccccaccggauguuaggggugcucccgagccaugcugguccggagcaucaccggggagggggcgcugccagguggauagucuggggaucccccguucucugcaggugaggaagucccuguaggguagagagguggggagggugugaggcccuggaggccaggcccuggccagguggccuugcacagccgggcagaggcagggcagggcuguggagggcagagccuuggucacuccuccucacccuagccugcugcacaccuacaaggugaggauagagaagguagggccugcaguggccguguaugaggccagauggcacagccugggccuggcauggagcaggcacuugguuagaugggagaaccuuccccuuguccugcauccucuccagagcccaggacaggggccccagaaccucagggcaaggggcccugccugaaggugcauggccacccccugcugcccacaggugcuuggcaguggcgucugcaguaccucaggaccucugauggcaccuguccuggggagaggggccagugucuggcaggucgcagccaaacacauccauccacaccgucgagguacaucugcccacgcaaaagccugugcccacuucucggggccucaguuucccccgugccauggagcgcauuggccuuguugcugucccucugagggacccuggggaauagagguggccuggggcagggcggcgccucuugcugcucacaucucccagcccuuguggcuccuucccuggcaggcccagaacuucugcaguagaacagggaccuccuggaacauccggaagucaggugagggcagugaacuaggagcagggauuacuucuguugucagaaaccuggugaugcuccugcauguggcaugguguggggcugacuuuaugaguggaggcggagcaggggcugcaaggagggguugucaucuugccccugugggugacccuuagagggucacacagcuuggucuccccaggcccaggguagagggagcagccgaagugggggcccugcccucaggcuguugcuguuuggacguuggagccagacagaccugccuuuauggccacuccucaccagacgcccaccguguggccucucuaagucaccucuucucccgcaugcuugauacaacagauaagugaaccuccccuacucccuuguggagucacugagaggguggacagggguggucuggggcugagggugguguucucuugggagcugugcacuuccagauggccccaucuaaucuccacgcgccaggcacugcuauggcaugacgcugauaacccggggagguuugucuguaaucuccacuuuacauauguccagagaggugaagccacuugccugagggcacacagcuaggaaggggcagaguugcaguugagcccaggccuuggcuccagagugagugcucacaggugaccugcugacuggcucucugagaugguaacugcagaacggccaccugugggacuccacagcagagaagccaucaggccacagggagagccggucacuggggccugcgcagucaggcagccucucugaacuggugaaaggcaagacgacguaguagcuaggacagucacagggaagagcauuucaggcagagggaagggcaugugugaaggcccugcggugggaaagcaggugucucauucagagaagggcucacucaagggucgggggcucuaguugggggugagugggaggagauagggcagagcugccacggccagugagaguuguguucuagucugggggugccucucuuuaccugugguguagccucaggucaguggcugaauucuggucaguuucaguuuccuugccccugccugggggcugcuaugaggcuggaguauguggaggacaccccaggacaccccgugcugagagccgggacaggcgggcuuaucguggguugccaguggccgccgagagccucuguuuguuguggugaugguugccacaacggcugcaccugggcagcccugggcugccuggccaucugggcccagcucugacgucugcagcagccugaggccuguuucuaggcugucuccaugacggccucacccacucccucugacagcuggguggcuuccccauggagccuguggcccuccugaugcaggcuugguguccccaacaggccgguggaugcagaggccaguccauauaccacccaggccugcgaggagcgugguccccacccauccagcccauaugugcaagugcccuugacagguggggaaacugaggcuuggugaagggggggccacaugauacaacauucccaaaucccaaggcaugagguggguggcaggcuggggccagagggaccaagagcagagagagugcagggaggguguggcguggaccccacagggaaagggugggacucaaggggcugggggcaaggucaaggcccagggucucugugcagagcuuuaauuuuuaacagaaaauauuuuauauucugguuacgaaaagccugacaucaggaauaaaagcuaccuauaauucucauuacuuagggcaguuuuuuuuuucaccucugcagagaggcuggucauauccauggugaccauuuaugggccacaacagguccccaucugcgcagugaacccugugcugagcaccuugcagacgugaucuugcuucguccugcagcacugugcggggcagguggguggcauuucugccucgagcuguuuuguacaugaggaacccaaggugcagaggagggcaccaugccagggucgcagagcuggaguuuaccacggcugcgccacuccaagcccagagccucagaaguucagagacuuuggcccagaggcaggauagaaguggccucagaagcugcuggcccugugugccaugguuuuuccuguuagaaugugcugagccucugcaucuccagacucuguugccguuucuuguugagcacgagacuugggccccuccuuccgccucagggagggcucccuguggcaggggugcugugagccauggccuggccuguuggggucugcgagucaauaaacucaggagugacuccuggccagaccccugacuugcugugcagccuggggcaaguggcuucaccucucugagccuguuccccaaguaaagugagguugggagccccucccuguagggcugugggaguaucuggagucacagaugagaagggcccugccuguggccggugcuguggcugugacagacucgcagugagacccaugcggucccugacagccaggguguugcugcaucuuaaaaugagauaaaaacgcugcgcacaggaguagugacuaggcgauugauucauggggugagcaguuagcaggcaggcacccagugcauguggcggcagcugcugcugcugcugcugcugcugcuucugucuguggacgcuguuguuuccugaagccucuggggccuggcagcgggguccccgggguggcuuugguggaaaggcugcagguaucugcuugccuggcuccugcacucugcccaccugccccaggauggacccugggaccccugucccugccaaggcuauucuguuuccuguuguucuggccuugucuucccaguagcgguaaccacccuucgcccuccaucugggcuggguuggcugcugggccccggugcguggcucugagauggggccacaagucuguguugcaccguggccaaggcuggaucugaaccuggcuuggaggcggcuucagagacuggggucuucuuggcaggcggcagcagggccaugggcaguuucuaagccccaguaccagcagccagggugagccagcagcagggaguggcggguggugggugagggccaagauguggcaggaucaugcuugggaaaugaugaggcagaagcucccacaagggcaggcauguggccagcaugucuguacuggguggucuccgggagccgugucacucccagcccugcugccugauggugccagagcaccaggugacccuggcaucucugauccuugcuucuccugccuguggaauggcggcuaugccuuauucaaagggcggcccugacuacagggagcucucucugcaugccagccccacugugccuggagccccagaaaugcugacccuccguuaguaccagcugagugcugugcaccuggccaggcucuuguagccagccugagagguguggacacuggggccucucgccugucccuagggguggagugaggaagguacugccccgggacucuggccugccuggugcaggggaggggagagagccagcgcuuuucaggggagggagagaaacgggcaucgggugucggccuccagggugagcagggcccagcagagcuagccuggagggcagcccgggcuggaguccccgccugcuccaccgccuguugcccuuucugggggccuggccuuccucaucuuggaugcaguaugagccccauccugcuaccugcagcuaaugaagccccuguacaguggcugcugcaggugcuggcuggacccccgcugggccccuucucaccccacaucccauugacuagucaggcagggcagugaggacaccucacagauggggaaacugaggcccagggagguacucaagaugugcccagugggcagggcugagauaaggcccuggaguccagccuccaggccugggucuguccugcucugcuccccugcagggcuggugggccuccuucccccuuugaaggccuaacggccuggcuuggagagagggggcucccggcaugggugauggcagaggcuggcacccuugugggccagggccugauggcucaugggagugcaggggacauugaugucaagggauaggccagacgccucaccuucucuccauucuaggaaaauccaagaggaagaaggaucuacggauauccugcauguccaagccacccgcacccaaccccacgugagucugccucaguuucucccuggcucacccuggagaggcuucccgaacagggcucaauggaaggagugagaggcagguggggccagcccugcuuuaccucguccuguccugggcagccccugcugugcauacagccaggugacggcugcuggggguucaugcagcaccauuugcucugcucugcucacuucucacccugucuuggaggcucgaugaggccgugcccagcucaguguagaugcucagcagccagugagaggagguggccggagaaggcgccuccggggcaggaggcaccucguccccacgccaggccccacacuggcccaucuacugcugcacuuggggaagggugugguucucucugaagcucacggagucuucuuucuccacagacccccccggaaccuggacucccggaccuucaucaccauuggagacagaguaggugccagccgccaccccugcagggccucucacuucaccugacgagcggguagagcugacccugcagggccacuuuggggggaggugacugaggggucagagagggucaggcucuggagaagagccucguccugcgcugcuggcuguguggcccugggccacccacucuuugacccuccuggugggaaugaggaccaucggcugccugacuggagcuuggcgagcccagagcugguaggaagguuucugagcugagagcaaggcccugcaccucauccuagcccuaggggagaguauugaacaugcaggcuccuaggccgcccuggacccgcuggaucacucccucaggccagcaccugggcaaccugcauuuuaugcuuccagaagccucggaagggcacuagccauucagaauccuggcucagggaccgugcuaugccccguuccucccaacagaaacccuacucccaggccaggugcaguggcucacaccuguaauccccacacuuugggaggccguggcaggaggaucacuugagccucggagcucgggaccaggccugggcaacauggcgaaacccugucuguacaaaaauacagaaaauuagucagcgugguggugcgugccuguggccccagcuacuugagaguaugagguaggaggauugcuugaacccaggagguggauguugcagugagccaugaucguaccacugcccuccagcuugggugacggagugagaccccguuucaaaaaaaaaaaaaaaaaagagcugggcacgguggcucacgccuguaagcccagcacuuugggaggcugaggcggguagaucaccugaggucaggaguucaagaccagccuagcuaacguggugaaacccugucucuacuaaaauacaaaaauuagcccggugugguggcaggcgccuauaaucccagcuauucaggaggcugagacaggagaaucgcuugaacccaggagguggagguugcagugagccaagauuaccccauugcauuccagccugggugacgagagugacacucugucuaaaaaaaauaaaccccauucccuaggccuguccuugacgauacucccuccaggcugucgcacucccugacacucaccaucugcuguccuguucaucuacuugcuuacuccuuuuugugucccucccaagagagggaaacaucugugaaggcaauacuuuuguuuuguugucacuguguccccagugccuaaaacacauuguggaugcuugguaaacaguuucugaaugagugacucauucuagccagcugaguggggucgggaaaagagggacagggcaccucuuucucagagcuguaccugcuggcggggcauuuugucucagucacacuccauagcagccuugggguguuggcacugugccuguuuuauagagggcaucgugaggcucagagagguuaagugacuugcugagggucacacagcagggagcgguggauaugagguuugagcccagaucuaaucagcugguccucuucaugcugcccagguaucuccacugggcauggggugaggacuggcuuccagcuugcuggccacugacucucuuuuccauccuucaagaacuuugagguggaggcugaugacuuggugaccaucucagaacugggccguggagccuauggggugguagagaaggugcggcacgcccagagcggcaccaucauggccgugaaggugagcagggccuggaggcagcugggagggcucccuggaggaggcgggcugagcucugccauggggcccugccuaucccucucagugaucaguaccgaggcuaggcuuuuuggggcacacugggcaguggcccccugagcuccuggcccuccugucaugaguguggguguuggccucugccacggcaaccucugaauggcaguccuucccugcagcggauccgggccaccgugaacucacaggagcagaagcggcugcucauggaccuggacaucaacaugcgcacggucgacuguuucuacacugucaccuucuacggggcacuauucagagaggugcguccuugcaugaugcagcuggggaucuccaccucccacccaucagucgccugcaacccacugucacucagucccuccaguacgccaggugcuggggacaccuggcauacuggcaggaggcucccccgucucuuggcuguuacuguccugcucagugccucaguuuccuugucagucaaaugaggccggugguugugggugccuccuaaaguugacacggaagguaaacgacauggccuggggccuggcauucagcugcacucaguucugucugugugaccauucgcauccccauggcauacagggcgugggaauggcauauggggcguggggugcccaagcaggcaacggccauggagauaugagaucuggauucuggguucuagguuuguggacaggauggggugugugcugagagagugacugaggcuggaagaguggagcugccuuccgccaagccgggugggugugggugagcagggaggccgggagccuaggcgaugcugggcucauacuggucacuugccccucaaagagcuguggcagggucagggcaucugaguccagccaucgggcaaggucagggcugcuucaccuguccucacucgucacucaugaagagcucagcauccucugugccagccccuagccgauggggccccugcagccugcgggugcccccugcgcaucucccaaccuuccugucaggaggguccucaggaguucacuggggaagagggagcagguccuugcaggcagggagccaucugccagggucagcuggcaugagggugucugucggucagcagggccggcuguugccauggagcuggugcaggugcauccugaagcucugguggagggacccagcgaggcugugugcuaauccucuuccucccuggagacaccuggaauuagggaucagauagaggaggcuggcgcccgaaccuggcagugcaggcagaguuggagggugggggaagcgggcaaguggguggugggugggagcccggugaacuguggcugagugggugggcacacgucggagagggggcuggggcuggggcuggugcuggggcaggcagugcagguggugcagacacgggcagcccggcagccuggcugagcucugggugucacccacagggagacguguggaucugcauggagcucauggacacauccuuggacaaguucuaccggaaggugcuggauaaaaacaugacaauuccagaggacauccuuggggagauugcugugucugugaguggccugggugggcuggcgggggguccuaggugcauaggcagaggcccagcccugccagcaggcauggagccugccuauugauggugucuugggcagagcugggcaucaaugugcccccugaaccugggcagcugcccugcauaggcccuucuccuccaccccagaccagagccuuugugcuuaggagaccuccgcuccuggggcuccuggagccccacagauuuggcagauccaggugucugagccauugauuccaacucuugaguuccagaucauuuuuuaaaaaaggaauuuaguauuuacaacagcgucauacuaaaaaugccccggggcagcucacagagguacaagcuaaguugggggaaagguuagcauccaaaaugugugcuuuuugagucuaaaaaguccuugagggagggcagcaacacugggcuugagcauuccaguagccaaaggaaaaaggaaaauagaaccagugagacugguucaauccucacugcaucuggaaacauuuacaauauaccccugccucaggcuccccacccagccuucccaagggaaauggcuccaagcugcuagaauacuggcucugccacgggaggggagaugggacagggaggcugccaagagcuggguuuuacccaagaagaguguggcaggcagugaugaugccucccugggaggugagcccgggaggaugagaggaggcaggaggccgagugugucugcaccaggauuguuaggaugcuggggcaaaugccaggacagggcaggaggcugggaugagagggugcguagccugugcagcgggagcgggagacagguggacauggauggggucuuacugcucugucguuuuugacgugaccaggaauaacagaguccugucucuucccuccuccccaccccaccgccagaucgugcgggcccuggagcaucugcacagcaagcugucggugauccacagaggucagugcccggcagccacccaggcacgguguagccagugggagggaucccaggccaaggcggguggacgucucccuaugagcaacuguggcuccgagaggugauagguugugacgugcccgaugggguuccagccgcuuuccaccugcagcccugcagcugccuccccucagguuugcuggugcucgaagcaaggacuggcuugacuucuguccugagaaagguggacuggguucuguucugauguauaguuuacaaaucgugaaacuccagcauagagugcauauaaucauguucacacccaugcaaccaccucccuccaagaugcaggacaauucucucacccccucccagaauguucucuugggcuccuucccugccaucccccaugugccuaaggcacccacaagucugguuuucccacaguggguugguuucgcccuuucuggaacaucagccucgcuugauguuucuggacccaccugggucugguguggucucaguuuguuccuuuuugcugcugagcacaagucuauuuuuccagauuuacugcuuuucaaaaaaugaauuaggcuuaguucccauuguccacugggugcccaucccagccccccaggucacugugguuggcgguuggcacggaaccuucugguccuuuuuaugugcauuuccaucuuuacacacauccccauggagggcacggggaugugaguguccuaugcgcauuuguauggagaaucccugcugggcugcucucccaugcuggucuguggggacuccauguccaaacacgcagauccugccucccaggcuuuaauugauccugcugcccucugggagcacccacacaagccaggcucucacuggaccucaugucuggagggcggaugcaggcacggugcucccagcaaagcaccuggaguccugccuuccuugcaguggccgggccgggcugggcacguccuggcuguucccugaggaccaaguaugacucucagcuggcccggcaccucuugcagccucaguucccuggucugacccuugggacccuggugcaaccugcccacuggggcaugggagggggcacaggaggggucuugggcgagggaggggggcacagcuaugcagagcauggcaccugccuccagucgugcuccacagacguggcugaggcaugucccucccuggcagaugugaagcccuccaauguccuuaucaacaaggagggccaugugaagaugugugacuuuggcaucaguggcuacuugguggacucuguggccaagacgauggaugccggcugcaagcccuacauggccgugagugguccccaagccccccaggcucaggagaggauggggcggggagaaaucugcccaggcuggccaccccggccauacccucuguccguaggggcagagccuccccacacugcguuuccugcuguaguggggccaccugugucuugcugcccaggggcagcccuucuguaccccguuguuaacugacccccacagugccccaguugggugauaagcucauggaccaccucugcggaggacacuggugggcugugcaggucccgccccgcccucauugucaggagggccuuaggggccugcucccggguagggucagaccgaugcaaggguugggccuucuaagcaugacccaggcccuccuagccucaguuuccucccccgucacaugggcaggugggcuaagcugagcgcucaguuuggggauugggaggcaaggccuagccaugggggcuuaccuggggcggguguucacgccucacucuucccuccugcagccugagaggaucaacccagagcugaaccagaagggcuacaaugucaaguccgacgucuggagccugggcaucaccaugguacuguggggggccagggccugcccuugguggucaggugggguggguggagccgugccuggggcccugagcuuuugggggacucaucaaauaguuuagguucuggaaagaaguauuggcuucaaaaucugagaagaaaaugugccaucagaaauuaccaucuauuuaagggaaccuccuagggucagggucacucaucgugaaguccugggugcuuugugauaugguggccacagggcuuucucuggaguucuuggugcuuguugagaaaucacagccaaucccaaauuacguaaguuccugguauguaaaucaugcaaaagcaagaugguaaagaucuuuucaaaaauauuucauagcagaagguuuguugucgguggcguccugguacauugcgguggggugguagaaagggugggcgggcucucaauccugggccuguggaagccaaaggcaucccuggcuuggguagggugagggcagauguggcagaaguccgaaguccagguguagggaugggcccagagcaguugcuucuggaguugccuggcagaaccccaugccuuccguguuggggcucaggucaaggugugggugagcccgcucuggcuccccuguggacaguggauuggagggaugggaagaccaccaggaugugucccccagccagggcuaggaagcugugcaggagacgcguggaaggacgaugccaucagcaggucgggcucaggcugguggccuuggccaguugaguggcuugggaccaauggaguguccugggcgucagcuccuucccugcccagggaagccuggcccaggacauuccugcuugucccuagucccuuugacuguuugguguuggggaugaggccgucagauagaaucaguaagauguggugagaagcgcuggcgggguguuuuccaacaccgcaacccauucucggauucuccagacacccacccagugcccugcaguuccguucgguucugaugcuaccuggaguucgcacagaccccacagguuaagggcucugucccaccagacugcccccaacaucacacaccaguuggaaguagcgggucucccauacuacuggacugaccagcuacaaauuggggguccccaugacccucucguaagguuugauaauuuccuagaauggcucacaaaacucagggaaacacuuuauuuguguuuacugguuuaucagaaaggauauaacucagggccaaccagauggaagagacucacgggggaggggugugaguguggggugcagagcugccgugcccucucagggccuggcacccuccugguaccucccugugcuugcgaaccuacaggcuucucaagcucauggaauuuuguuguuuuugacacagagucucacuuugucacccaggcuggaaugcaguggcacaaucuuagcucaccguaaccucugccuccuggguucaagcgauucuugugccucagccucccgaguagcugggauuacaggcaccaccaugcccagcugauuuuuguauuuuuaguggagaugggguuuugccauguuggcgaggcuggucuugaacuccugaccucaagugaucugcccgccucagacucgcaaagugcugugauuacaggcaugagccaccacgcccagccucacauggagagguuuuuugugagagagggucucacucuguugcucaggcuggagugcagugguaucaucgcagcucacugcagccuugaacucccaggcucaagccaucccccuaccucagucuccugaguagcuggaacuacaggugugugccccuaugcccagcuacuuuuuuaauguuuuguagaaaaggggucucacuauguugcccaggcuggucuugaaauccugggcucaagcaaucugccuaccucggccucccaaagugcugggauuauaggcacaagcuacugcacccacugaaaguuuuuauagagcacagucuccaggccccccuccucucagcaucaguuggcgggugaugcugagaguucccacccucuauaaucagcuggguuuucuggggagcagccccaucugaggcugucuaggggccuuacccugagucaccucauuagcauaaacucaggcuccuuguggauaacaaagccacuccugucacucaggaaauuccaaggguuuuaggagcuccaugccaggaacaaagaccaaauaaauuccuuuuuaugccacggggguggagaagacuggagcagguagggguggcucuggggacagguggaaggccacuguugcagaugcggaggccucugcaaggagggcacccugcugaccugagggcaggguagaccagggggugcaagugcaaaggcccugagguggggcugugccugcugugugccuggguggcugggucagaggagagggagggaggguugggagcgagcgaagagaagugucugguggguagagaguugacgcagguguuguggguuuuacugguguugcugcuaccauuguuaucaucaucaugugguuauaacuuuauuuauuuuuaauuuuuauuuuuuugagauggagucucacucuguugcccaggcuggagugcaaugggacgaucucggcuuacugcaaccuccgccuccuagguucaagugauucuccugucucagccuccugaguaacugggauuacaggcucgugccaccaugcccggcuaucuuuuuuuuuuuuuuuuuuuuuuuuuuuugagacggaguugcacucuguugccuagccuggagugcaauggcaugaucucagcucacugcaaccucugccucucgcguucaggcaauucuccugucucaaccuccccaguagcugggauuauaggcgugagccaccacaccuggcaaauuuuuguauuuuuaaaaaagacgggguuucaccauguuggccaggcuggucucaaacuccugaccucaggugaucugccugccucugccucccaaagugcuaggauuacaggggugagccacugugccuggccuuuuuuuuuuuugagggagucucacucugucgaccaggcuagaaugcaauggcacaaucucaguucacugcaaccuccgccucccagguucaagcaauucucuugccucagccucucaaguagcuaggauuacaggcauuugccaccaugcccggcuaauuuuuguauuuuuaguagagacgggguuuugccauguuggccaggcuggucucaaacuccugaccucaggugauccaccugccucagccucccaaaguguugggauuacaggcgugaaccaccacgcccagccuugagccacugcgccuggccuguggcuguaacuuuauaaauaguguaucuguagacagugacugggaaagacucaaagucgaaauaauuuugucagagaggugggacugggccauaccuucaauuuucuuuaauuggugacauguaauuuuucaauuaaaauuuuuuuuuuuugagguggagaggaauauucaggcugaaggcaggugcuguaucugcaauaacaguuuuccaaguccuaaguuugaugcaaaggacaaguucuugcuguauuuagacugcacagaacugguuggauauuagagacccugcucaugacuaccucacacauacacacacccuaugucccuuccccaucucccugucucccuuccaguuguccauccaucaugauuguuggggccaccauggcuaguggccuucugauauggcugguggaacuuggacaagugugugcuaaguguauauuucaguuaucaaauauugcauagcaaaccacccuagaaccuagugacccaaaccaacagcgguuucuuauuucucauguuuccaccacuguggcugggcucagcuggauggcucuucugcuguaccugggauuggcuggggucauggcugggcugggcuggucuggaaggcccaagacggccucacaaacaugggccuccucugccuggccucuccaugcaacuuacucacauuggccugcucccugggcuucagagcauggcagugucagcagaguuggaguucuuucaugauggcuggcaucuaaaaggaaguucucugaagugcuaggccuggaacuggcacagcaucacuucugccucauuguguuggucagcgagucacaggccagcccagguucaagggcagggaaugcucccggcuuaauggaggaucagcaggugcacacagcgggaggcggagguggucacuuuaggcacagguuagguuuuucuuucacaaguuacaaacguaguggaaaccuaacauaaaaauagaggcacaguaaggggaaaaugacuguaguuauucuaccuagagacaccucuuaccccguuucagugccaacauugugcauuauauuauauauauaauauuuuuauuacauauaauaaaauacguuuuauuaaaauuuagagaaauacaaacaauauguaaugcuucucuuuuuuuguuguugaaacagagccucgcucugucacccaugcuggagcgcgguggugcgaucucggcuuacugcaaccuccgccucccagguucaagugauucuccugccucaggcucccgaguagcugggacuacaggcgugcgccaccaugccuggcuaauuuuuguauuuuuaguagagaugggguuucaccauauuggcuaggcaggucucaaacucgugauccacccaccuuggccuuccaaagugcugggauuacaggugugagccacugcgccuggccucguaaugcuucuuuuuaaaaaacuuuuuaaaaaaaauuuuguagcauuacauguuguucauauuugucucucucucucuguuuuuuuuguuuuuuguuuuuuuuguuguuuuuuuuuuuagauguaguuuugcucuuggugcccaggcugcagugcaguggugcaaucucggcucaccacaaccucugccuccuagguucaagugauucuccugccucacucaaucucccaaguagcugggauuacaggugugcaccaccacauccagcuaauuuuguguuuuuaguagagaugggguuucuccauguuggucagacuggucucgaacccccgaccucaagugaucugccugccucggccucccaaagugcuuggauuauaggugugagccaccgcaccuggccaauuucucuaaauuauaauagacuccuguauguaucccuuccaaagacuccauaaccaucugccaccauucagucacccugucugcugauguggguuguuucccuuguuccugcuguuuuccuuccauuucaaauucucagccauccugggggagcgacugaugaaacagagucgggagagucccccuggguggggcucuggccucggccuccccccauccugcaagggccccagagcucucuuggcguuggcuuuuucccacucacugcacaagccucaggaugccagugggaaucacccagaacagacaggggucaugccggggauggcccuuggccaggagcaagugcugacugggugcuggccuguuaguguugucgcuggggagucacaggggugcgacuacgguccuggcugggucuccgcccccaugguggggccggccccuggcgcuggacauucaggcuguuucuuaguauuuccuggcagaaaacaccauauggcacaucuucgugucuggaggcuauuuuuguuguuuuucauuuuuugagcucuuuagaaaaaauaaaggaguacgagguugaagguuuggacacuucugcuuuucuaauuauaacucucauggccgcugguccuucuccuguagcucguaugggguacuugcucuacauauugcagucagugaaaauucuaagagaaaagccccccaaaucgguacgguuuuguccugugaacacgcaugcacacaugcacacacacgcagugggcccugccuguguggguguguuugucugagcuggaaagggccucuagccugaugggaggcacagucucagcacaguccuuagggucuuguccgggcuccaguugccagugccaaguguuugugcugaggucucuuccguucaucauggugaugacggccggcagugagggcccuugugcuggagccucggaauucucuguucuuccaggccggggccagggcugacauaacuuguuuuuuccauccagucaucaugauuggagcccagaguugguuguaagcuagcuaguccgucccuuccaugaugacuuccugccaaccacagggcugggagcuuggagcgaggacagagacccaccggcccgaugucacccacaggaaaucuggauccagcagggcacauguggccacacaggccacuugucuaggagggaaacugcuggggcccugcagaagaugaggcugcaggcucacgggugcagaggcgaagcagccucauggucucacacucuguccgcggccuuggagacagcuguguguguguguguguguguguguguguguguguguguguguguagcauuucccaugugccuccucugugaaaacagcccaaauuaaugacagcagaugcugaagucugagauggucagauguuaggaaggggauuggcugugaccaccugggaccugcccaccuggcucaugaggcuacggcccaaaguugccagcuccucagauuuuuccagagcagcuggaaccugcauuguuuuguaaaaucuucagaauucagguuuucugaaaacccuaugauggucccaccagucccggugugggcugaaucugcuuccugagcuggguccugcuggcugggucggaggagcuaagagcuggcauccccggcuuucucgccuuuguucugcugggaugugguagggagaucagcugugcagcuuugacgccuggcucugguaccaggaugggugggagcccccaacccucgcuccugggugcagagcgugguuguaucuggggccggggccucugacccccuguccccgcugcagauugagauggccauccugcgguucccuuacgaguccugggggaccccguuccagcagcugaagcaggugguggaggagccguccccccagcucccagccgaccguuucucccccgaguuuguggacuucacugcucaguggugagucuugggugcugcugagcgccugccacugccccucccuggccagaucccugcaccuuccugggcccuguuccuuuauuccuuuggcaaauaaacccccagaugacuuggcauccaaauauguaaggcagaaacagcuggagcaugaggagcauuugacaaaacgauggucuuggugggagauuuuaauacaguucuuccagaaguggacaaaucagauagacugaaaaagagaacaaaguauauggaaaauuugaacacaaaaaacaaguuugcuuuuauugauaucuagaacuuuguaccaaauuaaagaaugccccauaggagccuuauaaaaaucauguuugagaggcugggcacgguggcucacgccuguaaucccagcacuuugggaggccgaggcaggcggaucccgaggucaggaguuugagaccagccugaccaacauggugaaaccccgacucuacuaaaaauaggaaaauuagccgggcgugguggcgcaugccuauaaucccagcuacucaggaggcugaagcaggagagucgcuugaacccgggagccggagguugcagugagccugagccgagaucaugccacugcacuccagcaugggugacagagugagacugucucaaaaaaaaaaaaaaaucauguuugagguuacagaaggaauaaggaagagggcaacuucucugaacuuaauuaaauagagcaagaauuggguaaggaagaagcggccgggugcgguggcucacacccaugguccccgcacuuuuauuguugaccauaaucagcaacagaggagcccagcagagucccugggcagucugaccccuuuaauuguggacuaacuucucccagaacccaugauaaggaguuucucuccugauugaggauaccaagugugugacuguuaggcagagcauugcagccccauuuugguguugauauggaaauuccuaggucacuaugcagacaagaaaaccaggaccccaggagccagagaaacuugcugcaagucucuaguuugcuccuaugaaugccccuccacccuggaagaagcccuagacaguccugucccuucuucccugggugcacguguccccugcugcuaggccuggggcaauccuggggugguuuggcuggcccuugggggcugggcuuccucccugccagccuggccacagcugcacuauucucuccuagccugaggaagaaccccgcagagcguaugagcuaccuggagcugauggugaguaugggcgggaggugccugcccugcucuucagggcuggcuggggcuggguggggcucuggggagagggcugcauccugcacacagauggguagcuccucuggcuggcccuguguucucuccuuuaggugcucggucauuuguuugcuccugcauaccuggcucccuccucccuccuuccugcaugccaggcccugggaaggguacacaggcagugugugacagaauggggcagaggggccaaggguggcaucagggaaggcuucauggaggagguaccauuugaacugagccuggaaggaugaauaaggguuaucuccugauggagaggcugucccaagcagaagguccagcaugggcagaggccugacguguggggggaaagggagguuaguguggcuggagagugaccacaagagagcugaggaggagccacagaugccaucugugacagucauggagggccuccuggggguggagguccuagaaggaugaguaggauuuugccagucaggagaacacuugggcuggagcugguuggggaagaguggccaccucucccucccgcuaccccuccauggugacugugccuucugucacccccaggagcaccccuucuucaccuugcacaaaaccaagaagacggacauugcugccuucgugaaggagauccugggagaagacucauaggggcugggccucggaccccacuccggcccuccagagccccacagccccaucugcgggggcagugcucacccacaccauaagcuacugccauccuggcccagggcaucugggaggaaccgagggggcugcucccaccuggcucuguggcgagccauuugucccaagugccaaagaagcagaccauuggggcucccagccaggcccuugucggccccaccagugccucucccugcugcuccuaggacccgucuccagcugcugagauccuggacugagggggccuggaugcccccuguggaugcugcugccccugcacagcaggcugccagugccuggguggaugggccaccgccuugcccagccuggaugccauccaaguuguauauuuuuuuaaucucucgacugaauggacuuugcacacuuuggcccaggguggccacaccucuaucccggcuuuggugcgggguacacaagaggggaugaguugugugaauaccccaagacucccaugagggagaugccaugagccgcccaaggccuuccccuggcacuggcaaacagggccucugcggagcacacuggcucacccaguccugcccgccaccguuaucggugucauucaccuuucguguuuuuuuuaauuuauccucuguugauuuuuucuuuugcuuuauggguuuggcuuguuuuucuugcaugguuuggagcugaucgcuucucccccacccccuaggguaccagcaggcagagccuugcccucugcucaggcugggguccagugggaggggcccaagaucucugcucagagaagugcagggggagccuuccagcucacucucccugaggacuggcuugacaggggcuauggguuugcuuugguguuguuuuuaaaaaaagaaaauauauuuuuuugaaaaaacgacugcccaucccggguccuuucccugauggguuggggcaguuaccugguugcuguuuuaauuaaaaaaaaaaaaaaaaaaaggacuaaagguugugugagauugugu

SEQ ID NO: 16602 - RNA, 535 nt, Homo sapiens
uuuuuuuguuguuguuaagcaaucauuuuauugcuugaguacauagacaaauuuaugcuaccagggcagaggcuguagaugauucauauuuccaauugggagggaggacucgcuuggucuuguaauaucgagccaaguggugaauccagcucucuaucagaaucagauggaauuuagcauucuuauccuuucuguuccucucaagaugcuuuugaacagcaacugcuuucuuaauuaaaugguagagaucuucagggagaucaggagcaagucccuuagacuuaagauuucuuaagauuuuauugccugucacaaaacguacuugugcaacacuaugucagucucucaggaucacaccaauuugugaaggagucaggcccuucuuggccacuuaguaaaucugcuccuucacgucaucagaugucaacuucagccaaguggggaugcuguggcgauagggcaaagccaaccgggacgggcccuucccaggagcaugcaugcgacccaugauggcggcagucaggcagugaagugu

SEQ ID NO: 16603 - RNA, 3756 nt, Homo sapiens
uugcagucuggggccgcagacacccagccacucugagcagaacugacagcaugaagguacggggcccagggucgggggacucauagcaugggggaacugagcccacuccagaggccccuggccacagagggcacuaugaaggcacaaggaguucucuugaaacucguaagcuaugaggguacacagcgucccagagagugggguuacuuggcgggcggggugggggggcagggaagaggggccaaauagcaggagagggauucaggcaagggcaguaugugcaugcauggugggggcaaaugcaaagagaacaggggaucucuggagcugggaaggggcugugcugacccugucugcccaucgccaggcacuccuggcccugccgcugcugcugcuucucuccacgcccccgugugccccccaggucuccgggauccgaggagaugguaagcagccccacacucacagacgcggccuggcccacagguugugcaagaagaggcuggacugucagaacagacugucagggccgagccccagcucugcaggacucagguuccuccuuuacaaaauggggcagauggaugacauaagcauugcucaucucccuugaagaaaucuuccaugacuccuugugucaaagucccccagccccagggacugaggcaaaccuuggggugcugaggugucagugaugccauagucccacucuccucacuguccccaugucccuacccccagcucuggagagguuuugccuucagcaaccccuggacugugacgacaucuaugcccagggcuaccagucagacggcguguaccucaucuaccccucgggccccagugugccugugcccgucuucugugacaugaccaccgagggcgggaaguggacggugagugggaggagggaacagaggccagagcugguucuaaucccagcccugugacccugggcuucacauaugcgaaccucaguuucuucaucuuuaaaauggggauaaugauacccacagcacagcuucugagcagcugccaacgcuuaauucuaagugccugagguagguguuuguuuguuuguuuugaggcggagccucacucugucauccaggcuugagugcaguggcuccaucucagcucacugcuggaaacuccaccucccagguucaaaagauucuccugccucaggcucccgaguagcugggauuacaggcaugugccaccaugcccagcuaauuuuuuuauuuuuaguagagaugagguuucaccauguuggccaagcuggccuugaacuccugaccucaggugauccgcccgccucagccucccaaagugcugagauaacaggcgugagccaccgcgcccagcugagguagguuaaugcacauaagccucacaauaauccugggaaguagugaggaacuaaagcccagagaggugaaguaacuugcccagaucccacagcuaggcacucgaacucuagaacgccucccucuuagccucuuuccugccucuauacgaaacuggguaugaagagcccaggugggugcuggcaacugcuccacagggggccuggugccaauguggacguuguuuuagcaaccccacucccaccacccuccccacccccaacccaguccuuuaacaaacuggccacagcaucacaggguccaugcuugaggugggcagggcaggaccagaaccuugcccauuggacccuugaugauccagucucaucuucucugcuccagguuuuccagaagagauucaauggcucaguaaguuucuuccgcggcuggaaugacuacaagcugggcuucggccgugcugauggagaguacuggcuggguaaggcagggaccaggugggcugaggggcugccccagggccagguccuuguugaccagcugccccuccuccccagggcugcagaacaugcaccuccugacacugaagcagaaguaugagcugcgaguggacuuggaggacuuugagaacaacacggccuaugccaaguacgcugacuucuccaucuccccgaacgcggucagcgcagaggaggauggcuacacccucuuuguggcaggcuuugaggauggcggggcagguauaacccgcuguuagcuuugggaggggcugugaggggaaagaaggcagggcuggcccugcccagucagccccaaccuccuucaggccccuccuucaacccuucuggaucuggaagggccacagcuggcuccaaacaagcucaaaccagcuugggccucagcccuggggagcagccauccuggcccugcuccaggcaacucugugguggagcagcuguuucucuucauugcagaagcacaucaacccaacaucuggcucagggagggugcccccaucccgccaggcugccacgugauaucucucacagucgucauugucacccucucccggccagcucggggcucaguucccugccucagcagccccaacccuucucuccucugccaggugacucccuguccuaccacaguggccagaaguucucuaccuucgaccgggaccaggaccucuuugugcagaacugcgcagcucucuccucaggagccuucugguuccgcagcugccacuuugccaaccucaauggcuucuaccuagguggcucccaccucucuuaugccaauggcaucaacugggcccaguggaagggcuucuacuacucccucaaacgcacugagaugaaaauccgccgggccugaagggcuggcccccucaggcaccuuuccuccccuggacacccauggucuccaugagugcucccucugcugccccugaugcaugcuucugcugauucccgagcaccaacuccuuacaagggggccuuguggcucucagccaugccacaucccugucacacacccagggcauccauuccuaagccagacccggcuccccuacaccugaaguuacacugccagcaguuccccaggccucuuccgagaggcacaugguucuagccuggaccuggcugggcuccaugagaaugaguugccuccaaccugucccaacagcugacagccaggagccacucucccagcugcaggccuuugugguccaucuuguccugcuuccucacuguggaccccugucugggccacccuagugugcuaagcugagcagugcagugugaacagggcccaugguguauucuaggccacagcccagcacuccucugggcugcucucaaaccaugucccaucuucagcaucccucccaccaacuuacuccccuguggugaguaccguggaaccccagcccaccucacuaucauacucagcuuccccugauggcccaucccagccccugaagcucuaugccaagaacacagcuaccgcacaccacccugaaacagccacagccaagguaggcaugcauaugaggucuuccccauacccucuggguguugagagguuuagccacaugagggagcagaggacaaucucugcagggcugggaguggguagggacugaaggucucaauaaaccuucagaaccugaaugaacuggcuucauacacacaaacauauuuguuuaucccccaaauguaggcaccuggcuccuccuugcuccccugcugaugguguccuaccccgaacuccaaaaauuacaccuggagucaggugcagaagggaaccuuguauuucacaggccucauuuugauggcaaaaagacaguguaauaauaacauaauaauaauaaaaauauaauacu

SEQ ID NO: 16604 - RNA, 6380 nt, Homo sapiens
acucccuguccuaccacaguggccagaaguucucuaccuucgaccgggaccaggaccucuuugugcagaacugcgcagcucucuccucaggagccuucugguuccgcagcugccacuuugccaaccucaauggcuucuaccuagguggcucccaccucucuuaugccaauggcaucaacugggcccaguggaagggcuucuacuacucccucaaacgcacugagaugaaaauccgccgggccugaagggcuggcccccucaggcaccuuuccuccccuggacacccauggucuccaugagugcucccucugcugccccugaugcaugcuucugcugauucccgagcaccaacuccuuacaagggggccuuguggcucucagccaugccacaucccugucacacacccagggcauccauuccuaagccagacccggcuccccuacaccugaaguuacacugccagcaguuccccaggccucuuccgagaggcacaugguucuagccuggaccuggcugggcuccaugagaaugaguugccuccaaccugucccaacagcugacagccaggagccacucucccagcugcaggccuuugugguccaucuuguccugcuuccucacuguggaccccugucugggccacccuagugugcuaagcugagcagugcagugugaacagggcccaugguguauucuaggccacagcccagcacuccucugggcugcucucaaaccaugucccaucuucagcaucccucccaccaacuuacuccccuguggugaguaccguggaaccccagcccaccucacuaucauacucagcuuccccugauggcccaucccagccccugaagcucuaugccaagaacacagcuaccgcacaccacccugaaacagccacagccaagguaggcaugcauaugaggucuuccccauacccucuggguguugagagguuuagccacaugagggagcagaggacaaucucugcagggcugggaguggguagggacugaaggucucaauaaaccuucagaaccugaaugaacuggcuucauacacacaaacauauuuguuuaucccccaaauguaggcaccuggcuccuccuugcuccccugcugaugguguccuaccccgaacuccaaaaauuacaccuggagucaggugcagaagggaaccuuguauuucacaggccucauuuugauggcaaaaagacaguguaauaauaacauaauaauaauaaaaauauaauacugaaaaggauuguucagggggaguuggggucucccgauccugccauggcucggugguggcucagguggcugcuuaaggcugaaaggugggucugagaugaaccugcagaauaauccaagccgagccucaccugcuggguccagggcuaaagccuuugagaaugcucccauggauccuggaacuaggucuacuguggcagcaaggcacaggcugggggccucagggguccuggaggucaggcaggucagccagcagcauuggggaguccaucuggaucucacgcugcagggacucaauaucggcaggguucaugccauggccuucgagccagucagcaagcagggaggcugagagagaggcugaaucugccuggcugcaggggaaggaaagggaggggugcuauuagccuaggcuggacccucacccaucccacaggugcaugucuccugcaccaggaaccucuccccacagucccagucuaggagcucaguccagccaccuuacccauccuguggcccaucagccacgcccaugucgaaagacugguuuaagaauuccuccaggucaaagccaacaccguagccagccccacugcccuuuggugugccugagaacacagggggcaggggguccuccaccugcagggaaugacagguuacaaugcagacagacugaggucuguaggccacccugucccaaugcugcugacuacuccgccuggauaucugggagugcuaacaccagucucggcagucagugagugcuggcuggccccaucucugggcuaggcacuuugcaggccauauuuaacuugucuccuaacaaccucuucauugccauuaugcuccuucugugagcaagaggacacguucagagauaaagccccaucugcugcucaguuuuuguggaacacugaccgcuuccugaacccauuuuccuuuggcccagacccagguguccccauggccugggccucccucucaccugugacuuagauagcugcugggucacaagguugacaucaggugacucugacauggaagacugaggggcucccccggcgucugggggcggcaggccaggugggaaguaaggcaaaacuccuggggugcuggagccaggcagcccaggggguggcacaagugacugggcagccaggaggcugguggagguggcaaucugggguggcgcggggacagggaugggcccaggagggccagugggguggggugcagggccagggggugggcaggcaggcugggguacagggccagagguagagcccgcagauugugguugcgggccagugggcugggcuacagggccaggaggaggacugguagguuggacugggguugggguuggcguuggcgcuggggcaggggccggcacagaggugagggcuggggcugcgggccgggccauucgaguccagcguuccaacaggcuucugucauugucacugagcacuaguccagccaaggggucaguggaggggcccccagaggccccagccccccguuccuuucgcucccgcuccugccgccguuucucccgcuccuuggcucguucuugccgccuccgccgcuucuccucccgcucccgcuggcgcuccugggcugucaccggcuuccgaggcucaggagccuccaggggugcgcuggggccaucugcggggaaguugggcaggggagaagguaaaagccugaagccuuguccaaguccaagucuccccucugcccacccgaccugcccacaaggcaccucugagccggcuccucaaagacuugagcagggcagcuuuaagggcagccuuaguauugucugagauggcaccaucuuucuuugguggggcaggcucacugacugguggagguggcugcagggucagaucaauggugucaggugcagggccggggcaugguggcggggcuggugguggagacuccauggcacaguccccacugggagcccagggacugggcauuucaacaucuggacagccaggcucacuagccacaggcuguagagaaggcuggaagcggaucuguuggcggaugcccucacgccuugcauggaaguccucaauuucagccacaauggccuccuuaaugcgcucccgagugagggcuucgcggucaaaggcaaagucaaagggcggggcacagucaggcucaucaucaggaucaugguacuuggccaggaaaggguggcgaagggcagcagcugcugagaugcgagcgcugggcucaaaacgcagcaugcgacccagcagugauagggccuggcggucggcaccuggguacacugucucccagggcacaggcuggcgugguggcaagcucuggauauaggcccgcacccucucagcccccacagccugaaucacggcuggugaugggguacccagcaccaucaugaugagcuguagcugguguacauaguuuuugccugggaagagcuggcgccgggccagcaucucaccaaagaugcagcccacagaccagaggucaauagccuguguauacucaugcaaagagagcaugagcucgggcgcacgguaccagcgcguggccacauacucagucaugaaguacugauguucagcgggcgaggugcacaggccacgagccauaccaaagucaccaaucuugagcucacaguucucauucaccaauagguuggagggcuucaggucacgguggaugaccugagccgagugcauguacuucaggccccgcagcaguugguacaggaaguagcgcacguguuccagugugaggggcugugaggaguggaugaucuggugcaggucgcuuuccaucagguccaggaccacguagcuggaaggggaaggaaggagagaagcauggguuggccugaucacacuccagggacaagccccauccucaccacacccuuccgauuccagacagguaacagccuuacccugggaccccauaggggcugacggcaugguauggaagaagagcaucacguuuuagauucucuacgacuuuuccaugaacuugguuaaaucacuuuugucuccagaccuaguuuccccaucagauaaaagaugggguuggacuacaccagggcuggccaauagguuuccuuuuggggcuaucuccauuguuugguaguggcagcuugaagaacuaugaugaaaauugaccaggcuuguccacugucuguaggaaaguguucugugauugauuagugaagucugcuaugggaauaggaggguguggucauaguaggaauguccuacauuugacauccuauauacuaagauucuauaaaacuguaaaaucaucuguacacuucuugaggaauaacaguugucccuggcaaaacucuaaagaacugguccuagaacugcgggaauuuucccagccugcuucagauuagauucagcugccuuuccagaacuucggcaacaugguugcagccuucagaaaagucccaagucuggcucccucucccaucccgcuucuuacacagauuugaauucgccauagggcacggugggccucaggauguccuugauggcgaugauguugucguguuuaaagugcuugaggaucuucagcucccugaggguccgcuuggcauuggucaccacaucgaaagcauuagggaucuucuugauggccaccugcuggccugaggagcagggaaaagggacauaccagaggauaccuuggagaaacugcagagucgacucagccccuaucaacaccucccuucuaggaugcaaaugacaacagcuaccaaguauuggguaccuacuaugugccaagcccugugcuaagcauguuaccuacauuauuaaauguuaccuucacaacuccccugcggggcaggucccaauaggucaacguuaaagagaaggaaauauggcuuaguaacuuguuggagguugcacggaugcccagugguguagcucagccucuuaugccuacacccucuccaucucagaccucacccaucccaccaccaguuccuuaugccagugucuggcuccagaacacauuucucucuuagacacgaaggacuggcucuccauucuggucuaacugggacuaucauuuuccuaaggaggaaguaggcaggcaggauggcaaaaccaccaggccggaguuucagagaaccgagccuccccggagccuggcaggcagaaggcccuggucaguguguguugacuggagccagaacucgcaccccgcuuuccuucccggcugucugggacaggccgguuucccacucccugcgacgcugccacaucugggaggcgacggcucaggaagcucaccggugaggcggcggcgggcggaggacaccacuccauaggccccguugccuauggucucgaugaucucguacucgucgcccacgucaaaggucacaucgaaggagcgggcuuuaagcagggccagguucuuggccgcuacagaggcagcggugugggcggguucggccuucacgggcccggggggcuccgcagagccguccucgccgucuuccuccuucagaggcucggccauggugucuguguggagacucgggugaggagaggaccaccuaccgugggccucaguguccccucugcgggcuggggagcaggaccagggaacuucccaguuuccuaaaccgacaagggcagaagcgcgcggcugguucguggcagacuagcuaccccagggguccgggcccagagccgggggcccgccagggucgggggagggguaggcgaggcgcgggccaggaagaaagggaggggcggggcaccuggguuuccucagggccgcacucacccccgcgccuccucaaggcuuucagaggucccgaggcucgccggccucccguccccagcgcgggggucuccgaggguggcucacuuacuuguucaaaggccgcagccaccaccucagcgucuugagcugcccuguccgucccccuccgccccgccucccaaggccacgcucccuccagcuccuggccaaucgcugagcuacugcugcggaggguccugccccuucuaccuacugcguccaauccuagcccaccggccgagaaagccacgccuggcgcgcgccgcuguccagcucgccggcggga

SEQ ID NO: 16605 - RNA, 22252 nt, Homo sapiens
ccacagguaggcgcagucagcuggagcgucgcggcgguccgccggucguggagggcguguccugcggcgcgauggccguaguguugccggcgguuguggaggagcuccugagcgagauggcggcggcggugcaggagagcgcgcgaaguacgggaccgaggucguguguggcugcgccaugggcgcgggcggggcauccgggcaccgccgggccgggaggcaggaggcgggguguccgggccuggcccugccuuuuuuccaugugguucucuaaaccucuuguucguaaaaagacaaaaaaacaaaacaacaaaaaagcgaaauuggaacaaguaaaagucaaaucgauucagcaaauauuuacgguacagcgcaguugcaggagccccuccgucggagcgaguaggccaguggggaccgaagugcugagagcuggccgggucgcugggagggguccccgcccggggguggaagggacgggagccuacagugagugauagaaacguggaguucuugauuauuuuacacgaaauuuugaauuauuaaacuucuuuuucucaaauucugauguuaacauuaaaguuaaugcuuccauacacuuuaaaaaguaggcccagcgcaguggcucacucccguaaucccagcacuuugggaggccgaggcaguuggauuaccuaaggucaggaguucgagaccagccuggccaacauggugaaacuucgucucuacuaaaaauacaaaaaauuagcugggcgugguggcgggcgccuguaauuccagcuacucaggaggcugaggcaggagaaucgcuugaacccgggaggcggagguugccgugagccgagaucgcgccauugcacuccagccugggcaacaagagcgaaauuccaucucaaaaaaaaaaaaaaaagcauuuuaagagccacaaaaccuaaaugcauaugcaaucguuggaguaaaucuggguauugugaaagcaccauuuuuuuucugaccagcagaggguacucuuuggcuaugcucaccaaaaucacuugagaaggguugaucucaagauguguucagaguaugcuaggauaagaucaaaucaaauuugauauacucaaaaugcauugacuaaugaacuacucuuaggauguaaaaauggccaccuuauaaauaacagccauaucaggcccccaaacugccaucgcuuauucaacuuggauggcuuuuguuuuaaaaguacuguacugcauuuugaaaggguuuaucuugaguuacuguuuuuaaggaacugagaaaaauaagccaacuuuguuuccucaucucagucaaaauuaaggagacuuaaguauaugugcuugaaagauuagugcagccaaguauucaaacauacuuguuuccaaaaaggaugggaaaaaagccaacugauguuagcuuauacaauuguucugggcucucagauuugauggccugaggguuuggaaugcugucacuuuaaacaauaaucgccagaacuguucugugucugaauagguuaauccauacacugacaguaguuuggguugguuuguuuuuuuuuuuuagacagagucuugcucugucucccaggcuggagugcaaugggcgaucucagcucagugcaaccuccgcuucccaaguucaagugauucuccugccucagccucccaaguagcugugacuacaggcgcaugccaccacacccggcuaauuuguguauuuuuagaagagacgggguuucaccauauuggccaggcuggucucaaacuccugaccuugugauacggacaccucagccucccaaaaugcugggauuacaggcgugagccaccgugcccagccaguuuuggguuuuuucccuccaacaagaagguucacaagacacauugacaguccugaagggggcauaaucauugccccugacacccaugguucagacacaggaaccaaugcuguugauucauguuuauuuucagaagcccuguuuucugucuuuuucaaaaucuuuuuucuauuaauauauaguuaugcacccuuccuaacccccauucuucagugguaauuuuuuuagaucaagauuccaaguuuuauuuguaugaugauauauaaacuagucacaguggaaccauguaggaagcuaugauuacuuuuuguuuucuuuguaacuuuuggauuucccuggaguuacaacuaucuugguuuuguuuaugugcuuauuuaguuuuuuacauauuuauuccuacuuuaaccucacauccuuuacuaguguucucaaucuccccucaagauguucagaugaacgaaguauguuaucaguuucaccuuccugaagacaucucuagagccuucggacuugcuuaauauggacuggcugaucucucggcuguuugcugagaucucucuuaaccauuauuaucugggaauucucuguaucuuuguuggguccuauguuuaguauauccuacaguuuucuuuuucucaguuuacuaccucuuuuuuuuuuuuuugagacagucugucacccaggcugaugugcaauagcaugaucaaagcucacuguagcuuugaccuccuaggcucagaugauccucccaccucagccucccaagugaguaucugggacugcaggcacacaauaccacagcuggcuaguuuuuuguauuuuuuguagagacaaggucucacuauguugccuaggcuggacucgaagucuggagcucaagagguccaccugccuuggcuucccaaagugccaggauuacaggcaugagccaccgcacccggcccauguaaaauuuuuuuuuuuuuuuucgagacaaggucuugcucugucacccaggcuggagugcaguggcacaaucauaggucacugcucccucaaccucccaggcucaagagauccucuugucucagccuccugaguaacugguaccacaggugugcaccaccaugcccagcuaguuuuuguauuguuuguagagacgggguuucacuguguugcccaggcuuacuaccuuauauuauggcacacagacucugccagcuuccugaagaagggggcaugagauguaccuuuugaggcuuucuuuucuauuuuuugagaccgggucucacucuguuccccaggcuagaguacaguugcgcaaucacaccucaugcccagcugauuauuuuauuuucuguagagacgggucuuccuuuguugcccaggcuacucuggaacuccugggcucaggcgauccuucugccuuggccucccaaagugcugggauuauaguugugagcccccacaccggccccuguuugaggcuuaugucugaaaaaguugugggguuuuuuuguuuuuuuggguuuuuuuugagacggaguuucgcucuuguugcccaggcuggagugcaauggugcaaucucugcucaccgcacccucugccuccuggguucaagggauucuccugccucagucucucgaguagcugggauuacaggcaugcgccaccaugcccggcuaauaguuuuucuauuuuuaguagagauacuaaauguuagucaggcugaccaucgcgcccggcugaaaaaguucuuuuucugcccuuacacuuaagugauuguuugucuagguauugaauuauuuguuggaaauaauauuucuucagacaucugaaaacauuuuuccacuacaucuuagcuucuaguguuacuccugauuuuuguaugugaccuuuuuuuucucuggaaguuugaauuauguuuucuucauaaccaguguucugaaucuucugauaaaguuuuuuuuuuuucacuucacagugugggcacacagugggcccuuucaagcuagaaauucauguccuucagcuguggggaauuuugaauuauuugauugaugaauucccuccaucuguuuucucuguucuuuccgguauuucuguaauuaaguuacuggauguccucuguuguccuucugguugacuuacuguggcuucuguguugcuuuuauauuuucucuacuuccugggaacuuucuugaacuuuaucuuccagauuuucuguugaauuucugcugucuuuuuuuuuuuuuuuuuuuuuuaagagacagggucuugccggccacaguggcucaugccuguaaucccagcacuuugggaggccaaggugggcagaucaucugaagucgggaguucgagaccagccugaucaacauggagaaaccccgucucuacuaaaaaaauuagcugggcgugguggugcaugccuguaaucccagcuacucuguaggcugaggcaggagaauugcuugaacccgggaaguggagguugcgguaagccgagauugcgucauuguacuccagccugggcaacaagagcgaaacuccgucucaaaaaaaaaaaaaagagagacggggucuuacuguguugcccaggcuggccucagacuccugguuucaagcaaucuuccugccucagcuucccaaguaacugaaacuacagagacauaccauguauuuuuaauuuauaacuuuuuuucagaagauucccuuuuucuucuuauuaugccuucugccuguuuuugugccuguuuuaugauugcauuaacuuuuuucugaugauaaaauauuaguaauagauguuuaaaauuuucuccuuucugcaguuuuuccucuaacuuucuucuguuuguuuuauucuauuuccuuuuuccuuuguugucugguaacccuuggcugucuagucauauuucagaguggaagacuaaaaaguauauuggaagcucugggugguagaggggcuuacggaauaugaacgucacuauaguuguucucaguaggcuauuuaguuggggaaaccauuucagugucauucccacuucucuugggguauaccuagggaagacuuccagucuccuggcugaagugugaaggccugauugcuuguguuaugggagccauguuagggaagagagcaggagauccuguuuucagugugacacccugacuuucacuguaccuaguauuuuucccuaguccaaauagccuguguuugaaccucuccagaaaauaaaccuagucucuugccagaaugagggaaaggcagucaccuaaagcuguggagggaacuggggucccacuacuucucaaacguacucgaaaagagucuuauuuucauaucccuguuucaccccuaaugaagcuauuuggugccaccaauucguuaggguuuggggaaggggagagguggauuuuggaguguaacucaggcuggugcuugacucuccccauugcuggccuaggauucaguuuucuuaggucuuauaaaucauuuuccacucuucuaucagcuuccaauguaucauggcuguuguuucucccugucuuucucauccuuuggaauucauacuuuuaaaaacaaaucuggccgggcacgguggcucaugucuauaaucccagcacuuugggaggccaaggccaguggaucacuugaggugaggaguucaagaccagcauggccagcauggugaaaccccaucucuacuaaacauaccaaaaaaaauuagcugggcaugguagugcaugccuguagucccagcuaccugggaggcugaggcaagagaaugguuuaaacccgggaggcggagguugcagugagcugagauugcaccauugcacuccagccugggugacaggacaagacuccgucucaaaaaaagaaaaaggaaauccuuuuauuaugguuuuagugggguuuggggaaggaguaaaaccagaugcauagguucaguugaccaucacacacggaaguguuuuuaguuacaguguuuuuuaagauuuuuaugucaauggucacugcuuaauaugauuaacuuuuuuuuuccauucucauuuuacaguuccugaugaauaucuguuaucguaaguacauauacuguuguauuugauuuuuuuuuaaccauuaauguuaaaauccuuucaacaucaacucuugauuuuuaaaaauacucuugaccgggcgcaguggcucacgccuauaaucccagcacuuugggaggccaaggugaguggaucaugaagucaggagaucaagaccauccuggccaacauggugaaaccccaucucuacugaaaauacaaaaaauuagcuggacgugguggugggcaccuguagucccagcuacucaggaggcuaaggcaggagaaucacuugaaccugggagguggagguugcagugagccaagaucaugccacugcacuucagccuggggacagagugagacucugucucaaaaauaaauaaauaaauaaauaaauaaauaaauaaaauaaaaaauaaaaauauucuuacuaccaggcacugugacucacacauguaaucucagcacuuugggaggcaaaggcaggaggauugcuugagcccaggaguucgagaccagcucuagcaaaauagggagaccccccaucucuacgaaaauaauuuuaaaaauagaauaaaaggccaggcaccguggcucacaccugcaaucccagcacuuugagagacugagguggguggaucacuugaggucaggaguucaagaccagccugaccaacauggugaaacccugucucuacuaaaaauacaaaaguagugggaugugguggcacacaccuguaaucucagcuacuugggaggcuaaggcaggagaauugcuugaacccgggagguugugguugcauaucucgcugcgauugugccauugcacuccagccuaaguaacgagcaaaauuccaucucaaaaaaaauaaaaaauaaaaaauacucuuagaaacuaggaauaauauuuucuugacaugauucuuaaaaauuugucucaauugaauagccaacaccauauccaguauugucauauuugccacucuuauuuaacauuguuuuaaaaauuguggcuguuggccgggcgcaauggcucacgccuguaaucgcagcauuuugggaggccgagacgggcgaaucaccugaggucaggaauacaagaccagccugaccaacauggagaaacccugucacuauuaaaaauacaaaauuagccaagcaugguggugcauuccuguaaucccagcuauucgggaggcugagucaggagaauugcuugaaccugggaggcagagguugcugugagccaagaucaugccauugcacuccagccugggcaauaaaagcgaaacucuaucucaaaaaaaaaaaaaaaaagcguagcuguucaacuaacacaugaaaaagaaauuacaaauguaccuaucugcaaggaaagacaauuaucauuauuugcaguugauacaacuacuuaaaugagaauaauauagaguggucaguuauuuuaaaaaugcagagaccaaaaaaguaaaagcuaccuagguauaaguaauacuuaauuacugauacacacuuacauuuaaaaauccuggccaggugcgguggcucacgccuguaaucccaacgcuuugggaggcugaggcggguggaucaccugaggucaggaguucgagaccagccugaccaacauggugaaaccccgucucuacuaaaaauacaaaaauuagccgggcaugguggcaggcaccuguaaucccagcuauucggggggcugaggcaggagaaucgcuugaacccaggagacagagguugcagugagcugagaucaugccauugcacuccagccugggugacagaggcaagacucugucucaaaaaaaaaacaaaacaaaacaaaacaaacaaaaaaaaacaaaaccugucccaggaggacuguuugagcccugaaguuccaggcugcagugagcuaugauugugccacuacacuccagccugggugaugugagaccuugucucuaaaaaaauaaaaguucugaagaauauauaccaagcucuaccaguguuuuuucuuuggggcaaggaaggagguagaauugagggaacggccuuaaccuuuacuguauuucuuaaauuuuuaauaagaauuaaauauuacuggaaaaaaauguacuacuuuaaaaacaaaagggcaaagaauaaaagauguaaauagccgaauccuuugggaggaaaaagacaaaucuuacuagugaccacaaaaauacaaauuaacauaacauaacuuuucaucuagaaaauuagugaccacagaaaagaaguugacacaaauauggggaaaggggucauuuauaacaggaauguaaauugcaggguaacaggcaauaggaacuuuaaaacauacauauucuuugacccagaaauuccacauaaaagaacauauacccaggaaguaauuauagauguuuguaaagauuuuacagugaggauauucucagugugaugaauauccaguauuguuuaugguagcaauaaaacauagaaacaaucuaacaauucauggaguuugaggagaauaaaaaugauucaucuuuacaguagaauuauuuguaaccauuaaaagugauauggaaaaauuuuuaaugcauucaagagauguucacaguagguauuaaaguggacagagcagguuaaaaaaauucuuuuuuuuuucagacagugucucacucugucacugaggcuggaguacaguggcgcgaucucaacucacugcagccucugccucccagguuccagugauucuccugccucagccuccugaguagcugggacuacagguggcacacaccgaggcagguggaugaugaggucaggaguuccgccugccuuggccucccaaggugcugggauuacaggcaugagccaccacaccuggccuuaaaaaaauucuuaaagguaacuguugagauugauugguaagguucccgacaaauuuuauuucauuguuuuuuguauuuuguuauuuuauagacuaaaucuucauauguuuaauauaaaaauucaaagcacucuuuucuauuucccccaauaauuuguuguauauguggcugguuuguuggaaaaugaaguaagaaguugaacauuuuaauuuugaagccuuacuagguuugucuuacucuguguuaagucauauaaguucuuuaaaacauuaacuuuucaguuugaguuuaacccugccauuuuauuuucuaguuuauaaaaauaacccacacuuaggccgggugugguagcucaugccuguaaucccagcaccuugggaggugggaugcgccuguaaucccagcuacucgggaggcuaaagcaggagaaucacuugaaucugggagguggagguugcagugagcagaggucgugccacugcacuccaaccugggcaacacagugagacuccaacucaguaauaauaauaauaauaauaauaacccacacuuauaaaaaacuuuuauuggaaaauaaaaccuauaaaaagcaucaauaaucauaccacccaguaauaaucacucuuaaauuuugguuuauugcuuuuuuuuuuuuuuuuuugagacagaguuucgcucugucacccaggcuagagugcaguggcgcgaucccggcucacugcaagcuccgccucccggguucacaccauucuccugccucggucucccaaguagcugggacuacaggugccugcuaccgugcccagcuaauuuuuuguauuuuuaguagagacgggguuucaccguguuagccaggauggucucgaucugcugaccucgugagccaccuuccucggccucccaaagugcugggauuacaggugugagccaccgcgccuggccgguuuauugccuuuucaaaaaauuaaauuuuggccaggcaugguggaucacgccuguaauaugaggaucgcuuggggcugggaguuugagaccagcuuaggcagcacagggagacccugucuccacaaaaucaaaaaauuaacuggauguggugguauauaccuguagucccggcugcuagggaggcugagguggugggaggaucacuugagcccaggggguucaggcugcagugagccaugauugcaccacuggaauccagccugccugggugacagagagagacuuugucucaaaaaacaaaaaacaaacaaacaaaaaggccagacacgcuggcucacaccuguaaccccagcacuuugagaggccaaggcggggggaucaccucaggucaggaguucaagaccacccugaccaacauggcaaaagcccaucucuacuaaaaaauacaaaaauuaccugggcaugguggccugcaccuauaaucccagcuacucaggaggcugggccggagaaucucuugaaccccggaggcagaaguugcagugagccgagauugugccacugcucuccagccuggacaccagagugagacuccaucucaaaaaaaaaaaaaauuaaacuuuuaauuuugacauaauuguagguuuccuuuaaaaaaguuaacaugcuugagaguuccuaaaauauaauuuugucuucaaccuuucucaccuaauauuauaagaauuuucucacauaucaaaguuuuuuccuguauaucauuuaacaguuggauagccuuauuacuaauccaaaaaguacacauuuauuaucuucagaugggcaacauaaaaaagccugauaauacugguguuaguggggacauggagaaaguagaaguugguuuuucuguuuguuuguuucauuuauuuuuuuuuugagacggagucucccuguuaccugggccagaguguaguggcgcgaucuuggcucaccgcaaccuccaccucccggauucaagcgauucuccugccucagccuccugaguagcugggacuacaggcgugugccaccacgcccggcuaauuuuuuguauuuuuaguagagacgggguuucaccauguuagccaggauggucucgaucuccugaccucuggugaucugccugccucggccucccaaagugcuaggauuacagguaugagccaccgcgcccggccugagaaaauagaagucuuauacagugcuggugggagugcuguuuucacuuuuuuguguguuuuaguuuuuuuuuuucuuuuuucuuuagagauggggugucacuacauugcucaggcuggucuugaacuccuggacucaagugauccucuugccucagccuuccaaaaugcugggauuacaggcaugagccaccacuccuguuuccacuuuggagagcuauuggcaauaucuauuaaaguugaaaaugaacauaugcuuuaguuacauaaacuaaagggggauuuucagagauguaugccaagggacauguauggggauaauugaauauuauuuauaauaguauaaaauggaaacaauguccauacauagaguacuuaaauaaaauucaguguauacauauaauggaauauuauucaaagguaaaguaaaaauaaauguccgucaacaugccucauuuucaaaaaugcauugaguaaaaaaaugcaaguugccaaaagaagucuacgauauuuuauauuuucuuuuauuuuucaugagcuauuucaggaacagcaaaaagaagccuacaauauaccuuuuauguuuuaaaacaauacuauauauguauaugcauacaucuaugcacguguguuuguuauguaugugugcauacauauguucuauauauaauauuuaauaugaacacauuaacaggaaggaaaccaacaaaugcaugugcuugccucagggauaaggggaagguaggaagaaggaugcacuacagagaaguauaaagagggcuucuuuaucacuaacaguuuacucccuuuauuaaaaauauaauacaggccaggcgcaguggcucacaccuguaaucccagcacuuugggaggccgaggcagguggaucaccugaggucuggaguuugagagcagccugaccaacauggagaaacccuguuucuacuaaaaauacaaaauuagccgggugugguggcacaugccugcaaucccagcuacuugggaggcugaggcaggagaaucgcuugaacucgggaggcagagguuacggugagccaagauugcgccauugcacuccagccugggcagcaaaagaaaaacuccaucucaaaaaauaauaauaauaauaaauaaauauauauacacacacacauauauacauaauacaagaagaucugaaauaaguacacaagauauuaacauuaauucuggggagugaauggguccauggguuuugcuguauuauuuuccuuuuuucaaaauuaaaaugaauuuuuaaaaaauacuaagucuagugauccuuugggcaaguuacugaggugacuuugagaaucaggccuucuaaucugaaguguuuuuauuucacaggcugaaguuucucuuuggcucaucagccacccaggccuuggaccuaguugaucgacaguccaucaccuuaaucucaucacccaguggaaggcguguuuaccagguagaagucuagagaugggggugaucccuacagaaaccccuuaggacaaaauguucuucaucucuguagaagcuguugacuagcuuuaaauauuuccuggacuguuaaaaggcuuuugccccaacuugguaaaauuaacgaauugauaauuuuuuaaaauuuuuauuuacuuuuaacugacagaaacugucuauauucaugguauauaacaugauguuuugauauauggauaccuuguagaauaacuaaaucaagcuaauuaacauaucuaauaccuuauauacuucuuuuuuuguggugagaucacuuaaaauccauuaucuuagcaaucuucaaauauacaguacuucagucuuuuucuugguuuuuauagagacagggucucacuauguugcccaggcuggucucaaacuccuagguucaagcgauccucccaccuuggccucucacaauauugggauuacagguaugagcaccauccccgccaauacuuuguuauuaaauauauucaccauguuguaccauagauacccugaacuuauuucuccuaacugaaauuuuguacccuuugaccaauaucuccuuaucuuccucuuccucccccaccccaaggccccugguaaccacuauuucuuuuucuaugaguucaacuuuuuuuuuuguuuuaaauaaagacagggucuugcuauguugcccaagcuggucuugaacuccuggccucaagcaguccucccccuucagccucccaaagugcuaggauuacaggcaugagccauugcacccagccuaugaguucaacuuuuuuuagauuccacauauaagugagaucaugugguauuugucauucuguaccuggcuuauuucacuuagcauaguuucacuuaacaaaauccuccagaaauuuuuguaacuaaaauaagauggccaggcgugguggcucacgccuguaaucccagcacuuugggaggccgaggcagguggaucaccugaggucaggaguucaagaccagccuggccaacguggugaaaccccgugucuacuaaaaauacaaaaauuagcugggugugguggcaggugccuguaauuccagcuacucgggagguugaggcagaagaauugcuugaacccaggagaaggagguugcagugagcggagaucgcaccauugcacuccagccugagugacgagcagaacucugucucaaaacaaacaaacaaacaaaaacacaaaaaaaaacuuggaugguauuguccuacucaaaagagacugccaauuauuagaugaauuuucucauggagaacuuaggaauaaucaaagucacugaacuugcaguuuguaccugaggaggugugucuguccucuuuccugguguuuuuauuuuugguuuuuagguagcuaaaauacccgaaacuagagggaccuucaaguuuuucccauugcuuuuaguuugggauauuuggucuugauuccauuaugggcacaauacuugaccuggcaaguagacuuuuguuugaaauaguuuaauuacuguugacuuuuuguuccucccauuggucaacaguaacuuaagucacugguuuaguuuuugucguucacaucugguauauauuacauugcuuuauuaauuauaaaauacuaacuuccaagaauuguggcugucaucuuggacuuugaauuaaaugaggcuguagaaaucuuauacacccucaaauuaaccuuaaugguugcauuguaugguaauauaguaagaauuuggcugaauucaggaguuguaugagaugauaaaaguugagucacauacugccuuagugcccagcuaguuaucuuuucauaggucauucuucaucccauaggucaacucuaauauuauuguucuccagauguaaugugaaauaauucuaaagucauuguuauguugcugacaccugaguuguuuucuauaauuuuuuuuuuuuuuuuuuaaggcagagucucgcucuguugcccaggcuggagugcauuggcaugaucuuagcucacugcaaccucugccuccuggguucaagugauucuucugccucagccuccugaguagcugggauuacagguguguaccaccacgccuggcuaguuuuuguauuuuuaguagagaugggguuucaccauguuguccaggcuggucucaaacuccugaccucaggugauccaccaccuuugcuuuccaaagugcugggauuacaggcgugagccugcacuccuggccacuuuuuauacuuuuuugauucacuuaauaaggaggauguuucagucaggagaggcuaaguuaugcugugguaucaaugaccccaaaucugaaaggcuuacaaaaacaaaguuuuagaucucauucaugcuguguauccaccaggagccagcuguagcucuguuccaaaacagcuucaugcagggaucccagugggcaaagcagcccauaucuggaacacugugaaucucaaagagaaaaaggaaaacaugguacacaauuuuuaacauuuuucgcuuggcuacucagauuuuacuaaagcaggucacauggccagccuguauuuaacaggccaggaauguauaauccuguuuucagagagaagcaccaaacacaaggaacaauaacaaagacacuguggaguguccuaagaggcuuggagcggucauaaaauaaaacuguacccaugaauggaugaccauguagaugggucaccucuccuugcgaccuaacugaaaccacaguagaaccacaguagaaaccaccuccaagugagguuccuacaaguucugucagccauggucugaguauccucuuuccagcauguuccuuuuuuaaaaagcucucuccuucuggggauaaacauuccagacuauaagcgggaaaacuaggagcaauuccuguaagaggaaguuguuuuuucacugaagggugaaggaauugaauuauguuauccuuaaggucaauuuccaguucuaaauguuucuaacucagauuuugccugauuguuggguucauuaguuguccacugcuagauaagcgaaaagcaaauucgaaauuuaaccucuuuugguguuuauugcuuuaggcaguugaacauuuugagucuuagcccuugaaaggcucaggcaaggaaacucuguagaauuucuccccaucucaagucaccagcuguuuauucagcaugauccagggaggauuaugauggacggggacucgcaauaagaaggaagcagugaauuauucuagucaguacagaaucccagaggcuucugcuugcuuaaguuuaaaucuagagagaagagacgagauaacuaaagggagaagaaaccuaaaguuguauucauugguaauaguuuagacacccaagaauuauaggccgggaguggugguucaugcuuggaauccuagcaguuugggaggcugaggcggguggaucaccucaggucaggaguucaagaccagccuggccaacauggcaaaaccccaucucuacuaaaaauacaaaaguuagccaggcaugguggcacaugccuguaaucccagcuaaucaggcggcugaggcaggagaauggcuugaacccaggagguggagguugcagugagccaagauugcaucauugcacuccagccugggcaacaaaaugaaacucugucucaaaaaaaagaauuauacaugucacugcuggauguuguggguuuuuucuuuaggauuaaguagaaaacaaucugcuuuaaugcucuuccuucaguguaagcuuccacacaugcuggggaaaucucuccauugauacugaauggucucggugauauguucauaacacaucagagccuugcaguagguaauaugcaaggugugcuuuuucaacaccuaauuuguaacuggguggaaaucuuuuuuuuuuuuuuuuuuuuuuuugagacagagucuugcccugucacccaggcuggaguacagugaugcagucuuggcccacugccaccucugucucccggguucaagugauucuccugccucagccuccugaguagcugggauuacaggcacccgccaccacaccuggcuaauuuuuguauuuuuaguagagaugggguuucaccauauugaccaggcuggucuugaacuccugaccucaugauccacccgccucagccucccaaagugcugggauuacagacgugagccacuaugcccggccugaacugaaaucuugaauguguucaguaggcaucuucuuacccaaucauuggcuauuucugguaaccuaaaaucucccgaggaauucugacugcgucaaaaaaccauacugaggcugggugugguagcucaugccuguaaucccagugcuuugggaggccaaggugggaggaucacuuaagcccagcaguuaaagaccagccuggacaacauagcaagaccccaucucuacaaaaaaaauuuuaaaauuagcauagggugguggcgcacaccaguacuccuaccuccucaggagacugaagugggaggaucacuuuagccgagggauucaagacugcaaugagcuaugaucugccacuguacuccagccuggaugacagaacaacauccugucuccaaaaaacaaaaauuaaaaaaaaauguuaauaaaagcuguacugggauaacugcauuauaugaaccacugaaaaugugacaaaagcacagcaguggaaccugcuguuuguucuugcagucaaaccauaccuguagcuuuauucucuguggguaagaaagauuaaagaauccuaggagugcuaacauuguaauucaaaaaaaauuuaaaaguccuugcuuuuucauuuagauugccaucugagagccuaaaagugcuuugaaggcuguguggcaaauuccuaaguggcaguucauuauaaaaucacccucaggacauuucugcuucccucagauacuaauaauaaucuuacgccuccaggugggaaguuaacucuaggaaugaagaccucaacaaaaaguuuuuggcugcuuggugguagagagacuuaaacaaaggauuucuccagcaaauuugugcgaucauacuacagaugugucuuguuucuccuguaccucuccuuuuugucccucuugaccaccaccaagacuguuagacugugccucuuaucaacccacuauguaucaguguccuccuuccauccugcuagaugaguaggcagaucugggccugccucuuuuccugagaccuccauccugaacagcugagucauuccuuucgcaagggucuuugcuuuauuuauucucucugcucucaaaugcuuuucaaaagccucuucccaguuucuucuuuuguucuucugugaccuaucuuuauuuuagagaugggaucuuugucacccaggcugcagugcaguggugcagucacagcucacugcagccuugaccucccaggcucaagcaguccucccuucucagccuccugaguagcugggacuacuggcaugugccaccauaccugacuuuaaaaaaauuuuuuuuucuauagaaacgaggucucaccauguugcccaugcuggucuugaacucuggggggggucaagugauccucccaccucgaccucccaaagugcugggauuacaggcuuugagccaccacacccggccugagacuuaucuuacuccugcccugcuacugacccuuugccuguuuuuacucucucuuuagguauguaggaagcuuuagaaauuuauacaccugcugugaaauaccaaagguuaagaacccccacaauaaaauguagaugagagauuccccccccccacuuccuucuuauuacagucagcccauagagugggccccaugaaucacuaggcguaggaacagaaugguuuaugugguugguugaacuaaucugaaacucuucaguuccuuuauaugcuguccuaaaggugagcacugagaggugaggaagggagagucuguacacuggaggaagagaaguuguuuccucuuuuauguaaaacauuacugcaguucuucucggugcaauuugcagagcaacucugagucuacauaaauaaaaagggaaagaggugguuuuuccagcacaucugaggucugaucccaucuauccuuucuuuguagguccuuggaaguuccaguaaaacauacacauguuuggcuucuugucauuacuguucauguccugcauuugcauucucagugcuacggaagagugacagcauccuggugaggauggggaagacucuucccacuguaguugaauguagagagaaauugcccuuacuuugugguuuaacuauucuacaaaaugggaaucuuauuauauguugaaacaaaugguaguuuuuugucuuugucuucaguuagucaccucuuagggguuuagccucucaaaaugcaaugucauuuuuagaacugcaucaauuuccugaauuuuuauguaaaagaucaugagugaagcuuugagaaggaaaaaaagggaaucccagaagugggcacuggggaauuagauggccccauaaaaauaugaacuaaauucgauguugacaacuuugcauauccuacuuucagccaugugguauaucuuugcacuaccugugagacagccugacaccacacuugaccuucacauggggcaugaguaccuucaccuauuccuuuaagccuuugccaauuucaucagaguccagaccaugaagcagaaacaggacauacucacacacaccuuauuccaaaggaaaaaacacuaccuuccugaaagcaggcagcuguuuucuaagucuugcgaaagaagaaaauaaugauguccacuccauucuuucccuuucuuuuacacuguuaacuucuuaaacaucuugggaccuggcuggcaaguuggguauagcauuguccaagaggccacauucguaacugaugugcccuaaguguaucucaacugcaagagacaggauugaaccaaaaccccuucaagaucuaaagcuguguucucugacaucagauucaacgcaaucaucuccccagagguguguacaggccaauauaugcaagaguuuugccacuacuccccgccccccaaccccagaaguauaacacaguaguuaagagaguagccuagaccagccgccucguccgggaggugaggggcgccucugcccggccgccccuacugggaagugaggagccccucugcccggccagccgccccguccgggagggaggugggggggucagccccccgcccggccagccgccucguccgggagaugaggggcaccucugcccggcugccccuacugggaagugaggagccccucugcccggccagccgccccguccgggagggaggugggggguucagccccccguccgggagggaggugggggggucagccccccgcccggccagccgccccguccgggagggaggugggggggucagccccccguccgggagggaggugggggggucagccccccgcccggccagccgccccauccgggaggugaggggcgccucugcccagccgccccuacugggaagugaggagccccucugcccggccagccgccccauucgggagggagguggggggggucaguccuccgcccagccagccgccccguccgggagggaggugggggggucagccccccgccuggccagccgccucguccgggaggugaggggcgccucugcccggccaccccuacugggaagugaggagccccucugcccggccaccaccccgucugggagguguacccaacagcucauugagagcgggccaugaugacaauggcgguuuuguggaauagaaagcagggaaagguagggaaaagauugagaaauuggaugguugcugugucuguguggaaagaaguagacaugggagacuuuccauuuuguucuguacuaagaaaaauucuucugccuugggauccuguugaucugugaccuuacccccaacccugugcucucugaaacaugugcuguguccacucaggguuaaauggauuaagggcggugcaagaugugcuuugauaaacagaugcuugaaggcagcaugcucguuaagagucaucaccacucccuaaucucaaguacccagggacacaaacacugcggaaggccgcaggguccucugccuaggaaaaccagagaccuuuguucacuuguuuaucugcugaccuucccuccacuauuguccuaugacccugccaaaucccccucugugagaaacacccaagaaugaucaauaaaaauaaauaaauaaauaaauaaaacaaaaauuaaaauuaaaauuaaaaaaaaaaaaaagagagaguagccuagagacucugaugagcaugugguuacaauaccugucuuccuagggagcugucagauuucagugagauaaucuaugagaagcacuucacagccuagugccucaaggaauguuaaccauugcugugacagcuuucugaaggcaaggaagaaauauaacuuaggacuaacgugaggagugcagguagucuggguuuucaccauggguuacauaccuugugccugauggaucuaagccauuucccaaagcagcaggcaaaguaagucuguguccacucugauuucuaaagagaauacuccugucucaucaucuuuaucugcaguuuuuauuuauuuauuuuuugagacagucuggcucugucacccaggcuguagugcaguggcgugaucucggcucacugcaaccuccaccuccuggguucaagcgauucucauggcucagccuccugaguagcuggaauuacaggcauguaccgccacacccagcuaauuuuuguauuuuuaguggagacaggguuuugccauaucagccagacuggucucgaacuccugaucucaagugauccauccgccucagccucccaaagugcugggaugacaggugugagccaccaugcccggcccaucugcacuuuuuagacaaucaguuagagaccccguaaucuguaugcucuagucuucuccugccaaauaagaugguaaugagaaaucuugguuagacuggccagcccuggcccugccuguuucuaauagguguguguguuuuauauuccagugcaagcaucucuuggcaguuuaccugagucagguuaugaggaccugucagcagcuaagugucucugacaagcaguugacugacauauuauugauggagaagaaacaagaagcauaaaagguacagauugagcaucauucuuucaaaauagaauccugucaagaaaugcauugaaagcgucaugauucacauggaaaagaggugaaauggaucuucagacacuucauguuacugucccuuuucccuccaggacugcaggaggugcuguggguuggagccgugggcuguggaggguuuguguaugaugagaagcccuguacagucuugucaagaaauacccugagccagucucugagacgcuucgguaaaaaaugucccuggauggaaucaagauuuuaaauucaaauaaagccuaauaucauguuguguccacauuauuuagucuuuuuuuuuuucuuuugagauggagucucacuuugucgcccaggcuggggugcaguggcgugaucucagcucacugcaagcuccgccucccggguucacgccauucuccugccucagccucccgaguagcugggacuacagguacccgccaccaugcccggcuaaauuuuuguauuuuuuuuuuaguagagaugggguuucaccguguuagccaggauggucuccaucuccugaccuaguggucugcccgccucgaccucccaaagugcuggaauuacaugcaugagccacugcgccugacccuau

SEQ ID NO: 16606 - RNA, 3941 nt, Homo sapiens
accaaucucaaaauuaaaucccuaaacauuuucaccaguuuuaagcguacccacacaucacuagagaauuucaugacaaaacaccaaguaugcuaccaugcaacgaaaccuuuauuaacauuuugaacagguucagcuauuacugaaacuuguaauuucuaaacuuaaguuggggcaaauggcuauagugcagaguaaugccaucacugggcacugcgaaugccaugacugaagaauuaacagccaccccucaggcgcaggaccaggugcagggucgacucuuucuggauguuguagucagaaagagugcggccaucuuccagcugcuugccugcaaagaugagccucugcuggucgggggggaugccuucuuuaucuuggaucuuggccuucacauuuucgauggugucacugggcuccaccuccagagugauggucuugccggucagggucuucacgaagaucugcauaccaccucucagacgcaggaccaggugcagggucgacuccuucuggauguuguagucagaaagagugcggccaucuuccagcugcuugccugcaaagaugagccucugcuggucgggagggaugccuucuuuauccuggaucuuggccuucacauuuucgauggugucacugggcuccacuuccagggugauggucuugccggucagggucuucacgaagaucugcauaccaccucucagacgcaggaccaggugcagggucgacuccuucuggauguuguagucagaaagaguacggccaucuuccagcugcuugccugcaaagaugagccucugcuggucggggggaaugccuuccuuauccuggaucuuggccuucacauuuucgauggugucacugggcuccaccucaagggugauggucuugccgguaaggguuuucacgaagaucugcauuuugaccuaguuuaaaaguaaaacauaagcgugucaccucaggaucauuguauuucuugcuuuuacaccuaauauucuucaaaauuagcaacuauuccuucaaaaugccuuaaauacguuaauauuccgcaagccuccccucaauuuuacaaggcuaagucacuuaauacgaaauucgucauucaagguuucaacgucaacagcggaaaauccagagcgcucucuuaccaagcguccacagcuuuccccacuaacuguuccggauauucaaacucccccgaccgaacuccaaucugccucaaaccuaagcacgguguuaggcaaacugaaaacaaaaccaaacccacaagacucgcgaaauaaaaaucccauugaaacacaagaaggggcaccuuucucacacugggauuccaaaguaaaggcuuccagaaaccacacaaacuaccucuuuuccgccuuccccgcgaaguaaacucgacagaaucgccgaucgguuaggcguccguuaguuuccgucaacgcgcgcgcgcgccaaccgcccucgccccccucaggucaacaaggcccacugucccggaaaggcccagcgccgcgucaccucgcccuccccucccccacgcccuccccucagcggcccacccaaccccaagaagccuccaccuugaccucacccauuccccccucucacacccccccaaggucguuacggcugcgggccaguaccuguuagcggauaccaggauccugccaaucaccaaccacguccacccacagggacacaaacaagcucacccaacaaagccaaccgccccuaaaugcuccgggcuggcggagcgcaaauuuaugcaacgaguguugcgucacuuaucaccccucacguagacgccgucuccgugcgccgcugaaaguaguucgccgcgcccaaccucccgagaggcaguuuaggcuuuucaacugagccccaaauuccucauagccguaagaaaggcuccuaaaaaauuauuucccuucuccucuaugcgcuucucuuccuucuuuaggaaaauauaagaaaauuaucaggcggaugaauuugaguugaagaaaccuuccucgaaagcucuggaaacuuccuugcagcgccggcacugauugguuaggccugcgaaggcgaggucggcgcugauuggugggggacgcgguggcucuguuguugcugggcuccaccugggguggcuuagcgccgagguugcuaaguaacugagcgcgcgugcgccgcacaggcgcgccguccugaaagaggguauuuccggcgggagaaggagggggggucuuuccuuuuuuuucuugagacggaguuucgcucuuguuucccaggcuggagugcaauggcgcgaucucggcucaucgcaaccuccgccucccggguucaagcgauucuccugccucagccucccaaguagcugggauuacaggcaugcgccaccacguccggcuaauuuuuuguauuuuuaguagagacggggguuucaccauguuugucaggcuggucucgaacuccugaccucagguaauccacccgccucggccugccaaagugggccgccgcgccucagaagcgggacggcguggcacccgauaucgagacaccugauggugauugugaagcacaauucccucucccauguuuuaaaaacgcgcgccccuggccgggcgcggaggcucacgccuguaaucccagcacuuugggaggccgaggcggguggaucaugaggucagggguucaagaccagccuggccaagguggugaaaccccgucucuacuaaaaauacaaaaaaauuagccgggcgugguggcgggcgccuguaaucccagcuacuugggaggcugaggcagauaauugcuugaaccuaggaggcagagauugcagugggccgagaaugugccacugcauuccagucuggcgacagagugagacucugucucaacaaacagacaaacaaaaaacacgagccccucauacacuggccaguuguuuuugcuuuuuugugacaaagucuggcuguguccccaggcuggugugcaguggugugaucaccguucacugcagccuugaccuccagggcucaaguuauccugccaccucagccucccaaguggcugggaccguggaccacgccuggcuuuuuaauuuuguauuuauuuuuugagacggagucucacucugucacccaggcugaaggccaguggcgugauguggcucacugcaaccuccaccucccugguucaagcgauucuccugccucagcuuccugaguagcugggauuacaggugcgugucaccaugccuggcuaauuuuuguauuuuuuaguacagaugggguuucaccacguuggucaggcuggucucgaacuccugaccucaggugaucugccugccucggccucccaaagugcugggauuacagaugugagccacuguuccuggucuaauuuuuuuuuguuguuagaucagagucuugcuauguuacccaggcuguuacugaacucuugggcucaggagauccgccugccucgggcucccaaagugcuaggauuacaggcaugaaccaccgugccuggcggacuagccgcuuuuuauuuuucuucgugguuauugcaggguuguggagcuuuaaaucaugcuucuguagucagagugcucuuaguugcauugucuuaauccucaucacggcccgagaacagucuguaaaucgggaguucagagugggacccucugcggggaccggaaaccuguugcugaagccgcucaccaccaggcccagagaggcgaggcuggagcccauggugacaguggccgggcuucgcucuggcuccagcaauaccugcaaauccaguucuucccagcuguuucuccaaacugguaggaaaaaaaaaagugcagauuagggagccgaaaccccacuucaaaaacgggaauucaccuacaagaaaguagcugauccugcucccauugacgugcuuguugugcaagg

SEQ ID NO: 16607 - RNA, 1638 nt, Homo sapiens
acgaaaccuuuauuaacauuuugaacagguucagcuauuacugaaacuuguaauuucuaaacuuaaguuggggcaaauggcuauagugcagaguaaugccaucacugggcacugcgaaugccaugacugaagaauuaacagccaccccucaggcgcaggaccaggugcagggucgacucuuucuggauguuguagucagaaagagugcggccaucuuccagcugcuugccugcaaagaugagccucugcuggucgggggggaugccuucuuuaucuuggaucuuggccuucacauuuucgauggugucacugggcuccaccuccagagugauggucuugccggucagggucuucacgaagaucugcauaccaccucucagacgcaggaccaggugcagggucgacuccuucuggauguuguagucagaaagagugcggccaucuuccagcugcuugccugcaaagaugagccucugcuggucgggagggaugccuucuuuauccuggaucuuggccuucacauuuucgauggugucacugggcuccacuuccagggugauggucuugccggucagggucuucacgaagaucugcauaccaccucucagacgcaggaccaggugcagggucgacuccuucuggauguuguagucagaaagaguacggccaucuuccagcugcuugccugcaaagaugagccucugcuggucggggggaaugccuuccuuauccuggaucuuggccuucacauuuucgauggugucacugggcuccaccucaagggugauggucuugccgguaaggguuuucacgaagaucugcauuuugaccuaguuuaaaaguaaaacauaagcgugucaccucaggaucauuguauuucuugcuuuuacaccuaauauucuucaaaauuagcaacuauuccuucaaaaugccuuaaauacguuaauauuccgcaagccuccccucaauuuuacaaggcuaagucacuuaauacgaaauucgucauucaagguuucaacgucaacagcggaaaauccagagcgcucucuuaccaagcguccacagcuuuccccacuaacuguuccggauauucaaacucccccgaccgaacuccaaucugccucaaaccuaagcacgguguuaggcaaacugaaaacaaaaccaaacccacaagacucgcgaaauaaaaaucccauugaaacacaagaaggggcaccuuucucacacugggauuccaaaguaaaggcuuccagaaaccacacaaacuaccucuuuuccgccuuccccgcgaaguaaacucgacagaaucgccgaucgguuaggcguccguuaguuuccgucaacgcgcgcgcgcgccaaccgcccucgccccccucaggucaacaaggcccacugucccggaaaggcccagcgccgcgucaccucgcccuccccucccccacgcccuccccucagcggcccacccaaccccaagaagccuccaccuugaccucacccauuccccccucucacacccccccaaggucguuacggcugcgggccaguaccuguuagcggauaccaggauccugccaaucaccaaccacguccacccacagggacacaaacaagcucacccaacaaagccaaccgccccua

SEQ ID NO: 16608 - RNA, 2876 nt, Homo sapiens
accaacauaaccaauuuaugaaagucaauucauuaaaagguauagaaccucuuguugggcaugauggcaagggacaaagcuacaacuuggccugugccuuuggaagcugaggcaggaggaccaucugagcccaggagccugagaccagccugggcaacauagagaauccgucucaacaaaaaaaaaauuuuagccaggugugcugugagcuguagucccagcuacaaggugggaggauugcuuaggccugggugauugaggaugcaaugagcugugauugugccaccacacuccagccugggcaauacagcaagacugucucaaaaaaaaaaaaaaaaacccaaaaaaacucaagaauguaaugaaugauacccaaugugccuuuucuagaaaaaguugccaaauauaucucuuggaucugcugagcauguccucugauacauaaggcaagcauguuucuacacccaguguugaugccaguuaguuuucagaauccaaacugauggcagcuacugguccuugggacugacauccucugggaauauaaccugcaaagaaacuacauuucaaucucacuuucugcaccaacugacagucaaucacaggguaagagauaucuucagaaaaccauagguucaccacuacacaaucugccgguaauuccagcuauuuugggugauuucaucauuugauaucuuuuuuuuuugaagcgaguuuuaacaagaucagcuguuuauucauuccacuaugggguugaagggaucauuggccagcucaaggcuuaccuucucuugggcugagaugcugcugccagcucuaaaacagcacucuguucucaaaaccugggggaauggagaaggcgcauacaccuuagagacugcagaugcagagcaggacaggcauuucugaugacagucaauuaaugacuuuacaaauuuaaguccauccuaacaaaagccccuuaagaccuaauuagagguaauuuuucuaaguuuuuguaaauuauugaggacuacaaaucuuaauuagcuucucaguagguuguaauuuuuuuuuuuuuuuugagauggagucucgcuguugcccaggcuggagugcaguggcacgauuucgacucacuacaaccuccgccucccggguucaagcgauucuccuggcucagcccccaaaguagcugggauuacaaguacacgccaccacacccggcuaauuuuuguauuuuugguagagaugggguuucaccaugucggccagccaggcuggucuugaacuccugaccucaggugauccacccaccuuagccucccaaagugcugggauuacaggccacugugcccagccucaggggaguuguaaucuccauuucagucauaucaauuuaaacuucacaaagcuaagauuacuuuuccuuuucacaucugaggaaaacuacaucucagcagacagguaauuugcccgagacuaaacagccaagagguaaauagaguagccccucuuucuagguaauccacccuggcuccacugccaccggaaacuaaaaucaguaucucugggauaggcuacacuguuacaagguauuagguuaaccaaauccaauugccaauauucgaccugacagcuaggcguggucagccacuagccuccccauagagcaaggcuuaccucauggcaggcuccuggcuccaauacucagcugccaaacaugaugcugauucuucacgaauuugcaaccuaggugaauauagcaauuaggucaccguucaaacaaguuuacuccugggaaccagcaaguggugaagacuugacugcaaucagacaggaguagucuucgucaguuaucgcuucugacggcacuuccuauuagugauuucaucagagcagucaagcaccucacaacccuccaguacuguuccaaccgcagaucuagacccuaccugaaacuuaagcuaacccugcuacuggagacauuucuuaacgaaggaguuuguuucugcauuaucaguuugcuuuaaaugcaguucuagguuaggacuguggcugaagcagccaucuccaguuucuauuuaaguuccacccuaugcaaugacaugauaacguuacccuaaaguguauaaaacaccuaaacguagaaaacugucaaaacgccaauuuccgugcauucaagugacaaaacuacguuccauguuaaacccuacaccagagagccucucaccucguggcuaccccgucuucagcacucugcaguggguacgcaaucuuaaagagggaguaaggacaggaauucagggcagggcucuggcaguuacggucaacuaaguuguagagguuucagcgacugcggucagauagacauuagacgucgucaguuaucgcuucugacggcacuuccuauuacaaguaucaucaggacagucgaauaagucuuccaguaauacuguuacaaucuuaccgacguacaccgcccucgggguaccccaaacugcaagccgaccccaacuuacccaguucucucggguuugcacacccccacugugggccggggaaccgggucccggccuucgcagacuccaggcucuggcagauguggcccuaccacaaaagagugauccaugagccucagccacggcagccggauucggccccgcgcugcccugccaggcuguccaauaccgggccgcagcgcccgccgcgaaagccacgcgggcgcaggagccggggagccacgccaucucaacagcugcccuccgcccucuagacaggcuucccgggaacaucuccccagagaccacagaagcucgagcucuuuauuugcucuugccccccagcuacuacucccagauuccuagagagccuaccuccauaacaacgggaaugaa

SEQ ID NO: 16609 - RNA, 2181 nt, Homo sapiens
cagggcccccuccaggguccuccuggccuacugucccuucccggaccuccuccccacugccugggcccucacccagcuccaggaugguggguagguggcccugcuuuggggagcgcuugcgcaggcugagcaggaagggcuggggcaaggagaagauguccacguuguugcccaggucaauccacgugacauuggggaacuugcugggauccuuaaggaugucagugaggucgcgcagcacggcccgggucaaccgguugccauugagugccaguguggugaggcggggcagggugcugagugcuggcagcagcugcaggaccaugucguccgugaggccugugaagcccagcuccacgcugucuaccugcuccccacagcgcuguagguagcuggucacccgcuccaggucucgggaggucagugggauucccgacagguccacuguguugucuggggggcuuccggccaggacagccuugaggcugaagggaaaaaggacaaacaaggcucaggcacauagggcaggccuuucccccagaagcugcagugccagccucugcucggcucuccgacgcuagggacugcuuuuacgaaacacuuggaugucggaugccacaagugcagaggugggagcaaccagggaccucaguccccugacacugccgcacgucucagcugucagggcccagcuggccguagccugagguauguggcugccccuauuuaccagaaaaauugaguuaagaguaccauugggcugauauauggaagaaguucauaagugcaaaauggugccuuguauaguaggcgagugaggaauaaacauuugcugcuguauucaucaccuggacucagcuucccacuucuaccacccugggguggcagcucagcccccaugaauggcacaaaggaucucugaguccccucuuucaagaccaucuuccccaccagagaaggauucccuauggggagccuguaagacagcaggcagggcagggcucaggggcucugagccugguggcagcugcugacuccuggaggcugagugccuugcuccuugcuucugcuuguucuugggacagagcccaggcaguucaagcugauggcaagugugcccuucccugcacaccccccaccccacccccgccaucuguuugcuggcuccaaggcccaggugcaguggugagauguucauuuuccacauuuuuuuuuuuuuuuggagacagucucgcucugucacccaggcuggaguacaauggcacgaucuugguucacugcacccucugccucccgggcucaagugauucuccugccucagcuuccugaguagcugggauuacaggcgucugccaccacgccuggcuaauuuuuguauuuuuaguagagacgggguuucaccauguuggccagacuggucuggaacuccugaccucagguaauccacccaucucggccucccaaagcauugggauuacaggcaugagccaacacgccuggccauuuucugcauuuuuuuuuuuuuuuuuuuuuuuuuuugagacagucuuguucugucacccaggcuggagugcaguggcgccauuucugcucacugcaaucuccaccuccuggguucaagcgauucuccugccucagccucccgaguagcugggacuacaggugugugcccccacgccuggcuaauuuuuuguauuuuuaguagagaugggguuucacuguguuggccaggauggucucgaucuccugaccucaugaucagcccaccucagccucccaaagugcugggaucacaggugugagccaccgugcccggccccauuuuccgcauuucuaagugugcugggaaggagagggagguggagggggcucccagccugcuccaagagcauaugcuacugucaacagcucaaaggucauggcuuguacuuccuggcaacacaggguacauuuguccuugagaucuaagcugggaggcuguccacaguuuguucauuuugacucugacugggguccagccccagggaguuggaaaguaaaacucucaaggcgugacauuuaaaugcuuggaaugcugccagccaucugugcagcuugauuuaacuuuggugcuauuaucaaugucauuaauaaagacccauuccaccagggaagcagugugguggugaacagccugagcug

SEQ ID NO: 16610 - RNA, 2181 nt, Homo sapiens
cagcucaggcuguucaccaccacacugcuucccugguggaaugggucuuuauuaaugacauugauaauagcaccaaaguuaaaucaagcugcacagauggcuggcagcauuccaagcauuuaaaugucacgccuugagaguuuuacuuuccaacucccuggggcuggaccccagucagagucaaaaugaacaaacuguggacagccucccagcuuagaucucaaggacaaauguacccuguguugccaggaaguacaagccaugaccuuugagcuguugacaguagcauaugcucuuggagcaggcugggagcccccuccaccucccucuccuucccagcacacuuagaaaugcggaaaauggggccgggcacgguggcucacaccugugaucccagcacuuugggaggcugaggugggcugaucaugaggucaggagaucgagaccauccuggccaacacagugaaaccccaucucuacuaaaaauacaaaaaauuagccaggcgugggggcacacaccuguagucccagcuacucgggaggcugaggcaggagaaucgcuugaacccaggagguggagauugcagugagcagaaauggcgccacugcacuccagccugggugacagaacaagacugucucaaaaaaaaaaaaaaaaaaaaaaaaaaaugcagaaaauggccaggcguguuggcucaugccuguaaucccaaugcuuugggaggccgagauggguggauuaccugaggucaggaguuccagaccagucuggccaacauggugaaaccccgucucuacuaaaaauacaaaaauuagccaggcgugguggcagacgccuguaaucccagcuacucaggaagcugaggcaggagaaucacuugagcccgggaggcagagggugcagugaaccaagaucgugccauuguacuccagccugggugacagagcgagacugucuccaaaaaaaaaaaaaaauguggaaaaugaacaucucaccacugcaccugggccuuggagccagcaaacagauggcgggggugggguggggggugugcagggaagggcacacuugccaucagcuugaacugccugggcucugucccaagaacaagcagaagcaaggagcaaggcacucagccuccaggagucagcagcugccaccaggcucagagccccugagcccugcccugccugcugucuuacaggcuccccauagggaauccuucucugguggggaagauggucuugaaagaggggacucagagauccuuugugccauucaugggggcugagcugccaccccagggugguagaagugggaagcugaguccaggugaugaauacagcagcaaauguuuauuccucacucgccuacuauacaaggcaccauuuugcacuuaugaacuucuuccauauaucagcccaaugguacucuuaacucaauuuuucugguaaauaggggcagccacauaccucaggcuacggccagcugggcccugacagcugagacgugcggcagugucaggggacugaggucccugguugcucccaccucugcacuuguggcauccgacauccaaguguuucguaaaagcagucccuagcgucggagagccgagcagaggcuggcacugcagcuucugggggaaaggccugcccuaugugccugagccuuguuuguccuuuuucccuucagccucaaggcuguccuggccggaagccccccagacaacacaguggaccugucgggaaucccacugaccucccgagaccuggagcgggugaccagcuaccuacagcgcuguggggagcagguagacagcguggagcugggcuucacaggccucacggacgacaugguccugcagcugcugccagcacucagcacccugccccgccucaccacacuggcacucaauggcaaccgguugacccgggccgugcugcgcgaccucacugacauccuuaaggaucccagcaaguuccccaaugucacguggauugaccugggcaacaacguggacaucuucuccuugccccagcccuuccugcucagccugcgcaagcgcuccccaaagcagggccaccuacccaccauccuggagcugggugagggcccaggcaguggggaggagguccgggaagggacaguaggccaggaggacccuggagggggcccug

SEQ ID NO: 16611 - RNA, 1051 nt, Homo sapiens
agaaccgcagcaaugagggcucugccugaggcucuagguacugacucgugggcagugaggagagguagauuuuuguuggggauccacuugauguauguuuucuuacaacuaaaugauaaaacugaggcugaaacacagguguuuucugccuggccuuuuucuagaaugcaccucucucugaagauuauagagaacuaugaagaaaaggagaucgugggaaauauaugauugagucaguaugauuuggaggaagcucaagugcuugcugugguugcagagaagugaggggacuuuacauuccuggcuggacagguugaacucugggauuggagagguggugggggaguggagaggagcagaaggaacagacacagggagagacauuucaaaggauugucaacagggcaugaugauaacacagggagagcaaguccagccugucuccuggugcugccccgaguugaugacugcaauuaaacugccagacuuuacagccugcucugcacuguguccuccuggcaucuuggggacuuuuucacgguuggggccacaggggagguuagaagcugcucgcucucuccauugccaagcacuggccggucaauggaguuggggagaaggaggcuaauucucaacagccuguuagugacagccauucucucuccagcuuaucuaaagaggauuuuauuucagaagaaggcugagagcuuguuagaaaggcaaguucuugggccccaccccacauauacugaaucagagacccugggagugggacccagcaaucugucuuaauagaccuucuaggagauucuggcacuaaggaaagagaccacaggucuugucuaucucuguaguuggcugcgucugggccagaguaacugcuuguugaaaugaucagagaucucaaaugaggucaugcauguuggggugugugugugugcauguguguguguuguguaucuuuauguguguauguguuuggucuaggguccagcacauaguagguguucacucuugggggugggaauaaucacucuaauguccguguuug

SEQ ID NO: 16612 - RNA, 1273 nt, Homo sapiens
uuuuuuuuuuuuuggcugagcacaggguacuuuauugaugguauaugacaagguggggcucccuaggccccuccccucuucaaggggucuacauggaaacugugaggaggggagauucaguguggugggggacugaguguggcagggacuccccagcagugagggucucucucuuccucuugugcucuuacuggggcuggugguccaggggucuuacuccuuggaggccaugugggccaugagguccaccauccuguugcuguagccaaauucauugucauaccaggaaaugagcuugaaaaagugguuguugagggcaaugacagccccagcauugaagguggaagaguggguguugcuguugaagucggaggagaccaccuggugcucaguguagcccaggaugcccuugagggggcccuccgaugccugcuucaccaccuucuuggugucaucauauuuggcagguuuuuccagacggcaggucagguccaccacugacacggcaguggggacacagaaggccaugccagugagcuucccguucagcucagggaugaccuugcccauagccuucgcagugccaguagaggcagggaugauguucuggagagccccguggccaucacgccacaguuucccggaggggccauccacagucuucuggguggcagugauggcguggacuauggucaugaguccuuccacgauaccaaaguugucauggaugaccuuggccaggggugcuaagcaguugguggugcagaaggcacugccgacaaucuugagguuguugucauacuucucaugguucacacccaugacaaacauuggggcaucagcagagggggcagagaugaugacccuuuuggcuccccccugcaaaugaggcccagccuucuacaugguggugaagacgccaguggacuccaugacguacucagcgccagcaucgccccacuugauuuuggagggaucucgcuccuggaagauggugaugggauuuccauugaugacaagcuucccauucucagccuugacggugccauggaauuugcuauggguggagucauauuggaacauguaaaccauguaguucaggucaaugaaggggucauugauggcaacaauauccacuuuaccagaguuaaaagcagcccuggugaccaggcgcccaguacgaccaaaucuguugacuccgaccuucaccuuccccauggugucucagggaugugguuuggcugacgaugcaaaagaagaugcggcugacugu

SEQ ID NO: 16613 - RNA, 2690 nt, Homo sapiens
uaaguuuacaccauuuuauuauaucaggaauuuuugauauuugagauguagcuuuccacagcugugugaucacuugugccuaacauacguauaugauaccagguucuguaauuuuguuguuuuaaauucugacggagaauccgugucgauggucaaaucuaucacuuagaaaaguuuuaucugaaguaaaacuacugauaucucaauugagacagcacgaagguaugauccuuguauuacuaaauauuucuucccuugauuuucugcuuuauaucacuuugcauuuauaagcccuuuaccgaauggugguggcugugugugagcauaauaauuuguauuuuuaaauuuuuuauccauaauauuuuccuaaucuuaaaaaauuaaauuuuauauauuuuauucagucuuacaaauauauuguucuaccuuagaauauuuuuaugaaguguuaaauuuuccagaggauauauucauaguuuaaccucuaaccuguuaaauuauuugagaagaagaaaaaagacauguuuguagcauuaugaaaugucuguuucaaagaauaccccugcuuauuuuuuacuuuuccuauguuuauucugaugcaaaauuauagcuucaaauacuuauuuucuguuuaaaaauaauuaaauauuaaggaaaaauuaugcaauaugacuacagaaauuuauuaauaaucuaauaauguugaaagagcuauguaauuagaacuuuaaccauucuuauuuucaguucauuuuagauuuauuuucuaaaagaaacaguacaacucaaucaauuuggaaauuuuguugagauuuuuaacuuaaaagcuuguaacaugguaacacuuacagcuuguuuagaaaugugugguguuugugaaguucuuuacaaaggaaccagguaaaucuuggcuuaauguugauuugauaaaauucccuaaaauuucccucaaauguauuaaaaauaagccaaguuuauuaaaaauaagucaacugugauuguauuuucuuuaauaaucaaaaguauugaagaaguaccuauuuacaucuaaacaugaaaauuguuauaaaauguuuucaugagucauacaauaaaggaagcuuugagagaaccugguuauccauuaaucuuuauuacaccaauuuggacuaacuggauuuguaaaaaguucaaauuaugaaauaguuuugaagaaauauaauacuauuaauuuuuaaauuaaauuaggauaauuaaguuuuugaagaguuucuuguuaaaaguaaucugaguuguggguauuaugucuauuuuugcaugacccauaguagcuaauaguguuauaaauuaauuaacaaacaugauuuguaauuauacucaguguaauauaaaacauuuaauaaauauacuuaaagguacuuaaacaguugguuaucaagcauuuaaaaugccugccaucacuaccaacaccacauguuauuaaaacuaugaaauggcacuacauggaauaaaagaguuugcuagauguuaaucacuuucauccagauuucagucuggaugaugaaaaaaaugacuaauaauaucuaaauucaugagauuuuaucauaauugcagauaagaaauuuucuuuaaaauaguguuuaauucagauuuuuaugaguuucaguguagucuuaauuagugagauuuuagucagcuugucuuacuuuauagggcauaagugagauuauauguuuucauauggaagucuuuucuuuuuuuaaaauuuguuuaauauaauagaugauggaugacuuuuacuaagaggaacccugguauucguaaugguuauuugagucaguguuucugaacucuuuugguucuucuuugcuuugguguuaaauaauuccuuuucauacuguaaauguuaguaauauuuuuuaguuacuuauacuuuaaaggcuucauaagguagacuccaugaugcccucaaauucaacaaauguuaaugccugaaggaaaaaggaaugauucuuuguaguugauuauauauagaucuuuagagaacauauauuuuuagguuuuaucuacuuguacucaugaccuuuaggaauauuauuaaucauaugcauacaugcuuguuaaaaaguauucuuaaagaaugugaagagauaaaaaauacaaaguuaucuuuucuaucagcuuuuuuuucaaucaucaagaaauccaguaaacaacauauauguuagaaaauguuuguuuucuggaaaaaauuaacugaguucuuacaaguauuuuaaugguuguucacauugggagaugaaaagcauccgccuuugucagauaguguuucagagcacagaauaacucuguaagaugccuaauuuugcuuuguaugugggacacagauguuuucaccuccaaaaagggacagcaagcacauaaaaggagaucaaacuuguucccaaagaauaugugugguguaacacacucuuggagaggauuucaaaaguaauuagcugaguaagcuaaaaaacagcacugcuauuuaacuuuaauagcagaaagugugccuuuuaagguaguaguuuuuugacuagacauggauaaauuaauugcccucgguguuuuuuuuuuuuuaaguuaaacucuuuauuuagagaucuucauagauucacaugcaguuguaagaaauaauauagagagauugcauguagccuuuaccuacuuuc

SEQ ID NO: 16614 - RNA, 3301 nt, Homo sapiens
uaugaugucauguuggagcuagaagggaacuucgaguccaucauuuuccaguccaggaaacuggggcauguuuauaagcauucacgggacugcaugccuucaaaacaacuuaaaaauggucuuuguuuuguugucuuccuucugcaaaucugacugaaguacuuagggaaaaaaugugaaaacacaggaaaguuuaaguuagcauuagaucucaacugguuugucaauauccaauuuuagaacacaaaaggacauuacagcuuggcagggcuuguccauccucguaaacgcccagcgcuuuacggcaucagaaucuaaaaagcucuucacugguugucgaaucaguugggauugguaguucauaaacauaaaaccauaaaccauauccagcagugaguauuuaucuagcagggcacaaauucauggauccaugcaagcccagaguuagaaccacuaggugccccuuggaagcugaaaaaguggaagcugacuuccacuuccguggucaaauagagcacagaaaggcugcgaaguuccugcauggggacgcagaaaugccugguaaguuuccugcaccguggaccuugagccugcggugggcccuuguuagcacccgcagaggucccagaaagcugccuccacagcuugcaggggcugguaagaagcucccaagcuaccgcccacauggugaggcaaccuguggaggcaaggaagccaaaaaauaaggaacaaauaggauuagaacaaaaaaccaccucaugcagcuuccacgggccaccucccuccauuagacagcaaggcgguuuguaucccuuccugaccugcucuccggggagcgcacgaagaggauauagggucaggggaggcaagggaaagaggaaaccgcaguuuaugaaaggacauuuaaccucuuugcgagcgugcaugcgcgcgcgcgcacacacacacacacacacacacacacacaaaaguacaaacaacauuaaggaaauacacacuacauuaaaaauugggcauagggacuuggaaucggaguugaauuuuuuuuaaauuuuaauuuugccuuugauuuaugcauugguuuuuuuuuuuuucguaagagguuguuccuuucuaggcccuggaggacuguaucaucuuauacaaauccaagggaaaacaaucaaaauaagaaaagaaaagaaaacaaacaaacaaaaaacagacugauacgagaaagagcuuugcuccaagacccgcagcagacaguugaguagguagaaguccaagcugcugcagaggaauucgguuugcuccagacaaacgggggcguggcgugcagcgcaguacugggaacugcugcaaacaaaacuuccaaggggacgaggaguagguuccaggcgauggaaagcagugggauggggaaggauagggcaacagugccaagaggggagcagagcgcggggaaccuggagagggagggucagggcugcggagggcugagcugcgguggagagcucuggggccccucaccaagcuaguggcgucuuggguggaagucaggcccccagagauccggccggccuuagcugucacucaggcaaccccggagccgccgcagacaccggauccacuggaagggggcgaagccgcggggaggaaugggggacacuggggaaggggcgucgccccugccgcccccgcccucuccagugccauugggcggcugcugcggagcccgcgccaccuuuucuccaucccaccccgcccgucuggccccgccuggccgcugguccgcgccccgcugcgcucguccgggggcugguccggcccgggccuuugacgucaccagcaaguuugcugcccucggcgucccacguguggcggcggccagcggcggcccaggaggcagccggugagcgccugcgagcagaguggcgggggccgcugacaggucccgcgcagcccagcccagcccagccacgcggcucacaggugggguccaagagcaguuuggagcaacccggcgcuacggagagggguggacggcucugcacgggccuccugucucccgcucgggcagagggacucggggggaccucgcuccuuggcugagagaaccugaacucgggcggagagaacgcgcccaggcgggcaaggggaccagagaaagccggggcuggaagucacugucgcucgccacugucuggagcgcacggagcgcagaggcccggcagccgcgcgugcccucacggggaccgagccagugaugcaggaucgcugagcggagauccgcgccgagaagucucucggggccggggcugagacgcacgccuucgacaccgcugccaagaccccgauuccggcgacucuugcggggaaccgaggggccaaggcugccccaagcucaggacuugggcgagucuaagacgaugguuucuuaagcacggacccgcguuccccuucccgcucccucgacuggaggcagggauccugcgcggggcccccgggauuccguuuccccgcggagccccggccgcugccucccgggacaguucgcacggccacaggggcgcacggcgauguggccuccguccagcgcgcuggcccgccggggggaugcucuggcaccugucgggguccaggccuagcauggccggcgcguugcccgacgucgccuccggcuaggauggccccuccgggcccggccagugcccucuccaccucggccgagccgcugucccgcagcaucuuccggaaguucuugcugaugcucugcucccugcucacgucccuuuacgucuucuacugccuggccgagcgcugccagacccuguccggccccgucguggggcuguccggcggcggcgaggaggcgggggccccugguggcggcguccuggccggaggcccgagggagcuggcgguguggccggcggcggcacagagaaagcgccuccugcaacugccgcaguggcggaggcgccggccgcccgcgccccgcgacgacggcgaggaggcggccugggaagaagaguccccuggccugucaggggguccgggcggcuccggggccggaagcaccguggccgaggccccgccggggacccuggcgcugcuccuggacgaaggcagcaagcagcugccgcaggccaucaucaucggagugaagaagggcggcacgcgggcgcugcuggaguuccugcgcgugcaccccgacgugcgcgccgugggcgccgagccccacuucuucgaccgcagcuacgacaagggccucgccugguaccggugagcggggcgggcccgggcuggggcugaagga

SEQ ID NO: 16615 - RNA, 26425 nt, Homo sapiens
aaaaguaacguuauuaaaauagauuuauuaucccugagcuuggcaucuguucuugcuuuaauaaaccugcggggacauggccgucaaucucaaaugcacaccgggauggagccugaaggucaccaccuguguaaagccaggucccuggcugaucucucgcuugcuugucuuuugaguuuuuaaagcucuucuuuuuacauucuccuggguagggaauauacacaauaaauacuagauucaacuuacuuacuuacuuacuuacuuuacuuacuuacuuccuuggaaaaugcucuccauuugucgagcacuaauccacgucuguaaaucccgcaaggaggacaauggaaaccagccccgugugccauuucucaaaaccuucgagggcaaagugauccucacuccucucaguauggaagcaacaacacagcaaaucuauugucuccacuuuuacccagaaccaccagaagacuugcauuucccugaccaaugacaccagcccagccaggcucucacugauugauuugauugauugauugauugauugauagagaaagcacgcccugcugugagcuggcacagcucgaguugucaaaaagacuuggcgaauaaggguggcucucugaggacagguuccagaggugcucacuacgacgggagcugacuucuuccaagccacccggguaccaggcagcugccacacuacagcacagagagccuucuccaagguggugcacagcagacccugcucuguagcagcagcaggaggaagcaaaagaacucacaauugcaaacucaaucuuuauugcagcugaaauacuauuuucguuaagucucggacacuuagacccacugauccuguuacucugcuugucucuggugugcagggaaucacuuugcuggauuagaggaaaggugccgccgucuguuuccaagacuucuuuaaaaacugccuugaaaugaaauuaguucaucugcuugcuuccguguggcagccuccuggcccgcggcugugccaggcaccaguccuaagaggcaucuauagacuagugcuuaugugggagcccaagccucggcacagcuccauaccaccuauccugagcugccuccugggggaccgugcucuucagcuucuaccagcaaggagggcagauacgggugcgugcguggggcagaagacacacagccuucugaguucagggucucccagaucuucacugggcucugaccuucuuggccuguggcuccucugugugggcccgcuucugcugaggcuccccauccuccaggccgccugccagcucccuggacaggagggccgcccgcaccugccgcagcucccgcuucucccugcgcuccuccaucuccucgaugucgccagcaaacagggcuuucagugggggaaucagcuugggcauuguuggaaagucuccaaagcagaccuagaagacacaauagaagacaaggacaugucucagaggggcaggggugggggacaggagcuggaagggaugcagucaugugcucacacagcagcgccaacgccccuuccuuggcacaagccaacaggccacagcugaaauggaaaaaagaauggcauggagggaacccucuaaaggggcagaggcuccccaggccuggcuaagggccuccggagagggaagggagagcaguccagaugcucucaaaaucaagcuccugaaaaacgaggccuggcuccggcucugccccuucauuccggaaggccaagggucaggccuggcuuucccacucacaagaggcaaccaccugucucacaggucugugcugaggcucaaaugccaugacugugugagcaguccaggccuaaaaggauucucagaaauuuccagugaacugagacugaagacuaguuggccccugcaggaggugggucucaccagcaaacccagggugguucgaccugguuagugauggguagauaaccuuuucccacgguggccccaaauaagaaagcaaacuccagcugaccguccuacucaguguguagaguccugucucccugccccguccccgcccugugcuguccgugugacauacagaccuucauguggucaaaggcaacucccacuuucucgcugaaguuggggcugaagagggggaccuuggcauagcgcuggcugaagugguucagcauaaugaacuccgcguucauccgcauccccacgcugauggcuugggacguugugcugcaggugaaggacagagcagacugaagcugaacucaacugcaagacugcaaagcagacaguggcacagacccuggccaucaacugccagggcacccggggaagcugguggguuuucuuaacgggcaccuccguagccagcacaaucuccccugagggccagagccuucgcacacaccccuggaugaagcccacccucugugcuggcugccaaaucuguccaugagggcacccaagagaaaccacagggcccaccugggguaaugcacucuuucguugaaauuagcagccaaaaauucagucccccagcccccgccuuccccuggcaauucccugacauggcuuauaguuuauucagccgauuucuagaugcuuucaaaaaacugugccucacucuagaaucuugcuuagaaaauucugcaaaaauaaaggccaagagccugugagcacugccacaggucaaggaagcccccauagcccuugauaggaagcagggcagccccacaucaguggagacaaacgacggcugcucagugucacguagugggggagggagaggaugugggcgacaaggacugaccggccuuugcuaccugugugucuuuuccacugcuuccucuuccaaaccaucuuccaggguggcuucauguaucaggaggguggcaucuuucccuggagaagcagcacaaggaucagggcagaguucucugcgagagcggcacacaggccucagucacgugcuguuuccuggucucaacacucagcuccccuggcccugggucugccuacuaggaugacaaccagagacucugaggguggggaccugagucuccugccucugcugacguuucccugcaagcccaccugcauucaccuccagcuacacaaaccccagagcaaccucaggguggcuugcuucuuccucuacucacccauccggaccagagccucgcagggcaugguguccccggaauagaccacuuuccagccagaggugugcaccagcgcacagccaaacgcaugcuugcagugccgcaccagacaggucugaaacugaaaggguggggcuggagggcucugcagcucugcuccccaccucgcccccaugaugccugcggcugugccccuuaccucuuccaaaucacauguucgcaacagcgaacugaucaaucuuuccacugcaggacuggagaucucagccccuuccugaaggcauuuggcaggaaucauacuguaaaaagacaaaacauuuaaaaugauaauaaacguuucuuggacaucuggaaccaaaguuuaagucuuuggcuggagaaccccaaaaucauucuuaggagaaaacaugaguuaaaucauagucacuaugaugaggaaacagcagucaaauauaaagagccaaaccaaagccucuaggccacugggagaaacccagcaggugaaugcugccuccggcucaggcagcacgggccacggauggcuccagcagaggggacuccuuccccuuggggugaggauggugccaccugccagcuagccacacaccugcuauggacauucucugugcuagccacuauuugggugcuuggcucuggaacugucucaucaagaaaagcugcucgaaguuuagaaagcagcucagaacucaaaugaggacugggaagaaaugcuucuaagaaaauaagcauuacaugggaacuaucuaaugguuucuguccuucagccaaugcacuucuccccugcuucugccaucugggaccaugucaagggcaaggcugcugggggauauugguaacuaccccaguguccaccuugagcuucugaaggagacggcagcaagcaacagcccagcgggccaggcugcccuggaugcucaccugauguggugcaggaccuccuggcacugguugugguacugcuggagccaggcuuugagcugguugggggcaaccaccagcaaagggugaagcggcuuucccaaagaugccuggaacaaaaaaugcaagugccgacucgacgacagaacaucucaauaaaaacuggagugccaagaggcauggcggaugauguguaaaccgcugaaacucagaacgcccaucaagugccacacuuaccaaggcgcguucucucugcagcaagauacuuggcaagcccuggcaaggaaacaggagacaugcgucagccaggccccagggccauccccuccggguuagggucugcagcccucucucuugcaggaguugccagcccgacgucacccaccagccucuaacacagccgcaguggggguggcacaggccgagcccccugcgccauggcccugaaaugucacaggcagaaagcgacacgacccgugcugggaagagggcaacggcccagggcccggcaccccaggagaccaaggugagggucucauagccacaccuccugcauccggucaaagcuuccgcugagcaggccgugugagauucaagacucaaggaaggcuggguaaacucaaaccuguccugcugcaggaaaggaacugaacaggaagagaagacauucuuguggcgcagaaggacuauguugaguuuugcaaaaaaccauuuccuagccagagaugaguaacaaaagcucugggcaaguuuggaagcggaggaaaagacgcagccaaagggccaacucaacguggcagugccuccuccaggcuccagcuuugugguccagcccaacacucaccguguggugaucugcgugcaggugggacacaaacacagcagccagggugcccaggacccuguccaccuggucuccguaaugacggcacagcugcccaaaugugcccucaccacaguccaguagcagagacgugucggggcugcagaagagaagaggaagagagucacugccacuaggaagacugcugaugguucagaggcugaugucugcuuuggacaggaccaagaagcaacugcagaaauuucugucucuccugcuuugcuuugaggagcuaauauaaaagccaauuaauuuaaccauaaaggugauuuuacaugugucauccucuuuauagcaaagaaguauccauggaacccugaaacccuuucaaguagacuuacacaaaggcugggcaucaaaaaaaaaaaaaaaaaguuuauaggaggcuuaaagcauuuaguccuaacaaugaaucugaccaugcagauugacuguggccacagccucuguugaaaauaccaggacaggcacugggccauaugagacucuuucuagguccagcugccaucggacuuuucccccuuugcaaguggucgggguuuccucagcucauguccucaaagacaccuggugcagggcgggcugcaggugcuucauucagggagccaguuaacgcagacucccaggugucacucgggguuucugacuugguuuuaggcagggcucuggaagucuggauucugacaaacuucuugggcuauucugcugugcaguccauuucagaagcucugcuccaaggcagagagagugcugacccgcucuggccuccuucauucucugggaggagccacgaacacugagagggcugcacccauuuugcagagagaagccccggugcuaagacauuaccuucugggggaaaaaggagucgggaggcggaggcaagguggcaauagcaccuucccauuagcuucagcugguucaaaagcugcucgcagggugucaggucaaacucaaaaagcccuucuucccccaggaucucagcccccgggagaggccggcucacuccaagcugcuuuauugcauguccucauccacagagaaacacaccccagauuguauauuucugaugucagggcacaucucgucacugcuguauauauuuaaugcacuauuugguuguuuaucauccaccacuagcauguaagauggcagagcaaaauuuaaaacaaaccugguaauucacaaucuuauuuucuucacauacuaucuguagagauaacguguacaugucacaacgcauuugacuaaucucucugcugaugaccccaggcaaacccaagagaaucaacuaaaaaacaugucaaggggaauccaauaaagguucugaacacaaaugugcaaaacccuaaagcuuuuuaacauacuaccaacaaauggcugggggacaauaccauguagcaaucaagaccccaaguccccgcucaaacuucagaugccccacuuaccagcuguaggaaccauagcaagucaccucucugaauaucaggucacucaucaacaaaauggguaguuauucaccacuucauaggauuaauguaaaaauuaaaggagcuaauuucuuagcuagguguacugcccacaguaaaaucagcuguuuauuaaaagacaucaugggaugaauuuuggugauucccaggguaaaguuugcuacugaggcuauaaaaugcaguaaggccacgcuccucuccuggacacuccagucgacaugacaagugacagggcuugauaccgcauuucaaaucgacuggugaguacagcaggacuuuuguuuaaaaaguaaacgugcccuugauggaaggaugcuuccugggaaagcagcauaccuuauguugacaaguguggcacugacauuucgaaucuucaucgggauggcagacccuguuccaaggaagaugauuucuggguacugacuucuuuucucugugaaaaaauccaugugaaacaauccauuccuuugggucaaaagugagccagcaugcagccaugagaaggugcaaugguuugagugucauugguuuguccccagaccucauguggaaacgugcucccuaguauggcgguuuugggaggcggggccuaguggaaggcguuugggcuacagggacggacccuccugaguggcuuggagcugcaguaguaaguacuggcucucaggagacugcauuacuucucaagggaauggauuuguucccaggagagggggguuguuauaaagccagagugcagcucagguuaucccgucuucacaagcguccacuuccuacuugcgcuccucugccacguuaugaugcagcauggaagccuucacuggaagcuagggccgugaccuucaauucucagcccgcagaaccgugaacuaaauacaccucuuuucuugauaaauuacccagucucacauauucuuuuauaauaacaaaacacagacuaagacagauggguaagcaacauaguucuauccagcuucccaggagggggacuggcaggccccuggcaaccgcucugaaacaaaggacuucgcaccagugugggacccacaggcuaucugucaccaaaaggcuaagaagaacaaauaaauucuccaguccuuucuucaaaagaauugcuguaauucuuuuacauuuaaaaaaugacauuucuuuaugcugggaacugucauuuauuucaagagaacagugugugccuugcauccagcucucacugcaagaccaugcacuucggucgcauccucccagcccuaccagguaggaaaugcucugcuucccaagggggaaacaggcucagacgcccaggucuccagugaagaugguaagaggcagggucaggauucaaauccagggagacccgaugguuccaaagccugugcccggcccucagccucaguugagugacguggccaagauccuccauggauuugcauccgcaaagccaggacuagaucucugccagccaagucccugcucagagcucuuuccacagguguucacuaaaacguuucacucagugcgugccuugccaagaaugccugggugccaucgccaaaugcucugauugggugggauggggcacaggaauugggauuuuuuuuuuugagacggagucucacucugucguccaggcuggagcgcaguggcacgaccuuggcucacugcaagcuccgccucccggguucucgccauucuccugccucagucucccgaguagcugggacuacaggcgcccgccgccacgcccagcuaauuuuuguauuuuuaguagagacgggguuucaucauguuagccaggauggucucgaucucccgaccucgcgauccaccugccucggccucccgaagugcugggauuacaggugugagccaccgcgcccagccaggaauugggauucuuaaacuccccaaagcccccuccuccaaugacuauaauucuaauguagagcugaguagagaagcccuggauuagacugaaaagccagguuagaaugcgccccaccagcacuccacuuaaugcuaggaaaacagcagcaggggcagagcccaggaaagaaaggcugcucugugggcucccacucaccugcuggggcugggccguccugcgcacuccuccuguacuccugcacgcucugcuggaaguugggaagcugcagcgccucaacuaugaauuccucaggauugcaaguaauaauggcaucccugcaggaagagagagaagcaucucaggugacggacaggguauauggccucagcagaccccauuggggauguccagaauaaauucagggggacaaucugcaggaaguuccuucagaucaacacugaagguuaagugacuaggaucuggggcaggucugcuccaccgccuuuuggaugcugcaucgcucugccucagggccagucaacggggaacuacugaugcucagggcaagacaguuuuuuucuguggccagugcugcuguccuggugcaguaccccugaccucuacccacuagcagcaccacuacccaccuccuaggcugugacaaccaagaacguuuccagauguugccaaauguccucugaggggucaaugguccgagcugagaagcaggggcccuagaggagugacucugaaacucauguucacacccaggaaccuuggcaaaacgcagaagccaguucggcagcucugcagugaggccugagaucccacuuuccuagcaagccccagaucacacggaguggcaacuccuuggacaggcggcucuucaaccucgcugagcauuaaaaucaucugggagcuugugagucccaagccuaacucucaagauucuaauucacuaggucuagggcaggcccugugcaauauuuuucacaagcacaagguaaaucugaaugucggcuagggcuguguaucgcugcuguguguuaagagccugcgcagaugccaacaaagggacaccagguucuucaaccccgugauguugccugugggcccgagucuugcuaguauagucucuuaaagggccccaacuacccaaccucaacagcacacagcauccagucauaauccagcacaugcucuauucuaauacaaauacuguggagugggcaggaaacuuaaaaucaagguucagauccuuaaaaauuaaaacaggccgggcacggcucacgccuguaaucccaacacuuugggaggcugagguggguggaucaccugaggucaggaguucgagaccagccugccaacauggugaaacccgucucugcuaaaauuacaaaaaauuagccgggcgugguagcaggcgccuguaauuccagcuauucgggaggcuggggcaggagaaaugcuugaacccgggaggcggagguugcagugagcugagaucacgccauugcacuccagccugggcaacaagagugaaacuccgucucaaaaaaauaaauaaauaaauaaaauaaauaaauuaauuaauuaaaauaaagauguggggcaguaaggcuguucacuuuccugguuggauuguacuggaagaggcuuucaagauggcaucuuacauuuaucaaguaccuuaacaagucucacacucugggccaguaaucccacauuuaggaaugacuugaagggaacagaguucccaucaaagauuuauauauaagacauuuauuguuucauucauuaaaaacaacaaaaaauuggaaacaucccaaaugaguaaacaucccuauuuggaauaccaauaaaaaucuuguuacuuaagacuguuuagugauacaggaaaagacugacaauauaaacccacauacacaaaucaagaaacacaaaauguuaucaaucauuaucucugggcaacaggauuaugggugacuuuguucaucacacauuuccuauuuucuauacugugaaacacacgagcucuaucacugcuauucccaugcaaggcaauuuuggaaaaggagaacuacuggccccaauccgcccaccucaacccagccuggaguaggcugcuuuucuaaauaaauucacgcuggcacacagccaagcccauucauuagcuuauuguccguguuucuuuugugcucaaagcggaguugaauaguuacaacagagaccauauggucuggagagccuccuggaacauuuacuauguggcuauuuacagaaauguuucccaacucgacugagacgauuccauuaguucaagauggcacagaccucugccacucccuccugggacggagcugguacuugaggaggcauucacccugaaccaugggcacacugaggguggggcccuccuucugaaagagacaaaacacauucauggagagaaagagaggggacgagagcugggccgacaaggggccggucugagacacuaccuuacagcggaaacuggugagcagggggaagauguccggguggaugagguugagcuggguuugaaucuuguggcugcgaagguugugaacugaggcacaguucucauucaggaccaagugcugggugucaggcccaaaccugugaagaaacagacccggcauuugcagcgucuguuaggaggcagcucccccugaggaguggugcugagcucaggagugguaaugaggaugagguguucaaacaguucagugacuugccccaagcaguguuacuacauggccaaacauggucccacuccugcugucucaaagcccgguguucccuagcucagcugccuuucaggugugcugggaagagugagaggaaaaacaagaaaaagaagauguccagggcauacaaauaggggacccaaacccugaggaaugaaagagacagcaggagagcaggccauggagugaggggcagguaaacgggccauguggggagauacgggcaggggccaaaaagcagcccaaggucaccccgcacccgagcucaacucauacuccuccaccuggcccuggccagcgaugccccgaggaaaaagaugccuuccagugacuaaacaucuaccucccagggcugcuggcgacgacccuagaggaaaugaagugaaaugaaggguauuucacacacugccucccacaaagugggcauucaguaaauggaagcuaucauuuuauagcugcaaucucuucuuuggaauucacuuauggaauccucaaccaaacggcaguauuuguucagacacccugaagaguguggaggguguaaaauaaauggaaucguguggacacugcgccaccuagcggugcauuuucuucacgaguguagcacagaucugggaagccuagaauucugggaaggcaggaaucccacagaaaguuuaggcaggugcagaaggguagguagcgcuggaaagagcacgaggggaggaaaggggaauccaccacugcccagaagaguuaccccaagugccgcugggcugggcuccauaccucuccauccacugcugguaccugcuguccacaagcacagaugcuggggccaugugaaccaccaaggccacgggggcaucugccuuuccuugguaccugggcagaagaguggggcuuuacaaagugaugcagacucaggacacaccaagacagggaccacgcagccagggagggguaucgugcggcccucugcagcacugcagugagcugacagccuccacgcccaggccaugcucucacagcaggcugcucacggcagaccccggugcugggccauuuccaauggacgugggauuccuguaucuggcaagcucugcucugggcuuuccaguaggccuggcugauccuuucucagcacugcacuuccuuccuacccucuccacucauacggguccaaccugcaaagccagacccaggcucucccugccuccuccugcucccucucuccuuccucucucacagucaaauuuccucgaauaaaccuccugcaccuccaaugccacccuggugucugccuuccagaggaccugagacacaggcacgagaaaugaaaaucaucugaaauuucaccaccuggacaacagaccacuuacuaacaugcugauguguuucccuccaguucccuuuaaaaagaaauauacacaguagcuauuuuuaucuaucccagcaucaucacacauccacacauggcucucaaaugacaccugauucauugaagagguuuugcugcccaaaacuggauuaaaauacaaagccggggcuaccagcgcauccaaauucacccacagagaauaaagcagaccaugaaacaacuccuaacgcucugacucggaagggguacagcagcccaaaaggauuuguugugguaaguagaaaaaaacaagugaaaaaauacagauagauacaaacuaggaacaggaaaaauacagguaaaccauuaagagugggggaaaagauucaaacucagauaggugggucaaagaugauuccaucuggaaugaaagcugaaccgcaaaacugguuaacuucgauagaggacaacaacagaguggcaguuagcccaaaagacauuccccagcugugaguccaucccauaacacggacucuugaccacgacagucucacacacucugacccaccucauuuguuucaaugcagguaauggaagaaaauuaauucaguucaaaauaauccaaaugauaaucuggggcauuaguuagaauucaaaaaaguucuagaauuucuucugguauaagagcuguaagaguucuaguugaauuucuaguccucaguuguuucuaguuuucaaucuuuucuaauuucacuuugaggcuguguacaccggagcccaccaacuaccaacagugacuuaaggcaggagugccggccucugaacuguaaacccagauaguggucuucccagaaacacagcucuugccacaagaugcccaugucgaugcugggcuggguuucagcucucacuucucccacccuagagaccccucauuaccucugaaagguggcauucucacagauggguugaaugaagcuuucaucuggacauucuaccaccacaaaagcagcaccaggaucuggaggaguacacagcucuucagccaaaaucugcaaaaccaaauaagcccgcccacugggggucacagcucagccaccaaacugaacugccuucaaggcaacugcuaacaugacauauccuauccagugagcugagagguaaacaaagcacaaaaccaacuuuacacaucaccaucaacacccuucuggucucuuuguggauaccuaaacagguaacugucagguugaggcacuucaggccuacacuggccaggaaaggaggcuuggcauuaagguuuucuucagucuguggccacugguccuaauguccucagaagucagaggaaauaucuugacauagaauacuguggcauuccucuggaccauaaaccccaggcccauccauauggggucuguuguuagacacuguccugagcucaaguaccaaggaaagcaugcacccuuuaaggaggacggugacuagauccuaaauggacaaucuacaaaaaugcucgaaugcagccguguugacaugcgggacaaacacagauaaaagaggccauuuuaucacuuagcugagugauguccaaacuguuccacguccuucaaaaguggugucuguagggccugaagaagacagacucugcccagcauuucagacccuaccuguaacugcugaaucaagaaaaccaggcaucucaccucucuuccuucaugagugaugcuuuucccguccuugacagcagcaaugaugggagcgauggcagcugucccacugaaaugaagaggcaaggccucugugaaaugugauuuccuuaaguggacagguguacccagugaguccccagaagccuuaccccccacacucacacugggaggcccaucuccuuugcuuugagcaccaagaaguuuccucucuuuaagugaagcugcaacaaagagaacauagaugugaucuuaggggcuaaugaagaagguugguuuuaaucaauuuucuuagaaguguauuuuucuagauuaaaaaaaaauaauaauguuggccaggcacgguggcucacgccuguaauuccaguacuuucggaggcugaggcgggcagaucaccugaggucaggaguuugagaccagccugaccaacguggagaaaccccgucucuacuaaaaauacaaaauuggccaggcgugguggcacgugccuguaaucccagcaacucaggaagcugaggcaggagaaucgcuugaacccagaggcggauguugcagugagccgagaucgcgccauugcacuccagccuaggcaacaaaagcgaaagucugucucaaaaaaaaaaauaaaaaauaaaaugauguuguuuccuuacaauucauuaaaaugcguuuauugcuuucagaagguauaccauauucugaagaagucauuuauugucaaaugcuuuaguacuaaaagccaaaaugacuuaaaucaguguuuuauuucccagcauuaacucauuauaaauuuaauaaaauguaauucaauaugaaaguuaauaaauauccuucaaguaucauugaggagaaacacuguucugucauucuacauuccucaauuaauagcuaaaggaaugucaccagagcguugccuaacagagcaaccagcaagcaaacugccauguaacauaauauuucaaugacagugauaggcuaacaaaagcauggaugauuuuuauuucucuuguauuuuucaauuauguggcaauauaaugucacugcuuuuaucuuggagauaaauuauaauaaaaaaucucuaauagccaggcacagcggcucaugccuguaaucccagcacuuugggaagccgaggcggguagaucaugaggucaggagaucaagaccacccuggcuaagacggugaaucccugucacuacuaaaaauacaaaaaauuagccggguguggugacgugcgccuguagucccagcuacucgggaggcugaggcaggaacccaggaggcggaagauugcagugacccgagaucgugccacugcacuccagccugggcgacagagugagacucugucucaaaaaaagaaaaagaaaaaaaaaaaaacccuaauaugcuauuacauuagaaaggcaaacaauaauucuaccagaaaacuucacaaucauuuuauaggaaaaaaaaaauuucacacaaacagaaaaaugucagaaaugacauguaggccuuugagugcuaaaugacauuugauuuccauuuucuccuuuaaaucuucaucaacugugcaucuucuuuuaacucucugaaguuaaagaguuacucguagggcugagucucaaauuuggaucugaaauccuuauucucaggguuguagaauuuuccaucuuaaaaaauaucauccuagaugaaggauuacagcuucagugugcacaucacacagugaugauugauggcugacaucuuuagauaacuaacaaccaugucacgacccaacauucucuccacacacccaaacggguuugaggauggcaacuaaaugucucuaauguuuaaaagguacuugcuguugggggcaguggcucacgccuguaaucccagcacuuugggaggcugaagcaggaggaucauuugaggucagaaauucaagaccagccuggccaacauggugaaaccccgucucuacuaaaaacacaaaaauuagccaagugugguggcgggcaccugaagucccagcuacucgggaagcugaugcaugagaaucacuugagccugggaggaggagguugcagugagcuaagauugcgccaccgcacuccagccugggcaacacagaaagacuccgucucaaaaauaaauaaauaaauaaaauaaauaaaagguaauugaaggcugggcauggugguucacuccuguaaccccagcacuuuaggaggcugaggaaggcagaucacuugaggucaggaguucgagacuagccuggccaacauggcgaaacccugugucuacuaacaauacaaaaauuagccgggcaugguggcaggcaccugugaucccagcuacacgggaggcugaggcaaggaaucacuugaaccuggaaggcagagguugcaguaagucgagauggcaacacugcacuccagccugggcaacagagcgagacuccaucucagaaaaacaaaacaaacaaagaaacauaaaggcuggucaugauggcucacgccuguaaucccagcacuuugggaggccaaggcaggcggaucaggaaaucaagagauccagaccauccuggccaacauggugaaaccccgucucuacuaaaaaaauacaaaaauuagcugggcaugguggugcgcuccuguagucccagcuacucgggaggcugaggcaggagaacugcuugacccugggaggcagagguugcagugagccaagaucgcaccacugcacuccagccuggugacagagcgagacucugucucaaaaaaagaaaaaaaaagguacuugccgacuuaaggcagggaaacccaucucccugggagcugaacucaacccauggagauauguuccucucugaggaaugcagaguaucuggaagacugaugagagccagaacgcagccaauaacgccccaacagugcaccagcugcccaaagccgaggucuuccaacagaugaguuuuucagguccucaugccaagagacuccuggaacuugaccuagcucagcuuuauugcuuuccaaaaccucaccugagagcagcaaauuaauuagaagaggggaaaggcguuauaggcuaauccagugacagcagcccucagaaggagccgcagaagacagcaaggaaggagauggaaaagccagggcaggcagcuggcagcccccaggaacggcugccugauaauagggcaacugcccgaguguguaaaagugagcuugucacuuuucaucaugcucacuguuaccuauuccggaaagcaggaauacgauuuaaagauuaccauagaaaacaguuuaaaaaucagacaauauaaauauagauuaucaaaaauaaaauauuuuuaaaacuuuaaaaaaugauuuugcuaucuaaaacucagaaacauacaaguaauaagccuguuaacaguaguacuuaacuuuuaugaaaaucacauuauucaaauaaaucgauagaaaugauacuggcaaugaucuugccacuaauauuaacuacuuacuuucauuauuauuuucacuuguagcuuuuagaauuuagauaacaauuccaaauauauuucaaaaucaacauuaaaaaauaaucuaagcccacaaaaaggcaaugaaaucuuuucacauauuuagacaaauuuguugcaaauuguauugauaaaauuuuaaugcaaaauucuauuaaaaauaagccacuagucagaucuuacaaacagcuuauuguaacaaaaauuuuuaauggaauuugaccaauuucagaguuacagaucuaggccuuugugaaugcuagcuaauauuccaauuaaucugguguuagaccuuagcuauugcaggggaaugaaauaaaguaaaacagaguuaaaagacuuugaauaaaggccugauggaguugaaggaaaacaaacacagcugccuucaauaauuucugaauucuaaaaggaccaaucauuggcaaauauaaaagaauauggaccaggcacagugcuucacgccuguaaucccagcauuuugggaggccaagguggguggaucaccugaggucaggagugaaaccagccuggccaacauggugaaaccccaucucuacuaaaaauacaaaaauuaacugggugugguggcgcgcaccuauaauccuagcuacuugggaggcugaggcaggagaaucacuugaaccugggagguggaggcugcagugagccgagauugugccacugcacacuccagccuaggcgauggagacagacauggucucaaaaaaaaaaaaaaaaaauguacggaggcugacagggcacuggaaaaaaauuuaaaaggaaauaaaaguaugggguuauuuugagaaacagagcaucuaaacucugaaaccuacaagugaugacaauuaugaaaggucaguaguaauacuuguugcaggcucauugccagugucauuucuaucgaauuuuuuuuuucuuugagagagucuugcucugucacccaggcuggagugcaauggugcaaucucaacucacugcaaccuccgccuccuguguucaagcgauucucuugccuuggccucucaaguagcugggauuacaggcaugcgccaccacacccagcuaauuuuuguauuuuuaguacagacaggguuucaccacguuggucaggcuguucucaaacuccugaccucgugauccaccugccuuggacucccaaagugcugggauuacaggcgugagccacugcacccggccuuccaucagcuuuucugaagaucugcuaucucuucuugucucagguaacaggagugccuacccucaaauuaaugaaaaagugcaaaccagaggucgcugaccaagaccccagucauguacagcccuccggaaagucuuccuuaccuuacagaugaaagcuacgaccagggaagagucccugaccccucuucucuggcuaacaccugaggaaaaacacacuugauuaucacaagguaaaugugaaagcugugaagacaucacagacugauuaugacccgauaccuaauuucacuucacauaaaaauuaauggacgcuacugucccaauacaaaggcugaagacacuaauauacucaagaagacuuuuuuucccuacuuauguggagauguguuugcguaaaugaaaaacacaaaacucucaccagaaaaacuuuagaauggcaagugaaauuuuuuuuaaaugacacauuucaccuaggacuggagaagacagagaaaaauauauuguaaugugcuuuauaacacauauaauauaugaaauaacacaaaaguucaaaggccugcagagaaaaugcuggugucagucuuuacccggugccauccaaacaaggacagcacauaggggucagccuguucucagucacuagacaagaccucaggacagaaagaggagcugccgagcuuugccaacgcugaccuucuguuaaggacaacaaacucccgaagcggccugacuccugagcuacaucucaucuuggacuuuuaacuccguuucccagugggcugucauucuggaagacgugcagagccucucacugauuugacugucucauuggcuuagcaguuauaguuuccacauuaauggaaaauuugcauaaauguuacauuaaugaaaaauacaaaaugaauccguuugucaggcccuguucuccucugggaaaacagaacacaguuuugggccuacccagacccuggguggccaaaacuguggacuggucauuauuaaaguugcaggcugccaccuuuacaacaacccuucucauucccccaacgggccaaguuauaguaagcccaggaagaaggaucuguuuacacaccuggcuuucuuacaauaaugacucucuacaagcauuacaaggcagagaauuaagaaaacgcaagccuuucugcugcucuguuuuguuuauacuauuaccauguggaagguguggcucauuuucauucgacucggagucugaagaucgcucuggacugagccugcugagaggccuuucuggacucugccaugguuggugcuuuccccuccucuguucaccuggucaguacagauaccaccaaauuacacacugcacaaggugagcugacagccaaggcccagacguucauacaugggaaugccagaacgccaauuaaaucagcacaccuuuuacuauacaguaggaaauaacuaguuaguuaacuuccuaccugguuucugggcugcaccuauguccuauuaauguuuauguuucugcuuagcucacagccucggccacaguaccaacucaacaacguguuaucuaaacagcauguggguuguagacaugcuuauuuauuaucaucacucccgcuaaaacacauagacccaaaggguaccuaucucaagaaggagccucauuuuacauuuaguuaaggcucaagaucaagggaaaaaaauucgcugcucuaagaagcuaaagcacagcugcaacgagaaugaacguaaguucacucacugagggccgcuggacacugaaaaaacagugaucggcaaaacugagcauguuaacaucgaucacgcaaaucacauaugaaaguuaacugucacaugccauggagcgaagaacagggugcuggaaauggacaacaaacagguggaugcaacucaggcuggggguggcuacagcaggggucaggugagagaaggcaucugagcaggaggagcaagccaggcaaugggagugcugaucagcucaucacagcacuggccuaggagcacuugugccauugcuccggcacauuccucuccucccugcugccuucugccuucagucaguguaagccucaucuccucgccagguucuggacuucucuggccuuugcugggugcucuggucugucacccaucagcacuacuuaguaagcaucacauuaguuaguacuaacaaggaaauaccccuacugcuugguacucucuucacauguaaguaaaaccagacaugaaugucuuuagccaaguucaaggacaagacuaacucuuuuccuaagcuaagaccacaucaucuggcccugauacuucggaauuugcaggagcuucuaacccccaacaacacuucuuuuagguugcuguaaucauuauuuauuuaaaaaaaucuaucugugcaaaccucuucaugaucgucugaucaaaagaggguauuacgccugugggaaaaaaccuccaagcaaugaaugugcaaacuugaaugcaaucuauuuaccaacagugcuugauuaucuaauauuccaaagcauaaucacuaucauuaggcauaagucagacauccguaaguuuauaagccagggcaggagccauaucuucauuccucaacuaaauuuucuaaucaugcucagaacacaaaacagggugcccacagcaaguguucaguuucuauuuucauccauguuuucuuuacucaggacguacacccuccuccugggaaaccuggcuuucauacucacuguguauggggaucugguaaacugucaugguuucauccucguauucuggggcagaguggggccgcacagcuacaagaaaaccacacaacagcaaagugauugcauuagugaagaugugugggaagaguaacuucaggaucaccaaccacgagcaacugaauugccucagaauuauggugggaaucugacacgaaaaccagacuuucuaaggagauuaccauuuuuaggaaauaaauaaaaguguauuuuggucagccauuuauauuuacuacagccagaugaaaagacauuauaaucuuuggugacuauccguuaaaaauugaaaaacaagaaacuaguacucaacuuucagagacccaaguuaacaaacagaauagugaagccagggaaccuaucaucgcaaaccagaagagcugauguauauuuugaaacaaaguauuaguguuucuauaaaagaggaguauuaacaagccacagauacacaccagugccaggacaagagcccuacuagcauccucagugaggccucuucccaucaagaggcuguaagccccccugcgcagcuggagcugcguuucaauguacaaaguuggccacaaaaccucuagggaacccuugucacccccgcccccaacucaaagcaacucaacgacgagaagcaccucuggaacugaggcaggagcccugccgucuggauggagaaugccacacagcauguacacaggcaggcaucagcuguucaaucacuccugccgaccuggccccuauuuuuacagcaugaggugggaacacagaaaaugucacuauuuagaaaucccaucuccagccacaugguagcucauuuugggaggcugaggcgggcagaucacaaggucaagagaucgagacuauccuggccaacauggugaaaccccgucucuacuaaaaauacaaaaaauuagcugagcgugauggcaugcgccuguaguccuagcuacucaggaggcugaggugggagaauggcuugaacccaggagguggagguugcagugagccgagaucaugccacugcacuccagccugguaagaaagcaagacucuauccaaaaaaaaaaaaaaaaaaaaaaaucucguggugaugaagcauuugauuuugagguuugauguugauguuuuuaauggauucuaauuugagaggucagggcauauauaaguuagaaauagcagaggaugagucacagacaaagacguacccaguucuauuccuuucaauggaccagaaaauauuuugauugcuucgagguauuuuuccuaaugaaaaacaaagaaaugagcaguuaugguugaacaaauguagaacacagcaacuauucaaguauuuaaaagguuaccaauagguaucaacauaaaacaaagcuuaguaaauauuuugaacaucauuuauuacaaauauuuacugaguauccauuauaucagaugccaaggauauagcaggaaaaagagauggaggccuugcucuaaucaggccaguggaggagacaaaaggaaacacgauaacagaaacagcuuaguggcauuaugcuaagugcucugcaaggaaaaugaaaaauacagaaggcugggauccaacuugucuagagaagaagaggcaguucuggaguaaaugacccucuagcugagcccugaagguucaguaacaauauaggcagcaauuagaagaggcagagggaacccgcggaagggcgaaaguccugaaguggccagggaguuagagggacauaagagucagcccaugcagcugcaguucagcgauggguacagauggaaguguggguagcggccggggccuacaggacuuguaggccauaucaagguguuuugauuguauugcaauggggagcccaugaagggcuuuaggguggcaagugacacacuacuuuucugucuugaagugaccucucuggcugcuguguggcagauggauuacaggaaggcgagaaugaauaugggaggcuauuguaguuuacaggcauagaaaacagaaauaaggaaggccucaauaagagacaaauggauggauuucaaacguuauuuuggggaaagacuuaacaggucuuggugacuuucuucuuaaggacuggaaaaugaacuguuauauucaacaacacacacacgccuucucaagaguguaauaagcuggacugaaagguaagaagaugucagaaauuuauugaauaaaaacaaaagcugcccuuucuugugugccuacuuggugccaaacauauaucuaauaaagugauuuagugcuuuauaugugcugcuacgucauuuaaucuuuaacaacucuaugaaacgugauagucaucuuauagaugaauaaacuaaagcucagaaagguaaaguaacuugaucaaggucacauaguuaaucagaacucaagucuuuuuaacuugaaaggggaagcguuucaacgaccagguaucucuggagggcagaagacugauuugcaaaaaggaaaauucuuguuacugauauuacaaaaggaaagauugcuuuugaaagaugugucaggaaagacucaccaguuguggagguccagaaaguacacacuuuggaagcccgguuuccuuuaaaguaagaaucauuccuaaaaaggaugcauaaaaucagaucucucaucaauuugaccugucgucacuaacaggaggagcaccccguacuaauccaacuauuuaucuacaucuccaccuuccagcuuuggaaguacaaccagggaagauguacagagcagaagugaugccagcuagagguguaacagacaccaaauauucuuuaaaugccucuagaaugggcugagcugucacuagggugaagcagcaaggcacccagugugcaaaauguaaggaaucaugcaagugaagggcuggcacccuaagugccucacccuagucucagcccugagaagggagacuggucuaacacuucacuccuuccgguccaugccaccaagcccacacaauuuggcugcaacacaauccugaccuuccgguugauagacauaaaugacaggguaaucuggacaguggguauguguguggcugccaaugugccaauggcgucugcgguaaacauauuaacuguaaucaccacugcuagacucuccaguuuacugccacaaaucucuguccccgcaacgcaagaaacuaaguggaugguaacacuuaagaggugguauccauauuaaaaucuguucuccugagucacagcuuuuaaugcucugugcugcugcugacugggcugguauaaaaagaauuccaggccaggugcgguggcucaugccuguaaucccagcacucugggaggccgagacaggaggaucgcagaaguuugagaccagccugggcaacauagcaaaaccccgucgcuacaaaacauacaaaaaaaauuagccaggugugauggggcacacguguggucccagcuauuugggaggcugaggugaggggaucaccugagcccagaaggcaaagguugcagugagccaagaucacgccacugacaaaaaaaaaaaaaaaaaaaaaaguagcugcccaccccagacuuggaaaaaugguaaagccgguuaaaaucccagagacuucccaccagccucugacacugcaaagaauauacucaccacuuaagcccccaacauuagaccagugcauucgugucaggaauauguuguccaggcgagcaaccuuuaaccuaagaaugaaaaaacauuuaaacaggauaacaugaacagaacaaggaccacuuuugcuauaaaaaacaacuggccucucauuucggcuuucaagccccguaaucaacucccccuccgaaagcaagagacugacucacuugugcuccugcaugagucucugaacgccuucuccacaguugaagagauaccuacaagacaaacauuacacaagacauucagaagguuuuauucuguaaacucucugacaccaauuagauguuuuauuguagacucuggaaaaaaaaaaaagaaaaaaaaauuaaaaguccacguuggacuaccgagccacauuuaugcugguggguuuugagcccuccuuagcagagguggagaggagugggggccugugugugugggugcuaggacaaaaugaguccuuucuccaccaccggcuacacaccagaucuguccaccccacacgcuaacaacgacacacuggccuuggggugcacggaagaggguggagcuccgaaagugcugacagccaggccggggcccaaggguugggaaaaggacgcucagacccaggccugaaguucuucacagauccgcagaaaucacauggaugcaaagaaucucggauuucccacccaccauaacuccacgaacccccgcaacagugaaccacaugugugaagcagggaagccgaagcccugggaggugccccgaugcucagaggcugcgccgcacugagggcccagcgggacggggcguggcucguugacugaccgguugaacucggagaagacguagagcgcggcgcccgagucccggcuacccgcugccaccaccugcagguacacgguguuugggccgccggagcaccccgacgguccgcgcuucucucgcgugcgcaggugccgcagcggguccuugcgcggccgcucgcggcgggcgggugccugcgauauggugcgucccugcgacauggugcguccggccgcggaccgcagcagcgagcaaagcgcccacaugcgcccgucuccaccaaaacugagaaagccgccggucaccuacgcccgcguuucccgugcaccaccuagccgcuccgcauggcg

SEQ ID NO: 16616 - RNA, 55429 nt, Homo sapiens
ucuacuuugugucagcaaguucagcgugggccccguaugcugccguggaucugaucagcugaggccugagacacaggaccagguacauugggaggaaagagcugauuggagaaggucugggccacaugaggguuugccugagagaugccagaauggggggcuccugaugucugaggacccucugugcccaugaggcaggcggauugucaaaggcugagguccauuuggaaaguugguuaugucccuguggcaugaggguugggugacauaaagagacggcuuuggugguuuccugaaaccauaucauuugcgcacaucuucccccugauauucugaucaccuugauuugguuuccuauuuccugaacugcccacauagcauuuuucuggguugcagagggaguucauaggguucugacagguuuaucuggagccaacagagacagucagugagaugcacugaagccaugcugagcugaccaaguuaggggcuugcgaucauguccugggaccuugacuucacugcucaugggccauuugcuucccucugaacguguuuucucaucuacaaaauguaagacaucucuauuuuuuuggauguuuguaaacuuaagcagaaugaugauugugaagguguuuuguaaacuguaugauuguauucuucaggguuugggguuacuuuuauuucauuuuguaaauggaacuagaugauuuuuccugauaauauaauaucugauaaaaauuuaaucaguacagagacauugaaaguguuugcauaauucuaucucuaaagauuaauauuuuggcauauagacaucuagacuuuuaaaugaauauuuuuaugucaaauucuacuuacugucuuucaaccuuuuuuucacuuaauaguaucucuugagugucaucucuuguuaauucauaauuaucuaccuuguccuuuuuaacagcuauguaguauuccauuguguggcuguaccaugauuuauuaaaccagucuccuauugguggguguuuaggguguuuccaauuuauuucuauaauaauaaacagugccacaguaaacaucacugaauguacaucuuugcauacuauuauuuccuuagaauaaauccuuagauguuggauugcuaggugaaagguuguacauauauuuaguuuucauucauuuguccagauucccuuaagaaaugucguaccauggccgggcgcgguggcucacgccuguaaucccagcacuuugggaggccaaggcuggcggaucaugaggucaggauaucgagaccauccuggcuaacauggugaaaccccgucucuacuaaaaauacaaaaaauuagccgggcgugguguugggcaccuguagucccagcuacccgggaggcugaggcaggagaauggugugaacuugggaggcggagcuggcagugagcugagaucgcgccacugcacucuagccuggacgacagagcgagacuccaucucaaaaaaaaaaagugucauaccaucuuauuuauuuauuugaggccgggucuugcuauguugcccagccuggugugaaacacuggccucaagagauccucccaccucagccuccugaguagcugggauuacaggcuugagccacuguaccuucauuugcuuaguuuuuagauacauaucacugauuccucucuaacagaccuauaaaauuccuggcaauaugaucaacacauuagauuaucucucagucucuauuaucuauuagauuaucucucagucucuuucucuuauuccucagagacaucugccuggugccucauccuacugcucccucuuggauugguuucuccccaggacugcugaauguugucaucuuaggaguucccuuuucucuuucuugugugaauccucucucuuuuggauaccaccuuccuuucuuccucccucccucccucccucccuccugccucuucucucuuucugucucucugucucccucucucccucucucuuucucucuuucuuucuuuuuugagaugggaucuugcucuguugcccaggcuggagugcaguggugcgaucacagcuuacuacagucuugaauucccgggcuuaagccauccucccaccucagccugccaaguagcuggggccacaggugucugccaucauacuuggcuaauuuuuugcauuuuuuuagagacgagguuuugccacuuuuuaauuuauauguauacuuuuuuuugccacuuuauaguuuuaacauuuauuuauuuauuuauuuauuuagagauagggucucacucuguugcccaggcuggagugcaguggcgcaaucacagcucacugcagccucgaccucccugggcucgggugauucucuuagcucagccuccugaguagcugggacuacaggcacgugcugccauacuuggcugauuuuuguauuuuuuguagagacagggcuucaccauguugccuaggcuguucuggaacuccugggcucuugccucggucucccagcgcugggauuacaggcgugagacaccuauuuuccauuuuuaaugugccuugcccauuuuacauuuuuuauugugguaaauagauggagucucgcacuguugcccaggcuggagugugauggcgcgaucucaguucacugcaaccucugucucccagguucaagcgauucuccugccucagccuccugaguagccgggauuacaggcgccugccaccauguccggcuacuuuuuuguauuuuuaguagagaugggguuucaccaugauggccaggcuggucuugaacaccugaccucgugauccacccgucuccgccucccaaagugcugggauuacaggcaugagccaccgcgccuggcccauuuuaaucauuuuuaagcguacaguucaguggcauuaaguacguucacauuguugugcuuacugucaccaccacccaucuccagaacuucuucaucuucccaaacugaaacucuguacccauuaagcacugaauccccauuuuccccucccucccaggcccuggcaaccaucauucuacuuuccguuucuaugaauuucacucuucuaauuaccucauaugaggagaaucauacaguacuugucuguuuguauggaucucacauuuuccccuuuauuuucuucccuguuuuggugacaugcaucuuccaaugacaggagguaauuuugauagguuuugacuaucuggaaacaguccuucauucuauucuuauacuuguugaagggucuggcuugauuuagaauacuuguuggaaaugauuuuuuucucugaauguuaaaggcaaugguucauuguuuucaagcuucuaguuuauuguugaagucuucugcuauuaugauucaggauccuuuguacuuguccugguuuuaugucuguggaaguuuuuaggagugucuugucaucccuaggauucugaaauuucaucuguggguguuuuuucaucgauuguccugcguacucaggagacccuuucaaucugggugcucauguuauucaauucuggaggaaucucuugaauuauuaucuuaaaauaauuccuuccuccucauuuccccuguacuugcuuucugaaacuccuauuauuugaauauuagacuuugggguuuauccucucauuuucuuccuuuaaucuccuguuugggugaucugucuuuuguucuccuguuuuggaagauuuucucaauuuaauggucaugcucuucaaaugaauauuuuaauuucaacccucauugauuuuuaaaaagcgcucuuguucucacuucuuuuuuugaagccccguguucuuguuucaugauguaaugcuuuuguuuauuucucugaagauauuaaacauuuuuuccagcuuacuuaugcucccugcauugugucuauugcugcugaaucucucucucuuucuuuuuuucuuuuuuauuucuuucuuuuuuucgagacagacucuugcucugucucccaggcuggaguacaacagugcaaucucggcucauugcaaccucugccucccaugucgaagugauucuugugccucagccucccgaauagcugggauuacaggcaugugccaccaugccuggcugauuuuuguauuuugaccucaagagaucugcccaccuuggccucccaaagugcugggauuacaggcaugagccacugugcgcagccucuuuuuucuuuuucuuuuccugaaccuauggauuauauugaagcccuugaauuucuuuuaugcuauuuuguucuaucuuucacauuggaggcuuccucaaauguuugcugauuccuuguugaauguucauuuuuauguucaaggaacuagaagccgauugaaggguguuugggucugugucugugcgugugucuguaucuggcccugguuguuggaucucuguguauggugaucaaauggggggaccaguccaaaugauugggaaccccccagaagaaugcuccaaucuccugccuggaggauacaagccaggcugcuaacauucuagggggcaucaggggacacgagggggucucaucauucuguauguagcuucaaagacuuccccucucccaaauccuucuucccuuuauguagugacuuaacccugcccucggauguguccagucuccccagaucuggagcuauucugguuuaguuccuccagaaagcaaaccuccuucuccugcuggggugggagagaaguagaugccuuggcuuguugauugccugggcugugaagccuguguugaaaugcuuuguaaacacaucauauguuucgacagaucuuccuguuuuuagccccacccuaccuugcuuuucaaaguagcccgcaccuccaguuacugagacuuucuggaguuagaggcccagcacugcuugcuucugguuggcauuuaguuuucagccuuuucugaucuacugcgucagcugucgcuuacucauccacuuuccagcuuccaaaauccuguugacaucccuuguccacuguuguuuccuuuccuaucaucugucccuguggguuuauaccuuuuaaaauuuuuguucgaucuuucuuuuuggugggauuucaagaggaagugaagauacacguguuuaauccaucaugguaacugagaugguuacugcauuuuucacucugugaccagcauggcaggagacagugggcuuccuuacacuuuacuaacauuggguauuaccauuugucuuaaauuuugcuaaucugauaagcaaaaagcaaggagauaucucagugucauuuuaauuuauguuuaaaaguuauuaaugauguagcugagggucuucuuagguguuuauuggccauuuauaucucuucuaugaaccaucuauuuguguccauugcucauuuuucuacuagggcaggacgacuguuaaauuauuaauguauggccagcucuauaaaaaaguuuauggcugcuuccuuccuuccuuccuucuuuccuuccuuccuuccuucccucccucccuccuucaucucucucucucuuucucuuuucuuucucucucucucucucuuuccuuccuuccuuuguucuuuccuuccuuccuucccucccucccucccuaccucccuccuuucuuucuuuucuuuuccuuuucuuuucuuucuuccucucucucucucucuuucucuuucucucucuucuuuuuuauuuuuuugaccaagucucacucuaucacccaggcuggagugcaguggugugaucacgguucacugcagcaucaaccuccugggcucaagugauccucccaccagagccucccaaguagcugagacuauaagcacacaccaccaugccuggcuauuuuuuuuuauuuuguauagacgcagugucuugccauguugcccuggaugauuuugaacuccuggccucaaacaauccuccugccuggggcucucagagugcugggauuacaggugugagucaccacaccuggccugaucccuuauuuucuuguauaugcagucucagagcagacuucagaaaauagugauucuuaaugaauucaucuaaaguguuugacgauuuucuucccuuagauuaucaaaguaacguguauuugcuauagaaaauuuggaaaauacugauaaacacaaaaaagaaaauaugaauuacucagagauaaccaccacuuauaaauauauccagucuaauacauauaaauauauuccagucuuuuuuucugagcauauacuuauaaaaagaaaaguggaguaauuuuauuuugugucaugcucucaacuuaugaaaucauaauuuguuuucauaugcauuguucuaugacaucauuuccagugaccauacaguauuucuuugcauguauauacaaucauuuauuuagccaaucuccuaaaugacacacauuuagguuucuauuggguuaaaauuuugauuaacaaguuccucucuugaucacgaccccaucuaauccuguuuccaccauguaucugcuuagcauucucuuuuuuugggggaaaaaggaaaaagguaaacuuuaauucuuuuucagguuacauuauuacuaauuccaauuuaaugaauacagacucauagagauuuucuagcacuuuccauguuuguugcugggucagagggagugaucgggaagggucauucugggacccucauuagauaccuccacagcuuugcaucacagugaaacugacgagggccagaagcacccaugaaggagugcaagaaggaaugaggagaauaaagaagcagaucacccgagaaauaauagcuuaacggagagaaaaauccaaagacacagacuggucuaagagcugaagaccugaauucugucccugagucggccacuaacgcagucucauguguccuugggcagauggcucaacacuucccugguuuucuuauguggcagauuauuucaagguucucuucuacgucugagggucuaugaaugcugaccuugucauacuagcugugugaccuuggagacguugcuuaaccucucuaggacuggguuuccucaucuguaaagugggaacaugaauagcugcuucauagcauuguugugaaugaguguuuguaaagcacuuacgagaguuaaguucucugagccugcucugguucaagaggcugcccccccaaaauaaaaaauaaaacacuucacacagggccugucccauacuaaauauucaauaaaugauagcuauuuuuuuaaauugcaugcugacuguuauguaagaagaggacaauuacaucaucccacacucuguguacagaaaggacucuuggcuucucaaaagugguuucaaaguucaauuugcaucugggacagaugccaaagggcaaacuacaaagucaccacuggccacugaccuccauucucagcuuauucuucccuggggccuggacgcuguccagauguaggucaaguaaacaggcugcuguuuaacacagauaagucagauguaugaaugcugguugacaggggaagcaaagggaagcccuuuauauaagcccuuguaagucucauuauauauuuuucaaauauaaaauaccuaugaguguaagagaaggagaaccaagccuuagauuauaugaaucaucaauguuagggaugcuauuaaggaaaagcugacguacuuugaaguugucauugaugagcauggagacaggaagcagaaguuguggguguagcugaaguuuugcucuuugcugguguguauucuuggacaaauuacccuuuucuguaaauucaguaggcuggacuauauuuuuauucccuaagugauggucuguguacuacuggugacaggcagauugauguuaagugguaagagaugcacauuugaaauuucaauaguuagguauuuauuuuagggaauguuagggaaaauaugauuaacaucaauucuauaguuucauagagaugaucauuuagaaugagguuaauggaagauuuaagcuaaucuuuaaauaaaugaguacauuccaauaaauauucaaagaugauaugcagaaacagcaaauaaugugcaggugguacaacuggaagaucagaaagggguaggcagaauaauaggccccccaaaaauguucacauccuaauccccagaaccuguauguuaccuuauauggcaaaagggacuuugcagacaugauuaaauuaaggcuuuugagauggggggauuaucugggucagcucaauguaaucagaaggguccuuaaaagagggaggcuuaucaaagucagagaaggcaauaugaugauggaagcagcuauuggaacaaaugcagccacaagccaaggagcgcugguggccucuagaagcuggaggaggcaagaaacugacucucuccgagcuuucaggaggaaccaacgcugcccgacaccuugauuuuagcucuuuaaguaucgguuuagacacuacugaccuucagaagugcaagaagauaaaucuauuguuuuaagccaccaggcuugugguaauuauagcagccacaggaaacaaauacaccagaccuuagaugcccaugaagugguucauucugcaagaucagcaauuccuuagggcauagaaaggaacguuggcaagaauaagacuauccuuagucauuacccucacccucccaggagagggcugacucugccaucacauucugcagacuggccaaggagaggaagggcucucugcuccaccgggauggugcuuggcuagaugucaggguggguccugacucacucacugucaacaaugucaucugguucaaccugcucauuuuacagaugaagaaacugaggcccagagaagggaagucacuuuaacaaaaucagcugggauggcgcugauuuggccaaggugaauaacaugaggcauggcuggguucucacaccagugugggagcccugagaaaagguggugccugcaauggcuggggguggaggguagaccuugcuguccuuugauccucugcucuaugucucugggccucuugcuuucaaacuacuuccucuaauaucuuuuuauugggguguuaauaaccauccuguuaacacauaaucuuuagaaaauuguugaaacagcaacgugcuuggagaaagggcuccccugccucuccccuccacccccaccuuuuuuuguuguuguugacggagucucgcucuauugcccaggcuggagugcaguggugcgaucuuggcucacugcaaccucugccuccuggguucaggugauucuccugccucagccucccaagcagcugggauuacaggcacccgccaccaugcccagcccccugccuccccuuuaucuuguccccagcacuucagugaaugucuucucuucugccaggccugcuucccucuccuggaaggggcauuucuacugugauuaacauggaaacugggauguuucaggucugcaauucaguguuuaugaguaaaaauccaccucuauaguauaggcacuccugagugaagaagucccgucgccuaauuuucaacggaaaauguuuuccauguaaaggccauaaaaccaccuuguaauuuucuuuuuuccuuuuccuuuuuuuuuugagacggagucuugcucugucacccaggcuggagugcaauggugcgaucucggcucacugcaaccucugucucccagguucaagcaauucucugccucagccuccugagcagcugggauuacaggcacccacuaccacacccggcuaauuuuuguauuuuuaguagagacaggguuucaucauguuggcuggucuugaacuccugaccucgugauccacccgccucagccucccaaagugcugggauuacaggcaugagccacugcgcccagcccuccuuguaauuucgaagcagacaucuagauuuguguuguaucucauagggauggaugaaaacuagugugaaauuucuucugugaucccauguacuguuauuuuaucauauuaaguuuuaguuuuaaaugguugggguauuauuuuguucuuauuucgaaaauggucaccagacaagugacccccccuagagaagcaauccuuaacauuccagauuagugacaguugacaucccagguaauucuaccacucaaagucucagauaucauuauguuuucaguuaguagguguuuagaagguaugaaauugaaaagauuguagggcagaaacuuacacuggagagccaguauauauguucaaaagagggaaguguaguccggguguggugguucaugccuaucaucccagcacuuugggaggcugagacgggcagauugccugaggccaggcgguagagaccagccugaccaacauggcaaaaccccaucucuacuaaaaauacaaaaaauagccaggcaugguugugcauuccuguaaucccaccuauucaggaggcugaggcaggagaauugcuugaacacaggaggcgaagguugcagugagccgagaucaggccacugcacuccagucugggugacagagcaagacucugucucaaaaacaaacaaacaaacaaacaaaaaaggagggaauuguacaugacaacauacauaacaucagguuggacuaauuagggagucauagcagaagugaauuaauuccuaagaucuguguugcagaauugggagcccuuccuuugaggcuuuacugacaugagugcucaggucacucuuguaucuacugggguuacuuggcugaaaggcugccuuuuaaaaaaauuuuaacagauccuaaauccauaggcuuaggaaauaguuuacaucauuuacaaagaauuuugaggaaauuaccuugcuuuguuaaguuuggaugcauccuuauuuuuuaaacuuuagaaaauuacacguuuaagacauuuuugauaaaaauacagaaaagaaaaaaaggaaggaagaacagacgagagagagauuagacugugaucucaccucauuuugguguuuuugucccuagacccuuugucuaacguauaacguauguauguuguucuacuuuacaaagaugggaucccauaccgauuguugaguuaauugcuugauucauuuaacugcauauuguggacauuuuccuuauuaauauucuucuguaacguuguuaccauuugguuacuauuauauuguguagcuauuacaucauuccacuucauuaguccuuuaguccuuguuguuccuaauuuuuugcuaaacaaugcuuugaugaacauccuguuggacaauuugcacacauccuuaauacuucccuuuagguaaauuccuagaagcagaacgcuggaucacaaagguugcaccuuuguuuuuuguuuuguuuuguuguuuuguuuuucuuuuguuuugagacggagucuuguucugucgcccaggcuggagcgcaguggcgcgaucucagcucacaggaagcaccgccucccggguucacgccauucuccugccucagccuccugaguagcugggacuacgggcacccgccaacaugccuggcuaauuuuuuuuuguauuuuuaguagagaugggguuucaccguguuagccaggauggucucgaucuccugaccucgugauccacccgccuuggccucccaaagugcugggauuacaggcgugagccaccgcgcccacagcccuuuguuuuuuuaauauaaaguuuuuauuccuuuuacauuuuuuguagagacgggcucucacugucuugcucaggcuggucuugaacuccugggcucaagcgguccucuugccuugcugccacggugcugggauuauaggcgugaacccccaugccuagccgagguuccacguuucuaaguguuugauacaggcugcuaaacugcuuaccaagaacugugacauccuccuuagcccuuuucacgagggugcucguuucucagugcucuuguaugcauuuguagucuaauguuuuagaaucucuuauaccuguuggaugaaauauagacucucuucuuugcuauccuacuuugaauguguuugauuaggaucaaggcaggauaugauucacauguuucuuagccaccugcauuuaaaaauuuugucaauugcuucuuauugcuuguuucuaaagggaaguucuuuauuagaguucuaaacuaaaaaagugcuuugaggccaggcgcaguggcgcaugccuguaauccuagcacuuugggaggccaagguggaggaucgcuugagccuaggaguuugagaccagccugggcaacguggugaaaccccaucucuacaaaaaguacaaaaauuagcugggugugguggcacaugccuguggucccaaguacuugagaggcugaggucgggggaucaccugagcccaggaggucaaggcugcagucaacugugagagaaccacugcacuccagccuuggugacagagugagaccuugucucaaaaaaaaaaaaaaaaucauugaaagcuuuuauucauugaauaaauguuaacugcccauaacaugccaggcauuggggccagagauaaauaagucauggccgcugcccuagaugcuaccuuaaauguaaaauauuaaaaaaaccuugacuaauuuuuucuccuuagcacuuguuacugcuggcauacucaggguucuuugucuuuuuuuuuuuucuuuuuucuuuuuugaguuaaggucuugcucuguuacccaggcaaccaacccaugguacaaucauggcucacugcagccccaaaucccuggccuccagccauccucccaccucaggcuacagaauagcuaggauuacaaauguaagccaccuugcccagcuaauuuuuaaauuuacguggagaugggucucgccauguuacacaggcugguuuugaauuccuggccucaagugauccucccaccuuagccuccuaaaguguugggauuacuggaguaagcccuugagcccagccucucugucuauuucuguuucccuucuauuuuccuucuuuuuguuuuuucauuuuuagaaaaucuccaggaaggaaagaauuuagcuucuuuuguuaauugugcuaugccaggcaucuagaacagggccaggcccucauuaaauauuuguugaaugguuggaagcaugaucuuuugguccuggcaacuuugacucauuggcuuaccugguaaugggaaucgggcuaaaauugcuuaauaagcuuagacugguaagaaacacuccauuucuuuucagccccgucauuucauuagucuaguuugggaguagguaaaccuggcgccaccuugucuguauaaagguaugugagcacauaucauuuuuucccagggacagucacacuguuuauggaggugugaugucaacagcccuugggguugccagguguuaacccaaugggcaauuaacagugucaugccauccuuuucuugggaggcagcugccacucugggguguggguagugccugucacguggucgggaugagagccaaggaugauagugaagccugaagcuuggggaagucaggaaaaccgugagguuccagaucagcaggaaguccacaguuaagggagccuucugggaagaaauuaggaccagccagagauucaugggagcauggcaggguaucaaguuccaucaauaggggagaaaaggccagacaaaccucaauaggggauuaaaggcucuugaaaccucaguuuaccccccagauaaggaugaggucucuuucuuuccagguaccaucacccagggcaggaccuucauaggaaggccuguuucagccgcaaccuaaacuguucucauuuuucucuuuucuaaaagccaccuuccagcaggcuacaccuggcggccugcacaaggcaaagcaccuuccuggcaagggagccaagggccagaagcaggccgcauucucaggcacaguggaaagggaaggaaagggaagggggcuuggaaccuaagacacugcauagcaaauucaucucuacccaauuccagccuuucuguugacuuacagccaacuggaguuugaaaguguggggauaaacugaugggagagcugagguuugggagucugagcugcuuugaguggucggugagcucuguuugcuccagaagcuaaugaggaugcaauaaagacaacaaauagaaccuucuuucccuuugggcuauuccuggguauaggaauagcccaggcuggcuguuuguggcuggcugggucagggaccgaaccauagugagcauuuuugaaucggacaugaguugguuaccauucaaagucuuggaagggaggcugggcaugguggcucaugccuguaaucccaggacuuugggaggccgaggcaggcagaucauuugaggccaggaguucaagaccugucuggccaacauggugacaccccgucucuacuaaaaauacaaacaauuagcugggugugguggugcaggccuauaguuccagcuacucgggggcgggaggcugaggcaggagaaucgcuugaaccugggaggcagaggucucagugagccaagcucgcgccacugcacuccagccugggcgacagagcaagacucugucucaaaacaaaaacaaaaaacagacaaacaauaaaaccacccaaagucuuggagggggaaauuaaucuccugguugaaggcucuggcauucuguggacugcccagcaagccauuuauacgaccaauauuuauugagugcccacucagugacaaguguuaugaugaaaaauuaagaugcauuucucuauuuaaggcauuugcauguacuuuuauguucuuuuaaaauuucacaucuugguuacaucuuauauugcagucuuugguuuuaagggccuugacaacuuuacggaggaagagaauccuaugaauaugaagcccuauuuucacucagggagcagcccugccacacuauauccuuugccaugguuguuuuucuuuauagcauuucucaugaccuggcagaaauagauuagucugcuugcuuguugucuauuuucccuuuagaauauaagcuaauuauauuggguagggguugggggugcuuuuuaaaguuguggugggauauccauggcuuagaacagugccugguccucagcaggcacuaaacuccuugcuaaugaaugaaagacuuuucucucuauauaaaaccacuucucgccucaaggcucaagugugugugguguguguguguguguguguguguguguguguguguguauuuuuuuuuuuuuuuuuuccgagacagagucucauucuguugcccaggcuggaguguaguggugugaccuuggcucacugcaaccuccgccucccagguucaagcaauucuccugccucagccucccgaguagcugggauuacaggcaugugccaccacacccggcuacuuuuuguauuuuuaguagacaugggguuucaccauacuggccaggcuggucucgaacuccugaccucgugaucugaccacccuggccucccaaagugcugggauuauaggugugagcccccaugccuggccccaaguguauauuuuuaagauuuuuguuuuuuugagauggagucucuuucacccaggccagacugcaguggcaugaucucggcucacugcaagcuccgccucccagguucacaccauucuccugccucagccucccgaguagcugggacuacgggcuccugccaccacgcccggcuaauuuuuuguauuuuuaguagagacgggguuucaccguguuagccaagauggucucgaucuccugaccuugugaucugccugccuuggccucccaaagugcugggauuacaggcaugagccaccgcgcccggccuauuuuuaagauuuuaaaaacacauuauuauuaauauuauuuaauuacaaaagcaaaggauauugcauuagggauuauagacgcuauggccuggguuuaagauuuaggcuagagaaaaggcauaguugccuaugacccaaaucuuaguuccuuuguaaccuauaucaucuaaguucagccuuucauaccagcgaaaaucucugucuauggugacuuuuuucaggauuugggguauuuuccagaauguucugucagucuugccuuugaaguuauagccaccagaccauugguucauucuuucacuuucguugaagcauauuaaaugaguguuugcuaagugccuguugcuggggauauauuaagacaaucaacacugucccuacacucagugaguuuugguuucuugggggagauuggacaucucuguaaccaaaaggccauguuuaauaagucucuugugaacuguguagagcuccaugugagcucagaggaaggagugcucacuuugggacuuugaguaucagggaaggcuuccuggaggagcuagcauaugagugagacuucaaaaggcagaggagaagguggguuggccaagccuaggcagcagcugcaguguaaagggcaggggaagucaacaagauaggcccauagaggaagggaaucaucuauuugggggaccaugcuggugggucuggccagaccuagagaggugauccauaggauauagaccguagaagugggcuggaguugcuuugggaaggccuugaguaugagacuacuuuguuccuuaucacaaagguaacaagaugccaaaacaaguuuuggaggcagggaugcucugcauacagugagauuuuagaaagauuauucuuaugguuauguguggacugcugggcugaaacaagaagaaauucgagggagagaaguuuggggagagagggacagacaaauaagaaacuuuggauuaugggcgaugugggaagaaaguacugaaauaugacuagauuuacuugaguuuaggaagggaaagucuuugggcuuuggugaccacaugcgugagaugcaagcuggggagggaaaugauuagggggauuugaugagugccuugugcuucacugacuggaaugauggcaccauuggcagaaacaugaaaauuguuuuggaaauuucuguuggggcaaaggaaaaucuguuugggguuucggcauguagagcuggaggugguggugggacaucugguggacauaucugccagaccauuagcaacuggccagucagugggugucccuugcccagcuagaucuauacccuuagagauuagcaaaaaaugcuggccaaaggaauagagagagauuagguugaagcugauuuugagaugucuugcucaccugauucaguagaguuaaguaugccccaucucgucagaauuuccacagugggccugugugcauuacauaucaccuucugugagugugugauguggccgaaguccagcaucuuuacuagcuaggguucgggcuuguacccagaucucucuuaggguagccggucaaccuccacccuucccagugguggaaucuggccucuguuuccugaaucucagaguuugugacaggagagauguugggauccucaugcaugcucucagggacugugacauuaaccucuuuggcucaauccaagaaagaccuuguacugggacccaugccucggcaaaccccuuccuaaugauuuauaaaggcagaggguagggcagcccucacucaccuuuuuuaccaccacaagggcugguuuuauaacuucuguucccuuucggggcugauuuccaucuuccuuuccacuuuauuuuuucuggauuugguauauuggaagcaggggcuggggcaaagguugcugaugguuaauugccaugcccagccccugggcccaucucccagggagaaagcucaaccacaagggggaaggaauuacaucaguuugggcccuucggcaccucuuagaauccugccaggcaaagcccguucauuaagauaaggccaauaguccaguccugacaaacaccaguuuuggguccaggccgcgugggagggguggcagcuuggaagaugaugccaacauuuuccgaggggccuggccugccauuagaugacucagugcguuucccagcaccucagccaggaggcagggagagagccgcagcccuuauuaauuuuuuuccucuugggauaggacuguuuugucuuggcaccagguccacaggaaagccuucauucauccccucccugucugugaucucaucagccagagcacagcuucacccagggaagcagagccccagagccugaacgagcuguaccaguccauugucccaggccacuggccuugaaguaagaccuacuugaguuuaagcccuagcuccucugggucucaguuuacaauauguacaauggaagcaauaaucacagccucacaggcucauugugaggacugagggagggaaagcauguaaagcacuuagcacagugcucuagcccaauacaugguaguaauugcuaauacucccccuucuugaguagcaauauaauaguuguuaauaguguguuuucuggagaguuagacaauucgaacaggguggguuugaggcuugaggccucaucuuucuaguugagagacuuugggaaacuucaucuugcugagucuguuuccucauuuaaaaaaugggaauaacacuaccuaucucaugggauuacugugaggaugaaauuaagcagaccaaguguuuagcacaguugccagugcauacaagagaacuucggaaaguucauagaaaaauggaauuaaaagauaaaauuaaaagauauaaacuuuauuucucaacguaagcucccucaaggucaagacaccuuuuuuuuuuuuuuugaaacaggcuugcucugucacccaguggcaugaucuuggcucacugcaacuuccaccucccagguucaagcgguucucaagcuucacccaccugaguagcugggauuacaggcacaugccaucacauucagcuaauuuuucuauauuuuuaguagagacgggguuucaccauguuggccaggcuagucuuggacuccuggccucaagugaucuacccgccccaggucucccaaagugcugagauuacaggugugagccacugugcccagccaaggucaggauacuuucguaaccaugauaucagccauuuauuuaguacaucccuaaagaauugaggaucuggggauuuuaagcauguuaaugcagucuuuuuuacauuauuaacugaagaaaaauggcuacccuuuaaagagauauauauauauauuuauauauaaauauauauauuauauauaaauauaaauauaaauauauauauauuuaauggcaggccaauauauauauauuuuuugagacagagucucgcucuguugcccaggcuggaguguaguggcgcgaucucggcucacugcaagcuccgccucccggguucaugccauucuccugccucagccucccaaguagcugggacuacaggcguccaccacuacacccagcuaauuuuuuggauuuuuaguagagacggguuuucaccguguuagccaggauggucucgaucuccugaccucgugauccgccugccucggcuucccaaagugcugggauuacaggcaugagccacugcgccuggccuaaagauuuuuuaagauuaggaaacaaaaagucuucagagggagccaaauugggacuguaaggugaugucuacugauuuuccacugaaacucuugcaaaauugcccuuguuugaugagagaaaugagcaggaacuuuaucaugguggaaaggucucucugaugaagguuuccugggcauuuuuccacuaaagcuuuggcuaaucuucucaaaacacucucguaauaaguacguuauuauucuuuagcccuccagaaagcaaaaugccuagaacaacccacaaaaugguugccaugauuuuugcucuugacugguucacuuugcuuugacuggacuacuuccaucucuugguagccaccgcuuugucuucaggauuguacugguaaagcgaaguuucauucuugguuacaauucuucaaaaaaaaaaaaagcuucaggaucuugaucccacuuguuuaaaaugugugaaauuuugaaagcucuguucuugucagcagcugaccugggcacaaugguuuugccacccauuggguggaaaguuagcucaacuuuaauuuuucaguaaggauuguguaggccaaaucuguugagauaucuguggugcuggcuauuguuucugcuguuaaucauugauccuuuucaauuagcacaugaacaagauuacuuuuuuuccucacaaauugauguggagggucugcugcugugggcuucaucuucaacaucaucauguuucuucuuaaaaugaauuauccauuuguaaacugcugacuucuuuuggggcuuuguccuuuuacacuuuuauaaagcgucaaugauuccaccauuuuuccacccaggcuucaccauaaauuuaguauuuuguauugcuucaauuuuguagaauauguguucugauagggacucucuucaaacugauuucuuaucuuucuuggugcuucaagcuagauccuguucagacauguuauagcaaguuagaacaaauuuauuuuggugcaaacauuuauuuuauuuuuuuagagacaggugucucacugugcugcccaggcuggucucgaacuucugggcucaagugaucugucuaccucagcuucccagagugcugggauuacagguaugggccaccaugcuuggcccugugcaaaaaaaaaauuggaaauccaugcauaguuuuuucauaauaugcauauuauucauaauauuauucauaauaggcauauguaauauguuaccuuucccacaaaccccauuaaucccuucucugaucuuuauugauuuggguaccucuuacaauccaucuugcauuguuccuguuuauguccaucgcccucaaaaauauaaacugggccuccuaggcucacuuuguuuucaccuugaggcaugucuuacacauuauuuuuguguucacacccacaaauccaauccuaaaagcacugaaauuggaaaggauuacauugcgugccgcauggaggcuggugccuguaaucccaggacuuuguggggggcugaggugggaagauugccugaagucaggaguucuuuuuuguuuuguuuuguuuguuuuuagacggagucucacucugucgcccagguuagagugcaguggugcucacugcaaccuccgccucccggguucgagcgauucuccugccucagccuccggaguagcuaggauuacaggugcccaccaucaugccuggcuaauuuuuguacuuuuaguagagacaggguuucaccauguuggccaggcuggucucgaaguccuggccucaggugauuugcccgccucggcuucccaaagugcugcagcgccuggccgaagucaggaguucuugaccagccugggcaacacaguagaccccaucuccuaaaggaaaggauuaccuuguacauuauacagcaaaaguucuuaaaauuguuuuuaaaauguaucucuuccuuuaaguuuccacucccuauguaaguugccuaucccucuuucccuccuuuuugggcuaguaucgucuccagcuugcuuccaaguccgcuagggaauacacacgcgcgcacacacacauacacguguguguuuacguacuaaaaauauauaaacauuaauaaugcaagauggggccgggcgcugugucucacgccuguaaucccagcacuuugggaggccgaggcgggcggaucacgaggucaggaguucgagaccagccuggccaacauggugaaaccccgucucuacuaaaaauacaaaaauuagucgggcgugguggcaggcgccuguaaucccagcuacuagggaggcugaggcaggagaauugcuuaaaccugggaggcggagguugcagugagccgagaucgcgccacugcacuccagccugggcaacaagagcgaaacuccgucucaaaaacaaacaaacaaacaaacaaacaaaaaccaagauggauuguaagagguauauauauacacauaggacuccauuucuugggggaccuggaggggagaaagucacacccauacacacacguacacgcauguauacaaaaaugaauauaugcucagauauauacaauauauaaaugggcaaauauaaaauccccuuugugccaacgaauccauucauucauucaucaaauauuugagcguccacuuugccuagaaccaaguuaucuguugggaugagcaaggcauaagagguucuagcucucauagaacuuagaauucuacuggaggaagaugagaacaaauacaaaauguaaacaguggaaguucuguaaaaacaacacagagcuuugugagagugaugcuuagaaugcuccugauguuccauuggguguucgagcagggggaauggacucggaggugaacuaugagccgagauucauuuuauaaacgggaacacagacacauggacacuugaagggccuugguggccagaaaacugaaggcagguucccauccgucuuggcaccacucucccgaauagcaguuucagggaacugcacaagccaaaaccagccggucgcagaguccaggagcgccugcgcaagaggacgccugcgcaagaggacgccgucagcuuggcgucagcgcgccgggcucuggcccgcccccugugacaccagccccgccccaccccgccccgcauacccgugcgcugccgcgcaugcuccgagccccgcccccgugcgucacagaauggccucggacacccaggcagucccugacgugucggggaggagccgggcgcggagguacgcugaguggagcucggggcugcguaggggagcugagccgagcggcugggcgggccuggccgggccggcggaggggagacgucgguugagcggcggcgaacaugcgcuuuugacacauuggaggugagccugcagcgcggggccgcucccuaaggggcugcgcugggccggcggcgccgaggccugcccuuggggagccuucccggcccggggccgugucugaggcuccgccggggcgggccgggccggguuccggggcggccagccugggggcaacuguuccaaccgcucuaacuguccccucccuucccugguccgauguguggccccccaggggcgccugcaagggaacgauuccgguggccuccggaagaugugccccguuccggguagggugagggcuggcggugacggaggccgggacguggcaccgugggcuggggcgcuggcggcgcaaggaguggcccagucggagguggcagcggcgcgcccagcccgccuccuccuacccccucuucgaaauuccuucauuugcgaggguggcuuggagcgggguugcauuuugaucucucagugccucucucccauggggggcgagagcgcgagcagcccacguugggcucggauuggcauucuccugacucccgcccggaacugcuaaucauccucccccuggaguucggcaaagugucaccaacgggcucggguuacuugugcucgacucuuuucuugcuguaagccaugagaugacccuuuaaguuuugcaaaggaggugagaguucugucaccacugauuauuaccuucuauuuacguagcaccuuuacacguuucagagcacucuucuuccuaucuuuuucuaaccgcaucaccuugugguugcaacugauuauguuaucgccauuucgauggguaaauggagcugggauggggguaauuauuuauacuuagguucaaccaacuggugagugguuuagcuuggaucauaauuuacauuucuaggcucggaguucugguuucuuuucgugggauuuuuauacccuucucagcuacaaaacaaggcagaaaaugugacuugccaaagauaugccagaagcugguagauuacuuacucaauuauuuuugagaaaacucaccuaggauaaaaacggcugcucagucaugagaaaaaucuuccugugaagcuuguucaggaguugcugguuaauugcuuugcuaaaucgugaaguugaugggcacagugcagcguuaagucaugggcugaagagaaguaaagggaaaccaagugaaguauuucuucugaauuauuauuaaaauuauuguuauuuaaaauuagagugcgugagaaacaaaaccuuuggccagcccugguuagagguugacuugauccagauagaaguugcuaaaucuucugaagcuguaguucuuuugauuuuuuuaaauuaaauaaauugaaguuggauaaagagcuuaaaauaaguaggaaccuuaguaaaacuuagaucuugcuuucaugacaucugcaaaacaacuuauuuuuguuuucauuuuaaaccaugcugggauaaauuugguuacuaaagcuuaaaauuacuucugacguaaguuucugagcacuccauaaaguaaaaaagaagucugauagaaucaaagagagaccguguuuaugaucaacuuugaagaguuaaaaauucuguaaaugucaccuuugagaguaguagaauuucaguaaaaaggcauauauugccaacagugaguucugaaagaacucuucuaacgucaguccauuuuagaacuguuaaccagaaacaauaucauugaaaauagauuuucuuaccauuguacaaagaauaauuuccuuguaaauaaaaggcauuuuggacaggcuguuuuaaacucaaaugaguugauuguugcuagauuucugaaggucauacacaguaugauaaugcuuuacguaaaaauugucaugcuuuugagacuguguccguauugagaucugguauuaaagaaagauggggugggggcgggcagagaauaauaauuuuuuuuuucuuugauggagucucccucuguugcccaggcuggagugcaguggcacaaucucggcucacugcaaccuccaccuccuggauucaagcgauucuccugccucagccuccugaguagcugggauuacaggugcgcaccacgaugcccugcuaauuuuuguauauuuaguagagacaggguuucaccauguuggucaggcuggucucgaacuccucaccucgugauccgccugccucagccucacaaagugcugggauuacaggcgugagccaccgugcccugccaauaauacauaauuaucuaucuucauucuagcuucagaaaauuguggauguaccauuagagcauuguuuuagcaguauguuuucuauauuagcuaacuuucuauagccugaauaucuccaguuacauaguuugaaauaagugaacacauccucccaguguaacuugaagcaaacugaacagacuguauaacagccccugaaacugucguuugaguaucugcagugguagcaaauuuuauuauuuguaaauaaucugauuuuuauuuuuauuuuuuuggaggcagggucucauuuugucacccaggcuggagugcaguggagugauuacagcuuacugcagccucaacuuccuggacucaagcgauccucccaccacagucucacgaguagcugggaccacaggugcaugccaccacacccagcucauuuuuguauuuuuguuagagaugggguuucagcauguuguccaggcuggccuugaaguuccaggcucaacugacauucccaccucagccuuccaagugcugggauuaauaugcgcgagccacugugccuggccagaaucugauuuuuaaaaagaguaaaucugauggguaaaaguagggcaauagagcuggauaauaccaguuaggaagcaauaaagaugaggugugaccacaaaguaagaaguuuuugcuuuguucuuuuuuuuuuuuuuugaaacggagucucucucugucacccaggcuggaguggagugcggucgcgcgcucucggcucacugcaaguucugccucccggguucacgccauucuccugccucagccucccgaguagcugggacugcaggugcccaccaccacgcccagcuaguuuuuuguguuuuuaguagagacgggguuucaccauguuagcaggauagucucaaucuccugaccucgugauccgcccgccucggccucccaaagugcugggauuacaggugugagccacugugcccggccuuuuuuuuuuucuuuuauuugagauggaaucucacccuuuugcccaggcuggagugcaguggccaaucucggcucacugcaaccuccuccucccggguuugagcgauucuccugccucagccuccugaguagcugggauuacaggugccggccaccauacccagcuaauuuuuuuuuuuuuuuuucauauuuucgguauagacgagguuucaccauguuggccaggcuggucuugaacuccuaaccucaagugauccgccugccucagccucccaaagugcuaggauuauaggcaugagccaccgcgccuggccugcuuuguucgccugcuuuguucuuaauguggcucauaaaggcuauuccaaaaaagaaguuuuggaaauguuuuucagcaauggugauaucacuggaauaugcauauauuccugaaaugaucaguuuuaaagaaucauuugcauguuuuaaauuuugaagccuguuuacuuuguggucauacuugaaaggucugcuaucgaacuaccaauuuuuaauagcuugaugaacauuuagguuuuuacuaugugccagguucuguccuaaguacuuuacaaauauuagcucacuucauaagcucauucuaaugauuauccccauuuuacaggugaggaaauggggcacugagucauuaagucacuugcccaaggucacccaaguagugaguagaugcaucaguagcgagucugaacuuccaggucugacuucagacuugggcaguuuggcuucccggucugggcucuuaaccacuaugcuaugcugcuccuaugacuuauucuugguuaaauguuuuaaauuguuuugaucuggaagagaugaugguccuuuuaguaaaugauauccaacauagguuauaauacuguuagaggggccaauaagcggguuaugaaaauagccuauugauuagaaaaguuguggucaacauucaauucacaugagauucagcaagaaaauaaagaaugugaccaggcgcgguggcucaugccuguaaucccagcacuuugggaggccgaggagggcagaucacgaggucaggaguucgagacagccuggccaacauggugaaaccguguccuacuaaaaauacaaaaauuagccagguaugguggugggugcuuguaaucccagcuacuuaggaggccgaggcaagagaauugcuugaaccugggagucagagguugcagugaacuaggauugugccacugcacuccagccugggcaacagagugagacuccaucucaaaaaaaaaaaaaaaaaaagaaugugugugaaguaaaauaauuuugcuagaauuacuugacacugaauguaaguaguuggacaaagaggaugcaagggcuagaacuagauucucaaaaaguuucaugcaaaaggcuauuuaaaaaccugaguuaucaggggacacucauggaaaaguugguguuguauuaagaauaugucccuguacaagaaccagaagucagagacaaauggauacucgcaauacauccagagggguaaacaaugcuauuccucagggauuacuacuuaacuaggugcucuucaaagcauuaacugcuaguauguccucugauacuauauaaaugggucaaaaccaacaaaaaauacccccacauggaaauguuuugaaguggacuccugaauaacauuuagagauucaaaacaauccuaacucuuuucguagaagaauuggccccacauucaaacaccuucaaauaaauguuagaugccaaggaagguaucuaacagucauuaggaacuuccauaaugauaccgguucaugggccacacuacuagcaauaucaucaaaugcugcacaguaacagaaagaguacugaaaacucaaaagaaaaaugaucugaccagugaauaaaauguucaguacagaagcagcacuaggcacucagccccagaaaggcagauagguaaucuaggggcaauacaaagcauaacaaaauauuuaagggacugagauggcugccaaaucauuauaggcuaaaaaggcaagaaauaaucacuuugggaagaccaaggcugagagguauuaucaucaaaggcuacaaaaccagaggggacauaaaaaaggagaauacaauuuuguucgccaaauccuggaaccuuccaagagagcagcacaugggacucagggcaaagcuaagaccaaaaacaggaaguucaucgauggcuauaaaguuauggaacuuaucccaguugcuucaaauaagauaaaaucaauacauuacaaguuuuagacuugaaaucauuaacuuacaaaaugcuuuauauaaggaucaggacuuucuucuauugcuuuuuuuauuuuccugagcuuuuaaauuucucuuuuucuuagugacaguagaguaacaugucuucaccacaaccucaaauauaucuagcuucucacuugugcucuaugcuaucuguucuaugggauuccuuauuuuucuuggugucauccgucugaagcauucuaugggccugauggacuaggcuucauccugggacuuuucauugcagcccuagguuggagccccuauuuccugcaucccaugcuguccaggucaugguuuucucccuucuuuuguacuugucucaggaaguguguaggagguagcccuccugaccuuuuuuuuuaagucuuugucuaguaccuucugaguucuuguauaagaaaaaaucucauuuccugaauugucuguuuccucucaguucacuagguccuaaaauuuucuuauucaugcuacuggguuuucuuacuugucagauggcucuugguuguccauuuauauuucagggccggauaaugaugauuugagguagcuagugugcagugguuaucucuaagguucuucccaauaaaucccaucaacucccuauucuuugauguggagccuguacugagccuaugucagugacugaauguggcugcccauguaucggauuaauaauuuugucuaacugauaaugauagguuuucuaauauugauuuaauauauggugguacauuguaagguggaaguaaacuacccgcacaucuuuuugcuuacuccauuccugaaguaggaauucagauguuaauaaagugguacuuugaaagucaagagggaauauugaaaggaugauuauaaaucaguucacauauuuauuuauuuauuuuagagacagggucuugcuguguugcccaggcuggagugcaguggcacaaucauggcucacugcagccucaaaaucauggcuuacugcagccucauugcuucugggcucaagcaguccuccugccucagccuccccauguguugggauuacaggcaugagccaccguguccagccucaauucaaauauuuauugaacuuccacuguguucuauguuugaugauguggagagauuuaaccguucauuccuuuaaaaagauuuuuuuuuuuuuuugcuaaaccuuccugaguggcuugugcuagauaaacuccaaguucuaugcaucuccagguuuuuauuuauuuacuuuuuuuuuuuuuuuuuuuuuuuagauuuuuagacggagucucgcucugucccccaggcuggagugcaguggcgcaaucuuggcucacugcaagcuccgccucccggguucacaccauucuccucccgaguaggugggacuacaggcgccugccaccacgcccggcuaauuuuuuguauuuuuagcagagaugggguuucaccguguuagccaggauggucucaaucuccugaccucgugauccgcccgccucggccucccaaagugcugggauuacaggcaugagccaccacaccuagccuauuaauuuacuuuuaaagcuggucuugaguucuugcugccuaguauggaauagguugaaucaauuaugguuuaauucaguaaauaucauugaguauccacuauugugcaggcauugggcugagacggaaauaaguaagccagccuaacaggcaacacaaagguguaagcaaaugcauugcccugugguaauaauaucagugaaagcaugugugggguacagagguagcaaagaaugcaagagauuuuaaugcuguccaguugagggcaagaaaaccucucuggaaaagaugacaauuagguuuuaaggauaaauaguaguuuuccuauuuaggggagccacuccagguagagaaaaccuggaguaguuuuccaugccugaaagagccugguguguuaagacaguuucgaacaguacugccagaauauagagugggaugccuggggagggggugcuaggaagcaguaggcaugccucuagagugggccugacgaucaguugggaguuguagguagccaguccaaauguuaguuaauuaaaucgcuuuuuuucuccucucugaaugccuugggagagaagaaccaggaugagagagagagaucauugaaguuggagauuagugggcuuuuggaaggaagcuuuggacuuaaaagaugauuaacaggagguuuuuagagauuugauaauaguaaauuauugggaauguggugccugauuuucuaguagggucaccuggcauaaaauguuccaagcagauguuuugaagcaguuguauaccugggaagggcagcaugcaugcgguagcagcaucucugacaauaagcuuguuucugucucccgauucgcagaagaccacguggccuuaaaccaacugcugcaacucugugugcaggaugauucugugggcccaagucacccagcgccuaugcugcaaccaaaagugccuccugucgcuuuguaucaaaggaccuuugucaugaucucauucacaauauugguggucccugagaguggagcaguggagugauugacgugccugaguuugaagagaguuaaccacuggaaucucucauguuuuauucccuccaaaaugcugcaguucaguguugucccagauuuuaugcuugugcuuagauuucucuguucucuaauuuguuaaguuugucuuuaauauuucacaggcuuucuugaucauggauggugaagauauaccagauuuuucaaguuuaaaggaggaaacugcuuauuggaaggaacuuuccuugaaguauaagcaaagguaauguuggaaagcacacuaaaaguaggggagggcauuuggaauacaccgugucuuguuugugcauuuuucuuuuuaacauaaagcuaaauuuagaauugcagauuuaggauucuaggauugagauucuacaaacagucaccacauggguuguauuuaaauaguguaaacaugccauaagucuuuauauuguucaaauuauuaaaauaguaggaaaacugucauuuaugauuucuucugauuguuaccuguucuaugcuuuuuaguaggcggggccaucuuuggcccguuuugcaugcacugauucugccucaucauuuuggucauuuggagauucugauaagcugucuggggcuccauagaacagacuuuacguucuccucaggcaagcaugaucagugucuggagccagcaaagcuuugagggagggggagaagcuucaggggcauggaacguuuuauaaaauuucaguuauuugguugggagaacuuucaggcaacaaccuuuuaagcaacaaaacuugucucaaauuucuuuuuuaaaaaugggaucuugcuaaauaaaauauugauacauuuuccuauuuugguuaacagaguuuacuaagucuuaucaaaccuuuuacugcccuuucauuauuaucaccgaagucaguuauucuauugugccaguggauaugaaagguguguaucuauggcaggguucuuaaucuuuuucugugucauagaugucuuaaugggcugggguagccuguggacuccucagcauaauauuuuuaaaugcauagaauaauagaauuacaaagaaaaucaauuauauugaaaaaaguuaucuaaauauuaaacuaauuuauggcauaguaacauguacuucucuauuaaugcauuaaauaaaaaaagauacagaagugaauguaauaacuaccuaauuuugaaauagucaugaaaauaaauauauuuagagauacaugcaacgauucuauugugaugugaaaauaugugugauuucuguugaauaugguagaaggaaaugccaaauuuguuacuuuaaugaaaguaaaaaugcauuuuucucgcaucugaguucugugguggaagaagcuaaugguauugagccacguagccuuacuuuucauaaauauuguaaucacugacuuguggcuccuuuuugggcuugucguuuucauugaacccugaauauauacaguaagagaugcaaaacagauugucuuuaguauauuuuaugagagcauuagcauucaagcaaaaauuaucgaauugcucuauaaucaccuccaagacaauccuugugguucuuaguguaacucgucuuucccacuuuguuucugauuagcuuccaggaagcucgggaugagcuaguugaauuccaggaaggaagcagagaauuagaagcagaguuggaggcacaauuaguacaggcugaacaaagaaauagagacuugcaggcugauaaccaaagacugaaauaugaaguggaggcauuaaagguaauugcagcaguagacgcuggggucuaauguguugaguuuuauuaaaaugagaaauauguuuuucaggugcuuaagagcagcuggcgacaaaaaauaguuugaaaaaaacgcuuaaagugaauuuuugaauaaaauguuuucuuucacggaaccaggggaaaaggugguuuagaguuuaggaguucacuuagaaacuuuguaguugucacuuuucuagcuauaauguuccuagcuauauuauauuauaguuccuauaauuuucaaaagcugccugauuauuuguuuugacagauagguugccucauucugcaguauguuuacaauuauauugauagggaauaugcauuuauuucauuauuguucauagcccuuucaguuuuggaguuuaguuaggguuaaaaauuucccuucuaaaaaggaauuuucaggagcaaaaggauucaccccuuucucugcccuuuaccaucuacuguagccacaugcuugaggguauuuagugucuggggaguggguggguucugggaagguuggaugggcaggugaaagguagggaaugugaacucugugcuuacccugggccgcauuuagccugaaaauccagagguuuccuuaacaaguuugcggauuuugaggcaaggauuuuuuauauuaguucuuuucagagagauuguuauuggguuucuuucugagaggagaaugguugacaaaauuuaacaugaguuuaggcacuuagaaugaaugugucauuuaguuguuuuuaaaguaauuguuacaagaguguggguaaauuccuuggguucccccccacccuuuuaacuugaguuaccucuuuaguaaagagaacuguauauuaaugacauguacuuuccuauacugaugcccucaggagaagcuagagcaucaauaugcacagagcuauaagcaggucucaguguuagaagaugauuuaagucagacucgggccauuaaggagcaguugcauaaguaugugagagagcuggagcaggccaacgacgaccuggagcgagccaaaagguaaacgaaugacugcauuuuguuagaaaaaaaccaccuugguaauuagugauuaaaaucuuuauuaggcucuuccccuagaucuuagucccagaacauuuccuguugguguuucaugucaccuguaacucaucggacggaagggaaccccaaauccucaucucccagauaacgcccuucaaagcuuucucuuucaauuuuucuuuuuuccuucuuucauauacugugguugauccuauugguuuuguuuuguuuuuugagacagggucucacauugucgcccagucuggagugcaguggcaugaucucggcucacugcaaccucugccucccagauucaagcgauucuugugccucagccuuccaaguagcugggauuauaggcaugugccaccacacccagcuaauuuuuguauuuuuaguagagacgggguuuugccauguuggccaggcuggucuugaauuccugccaucaagugaucugcccaccuuggccucccaaagugcugggauuauaggcaugagccacugcacccagccuagguuuuguguauuuauuuauuuuuuaaacugucucaugcauucccccaucuucccucugugcucuuaacacuuccauacuuccuguagguccucauaucuuauaccuggauucuguaguuauccucuagcugauauaucuuuauauuucuguuccuuuuuauucucuuuuaauacugacugaugaauuuucuuaaaauguugauuucaguucaaauuucugaacaacgugcaguggcuugcuaucacuguugccaaacuuuuaugcauguguaauuaguuguuucuuaaccauuccaaacuuaauuccuauuacuuuauaauuguuuccugguauuuccuuccuuaauauuuauccagugagucuuaagugacugacaugaugcuaaacuuacagaugcggagcuagucuggucacuacccuugggggugacagauauguacauucacuauguuaauacccuaguaaaaaaaagugggcaagcugcugcuccagggcauagaggaggcagcagccagauugguugcggggaggugggcggggggggggcagugggggaaccaaucagaggcugaagugaaguuacaaagugacacccuaugcaaaugucugagugguugcagaaagcaaagggaauagcuucugguccuuuucuuacuuagguguggaaaguuccgguuuuccuuuugauuuaguucuaggaagucagugugaauuggccuuagguucccugacuugggacuuaauguuuuaaacaaacucuuacauauauuacaaguuuugaaaaguuuucuuucugaaaauguguaaacuugauuguauuguguucaaaacacaguggagauauaaauaguguaacaaauagccuuucuguagggaacauuaaggaauagaugggaauuuaaaagaauguauuguauauauugcccaacugauagagacacuacgugccagcaguggucaggaaggggcaagaucaucuucuuugauuggggccaggcuggcuaggucaggaaaugucacgagauaaacugacaguuuccuuuuguacuaucuguuugcacauguuauuuauuuaauucauguacucuaauuuuucuuuuuagggcaacaauaguuucacuggaagacuuugaacaaaggcuaaaccaggccauugaacgaaaugcauuuuuagaaagugaacuugaugaaaaggaaucuuuguuggucucuguacagagguuaaaggaugaagcaagagguaaaauuuauaacuuaaagaauacaguugacccuugaacaacauggguuugaauugugugggcccacuuauacucugauuuuuuuucaaccaaauguggauugaaaauacaguauucacggcauucaaaacccuguauauggagggcugacuuuucauauauacgggcugacugugggacuucaguaugcgccaauuuugguguagguggggguccuggaaccaauccccauguauacugagggacaacuguauuuauccucccuuaccuuacugucccuaugccagaagaagcuuagagucaacuuuuuuuggagacgaagucucguacuuucacccaggcuggagugcaauggcacaaucucagcucacugcaaauuccgccuccuggguucaaacaauucuccugccucagccucucgaguagcugggauuacaggcgcccgccaccacacccagcugauuuuuguauuuuuaguagagacgggauuucaccauauuggccaggcugaucucgaacuccugaccucgugauccggccgccuuggccucccaaaaugcugggauuacagacgugagccaccgcgccuggccccauccagcuaauuaagaaaacauuuuuuuuguggagacagucucaguauguuggccaggcugguuuugaacccuuggccuuaaaugguccuucugguucugucucccaaaauguugggauuaugggugugagccacugugccuggcuucuuaaucauuuuaaaguguacaguccaguaguguuaaguauagucaaauuguuguguaaacaaauuuuuagaacuuuuucaucuugcaaaacugaaacuauaccuauugaauagugacuacccauuuucccuucccuucagccccuggcaaccacaguucuauuuucuaugaguucagcuacuuuagauaccucauauaagggagauuauacaguauuugugacugguuuauugcauuuagcauaauguccucaagguuuauccauguguaguaugugacaaaauuuccuucuuuuuuaaggcugaaugauacuccauuguauguauucauuuucuuuaucuguucaucuguggauggacaucgaguugcucccaucucuugcuauugcgaaugauaccgcugugaacauggguguccaaauaucucuuugagauccuguuuugaauucuuuuggauacauacccaaaagggggaugacuuuguuccuuuuuuaacacaagcaaauauucuguaaguuaaauugcauaauuggaaaagauaacauuaauuuuggguuaaaaacucgacauuggcuggguguggcggcucacgccuguaauucuagcacuuugggaggcugaggcggguggaucauuugagguuaggaguucgagaccagccugaccaacauggugaaaccccaucucuacuaaaaauucaaaaaaaaaaauuagcugggugugguggcgggcaccuguaaucccagcuacuugggaggcugaggcaggagaaucgcuugaacccaggagguggagguugcagugagccgagauugcgucacugcacucuagccugggcgacagagugagacuccgucucaaaaaaaaaaaaaaacgcucaauauuugaaagcaugagaaaaauuuaaaccguucugaauacuucuuuucuaaaaguaaauauuucauagugauaauaguuaaugccagcccauuuaaaauuacaaaaaugcacuuaguugauuuugcaauaaccccaaaacuacaucauuugaaaauaaaagcaaauaaguuggugaagaauauuuacuuuugugugaauuguacuguggacucugcacuguuucuuuuugcauauaagcauaaguaacuucucucagguuauagcauuuuuaaauucuaaaagaucauuuagacaguaguuuugccauuuuuauuccccuagaaaugaaaguuauacuuaaauaggaaauucauuuuugagaaauaguaauuuaggaagaagaccuuuaugacauuuuagaugucacuuugcuugauauauuugcucccucuagugaguauuccugcccuuguuugcaauauuuuacagauuuaaggcaagaacuagcaguucgggaaagacaacaggaaguaacuagaaagucggcuccuagcucuccaacucuagacugugaaaagauggacuccgccguccaagcaucacuuucuuugccagcuaccccuguuggcaaaggaacggagaacacuuuuccuucaccgaaagguuuguaaugucuuuucuuuuugaggcgauguguuagaugaucagcuuacggggguuuguugcugaaggcgguugcuaagguuuaaagaguaauuuuaguuuaaaaguuggugaagucuagugcuaugugaaauagaagaaggaauuguuuuccuaggccacuaauauauaggaaacagugaaaugaugguuacauuuaagaugagauuuuuaaaaguuaaagguuuuuaaggaaaguuuauuuuuugaugauagcaauagauuuugugauuacagccguauguuuagguagaaaauuuuaaaaacacagaaaaagaaaauaaaaaucauguuaucuuaccacuuacaggcacccaccauuaacauuuugaguuuuuuuuucuauugugugcuuguguguguuugugcacaucucuuugucacaugcaaauuuggggaucauauuuaaacacaguuuuauuucuuccuuuugccacuuuccauaucaugggagaccugaggccuuucuacauagaauguacagagaaucauuaaguuaucuuucagacucauguaagaccggcuuggauggacaugcccauucuguuacaugcuucaggagcugccauuuucaaaagcauuguucggaguaauugaugauuggcacauacagaauacucacauugccaugaaccaguguguuuuuuuaaaauccggauaagcagaaaaaccaccuaguagccacuagauagaaccuuaaaauggaaucuuaaagcucucaauugagauuuguuuagauuuugcagcucguaguucauauuucugcuacucucauccccccuugcuuuuuuuuuccacccuauauugaagcugucaucccacccuuuuuaaaauauaggguuuuaucuuuuagaaugcuaugugggcaacuaguacagugagcucucucugucugugcuacucaauagucaccagcccauguggcuauuuaaauuuauauuaaaaugaaauaaaauauaaaauucaguuucuuugucacauuaaccacauuucaagugcucaguaacccuugaguagguaauucaacuugucuuugccuuguuacgagaugauaucagauaagguaugugaaggugcuguaugguuguaagguguuacuaauugcgcuagguuuacugcugaggacaaagggcaggcaauagauuauuagcagucaucaggagcccucacggucaguuuuucagaagagcugcuuguauauuugaagauuucacaauuacaccugaggacuaacaaaguuuuacuuuuauguuacugauuagaauuaugcagaucugaaaauccuuuaauugaagacgaaucagaauagugaaaagccucaggugcggugacacccacagguggugcacauuuuuuuuuaauagcccguuagaguuuucauucagggacuuggggagucaaaaggacauggagccugcuguggcacggcaugaggugugccaacccuauggcaguaauauuugcuuaauagauauguuuuuaggcuggaaccaauagcaugaauuuucacuggcuaaccuaaaagcugcuguguacuagaucacugcaauuucauuacaagaaagcacagaguugugagcagcagcagguggucagagaaaucgguaagaucuuagagcugaucuuucugaaguggucugucuuuaauuguauuuuaccuuuuacaauguuuguuucucuuucuuucuuucuuucucuuucuuucuuuuucuuucuuccuuucuuucuuuucuuuucuuuuucuucucuuuuuuuuuuuuuuuuuugacagaguuuugcuuuuuuugcccaggcuagagugcaauggugcgaucuuggcucauugcaacuuccgccuccuggguucaagugauucuccugccuuggccucccaaguagcugggauuacaggugugugccaccacacccagcuaauuuuguauuuuuaguagaaaugggguuucaccauguuggucaggccagucucaaacuccugaccucaggugauccacccaccucagccucccaaagugcugagaguacaggcaugagccaccaugcccagccuacaauguuuguuucuaaaaagcauuuaaagcaacuuaccauaaaagcacagauuuaauaacaccuaaaauguaaaacuugaauagggaaaaaugagaucuagaaaucccugccaagaacaguacagcgguuuuuuauaucacguugagcgccuguuaugugucauguguuauucuggaugcugggagcacagugguaagacaaagccccuaccuucaaugagauuauauucuugaggagaagaaggauaauaaacaacaaaaaagccacacaaguauuuucguugcugauuagcacucuguggaaaacaaacauaaaaaauaauagcuaaccuuuauugaguacuuacuacgugcauuuuuaaaguacauuaauuuaaacuucacaacaucuuuaugaugagguaguuguuauuugcccccucuuacauaugggucacuuacccaguggcugaacuggauuugaauacaguaguucagcucaagagccguuaaucaugaugucauauuaucucuuaaaaauuaagaaaugugcacgacugaaaaccuuacugaguguggaagaagauauggguaaauaucaugguaaauacuaugauucugaaugggaagacuuaauuuucuuacaauauccauucuccccaagucaaucuguaauuucaacuucuaauaaaaauccuaauaggauuuaaaaaauugauauguugauauuaaaauuauuuuggaauaguaaaugugcaagaacagcugagaaaaauuugaaaugggcuaauaacaagagggaucuuugccuuuugagaucucaaaauauauuuuaacauuauaauaaaguagcauacuucugauagaauaggcuaauaguucaauggaacugaaauauauucauauauuuagggaauuuaguuuauaguuauagugcuauuucagaugagaugaguuuucccuaaaugauacuaggacaauuggcucuccauuuggaggaaaaaauuuagauauguaucuuauagacaacuauaauuucuaggugaauuaaaugaucuaaauguaaaaaaaucagaaaaauacuaggagaaaguaugggaaacauuaugacauuaagauggaaaagccaaagguucuccuaccgaaacacaguguuuacaagaugaaugucacgcugagagauagaacaucuauaagagaaagggugaacauccagaauguauagaguucuuacaaauugauuacaggaaagacaaaccaguagagaaauguacaaagacuaaacagcugauuuucagaagagauucaaaugacuaguuacuauggaaauagaaacuaaaaaacgugacuaucaaauugucaaaaaaaaaaaagauaauaucuaauauuaucaagggcaccaccgcauagauugcugauauuagcacaggcuuuuuagagagcauuuuggcagugucuguuaaggugaaaaaaaugggcauauguucugacccagcaguucuauuuuuaggaaucucuuuuccagaaauacuugucuagauguuuaagaguauauguccuuguagcauuacuuauaauggcgaaaaauuugauauaauguaaauauccaccaauuggacagugguuuagccuauuuaugguaucuauacuuuauccauaguuugaaguaguuuguugauauuguauugaguguuacacuacuuuguaacaucaacaacaaaacccaaauguaaagggaacugcaaguguaaucacucagcuuuuauuuuucucuagcuauaccaaaugguuuugguaccaguccacuaacucccucugcuaggauaucagcacuaaacaucgugggggaucucuuacggaaaguagggguaaguuucaauuauuuaucacuagguguuuccacugacaagguauugaauuauuucuuaauuugaagugagggaagaaagaaaggauacuuuccugugguaaaggcugucaugaagcucagaagcaaaagcauccauugacuagccaaguccagaugacacuucaugaugccccugcagaagagccuguaccuugaacucugagguucccaccggggcauucuuccuguuccccacuccuguuucaacagcacgaugccucuguccuugucuagaauacuuugucuaaggccugcugugugucuucuaccacccucauccuggucuuugcugcugucuaccgucuuccuggucauuccuuuguuuuguguuugugggacuuuaacauuuggcucauggcauuacucucuacuuuuagucuugcccaccuuauuuccuuggccaccucaacuucagugccuucuccuuggugugagccuuguauuccagaacaguuucgcuucugaaauauuaaacccagccggacgcgguggcucacgccuguaaucccagcacuuugggaggcugaggcggguggaucaccugaggucaggaguucaagaccagccuggccaacauggugaaacccugucucuacuaaaaauacaaaaauuagucggcaugguggcagaugccuguaaucccagcuacuugggaggcugaggcaagagaaucacuugaacccaggaggcggagguugcagugagccgagaucgagccacugcacuccagccugggcaacagacagcaagacuccaucucaaaaaaaaaaaaaaaaaaaaaauuaaacccguuuuucugcuuaaucaguguguuacuguguaccauaccuacucuuuaaccucaucaagaguauuaccccauuuuuuaguguguuuguuuuuaucagccaucucuugcuuucacuuccuuucuauucaucugugaucucacacaucucuuacucugucacuguugacuucauggucucucuggccacaaaggagaucugcagucugaauuacuggaaacaguugcagaaccauguggauuuaugccacuaucaagucagcauuucuagcauuagcucccauuacuauuucccuuagugaguuuuaccucuccuuucaguaaucaaccauugccauuucccacuaucuacuacccccuucacuuauuuucgugugugacacuuucuaaaaaauguagaaauugcauuauacuuuaucuaaagcagauaugggaggccaagacacagguccuauguuugccuguuucagcucaucauagggguuauuuucuaaccaucagauuaaaccugcauuuuuaagguuaaaauacaaaguaaagugcacaggucguuccuacaguacauagaguaaucuuucuucacucccaagauaaccauuuuaaaauccucuauguuggaguauuugucuuuauaacuugaaaucaugugcuuauuuuucuguuuaucuugauuuacucaacuuuaagcaaagauauuuuuauuuuuauuuuuuguucuuuuaaaaaaauuacuuuaacauucuugaacuuuuguuucugaauguauuagguuauaucuuuuuuuuuuuuuuuuuuuuuuugagaacggagucucgcuuuguugccaaggcuggagugcagcggcacgaucucagcucacugcaaccucugccucccagguucaagcgauucuccugcaucagccuccugaguagcugggauuacaggcacaugccaccacaccuggcuaauuuuuguauuuuuaguagagacgggguuucaccauguuggccaugcuggucuugaacgccugacuucaggugaucugccugccuuggccugccaaagugcugggauuacaggcaugagccaccaugucuggccaguauuagacuauaucuuaacucgcuguucucucccuuucuuccccaccacacucccacuccgcuuuccuuuucugagcccucuacuagcugugugagcucucuguugguugguucuaaaaauggaaaaguagucaaacagcauuuguaacaaugcacauauauguguuauuuacuguguaaucacagaggagaugcuggacuuucagaugggucuuuauauuugugccauucaacaaauguguuuugagaauuuuguucuuuaacuguaauuuacucaaaaucauacuggguuuuuaaauauuucguauuguagcugacuguacgcugcuuucuuuuccuagcauuucuguuuccccuucuuucuuuugaguagaagaaaccuacaccuuucuuugcucucggaucuucuagcuucuucuucacacucuuugugggaugcccugaugggcuucgagggcugcugcauuguugucgcccucgaauuucucuccauuuuacucuuggguuaguucugccuguuccucaccccacguuguugucugucuuuguuccuuguuuguuuugcuuuaguacuuuaauuuauucagaaguggugcaugaaaguuuaauuuggcauccuuguaugguuuacacauucagcugacaauccgucuucuaagaguuaucaaaauaacgaccuccaaaagucaucaacacuuugggucugcugguguccaccagcccuuguuggcuuuuaugaauauuucauuuaugccucuuuacacgacuuuguccacugacuugaacuggaagcccuucuccacucuugcaugccuucacagagaaaaucaaggccauuuguuuuaagcuucuuugauuucuuuucucaucuuuuguuauuacucuccuauuauuaccucuauuuguagccauuccuccuuuuugucccagugguaaaagugcaaauuccuguccguggcuaauuuuguccaucugugcuuuggaucucauuucuuccaacccuuaaaucuuuauuucuccuguauuucagccuuuuacuauauaugcguuaauauuuauguauaauguuuauguauuacacauuauauguuauguguuauacagguauacuuugauauuucuguauuacauguuauccauauaaauauauguaauacuuaugugguacauauuacauacuuuaaagcuucuugaaagcguguccccauuuauuguuagcauuuugacugcaugcacacgccccagacacuuuagccugggcucuguccccugcuuaugccgcuaaaacugcucacuggugaucucagugcugucaaauccuguggaugccguucuguccuaauuuuacuugaagcauucaacacugaccguuuuuuuuuuuuaaugcccucuuuucucuccuucucugaugcuguuucauggcugcucccaacuuucuuuccauuccucuuagucaucuuguugggucuucaucugcucacccuuucgauauugguuuuacucagaguucuguccuugauuuucugaucuuaaucacagccauaguuucauccaccccuggguguggaugucuuucaaaucuuaaucucuagaccacccuuuccccccucaaaagaccuggugcucgugcuuggaugucucacugaugucucagacauaaguugugccugccgugugauagauacucaauauggauuugaaugaaugcgugucuugaauauaggaauugaauggcucucaauuucuacuguguguguguguguguguguagcuuuaauaagcugcugaauuauugcugaauuaugcuuauucagaguuuguuuuacaaggucauuaccucucuuccuuuuuucuguugucauuuuaguaggucauuguacuuuugucauaggaaagaaggagaagaaaaaaguuugucuguuuuuguugcuguuucuuuuuuuugagacagagucucacucugucgcccaggcuguagugcaguggugcuaucaaggcucacagcaaucucugcuuccuggguuccagugauucuugugccuuagccuccugcguagcugggauuacaggugcaugccaccacacccagcuaauuuuuuuauuuuuucuuuaguagagacaggguuuuaccaucuuggccaggcuggucucgaacucauggccucaagugauccaccugccuuggccuccuaaagugcugggauuacaggaaugagccacugcacccaaccauuguugcuguuucugaauagcuguuauugaaauguggggggaggagguccaaauggauucucaaagugaaguauauguuaccuguggauuuaauuuagcugugcauucccaguccuuuacugucauggauaauagacaugaauuguguauauauauauuuugccauggauaguauuuuucuuuucggagaaggagggguuugauuugggcaaaguguuuaugggaaagagacagcuggugaagugugaguguguggaaauacaugagaaacgccugaucucuccaugucaucugcguugguagagcccugugcuugccagguguuguggugacaggugcaaaacaagggugcccaauuuagagguaaaugcuaaaaggccagugucauuugcgggugaauuauuuaauuacagacaaaggguaucaguuaaacauuuuacagagugcugucagaaauaaaauagcuuuuaauuucauguaaaguguuguaaauguucucauccauucucaugcaguagaaaaaaugaagaaccuagagaaagaauuggcugccguaaaaaaaauucucaagugauauuuuuggguuuuuuaauagugcuugcucccaaaacacacccugccccccaacaccaacuaacagucuacagcuuagaaacgagcaauggauagggucaagagaccugggaucugcuguuccaccuccuguaccacacuuuuuuuaguuguaaggggaagauuauauguauuuccuucaguaacgcuaagaggaggaaacaaaauauucugaggucauuagaaagggagcauaaguauucccccuuuuuauuagaaaguugauugauuauggcugaacuaaccaccauuaucaacugagaugaguaaguuuugaggcuugaaauagaaaugguuugaaaugcaaauuuuuaugugcagcuacuguuuugacaaccauaucauuccuccuucuuuuuuguaggcuuuagaauccaaauuagcagcuugcaggaauuuugcaaaggaccaagcaucacgaaaauccuauauuucagggaauguuaacuguggggugcugaauggcaauggcacaaaguucucucgaucagggcauacaucuuucuucgacaaaggguaaguccugaauguuuuaagugauaauuuuuugaguaguaaagugacagguuaguaagugagcauaaugaagccuugaaaagguaaacucagcuugacaaaccuucccgaagccuguuaucauucuaaucuuaggugacaugacgucuguuguuguccucuaguccccauggagucuguugccccaggaacccugaaucugaggcuucuguccugggaagcagacucuugaaaggcagcagugugaggcucuggugagucaaaaugacugcgauaaggucccuguucuccaggugcuuacaggcuggcagacuuggaaauauuuuuuugggguagaagacagcaucacaauuaaauauaugcaaacucuacaacagacauccccugugagaauuuuagagaaauauaaagcccugaaguacuuaggcacuggaucaaauacaguuuaggagauacaacuuuuguauaaaguuaaggcuuuuuugaagauugaaauaaaauuguuuuaagguugaagcauccuuaaugcaaaaaauuucaguuaguauggaaguauaugaacuaaaaagucaugguuuccugccuucacacuguuucugcauuccuuacaguuauuccaaggcaugccaaaucauauuuuuaugcaucugcucuaaguuguuuguaacacaguuacgggauuauacuuuaaauauugcuuugcagugugccuaucaugacuucuauugccauuaucuuuccaugucauguauauuauucuaccucaauuuacuuauuuauuuuuaaauacuacaugguaauacgugguuguaugaguaugccuuaauauaggucacuauuaggacccguggccugggaugcucacgguguugccuaagguaguuguuauugaaacagccaacaggcacccgugauccuuggcuacugucucugcuuugagucaaagagguaauucuugcuuguuuuucucugaaagcagagcagguacaacucuagaaacgcucacaaucucugaaagcagcugggauuuucugccguccucaauaauuauggcacauguguaaaggagcagauucgacacacggugcacucugaauaggcucuuauccuugcaguggaguguuuugguugaucucugucccugauuuuacccuggagaauauacauuucauuaaggauuuuguauuaaaagcacauccuaaaacaucacuauacaaauuagaacuuuauucuuucuuaaaaaauuuguuuaaauaauuuuuguuuucuuuugaagagaugggggucucacucuguugccuaggcugaucucaaacuccugggcucaagugauccuccugccucagccucccaaagugcugggcuugccgccgcgcccagcugaaaucagaacuuuauucuaaccauuggguuuccucggguggaguaaacauaaaauugauuuuccucaggcuuaggaguuucaggcagacuugcggcagcccuuguuuuuauaguggaaugauaaauggaaugacuggaugguuuuacaugagcguagccauuuccccugaaugauauggagaacuuuuaggguagucuucauaaauguuggaagcagugccuaauuauuuuucccuacaacuuauaaugauccucuacuagaguaguuauuaguuucuccuuggaaucguauuucuugaugggccgcaggugccuuucaugagagcaggugugaaucauaaauggauaggucggacaggugccugugcguguggaagcccugaagaacagucacgaggagggaaggauaacacugucuguucagggucgcuacuccugcccgccacuugccucccaagacagagcaccagggcagggauugccaagaggugagccuguucugagggagauguggggaccuuagggugagcugaagccaggaacaggccuugggcacacugacugcaccucugccccuugagagcauccgagauguaaguguaggcuuuacuuccugagcugaacccggaaaugugcugugcuucccaaucggaacaguugcagauacugaguuuugguuuuaaaugguagacauuuuacauugugccuuuucuauuaagaaauaugcuuuugugggcuggcuguugugugaguguuuagcuuauaugauaaguggauuguguaugcgcacugaaauauuaaccuacuguugcuggaguugucuuucuaguugcuguauuccugaggauaacucuuuuguggguuuugcuguguuuucacuuucuugccgcuuugcuucgauuccggcuuuuggccugucuggcuuuuuaccucuggcuuuucuucugccaaccuguugaccagauaaaaaccaagauguuguguagcagccgcaaaaggaagggcaggauauuccacuucccagguccauuauacacucuggcagguuaaaaacacaaaagccugucuguguagaaguggagaaguauggcuuguaguuucagcaugagaaaagugccccauuugaaaaagcccuccacugcagaaccugccugcccucccucucacuccugaggagucuguagcaccguggugauggcucacuagugcugccagaaaccugcggcaggauuguuugggggagagacaucaucaaaguagguuugugugugugugcaugugugcggguguacauguguucaccuucccacccgcugaaacuucagaugcagugaagccuucucacauaaaacaauauaccuuaacugggcguauugcucugugggauucaaaaguauuuuguaaauucuggucacuugagggcuucuuggaaucagguuuuugucuagucugugagcacuucugccaguuccugaaacaugggcugccgugccugcuucccaggugccgagcuguuuccuucaaccauggucacccuuugucucaccaucugaaaggacacacauuucauguggaguguggucgcuuggagucucucaaaaacacucuuuuuuuucccauaacuuuauguaguuucuuagguaacaugugcucuauuuuuguaagccacucugaguucuuuugggcuguguguaggugggcauggacuaauuuuagggcgugauguggaaauaguauucguauuacuguuuaauauguucuccuuucuuuuauuaggcaagaaaaagucauauuucccacguuguucauggguaacugaauuuguuugcugugcucuuuuucauucuuucuuaauccuggugugugguggaagacacauuaacaaucugguuuuacuaacugcauggggcugacucagcuuuaaccaacuuacagcccaucagugaacuuucacgguccuguucgacuugacuguaugccguuauuaguucagcugugagaaacaagaacaaauuaguugcagugguccugggguggcugggaguagcaugccagguggcacgccugagaugggcuagggcgcuguaguguugauuucagagucuggcgauggggguuugaggucacugucaggcccugggaucaccuuugacugucuuccugggacugggggucuucccguuacccaguugcuucuguuuucucaagucaggcaccagugugagcauucccucaccucugcgcucacgcauggaguccccaguuaaaauggaaugguacauggggacguguguaagaucugccuuacauuucagaacugcuuugcaguuugcagagccugggcugagaacuggagcaggcuggagcugcucugagcccacacucauccacugaaauaggagacucagguguggcgugugccugccugcaggcucuucuggauagcuugagcccacccuccugcccucuccaguguccugauccuugcugcuuugacagaguuaauguuuccauccuucaucucagcugcuuuggauuuauuguccugaguagcuucuaagugugccuuggcucuucccccuuuucacuucuuccacugacauuuuacaacugaccuuagcacuuuuucuuagcuggauucucuauauuucagccuccuuaacuagucuguggugguaagaucaugaaauuuuauagcucuggaaccuuuuuuuuacauauaugauucccagaucuguaucuucaagccugccccaucacucuuccuucaguccugucuugugcacugggacauugcccuguggcucuuugcugcucccugaaacugaaucuguugaauauagagucucuucucuugcaaaucuuuuccccaugcacagcuuugcaggccucugaaggacuucacuagaccugucaucccaucuagaaggccagcuuucuucucucucuguucuuuaacuuucuacuuuuugagucaggagagaggcgcuaggugagacccugguggauugauguucccucucuacuccacccaccuucacauuaagcguuccauuucugcccauguagaaauuuaccgguucucucuuuauagucugggcugcaccacuuacuuuucccauuagagccggccugcauuggagugccgaagugguugcuucugagggcugcuagguggccucugaccaggaggagacuagaaaaggguccuggccugggcaucuggaggcagcuguggccccgacuuccccaucaguggcucacuaggugagccuaggcuaauggcuggaccuucucuugcuuugguugucuuggcaguggaacagugggaugaaccuguuguuccuuacggugcacuugaaaaugccagaaucccauccucaaccugcuugaggagccaucuccuaguugcugcuuuuguacacccccguggcccaggugccagauucuucuuggcauccaauggugcucccuuucugcuggguuccgggcacugucugcaguacagguuuaggggcuugccugccacugugaugugugaggccaggaaucugagguucacacgugcugagagcugcaggcauuuguggggccugccugguugucccugagguuucuaggagaagcaggugucagggacucugggacuagccagacagauggagccuauuauaugagggcuaccguggcaaauaggauauggccuuggccccagaagaggcacaggccugugaccuugggagagugggaaggaugauuucaaacuugcaaauguguugaagcucaaaaaucagaccuaacccagugaggaaagagacaaucuggcuguuugucgucgaaguaggacagugugcaacagggagaaaugacauuugucagagccuuucuccuggggcucuuggucucuguaugcgugguuggaauuuaaacuccacauauguacucugaguuuaguuucuuuagacaugaacuuuguuucuuccaaguaggcagggacuauuugucaagucucugcaugccuguuugucugugagguuauccucaccccgucaguguacgaaacagcugucucugcagggagugugugucggcauuuuuuuuuuuuaaggagaaccucucuccaugagucuguauuuagcucccuggagccgucugaugaguaggugggggcaguagugggcagguguggugcaguguggccccuugucguaguuggcuuuaucucccaaauugcuagugggacaaauuuuccuaggaagcguuucaagguggaaaggcugaaguggcuccugagagagguuccaggcugcacacucccucccccucuugcugcuuccuguggcugcgcugcauggugcgugagggggaugcuuggggggcucccugcaucgcugggcucugggugcgugauggggacgcuggggggcucccugugucgcugggcuccgggugcuggguccuggcugcaggcuauuggguugggcugggcugucugcacacgagucugcguugaaaagccuacucaucuggcguugcuugcuaaacaauuuuuaaaagguuauuuuucuccaccuuauuaagauauucguguauuaauacauuauauuuggaaaauguaaggagauuuggaaaaugauuaaaaaaggauaaaguaguaaacaaaauucacccacagcccagagggaagaaaaguaacgauucuuaaauuuucuuuuuaugauauauaugauccuauguacauauauguugguguguguauauauauauguguaugcguauauauaauguauguauauauacauuuauuuauacacacucccccucugucccugcuuuguggauuuagcugcauggauaguaaugucuaucuaaggggcuauagucuagaaucuagaauauauacuauuugcuuuuuuuucuuucauaucauugaaucuacagaguuugguaaccugcaucuuuuuccacuuaguguuaguuacauucugaauauuuucccaugcuauuaaaaaacuuguggaauguguuuuuaauggcugugcaauaucuuauuguucaguuguaccauuauuuauuuaacuaguucccuauugccaggcauuuagaccugcuuuauggggaaagaaucaggacuguggcuuccguggccagugugcggcaguugccaaacaggucaugugguccugguuccccaggauucccaaaggcucaauucucuaaccagcuggugcuuuccaggcagccagugccccuugggccaucaggacccuacagccugcgaggaauaguuuuagaaagcagauuaauuuccuauugugugugagugauuuuaaaugaguuuuucguuuccccuuucuucccuucugugcucugguugcucccacagggcaguaaacggcuuugaccccgcuccuccuccuccuggucugggcuccucgcguccaucgucagcgccggguaugcugccucucagugugugagugccuagccuccaggugggggcuccugcccuccuccaacaacccaggacacccacgccucaccccucggugccugggcccagccccgugccccuccgucugccuccgcacggcuggcagagggcaggcugcaugcaguggcggcuacugggcccugcccagccccggaacucugcgcgauaucaauacuggcuauuuucucuucucgccguagugccguugguuucacaugauugcacuuuugugggucgcaaggugauacauacguguauuacuuggucacuggaugcagaaguacccauucaucacaccugccccauagcccccacucugcuguacugauaggauuuaguuguguuuuaggacauugcaaaucuucuagaaguucucccccaaaucaggucaaugugugcccuccugagcucccacccaggcaucuccagugcucaugaucaugugucccccaacuccaccccucacaguuugggccuguuucuggcaaagagucaggaagguuacugaauuagggaacauuuucugcaccuucugauuuuacuuaagcagcuaccauuccauggacuugccucccagagcagcacaaugcccgucugagccccacguggcaggagccucugggacggggcacacacaggcccagccucugugcugucuccuccuccgugcgccucagacucggggugagggaggcgggcagccucucgccagccuucccguccuucaguucaacgacaucuuuggaguguuuuuguuuucucuuccaagggccgucccguuguguuaggaagggugaguggcugguuccagggugggccggugccagcuccgggguggacugaacagcggcggcugucccugugcauccuuugauuacucucaugcugcauuuacuguuuacauuuguuuuauuguacauagguuuguaaacauuauugccugagauauuuguauauaacuugggcuuuguagcuuuuauuuauucagaacgcauacggcauguuaaugacucugaugguguccuccucugggcagcuguauaggaucaucaugugguuacaaaaaauacuucccucaaaaaaauucuuuuaauguggaaacaauaaauuucacagaaaaaaaggauugacguugcuuuauucagucucugccaucccaugagaggagagcuggggcccguaaagccagguuccaacgucacugcugcucugacaugggacacgcagcuguggaaugggacagagaucagguggccuccggagaugucuuaugugcggagcaggcguccucaugcuguuucuuggcacuggcuucugggcuuggcugugauuuccaggagcaguuugagaauggccugggccccaugugaaaaucugaaaggaaggaccaggauguugagggcggaaguucacaaagucccagaguaacugggauggauccgggaccugguccugcagcugugcugccauucaugacagauguugucauucugggauuagaagucgcuucgaaccggcacuucuccucaucccucagguuaaugcuagcaagugagagaaggugucagauacuugauag

SEQ ID NO: 16617 - RNA, 12325 nt, Homo sapiens
ccugaguucccaccccagaaucacaggaacacacacuuggaaaccucagcccugcauuccucgcuccaaggggcagacaggacaggcugaaaauagcaacugguuccaaaaagauaaagguaaauucauggggaccuacugcagaguuagggagggaagccugcgggagggucccugggugugaaauaggcguuggcucacacccggcucaggagacaggugguggugcaagucggggaaagauggugagacucgccguggagggacgcacgcagcaucccuuagcugagacagaggcauccagacacccaugcugcucagccaggcucugugccauugccgucuuguccucaucccuaccccuguccaccucaccccuaugagccccgauccacacagcugugcagguagaaccugcgcacacacuuuccaagccugaauuucagcuuuuccccagaccccuuuaaccucugagacccuggauaccucugucuccuggggcccugugugaugugcgcauguggagaguggugugguucgugagggggggguguccgguugggaggcggaucugauuccuguuuccugccccuacucacucagcccugggaggugacugagaguggaggggauucaagggugagugcuuggggcccgaguaccuggguuccuaagggugggguagggaaggaaguaaaugcagguacccgagagggggugggaucccugaggggcaggggcuggggaggaguuggccaguggucaagacuaccgugugggucacuuugcuaaaugacuuucugccagaacacagaggccacugagcugcaagacccaucaucuacaacccccuuguuccccccucaucauuucucaaggagccaguccgaggccuggaggggucugacucuccugcugaccccugaagggaguuuggggguuccucugcuucccagcccugacccugcagccuucuugggauuguagccuccuuccucgagggaggaagagaaacccaggccgcagcgcccuggcccgacugguccuguccuucgguucauucucccagccaccuccccaggccucuuggcaagacccauggcugugcugggccucucucugugaccagacccuagggcaggcggggaugaucagacgcaggacaggagagaccucgccaggaccuccucaucuccgggggucagaggcuccaagaaucuugauggcaggaaaaggagacuaaaaauaauccggaaagggagaguccggagagaggaacugggaaauggggggcggagggccaguggagcagggaaacagugaugcacgccucgcagcccaggcccggcggacaggcgcgcccacggcacccagacccagacagcgcagaacacacauggcacacccacccuggcaccgcuaucucagacacucacaccgagaacuuccuaaagggccacacaccacacaccguaugcuccacucucccccugcacacccacccggcaagcacagaacucgcacacucacaacacaccaugccacccccuacacaaaccacacacaaaccuccacaacacacuccacggacacacgguucagugggcagacacggagcggcuguaucccguauugaguuuuauggauucucuggaacccccacaccagccuucccuccugacuucaaaauccugccuuccaguggccccaguuuacccucccuguggggcacuaagggucuuucucuuucccucccuccuccucaggggaugacuccagcagagcaccucacuccuuugaagagcacagaggaagaugucagcccagucccuuccugcagcaacaccccccacgcagaagcccccucggaucauccgcccccgcccuccuucucguuccagggcugcccaguccccagggccuccccacaauggcuccucuccacaagaacuaccccgaaacuccaaugaugcaccaaccccaaugugcacccccaucuucugggagcccccagcugcaucccucaagcccccugcucuuuugccccccucagcuucuagagccagccucgacucccagacuuccccagacucaccuuccagcacccccacaccuaguccagugucccggcgcuccgccuccccagaaccugcuccccggucuccaguccccccacccaagccgucugggucacccugcacgccucugcuccccauggcuggaguccuggcucagaauggcucugccucagcuccuggcacugugcggaggcuggcuggcagguuugaagggggugcugaaggccgggcucaggaugcagaugccccggagccaggucuccaagcgagagcagaugugaauggggagagagaagcuccccucaccgggagugggucccaggagaacggugcuccaggugaguguggcggguggggggcgcugggugaccucaauccacccaucuucuccguuuucagugcuaacaacuuucaggggcuaccuuuucaaaaauggaguuaauguuugggauaucugguuucuguaugucgggauuugaagggagucaggguggaggagaucuauagaugccuggaccuugauauugcaguugcugggcagguuaaagauggagauggucugggcggggguggagcugggccccaagggcuuucuccuuaggcuaccugucucccacagaugcuggccuggccugcccucccugcugccccugugucugccacaccacccggccuggccuggagcucagaugggugccuguggggggcuaugaggagguccccagggucccccgucgggccuccccgcugcggaccucucgcucccgcccccacccuccaagcaucggucacccugccguuguccucacauccuaccgcuccacugcugagcgcaaacuccugccacuccucaagccucccaaaccaacucgugucaggcaggaugccaccauuuucggggaccccccacagccagaucuugaucugcuuucugaagauggaauccaaacaggugcagggccugggggaguggaccucugggcugugaggggacaggagagaggcaggggggaacuaaagcccagcaaacuacaauccccaacaggcacugggcucuuugcuuccccaccagcugcugcucuggugcugaagagaguugcaguuuuuauaguaaccaucccugcuggggcuggagucgggaguccuggcuggggauccuggaguuuuuuuuucucuucacucuggcuucucucuccaggggacaguccugaugaagcuccucagaauacuccuccagcaacuguggaggggagguacugaacacccccaccccuacucccugguucucuccccaccaugcuucuaccugagggcagacuaaccuucagcuccagcuaaaucccaccuccacaaaggugaggggacaagggccagggcucuagagauaagcagcccuuguuucgaaucccagcucuggcccuuaucaauucugugaucuuauagaaggccgggcacgguggcuuacaucuguaaucccagcacucugggaggccgcggcagaaggaucaccugaagucaggaguucaagaucagccuggcuaacguggugaaacccugucucuacuaaaaauacaaaaauuagccgggcauggugacgggugccuguaaucccagcuacucgggaggcugaggcaggagaauggcuuggacccagggagauggagguugcagggagccaagagcgugccacugcacuccagccuggucgacaagagagaaacuccaucucaaaaaaaaaaaaaaucuguagccuuccugggucucaguguccucaucugugaaauggggcuaagcauaggaaccaccucauggaaucguggggauaugauauugugaagagccggguccagaguaagugagugcaccauuuuaacucccuucccucaccuugagcuucuauugcaauuauuguccgaaaaucuauuuggcaaucaugaccaucucuucuaugcuauccaggauuguuaauuaucuuagauucaccauuguuaucagaaguuaucuguguccauucauuuauucaacaaacauuuacuagugugguuuuuagcuugggcgaaugggggugugguggugcugaugaccacagcaggggagauaaggggcugcaggugcuggugggaggugugagaguuugcaguccaucacguugagcuuccuugacacacaaauagggcguuccagacaaugguugcuacgugagacggcugacaaggagacucagaaaucucuggucugcaauaguugacauaagaauggggcccacuuaguucaggggcuccucucuaaaaggcacauaaaaagaucuggaauuugggccgggcaaaguagguuacgccuguaauccugacacuuugugaggccaagguggcaggauugcuugagaccaggaguuuaagaccagccugggcaacauaacgagaccuugccuuuccccuucaaaaaaaaaaaaaaaaaaaaagccugagguuugauuuggggagccgucagggucccuacauccaaccugcacauggguugcccuguccagcaugagaacaagcaccccuacggugggcagcagugguggcccuggggacuuccuucccuuucuuucuccacagggaagaggaggggcuagaggugcugaaggagcagaauugggagcugccccugcaggauggugagggccucuggaccugagggucccugcugugaccaucaagcaguggggaaggguuugggagcccugggcuucccugaagugcuauguuugcccucuagaaccucuguaccagaccuaccgagcagccgugcugucagaggagcuguggggggugggugaggaugggaguccuucuccagcaaaugcuggagaugcacccaccuucccacgacccccuggaccucgcaacacccuguggcaggagcuuccggcugugcaagccagcggucuucuggauacccucagcccccaggagaggcgcaugcaggaggugggagcuggaggugggagaugggaggggggugcugggguugggcugcaugggucaggcauaggggaggagggcccaggguccuagcuucccacggugaacugggcuucccacgacugccugcuuuucuuucuagagucuuuucgagguggugacguccgaggcuuccuaccugcgcucccugcggcugcugaccgacaccuucgugcugagccaggcacuccgggacacgcucaccccccgugaucaccacacacucuucuccaaugugcagcgaguccagggagucagcgagcggucaguggcuuuccguccuuccagggaaccugcccuuaggcugcugggcacgcccuuuccucucucccgggcccagguccuuccuucuacggacccaguuaguucccaaaccuucucucaagaacccgggagaccuggcucucugccccgccccauugcuugcuuccccaauuccuucagguuucuagcaacgcuccugucccgugugcgcucuuccccccacaucagcgacuugugugauguggugcaugcccacgcuguggggccuuucucgguguauguggauuaugugcggaaccagcaguaucaggaggagaccuacagccgccucaugugagugucccagggguggggaggaagcuggggagagggaugggaccgaggccacagcagguuggggcaccagggccuccaggcagccgcuagccaugccugcuucugcagggacaccaacgugcgcuucuccgccgagcugcgccggcugcagagccucccuaagugugagcggcucccgcugccguccuuccugcuacugcccuuccagcgcaucacccggcugcgcaugcugcugcagguaccugucccagcugcggccguuucugccccaccaaccccaucggagaacucucccgagggcuucuuggcccuccagcuaucaccaugcacuacuccaccuuaaacauaaaaucccccaaaucauaacuccgaaucugggucucucagccuaggacucaccaaguccuaccuuaggggcccugugcucuuccccuuaccuggacugccucuagguccaggugcagggaaaggcccucuggcuggagacaugaguuccacaccuagcucugccacugacucucugagugaccuuaggcaagucccuucugcucgcugggucucagggggagugugugagcgguuuuugagguugucucuggcuauauucuucuacccacaugccuucccagcuggggugguaucacccccaagggggcaaaaauugguucuuugggggugaaaauaaucuuaguuauuccaacaguuguacuccauuaagcuuuagugcauaaacagaguuccaguagaucuguagaauuaaacuuucauggugagggagauguuuagggaaaauuaucuuaaaaaggcaacuuaguggggugauacgggggaaaaaaaaguuugagauuugagacacuuucuuccuccuccuccuccucuucuccaucuccuucuucgagacggagucucacucccaggcuggaguacaguggcgcaauaucggcucacugcaaccucugccucccggguucaagcgauucuccugccucagccuccugaguagcugggauuacagguguggacuaccaugccuggcuaauuuuuguauuauuaguagagaugggguuucaccauguuggccaggcugcuaucgaacuccugaccucauguaguccaccugccucagucacccaaagugcuggcauuacaggcgugagccacugcacccggccuaagacacucucuucuauagcaaagcagagaguccuuucuaaccaggucucccaauauggggaucuuuagagcacuggcacgaucacggcucacugcagccucaaauuccugggcucaagggauccuugugccucagccucuagaguagcugggacuacaaugccaccaugcccggcuauuuauuaauuuuuauuuuuauagagacagggucucacuauguuggccaggcuggucuugaacucccggccucaagcaauccuccuaucucagcuucucaaagcucuagcauuauaggugugagcuacugagcccagugaaugaggggaucuuuaugugaagaguucccaacuagauuaucagugucuuuaugaucuuauucagcuuuaucuauccccauuguagacaacaaaauaauaauaaugauacuaaucaaaauagcucaacagcuauuaagcuuucuaggaaugguucuaagugcuauacaccuguguaaccuuaccugcaacuaugugaggguaggaacuauuacuuguccuacuuuagacaugagaaagcuaaggcacaggucacauaacuugccucaggucauacagaaauaauugauggagacaaaauuguaaucuaagcacucuuagcuacucugcuauauugccugcacuaacaguuuugguuaauaauuauuaaaauaauaggaaccuucggggcaggcacgguggcucaugccuguaaucccagcacuuugggaggccgaggcggguggaucaucugaggucaggaguucaagaccagccuggccaacauggugaaaccccgcuucuacuaaaaauacaaaaaaauuagucgggcgugguggcacacgucuguaaucccagcuacuugggaggcugaggcaggagaaucacuugaacccgggaggcagagguugcagugagccgagaucgcaccccugcacuccagccugggugacagagccagacuccggaagaaaaaaaaauaagaaccuucuuuucaacauuuaauaugugccaagaacuaugcuaagcacuuuacauauauugccuucuugaauccucaaaacaaugcuauugauaugcuagguggguauuagccccauuuuacagauagggaagcugaggcucagagagguaacaggacuugcucaggguucugcagauggugagugaugaggucugucagccuuguugaaacuggcugaaacagacaggguccucugagcuguggccccucugaaucccagggccacagagcagggggcccagucacccuuccuccuuguccccagaauauccugcgccagacagaagagggguccagccgucaggagaaugcccagaaggcccugggugcugucagcaaggugggcaguggggaagcugaagcagggggaggugacaaggugguagagagaaaugguagggagcagggggcuggccgcugggguggugacacagcuccccuuaccuagaucaucgagcguugcagcgcugagguggggcgcaugaagcagacugaagagcugauccggcucacccaaaggcugcgcuuccacaaagucaagguacaucgcugcccaggcuccccaucuugcccugccccauguugcugcugccacgcuagaaccuccucugccuccgcuuccucgcaggcccugccccuggucuccuggucacggcgccuggaauuccagggagagcugacugaguuagggugccggagggggggcgugcucuuugccucgcgcccccgcuucaccccucuuugccugcugcucuuuagcgaccugcugcucaucacucagccuaagaggugaguccuagggaaggaaggagcccaggcuggagugggcaggagggguccagcgggaccccugcuguccuucugaacgaccucaucccugggcagugggcagcgguuacagguucuggacuaugcccaucgcucccugguccaggcccagcagguuccggauccaucuggacccccuaccuuccgccucucccuucucagcaaccaccagggccgccccacccaccgacuacuccaagcuucuucccugugaguuguguuucccucagaaaacaaccuugggacacuuaucugaccucucagaccucccccacuuccccagucucucucuucuguggcuccugccucagccccagaggaucuuuugggccaacugugacacuucccaauauccccaccagaucagacaugcagcgcuggcugggagccuucccaaccccaggcccccuucccugcuccccagacaccaucuaugaggacuguggugaguaucccccuagaggggaugagggaagaaaaagcgagucuuagaggaauaugggggagaagcuaaacagaaucacuuuaaugucacccacccccaaccagacuguucccaggaacuguguucagagucgucugcaccugccaagacugaaggacggagucuggaguccagggcugcccccaaacaccugcacaagaccccugaaggugagaaagucuuucauuuauuuauuuuguauuuauuauuauuauuuuuugagacagagucucauucugucagccaggcuagagugcaguggugugagcucggcucacugcaaccucugccuccuggguucaagggauucuccugccucaaccucccaaguagcugagauuacaggugcccaccaccacgucuggcuaauuuuuguauuuuuaguagagaugggguuucaccauguuggccaggcuggucucgaacuaaccucaggugauccguccccuuucaccucccaaagugcugggauuacaggcaugagccucuggugccaggccuuauuucuauucuuuuuuuuuuuuaauggagguggggggucucacuauguugcucaggcuggucuugaacucccgagcucaagugauccuccugccucaggcucccaaagugcugggauuacaggcgugagccacugcgccuggccguguuucauuuauucauucaauaaauauuuauuaagcaccuacaaagugccacucgcuguucuagggacugugaaucaaauauaucacacuuccuuccuugcuggagcuacguucuagcagaggaggcagacgauaaagaaugagcaaaauagauaaguaaauuauaaaguacaugugaagguuaugaguguuauggaaaaaaaaaaaagugagcagagcaaagaaggucaggaguuccaggguugggcagacugaaauuuucaauagggaggccgagguggaccucacugagaaggcaacaugaagcuugauggagcuaauuuaggcccauggugucugggggaagagugucccagcuggaggcagcaggcagugcaaaggcccugcggcuggugugugacugaggaacuguaaggaggccagugugacuagcaggagagagaaagggggagaagcaaaugaggucauagaaguggcagggaugggaucacgcaggaccugacaggucucugcaaggacuccaccucuuacuccaagagacaugagcagccacugcagggcuugacggaagagcagcccagacucucuccgagcugcugucaccuccacuucugaugcccuuucuaccgaugcuccaggcuuguccaugaauucccacaccuacaaugacccugaaggccugagaccccacgaggcccccuuugccuccucaccugcucccugcccccaccucauuggagccucugucucucuucccccagguuggcugaaggggcuuccuggggccuucccugcccagcuggugugugaagucacaggggaacacgaaaggaggaggcaccuucgccagaaccagaggcuucucgaggcuguuggaucuucuucaggcacccccaaugcccccccacccuaaugcaggcugaggagggggcacauguugggagacaccuaccaguguggcacggagagaacaaagcccauucauccauuggauucacugucaguggagauacuaccucucguggcaaccauagagaucgagcuucaggacagagcagccaaugaaaacggccgccugaacccacagcaauaagaaugaaugaggaugccuugaauguguggccaauggagacagaggcuuagugcagagcagccaauggguacugagcuggcugagccuauggccaaugaguauuccugcuaugcucagggccaaggaagacaaaucuaggucauggcaguugaaaaagggccucauuggagauaaagucguaggauaaaauugggaacaggaaugagcaggaagccaaucagccaaagaaaauggugaucuggacccaagagaccaguagucacccugcuuguuucugcagcaaugacugguccugucuuuugagucugggaaauacuaguuuccauuccuggaugcuuccugugcccucucaagccaguucuucucuuccagaagaauucagaguaugugucucagaaaaucuguguguguacaugugcauguguagauauguguguauauguaucaggaaaggcauucugcugacugugguguguguguggugauugugcuccugacccacaaaugacugagugcuccauuucuuccuuuaccccccauuuuuccuauuauucgcuccaagaaagaugcuaagucugagcuccagaagagacugugcuggguguggcuuggcacccaggggaugagagcccugagcuuugggucucuuggaggcuaggguucuguggcaguugcagggcaauguuauggagcagccaacggccuggcagaggagcccaagggacugaagauggccaguagcuggguccugaggccccugaagucugcagacccuucuccuugccccaaacacuggccuccauaauuccugccugcagaucucccaacuugaacuauaauccaccagccagccucagccuugagcuuuggaaccacauuagauccugcaucugggugaagaaacgggagcuguggaccacaggccagccagugaaccuccugggcuuucuugccuuuguccugauccucucacagaaacacugggccaaacaguggggagagauuggagagcggguguggcugcccaaccccauccagagcaucugcuuccagaugagccagugccucgcaugauaccagaggaggcgagggacagagacagcaaggcagacaguggcuggcaggggggcccaggcccgggacgaggccuccccuucagcucaggcacagcaacuugcccaggacugacacugucacccugacugcaggaggcacagggacuccgggagacucagagggcgaagagcacuggcauuuggcauguccaugacauuggagacuccccuagcagggugccugacguguggggaacccucaguaaauaguggugcauuuguauugaggcucucugaggaagugugugcuuauaggagcag

SEQ ID NO: 16618 - RNA, 487 nt, Homo sapiens
gguucuggggaggcggagcgccgggacacuggacuaggugugggggugcuggaaggugagucuggggaagucugggagucgaggcuggcucuagaagcugaggggggcaaaagagcagggggcuugagggaugcagcugggggcucccagaagaugggggugcacauugggguuggugcaucauuggaguuucgggguaguucuuguggagaggagccauuguggggaggcccuggggacugggcagcccuggaacgagaaggagggcgggggcggaugauccgagggggcuucugcgugggggguguugcugcaggaagggacugggcugacaucuuccucugugcucuucaaaggagugaggugcucugcuggagucauccccugaggaggagggagggaaagagaaagacccuuagugccccacagggaggguaaacuggggccacuggaaggcaggauuuugaagucaggagggaaggcuggu

SEQ ID NO: 16619 - RNA, 487 nt, Homo sapiens
accagccuucccuccugacuucaaaauccugccuuccaguggccccaguuuacccucccuguggggcacuaagggucuuucucuuucccucccuccuccucaggggaugacuccagcagagcaccucacuccuuugaagagcacagaggaagaugucagcccagucccuuccugcagcaacaccccccacgcagaagcccccucggaucauccgcccccgcccuccuucucguuccagggcugcccaguccccagggccuccccacaauggcuccucuccacaagaacuaccccgaaacuccaaugaugcaccaaccccaaugugcacccccaucuucugggagcccccagcugcaucccucaagcccccugcucuuuugccccccucagcuucuagagccagccucgacucccagacuuccccagacucaccuuccagcacccccacaccuaguccagugucccggcgcuccgccuccccagaacc

SEQ ID NO: 16620 - RNA, 7656 nt, Homo sapiens
uggccccgcgcuccaguggcaggaguguggcggcccggccuccgcaggcuacccgggguugaagcuacugcgagcuccgguggcugccuggggacgcucagggacgcucauuccuggccagaguccugacuucuuucucggaucgagaucucguugcuggcucgaggaaaucaccggcucuucucccggauccuuuucuucucucacuugcuggcuuucuucuuccugccucccuggcuuccaucucccaaccccgcgauucccuccucuacucccgugcucccgucgcccgccauccugagccaucccaccugcaaccuucugucuuuugccccuccuugaccucagaggguccugccuuaagcuucucaccagaaucuccuagauuucuaucucuucccugcuugccagcucuugacucccaaauuccagcugacguuugaccacuugacauuugacccugacacccuugacugcaaaucuaaauucuuaucuucugcaaccuguacugcugaaacaggccuucccccugucuuccaaccccgcuuucugacacccauuuuuacuuucuuacucuugggucaguuccugcuacagcuaucccaccauggacuucuugaugaguggccuggcagccugcggggccuguguauucaccaauccccuggagguggugaagaccaggaugcaguugcaaggagaacugcaggccccuggcacauaccagcggcacuaccgaaaugucuuccaugccuucaucaccaucggcaagguggauggccuugcugcccugcagaaaggccuggcccccgcccucuuguaccaguuccugaugaauggcauccgacugggcaccuaugggcuggcugaggcugggggcuaccugcacacagccgaaggcacccacaguccugcccgcagcgcagcagcuggggccauggcuggggucaugggagccuacuuggggagccccaucuacaugguaagaagagggcucuugccugggaccuucagggcagauccucguuguaggauaggagcuguucuuucccaagggcauagguggcagagugcugccccacugcaagcagggaaaggcaucaggaaagugcugguaggcuucggagucuucugaucugcccuauacacacccaucugauggacacgauugaauguauugauuaagauuaugggcuuuggggccgggugcagugguucacaccuguaaucccagcacuuugggaggccaaggcgggcggaucacgaggucaggagauggagaccauccuggcuaacacagugaaaccccgucucuacuaaaaauacaaaaaauuagccgggugcgguggugggcgccuguagucccagcuacucgggaggcugaggcaggagaauggcaugaacccgggaggcggagcuugcagugagccgagauccggucacugcacuccagccugggccacagagcaaggcuacgucucacaaaaaaaaaaaaaaaagauuaugggcuuuggaaucagacuuucuggaacuaaaauccuggcuuugaaaauuacuaguuguuggccgggcgcgguggcucacgccaguaaucccagcacuuugggaggccgaggcgggcggaucacgaggucaggagauggagaccauccuggcuaacacggugaaaccccgucucuacuaaaaauacaaaaaauuagccgggcgugguggugggcgccuguagucccagcuacuccggaggcugaggcaggagaauggccuaaacccaggaggcggagcuugcagugagcugagauccggccacugcacuccagccugggccagagagagagacuccgucucaaaaaaaaaaaaaaaaagaaaagaaagaaaauuacuaguuguugagcuucaguugccacaucuguaaaauggugauaauuauagugcccuuucugugugauuauugggaggaucgagggagacaaaugcgguagacaugaaagcauuagugcgaauccuggcagacaguaagcauuugguagcauuuguuuuuauuauuauguguugauauugagguuggauuugugaaggggaggauaaggaauuuaacauacgucagagagucuagggaucaggaaggcccugggcaucacagaauuaacaaucucaacaucugccccuuugaguuaucugguauaggugaagggucaagagccugaggcccagaaaggggaagugacccacucaaggucacacagcuguuuauugcuaggacuaggcccugcuuagugcucccaagagcaaaagagacggggaaguaguauguccuguagcagaggcagucuggucucauuucaaggugugaguuucagggacaguggucuccccaaagucagcucgauaccucuguggggguugggggcuagagagcaaguuuugcccagagucugauggggagccugauagaagugguggcuggagauccagucugggaaugggagcuagcaugagaggcgggacaccaggucuugccuaacaugaacagccuuaggaaauauugccauucuccaaccacuccacccccgacugcuagccccaagggaaagaggauaugaagggguuggggugucuugcagugcugggagauccaccccccuggggcuggagccuagagacagagucuuuuuguuaaccaguuuguuaaguaggaagaacaauaaucagaguaagaggcuauucauugcugaacacccuagaggaagugugagggggugagacauuugguucucagguaggaggauggccacuggggcacaggcuaugauauucucuuguucccaggugaagacacaccugcaggcacaggcagccucagaaauugcuguagggcaccaguauaagcaucaggugaggguucccaagucugccaaagucccugaccauccuuucucuuuuccccuagcuuucugccugcacccaacagauccaaucccagccacugcucugcucaacccaucgguucugucccauuuugccccuggagucuacccagacccucuuuacucuuuuuuuagauggagucucgcucuguugcccaggcugaagugcauuggcacgaucucggcucacugcaaccuccgcuucccggguucaagugauucuccugccucagccucccgaguagcuugggacuacaggcgugcaccaccacacccagcuaaauuuuuuuuguuuuguuuuguuuuguugagacagagucuugcucuguugcccaggcuggagugcaguggcgcagucuuggcucacugcaaccuccaccucccggguucaagugauucuccugcugcaaccucuugaguagcugggauuacagccaugcgccaccacguccagcuaauuuuuguaauuuuaguagagaugggguuucaccauguuggucaggcuggucucgaacuccugaacuugugauccgcccgccucggccucccaaagugcugggauuacaggcaugagccacugcacccggcaauuuuuguauuuuuaauagagaugggguuucaccauguuggccaagcuggucucaaacuccugaccucaggugauccacccgccugggccucccaaagugcuaggauuacaggcgugagccaccgugccugaugccucuuuccaauauguacuccaguuccucuaauuuucugccccuguuucuccugaccagugaauggccucacuugcauacaucccgccccaguucuugggugcccagggaaggaacaaugggguggcuagacaaccaagggcccacauucuggcucuaagcccacauugaacugguugucuggacaagagauuccuauuaaggacccauccuuggcaguguuaggauggcagccccugaugcugggcugucugaaccccacccccggucuuccccacacuagggcauguuucaggcgcuaaccgagauuggccagaaacauggucuggugggguuauggcguggggcucugggcggccugccccgaguuaucgucgguuccuccacccagcugugcaccuucucauccaccaaggaccuccugagccagugggagguacugccugggaaaugggugggucuguuucgggaaggggggaaggggagggcaagcugcacuaggcccuggaggggauggugcccaacauucacaggugagggaguggcaggagggcuuggaggucaacucuuuagacccuucccacaguucucuugucacuuccucccagaagggguaccugagccuucaggguacccuggccuuccuccuucucacuguuuuugcacuguuauaacuggugcaguggaagcucccccaguuaccagcaucuguguccccagggcagggacuguccuguccuugggguguaauaguuggcugguugacaacgcucuuccucucuacccccuuagaucuuuccuccccagagcuggaaguuggcgcugguggcugccaugaugaguggcauugcaguugucuuggccauggcacccuuugauguggccugcacaaggcucuacaaccagcccacagaugcacagggcaagguaaggaagugcucugggaugcaggcgggaagcaggggauggggaaggcagauugcgggugcaggugggauagccugaaaugcagccuguagaggugcugccccuggugggcucugacaaacuccuucucugugcucucccucccucucugacacacucucagggccucauguaccgggggauacuggacgcucugcugcagacagcucggaccgagggcauuuuuggcauguacaaggguauaggugccuccuacuuccgccucggcccccacaccauccucucccucuucuucugggaccagcugcgcucccucuacuacacagacacuaaauaacagccgcuuucccagucuccaccaaaugagcacuccuuggccacuugugccuccaccacuauguccuggugacuacugauuaggugaccuuucauccauccaugggggacagccaaccccacuccccaucuguucucaggguugaaucacuacaagagaugaguuucccuucuuuccuuggguguugcuuuaaaccuucccuacccauucccuggguaacucacaccccucucucagggcugaacgagucaucccaaaguguauuuccucccacucaccacugccacccuugagucccuccugcucccaugcacaguuuuaaacuccucccuccaaaaccaaagggaaucgagagacccaauucccaggcgucugggacccagguguccuguuagauucaaaggcacagagauuauauugauuauaaagcaaguuuauucugaagagggauugucuuauguuuacgcacagggaagaaauaagaggaaacccucuuuucaaccucuuuucccccucacagaaccgaguccccaaguucucagcaacaucaugcagugcuucagcgccuuuacuggggaccaaagauguuaggaucgugaagggucagacuggucaccagcuguucaaagucacccaggcuccagggugcaggugacagauuuucggggccaagagaugaccuguugucagggcuuggggugggggaacagauggagacagaacaucauccaggccugagguuuggaaauugccaauuccuguuccccagaggaccuggguaucaguuaccccaaaccucuggcccacuccugcuuccuuggaggaucccaccagugagucucccuguucugucccucccagcccgauucuccugggaacccagucaugagauacccgcccguuccuuccuccuuacgggggcugauugaagguaagcaagagaucagucugguacuggggcagccucagcaaggccugaugaagugucacguccuuugcuaccuaaggggaucagagucaggaugcuuaccuggaucucugcguccccgcuaccgcccuuccaggacauuacacacucucgggcccucaccugcugguuuuccuuagcuaucugcugcuugccagagaggacccaggcuucuugacagcggccccucagggccagguucuccaaacugagaggcugaacagacuccacauggacagcccuagcccccugcacgccaccaacauccucaaagugguaccuggaguagggaagcggggucaggaagggacaucucuggucgccuccccgggagcaucuuuaaguugcaggccuggcucccggcccgugcguggucucaccgcccggauuaaccgucggccgcgggccccgcccacugguccgaccccgccccugccauuggccagccgggggccauucccucaccgcgcagccgcuucgccccguacgugggccugcagcucgagaaguuccacuaucaggcucugguccgucacgggauggcagaaaacuucuugauuguccgggaccggucggaggucgcuggagugaggcgaggcagacccugguugaccccggucucuucccacaacccacccagucagccgccccugggcgccccggccuucucaccuuacgucaauggcccccauggggaggauggcggaaaaggcgcccccgaacagcgggcagucucucgugggcuccaugggucugaggcuggguuaugggcauuagaaagguuuaaaagaaguccacauugggucacguggcaucggcucccuggguuucgcagcugccaccgccacccgggucuggcuuagcucccggauccuuuaagauuuggcuccgcccugcgcucucguuggccaaucggcgccaagacccugggggcgggggucagcggcuuugcuccggaagccgcgcucuuaggagugcgccuggcgggacgguggggucugccuugggguuggacuuaggguuagggucuaugucgcccccgguggucacgagcaugcucccgccagccuccucuugauugauugauugauugauugauugacaggucucgcugugucgcccaggcuguaaugcaguggcgcgaucaccgcucacugcagucuccaccuccaggacucaagugauacuccugccucagccucuugaguggcuccugcucccgccaccacgcccggcuaaauuuuuaauuacuuguagaaauggggcgggguggggagugucucccaaucuugcccaggcuggccucaaacuccuggacucaagcgauccucccgccucggcucccuaagugcuggaauuacaggcgagagccacagcgccuggccuccucguccuuuucaaguggucacaccuuccaagaaggucgccugagacccuccugaggggcaggugcucgucaaaggggcccacgucuagguagggucucuugagucaggaaagcauaguuucacgguguucugggccucugaaagaagaaugggcugccacccagaccgcuaauucauagaucugcugcugggaauuaggggaacaaugcguccagguuaggauucaggucucacaucuuccugaaagugagagccaaccuggguauuagaaaucuaauuccucucaaauauuugccuugggaaugcucccgggcaggugcaaccccacccccagcuccacacaccuggacagaagcacagauuaaacccucuuuuguuugucuuuuacaga

SEQ ID NO: 16621 - RNA, 1243 nt, Homo sapiens
cauuacaccgaauaggggaucaugggcuucacaaaacugccaaagcaguccacaguagaaaaaaggacgaaaaccccugcuuaauagaaauauucauuguccuaacucaaaggaaugcuugacuuugggugugguguugucucucugaucugaguccaucucuuggugcccuaaaggggagagucucugggacucuuguccccauagcaaacaacugcaucaacugcaugcagggcauuggauaagggaaugucccagguguagagaaucaaucaguugcaggccuacuugcaaccagugggcugacagcgagccauacccucacauucgccugagaaaaguggcugcuggccuucucucuacugagauuuguccccugauacuuaucauccuagccacagccagcuggaccagagaucucccuuguguuugggugguggccugaggaguggccaggcaggagagccggccaaauagguacuuucagauugaauaacaacuaaucgacccaguuggauccugucccuugggaaguuggaauuugaacacuugagggagucgacagguggcagggccagcagaauugacaggcacacaaaaaaaaaggugaagggagaaggggaaguggagccaagcguggggauuugccaagugaggguggccuuccaccccauucauucagaggaggucuggcugagcagcccccaagagcccacagaauuguggagggccagggguccccagcugcguagggcucaugggagaacaugagacaggccagacacccaaaaugaggaaguugggggggcuuuuuucucagccuuccugaccuggcgugaccuccucugggcccauguaacaggccuccacacccccuuaugccuggugcaggcacccuguuaacuucuaugucccuguaggucccuuuccaaggacucuaccugcuugacugcucccaaagcagccagagccaguauugccccugguggggaauggagcuggagagcaggcuggcagcaaggaggagagagggacagagaggucugucacucauuaucccagagaagcaucaugggguggacuccucugaccuggcuccuuuuguuucccauggcugggguccuucuuucccucuagagccuguaacgcccccgcucugucaaauuccucauacagcaaacuuauucuacucucuuuacccagaaauaggucagacucaacuacauccauaucugauuucuuc

SEQ ID NO: 16622 - RNA, 5807 nt, Homo sapiens
auacauacacagacauacaaacacacgcacccgagugaaugacagggaccaucaggcgacagauugaagggcagagggaggcagcacccuccgagaguuggcccggacccaagggugggcugagaccugggccaggggcagccguuccgagggguuaugccugagcaguuuggagaugagguccugggcucccaugggcacggaagcggggaacuuuagguccaccugcaggugugaagagauggaagggcugcauuaguuucacccuggcuacaucuuccuugacuacccauucuguuuggaguuacuuagggccaugcaaauacacucugcccacccccagccccccagcuccuggcuucagcagcuggcacgaagcccaggccgcccucccaccuugacgaugcggcgauaggucucguugugugaugcacucucaaaggguggguuccccaccagcagcucauagcaaagcacuccaaugcaccacagauccaccuucucauugugcaugcgccccucaaucaucucugggggcagguaguccagggugccacacauugucuuccuccugggagggauaaggggcgugggcagggguccuagugacauaggaacucuccuuucccugcugccugacggcugggagccaaaagaccacgggauguaccaggggagagguccagccaggcaaggccacuggagugggggugggguuggggugaugauauaucccaaagccccagaggugagccugcacacagcccagcaacuccacacugaaggauauaucuuaauaagauacccugauaugagggcaguguucauuuggaguucacuggggacaucucuaaugcccaucaggcauguucugguuaaauaaaucagcuacuaugugauacuaugaaaccauuaaaaagugaugugggaggaaaaaaggccacugcuccgggcuuuuuuugagagaguccaggcuggagugcaguggggcgaucuuggcucacugcaaccucugccucccggguucaagugauucucaugucucagccucccgaacagcugggauuacaagugugcaccaccaugucugcuuaauaaauuuuguguuuuuaguaaagaugggguuucaucauguuggccaggcugguccgcuggucuugaacuccuggccucaagugauccacccgccuuggccucccaaagugcugggacugguaggcgugagccaccgcgccuggccaaaguuuuaccauuggccccuacagggaucaaaccugcgaccuugggguuauuagcaccacacucuaaccauuuuuuuuuuuuuuuuuugagacagagucucgaucugucacacaggcuggagugcaauggcguaaucucggcucacugcaaccuccgccucccagguucaaacaauucuccugccucagccuccccaguagcugggauuacuggcguccgccaccauggccggcuaauuuuuguauauuuaguagagacaagguuucaucauguuggcaaaucuagucucgaacuccugaccucaggugauccgcccuccucggccucccaaagugcugggauuacaggugugagccacggugcacggccccuggagagguuuuaauggcccagccucacacccaggucuggccucccaggccaccauaccucagggagggcgcaugcacagaccagccgaagucagcaaucuucagcucucccuugagcccuaagagcagauuuucuggcuuuaugucucugugaaucaccuucuucccauggcaguacauuagagcaucugccaacuccuccaugaucugggaggggcaacgacaggcaaucagacaaggauggaccuccagcuacaagcagcacacccucagccucgagcccccuacuggcgccccaggugcccacccgcccggaccguggcuguucgcugcucgucaaaugugcagcucuucugcagcuccuuguagagcuccccgcggggggcauacucuagaaucaaguagauccuccuccggucauaaaaauaguuguagagacgcaggauguugggauggcugggggaagagacagaggaggccucaggccaaaggcauaaaagagcuggaaaagaugauaggagcaaacuggggucagacguggcccaggccggggacaccagggcugggagugguaaggggaaacuggaggcagauuucuggauucaaggcuugccaggacuaagagcuaaauggggcucacuagccauagcuacagagaaagcaaucuggaugaaguggggcugaaugaggagcugggggugagggagcagaggggcuucggcucagggggcaucaacccauacugcaggugggccuggauuucgaucucucugcgcagcugaugcuccacgcccuccuucucuaucugggacuugaagaggaccuugagcgccacgaugaaauggcuuuucuucucccgagccaaguacacguuuccaaacuugccuuugcccagaggacgcccaaucucaaagucaucaauugugaagugccgccugcuuagaaaguggaggaaggcaacucagaaccgguuuugguuauuaagagguuugcuuucucucugcuuccucaucccauccuguccuccgccccacuugucuucaucccuacuccucccgugcuuagguuuuaucuccccgacuuccugccuguucauuguccccucacccccguccacccccaggcuuggggcacuuacguuaagaugucgggugucccacugcuauucuccaucaccuucuggccaggggcagcuaaggagagaacagguagguugaaugcgaacagggaugaccuucucaucccuaaacccucccacagacggucaucuccccagcucaguccucucccccuugcgccaguuaccugugggcuggacauuggagcggcucaugaggacaagugcagauggggugacaggcucuuuccggaggacucgcuggggcagggugcucaggccagauggagccugagaaggagcaggggguagcucugagggugccuuugucugaugaccgggguggaaugugcugcaagcaguauuucagccccuugcuaaagagccacccacccaccuacccccaauucaaagagaaacacugaugugacaguuuugcuucccagccucugcucauagucccauauuaaaauggguuauuaauaaacaaccuagggcugggcgcaguggcucccgcagucaggaguucaagaccagccuggccaacauggugaaacgccaucucuacuaaaaauauaaaaaauuagcugggugcggcugggcgugguggcucaugcuuguaaucccagcacuuuggaaggccgaggcaggcggaucacaaggucaggaguuugagaccagccuggccaacacagugaaaccccaucucuacuaaaaauacaaaaauuagcuggccgugguggcacgcuccuguaaucccagcuacucaggaggcugaggcaggagaaucgcuugaaccugggaggcacagguugcagugagccgagaucguaccauugcacuccagccugggcaacagagcuagacuccaucucaaaaaaaaaaaaaaaaauuagccaggugugguggcaggcgccuguaaucccagcuacucgggaggcugaggcaggagaaucgcuugaaccugggcggcagagguugcagugagcugagaucgcaccauugcacuccagccugggcaacacagugaggcuccgucucaaaaaauaaauaaauaaauaaauaaauaaauaaauaaauaaaaaauaaauaaccuaaguaggccuaagauaaggggcaaaggacucacaccaacaccuaacauuucacuucuuuggcccuggcccacacuuuucaggcaugaagcuguucaaccuguauaaguccuguccauaacaacacagucauucauccagccccucacuuacaccacaguagagagcugcgucaaugaacacccacaauucaagggguuuagcacagagguauucucaaagucuccuaaaaagcuuaguuuauuaaggcuuagauaagaugcuugaggccuugaauguuauagcaauaaccaggauuuacacuuuugcaagaacaggcuuuaaggacacuaagagcuacccugauggcccuggaccacuucucacuuucaacuucuucauuuuuuuuuuuuuuugagauggagucucgcucuauuacccaggcuggagugcaauggugccaucucggcucacugcaaccuccaccucccagguucaggcaauucuccugccucggccuccugaguaggugggauuacaggcacaugccuggcuaauuuuuguauuuuuaguagagacgggguuuuaccauguuggccaggcuggucucgaacuccugaccucaggugauccaccugccucagccucccagugcugggauuacaggcgugagccaccuaccuggccucacuuucaacucucaaaauaauagguacauuuucuuuuaggagugacuaagguaaaagugacaaugguuucucauucagacuccauuccugacagccucacucagugcuccaugagggagggagcugauguacaagggaacagacagacucuccaggaagcaagagcuccaaaaacagggagcaaagccugugcagggccccuuccuucuucugcagccaagagaagaaagccccuaggccccaaauagugauauugguaccaaucuacaaauaagcaaguugaauaaaauacaguccagaaauagacccacauauaugugggaauuuauauauauaauaaagguggcauuucaaaucagagaggaggcccuucaaugaaaucugucuggaccauugggaaauaagucaauuuagauccauuuagauucuuaccucaauuuagucauuaauuccaaauuguaauuuagacuugcccugggccuuuuaaacuguaacuuuauauccuuuuagagucuauuucuauuugcugucuaguuuuuuuuuuuucaggauauggauugggaaucauggccugaaggccaggcccugccugcucagucccagauaucauuuguaugugacgagcccugcagagguccucaccagcugggagucacuggcuggucagauucacguuggcagcaccugacaggauguggcuacaaaugaccagagcggguucugucgucaaacuugggacccguacuuuggagcauaacggggaagaaagugcuuaaaggauugcucauugcaggaucucaaguuucccagcaggaacucgccaugcggggucaugggggcgcagggacggagggaagggccuuaccgucugucggccguagggccagggguaggaguucuccuucugggccauccuuagagagaaagggggaggagagcugggcggagaagggaaacagccgugagaagcagagaaaaagagagagagagggagggguuggaccgaucgagccggaagcgcuagcccgagcugguaaaagggagcaggucagcacacuagccccaaucugggcgcuggucucaccgcccccgcccugcuaucgucccuaccuccuuccagcccugcggcgugcgcgcaggccagcccaacggacccucugaucuaccugaucaucugcccacucccggcgcaaggccugcgacaggaggccagcucaccugggguccaaggcacugcuacucucccggccgcccgcaaacaacugaaucugccacgccgcgcccuggccaaggacuuuucaaaucucccgccccg

SEQ ID NO: 16623 - RNA, 3866 nt, Homo sapiens
cagugcccggaugcgggugacgcgcggccgccaucuuuccgucccgggcagccagcgccagucggagccagcgcgagccgccgccgccaucacugccgcugccaaguccuccacccgcugcccccgccaugugagucggccgcccgccacccucaccgcgcuucccugcgccggccgccgcccuuggcaaccggccgucgggagugcccggggucucuccugcguuccccgcgccccggggccaggcccaagccggugacugcgcgcgggcggccgaggagccccgcgucccgggcuggccggcucgggcgauggccgcgggaaggagcggacccaguguccuccugccccuccccgccccugucaccgcggccgccugucuuuucgggucgacccggaucgcaucugugaggucgcccucaguugacaggcggggaaacugaggccgggggggccucgcucaaggucacgcagcucaucggcggcagggcuggaccgagaccagggcuuacaucggguggccuuccucccgaaaaggaggacuggagggacgaggauggacagguggaugggcggagcccuggcugcggggccgggaggcugcaggcccugggucuuaauccgucccugcuccucaggucugcuaccgcugccacggcccccccugcugccccggcuggggaggguggucccccugcacccccuccaaaccucaccaguaacaggagacugcagcagacccaggcccagguggaugaggugaguguggggggagucaaaagcaguaggagggacccuggggguuggcguauagguguaggggcccauguugguuugggagugaugacaguucacgccuguggguuugcggacaaagauaccaugccccaucccugucucccugucagcacgcacuuggaagggcgcuggggguguuaaucagcuuugcuagccuggggugugccagccugggcaggugugcucuggugauggacagagcgccugagguuccauagagggaggguguugcuaugacaucugagaugucaccagcaugccccugaugugugcuccuugcauguccccaggugugcuaggcauguucuguguguccuuggcauguuaaccuggcaguaucagggugcauguuccauguguggcacggugggcacauguuugaggauugcccucacugaggugggccuuggcacaccccccugccucgugggcccuucucccaggugguggacaucaugagggugaacguggacaagguccuggagcgagaccagaagcugucggagcuggacgaccgugcagaugcacuccaggcgggggccucccaguuugaaacaagcgcagccaagcucaagcgcaaauacugguggaaaaaccucaagguaaggguggggacaggaaggaggacaggugggugaaugggguaucauaguuugucuuacugauccucgccucucacccccagaugaugaucaucuugggagugauuugcgccaucauccucaucaucaucauaggugaguagggugagaauggccggggcccuuucccuggagagguuuccccaguggauucuagguuuugaaggucauuaaucuaguuuuuacucuucagccaaaaacacauauagcugcuaauggcaauucugauucaucuagagccaaaaacuuugauguuauuuagccugcauuuugccuaguucuuggcagucuuguuaacauuuggaaauaggaaagcugguguauccauugaggacccuuuaggccuaagagcccagucugagaacccuggaauugaggagugggagaaaggaaaggaccaggggcuugagacaugaccaggaagccaaccaccccauuauuugagagcuugcggucucagaggcucagaggauuagggucuguggcuucaaggccauaccauggagcggaagggaccucagaaccuaccugucuagccccuugcuuuguagauggaaaaacugaguccaagagagggugucagccagcuggggaguggggaggauuggagcagggccaggccugacacacugcuuucuuguucucucucuuucucuccccucucccucuuccucaucuucuuccccucucuccacaguuuacuucagcacuuaaauccccgaggagucugcccugccuagagaagggccucucccccaacccucagccguuccuccaccucucagccauaucuuucagcccccacuccccuggauccguguguguguguguccgugugugugucccccuguaaauagccagcuguuauuuauacauauauaauauuauauauauuuggucuguuuguaguuuuauuacuagaugauuuuuccgguuguccuuaacaccccuuccugagguucccuucaccccucucucuugccuuccuucccuuucccuuucuuccugacuagccccaagucccuucauuugcaucugcuaugcaauagucccucuccuuuccuucuucuucccucagauuuagcugauccuuccucccacccuggccuuccuuuccucuuuccuccucacucuccccgucaugcucccucugccccgcccucaaaaaaaaaaaaaaaaaaaaaaaaacaacagcaccuguccaggcuuccuuagguacaucuucuuuguauccauugggaggcucugagacuggccccacuugguccuaagaaucccaaggucuuugggagcguccagcauguuaauuagcguaucauuacauacugcuaucccuuuccauuucuuuuuguuccaucacucuucucucaaccuguguuucuuuuuuuacugaggaguuaguccccauuaguucuuguaucacauuuucauuugcacgacauuacucgcaggugguggggagccugggcuuuuggggaaccaggcugcucugguccccagcauugccuccuccuagccccucuaguccaguuugccucccuuacccucauuuuccaaaccucuuguacccuccucucccucccccagcugguauguaagugucuugaaguucaguauguuaugauggaccaauaauucugccacuucggguuucucccuacauuccugcuccccaguuuucaugugggguacucaacugacauucccaugggguuucccucccaucugccugauccaccuccuccucccaccaggagaguuggggguuggccacaauugaucucuugugagagggguggcuaccagugugugugugggggucaucacugccuuggggaggaguggggcagggcagagaauccccccaauuccugccugaaaucucuggccucaccccugcuggggguuggacugaaaacccuccuccccaauuugggggguguugccccaucacugcccagcuccucugacugcccccccugaauuuaggguggggguacuagucacugccaauguguguaugggacuugcuggaaaacggggaugcuugccccucuccaggacuauugagcccagagagagcuguccucucauugggugaacugauugaggaagggucuauugucuuuuuaaauggcacaauuuuaaggguuugaggguacagucccuuaaccugccacgggagggggcccccaaacuuucuuccccccacacuucugguuuucuguguggagggggagcagggauaucuaagcuguggugugaaaggguaggagagaugcuggaggugggggugcuguguuuuagaccccccauauuaucccaguguccccugccccccucuucccccaccccaugcccccaauucuguggcgcauccagauugugaaaauguacaauaaauguguaaugaguaaccagguguug

SEQ ID NO: 16624 - RNA, 2510 nt, Homo sapiens
ggcugagaggugcuaacuucuauuucaggguuagugaggguacaguaagccucccagaaagcugcaauucuggaggaacucugaauuucauccccaagcgagcucugccccaauagccuccuccuuucagcugggucccgccuccuuauacagccuuacggucuguaaaccagccagugcccccauucaccccucacuucccgcacucccaggccaguuucucuccuuccccuccccccuucacuccuccucuuuccgggagccucgugccggguccuagaggggcagaaucuggaugucgaagggggcggggucggguccuaucccuccuacccuugggccgcggaauauaaggcuccaggcgagcagggaaccgguccacacaggguccggaggagcaauggucacccgggaucgagcugagaauagggacggccccaaggugagaggcgggaggggagggagcagaggucccugguuuggcuaggggacugggccccugacgccgucggucuggagagaggcuggggacgcagggguggaaggggagcggugcuccagaacuccaggagccagaagcuggagaggaagcugcaaaauaugaagaaggggacaggggucagagccagaccugagugggcggcgggaacauaggacuaggggccucgguaaugggugucggcaccuuguggccuggggagggggccgguguuggaguaaaauaagcaauuagagggcagagccaagggaggagggugggaacgaaaagagaagaggauaggcacuugcuccacucuggcugugagccgggcggggcuggcccaaggcggucuuguacagaaggucccggggcguugguuccagaggccccagacugguggaagauuuuaggagaaccguggagaaggugaaggccuggaggguuuugagggaaaagaggcggcgcggucgcgcuagguaucucccuuucuauacucagggccgccaggucugagcccggcaccgugcggcgcacgugcgugcgcgcagagaguccccaaaguucuccacugagacaaagagaaacugcaccagacggagacguagagagaaaagaggaggagagacacagagaggggaggagggaggacgagacugagagaggagaaugcgaagauccggggaggcgagcuacagaaacugaucuaggggcauugggagggggagcggagagggaucgaauggggccggcccuaggcaaucuggggucuuguggccgggguggaagccgggcucucccagcggcgggauccgacgccggggcggccgcacugagucucggucuggucggcccgcucuccuuuucucgcuggucgcagaugcucaagccgcuuguggagaagcggcgccgggaccgcaucaaccgcagccuggaagagcugaggcugcugcugcuggagcggacccgggaccaggucagucccuccgcuagcccuagguccccaagcuucccguuuccgcgucccagggcuucccacugggguggggacacaagcuugguuggcaacccuggccccaaggcauccucacccgagucccgccuuuggaauuccaucccagacccccacucgcucucagaacgcgaucuucuucgccaccccucgggucuguaaguuucacgccugguucuguaaauuucgcucccggggucggucaguuucacccuuugggucucuaaguguccgguucccccucccccacagccagccucugaugagccagccucuguuaugucgggugguuaauuucauucccuggguugcgguuucaaaucuccuccucacgcguugggcauugguuccaaccccuaggauuggacaguuucgucucagggugggccaggacuuuccuuggucaucuccacuccgcauuuggucgcgcguucugugggcagugcgcaaaugcgaucgggggcaccaccagcucccgcauccgucccucccuucuucccccugccacuuucccccuuucuccccaccccuuucugucucugcgcccuccccucccgucuguagaaccuccggaacccgaagcuggagaaagcggagauauuggaguucgccgugggcuacuugagggagcgaagccggguggagcccccggguacagcgcggggguggggcagcggagggagggaggggggacgccaggaggcuccggccggggcagagugggcgggcccugcgguggauggugggcuuggggaguggccgguucugcuccgaggcgagguuaauaacacccgcgcgugucugucucugugucucccucauuuucucccucuuuccguccaucuggcuuccugucucugugcgccuguccggccuugguaucucugcgccccgccccuucccucaccccugccgggccccugcccugcccaccugugcucccgccggccgcaccagccgccgcggcuccagggguuccccgguccccaguccaggacgccgaggcgcucgccagcugcu

SEQ ID NO: 16625 - RNA, 3116 nt, Homo sapiens
cuacccuugggccgcggaauauaaggcuccaggcgagcagggaaccgguccacacaggguccggaggagcaauggucacccgggaucgagcugagaauagggacggccccaaggugagaggcgggaggggagggagcagaggucccugguuuggcuaggggacugggccccugacgccgucggucuggagagaggcuggggacgcagggguggaaggggagcggugcuccagaacuccaggagccagaagcuggagaggaagcugcaaaauaugaagaaggggacaggggucagagccagaccugagugggcggcgggaacauaggacuaggggccucgguaaugggugucggcaccuuguggccuggggagggggccgguguuggaguaaaauaagcaauuagagggcagagccaagggaggagggugggaacgaaaagagaagaggauaggcacuugcuccacucuggcugugagccgggcggggcuggcccaaggcggucuuguacagaaggucccggggcguugguuccagaggccccagacugguggaagauuuuaggagaaccguggagaaggugaaggccuggaggguuuugagggaaaagaggcggcgcggucgcgcuagguaucucccuuucuauacucagggccgccaggucugagcccggcaccgugcggcgcacgugcgugcgcgcagagaguccccaaaguucuccacugagacaaagagaaacugcaccagacggagacguagagagaaaagaggaggagagacacagagaggggaggagggaggacgagacugagagaggagaaugcgaagauccggggaggcgagcuacagaaacugaucuaggggcauugggagggggagcggagagggaucgaauggggccggcccuaggcaaucuggggucuuguggccgggguggaagccgggcucucccagcggcgggauccgacgccggggcggccgcacugagucucggucuggucggcccgcucuccuuuucucgcuggucgcagaugcucaagccgcuuguggagaagcggcgccgggaccgcaucaaccgcagccuggaagagcugaggcugcugcugcuggagcggacccgggaccaggucagucccuccgcuagcccuagguccccaagcuucccguuuccgcgucccagggcuucccacugggguggggacacaagcuugguuggcaacccuggccccaaggcauccucacccgagucccgccuuuggaauuccaucccagacccccacucgcucucagaacgcgaucuucuucgccaccccucgggucuguaaguuucacgccugguucuguaaauuucgcucccggggucggucaguuucacccuuugggucucuaaguguccgguucccccucccccacagccagccucugaugagccagccucuguuaugucgggugguuaauuucauucccuggguugcgguuucaaaucuccuccucacgcguugggcauugguuccaaccccuaggauuggacaguuucgucucagggugggccaggacuuuccuuggucaucuccacuccgcauuuggucgcgcguucugugggcagugcgcaaaugcgaucgggggcaccaccagcucccgcauccgucccucccuucuucccccugccacuuucccccuuucuccccaccccuuucugucucugcgcccuccccucccgucuguagaaccuccggaacccgaagcuggagaaagcggagauauuggaguucgccgugggcuacuugagggagcgaagccggguggagcccccggguacagcgcggggguggggcagcggagggagggaggggggacgccaggaggcuccggccggggcagagugggcgggcccugcgguggauggugggcuuggggaguggccgguucugcuccgaggcgagguuaauaacacccgcgcgugucugucucugugucucccucauuuucucccucuuuccguccaucuggcuuccugucucugugcgccuguccggccuugguaucucugcgccccgccccuucccucaccccugccgggccccugcccugcccaccugugcucccgccggccgcaccagccgccgcggcuccagggguuccccgguccccaguccaggacgccgaggcgcucgccagcugcuacuuguccgguuuccgcgagugccugcuucgcuuggcggccuucgcgcacgacgccagcccggccgcccgcgcccagcucuucuccgcgcugcacggcuaucugcgccccaaaccgccccggcccaagccgguagauccgaggccuccagcgccgcgcccaucccuggaccccgccgcaccggcccuuggcccugcgcugcaccagcgccccccagugcaccagggccacccuagcccgcgcugcgcaugguccccaucccucugcuccccgcgcgccggggauucuggcgcgccggcgccccucaccggacugcugccgccgccaccgccgccucacagacaagacggggcgcccaaggccccgcugcccccgccgcccgcuuucuggagaccuuggcccugagccuugggggguggugggggcggggucuaggggugggguagagacuccagcccgagggcagcagagggacccgggcguccgggcgagcagguguuggggagggcaguggggcgcgcgggcucagcgcgcgggugagauguggucuauauuagaguaucuauauaaauauauauuucccugguuccugucccuuuucccugccccaacuucucccuugcgucuaggauuguacucucucugccccucagcccagucccagucccuucccgagucccuagugcauggaauaaagugguuauuaaauccccguguguccccgagccaggggccugccuuuaucucgacguccacgcccacuuucccuucccuucugucucccacccucaguccugcucuccauggcccaagccccggggcagacagguaaguaaagaagagagcagagcgggaacugagaucgaaauugaaaccagguggaaagagagagauaggguagggggagaagggaugggggccuuuaagaaaaaaacg

SEQ ID NO: 16626 - RNA, 22813 nt, Homo sapiens
augagagccaaauauuuugguuuuuauugaacucacugggcucaaggacagaaagaaaaaaaugggaugaaagggagugggaugaaaggggaguuggaugaaaucuuuggagaaagacagaucuccacaaacaccccaggccugggaaccuguuccugagaacagccguuagggguccaggcaagcugcccuccaauucuuccccuccccuuaaaggugcuagggacaaaggggaccacauguuagacccaggcacacaguccuucugugcccaguuuccaggcuuuuccagagaaggaagcugggcugguggcucuaggcuuggaagaaagagaacguagaaaggcaugguaggagaaggaguuuggggauuggggaggaugagggagaaaagcucagaaacccaagcugggcauuccaagaggcuggaacaagaggcugccccaaguggggcaagaagugaagcgguuccuuccuuucggaggggcuauugugcauuggacuuuggucagcggcuuuuaaccuggacgcugcugugcuggucucucacagcucagggcccaguuuguaugaugucagagccaucuuggcugcaaaagucuccaugugcagaagagaagguucaggugaacugagaacagggaggauggaagggucuggaggaccugaggaacugguccuccucaugcuuggaccuuucuuucuucuugggugguauuugggggugguuagauggagacgcuguucucaaugaggggaggguccagguagguguagggcagugccagacccugguuccgcuccuggaugucccuugagaucugggccaggcggcucuggaaggcggcgaugcuccgccucggggccuccucugugaagugcucaucuggguaggugcccaggggccucugggaggacaucagguaagaggucaggaugacauucagaugggauggggaauaacggaggaccacauguaacagcaaauccagucaagguggcuucuaguagcacaacccaguugcagccauuguaaacacuugccccaaacugccaccccaugauccugacacgaggccccccagcacccaaaccccaaacagaguaggggacagacugugacguaggagccagccaacccaaauucaguacugccucugcuggcaagccucugccuguuacuuugacucuuugagacucaauuccugcaucugaaaauggauggguugaacuagaaaaaaaaauuuuugaggcaaggucucacucuguugcccaggcuggaguacaguggugugaucauagcccacugcagccucaaacuccugggcucaagugauccucccaccuuggccucccaaagcacuagaauuacaggugugagccaccgugccuggccuagaccuuuaaaggucccuuucauaccugauccaacugcucugugaacuaaaagaacgaaccacaccuuucauacaaccgagaucaaaguaaacacugcccaggaaauauacccaagaauauaacaauuacuucauaauuucacaaaauucaacuccuaaaaacaaccagcauccugguucuaagguaccuucacaaucaaccaucgugauggaacuuuugccaacacaaucaccaucauccuccacugccacacuuuacagcacagccaaucacuaucgagaaauaucacaaugagcuccagucacugccauccuguguacaggacugucccucccucaugaucauaucacacaaccagcucaucacgacaacgcagagguccagccuccuaaccagcacacacuucccauuuacuagaaccuucauauaauuguugccaauacuacugaucuuuuuuuuuuuuuuuuuugagacagagucucgcacugucgcccagguuggagugcaguggcgcgaucucggcucacugcaagcucuaccucccggguucacgcuauucuccugccucagccucccgaguagcugggacuacaggugccugccaccaugccuggcuaauuuuuuguauuuuuaguagagacaggguuucaccguauuagccaggauggucucgaucuccugaccucgugaucugcccgccucggccucccaaagugcugggauuacagaugugagccaccacgcccagccaauacuacugaucuuuaacaaauucuuuuucucguuuuguugcauuggcgaagcccuccagaucaauguuaaauagcagcaguaauagugggcauugggcauuauuuucuuaucucugacuuuaaugaauagacaucuauggucucaccauaaauacaguguuuuuugaaauauacuuuugguuuuuguuuuuuuuuuuuuuuuuuuuuugagacggagucucgcucugucacccaggcuggagugcaguggcgcgaucuuggcucgcugcaaccuccgucucccgggaucaagugauuucuccugccucagccucccgaguagcugggauuacagguagccaccaccaugccuggcuaauuuucuuauuuuuaggagagaugagguuucaccauguuggccaggcuggucuugaacuccaaaccucaggugauccaccugccucagccucccaaagugcugagauuacaggcgugagccacuacacccagccugaaauauacuucuaaucaaaacuccuuaaggggguuucauuuuacacugaguuuuuauuaguaauggcugcucacauuuaucaaaugcuuuuucagcacauauugagauaauuauaugguaugcaucuuuauugacguaaugaacuauauugcuagauuucauaagguugaaccaaccuuucauuccuuucauuccuagaauaaauuagacuuuaucaugguguguuauuguuuuauuauucacuauuggccuucauuggcugauauauuuuuaagauuguuguagcuaaguggaauaaguauauauauauuuuuuucuuuuuuuguuuaaacagggucucacucugucacccaggcagaaguguagcgaugggaucacagcuuaccacagccuugaacucccaaauuuaagcaaucuucccaccucagccacccgaguagcugggaucacagccauacgccaucaugcccggcuaguuuucuuuuuuuuuuuuuuuuuggagagacaaggucucacuauauuacucaggcuggucuuaaauccugggcccaagcgguccucuugccucugcuucccaaagugcugggauuacaggcaugagccacugcacccggccuuauaauuucauuuucguaauaacagcuaacacguaagcacuguacaugaaccaucgcaaccauacaucaacucugaagacagguauucuuauuauucucacuuuaaagauaaggaaauaaggcuuagagaggccauuacauaacuaaagucauaugggugguagguguggaucugggacuagagccuuccaaugagacccacugcccuucuuaguacuaccagccgggcgcggaggcucacgccuguaaucccagcacuuuggaagccugagauggguggaucaccugaggucaggaguucgagaccagccugacuaacauggagaaaccccaucucuacuaaaaguacaaaauuagccaggugugauggugcaugccuguaaucccagcuacucaggaggcugaggcaggaaaauugcuugaacccgggaggcagagguugcacugagccgagaccgcgccacugcacucuagccugggugacggagugagacucugucucaaaaaaaaaaaaaaaguaaaaaaucuucucugcauuugugguuauacgccuuucccauuccuaaugcuguguauuuauguucccuuucuuucucuuuuuuauuuuccuccuugauuagaauugucuaggccagaugcaguggcucacaccuauaaucccagcacauugggaggcuaaggcaggaggaucacuuuagcccaggaguucaagaccagccugggcaauauaacaagacccugucucuaccaaaaaucaaaaaauuagccaggcguggugaugccuguggccucagcuacaggagaggcuggggugagagaauuucuugagcccaggaguuugaggaugcagugagccaugaucaugucacugcacuccagccugggugacccugucuggaguugaccaggcuuuuuuucagacaaccugacccugucaaaagagagaaagagagagaaagaaagagagggagggagggagaggggggagggagggacggaagcaaaaaaaauagugcuguaagugacagucugccacuucugggccuagacuugaagaaaucugaaagcuuguuugcaaucuuggaagccagccaccgugcuaugaggaaguccagcuauccugcuggggagagaccccuuggagaguccugggggauaagacagcauauggagagagagaaaaaccacacaggugcacugaggccccagacaugugagcaaagccuucugggaacuuccagcacagcccagucaccagcugauugcaugcaaguguuucacccuagccaguacccucuggacugcccagccuagcccugcccaaauuucugauccagagaaucuuaagaaaaaagaaauaugucuguaguuuuuuuauuuuauuguauugugguuuuuuuugaaauaacaaguuuuauguuuuuaaaaucagauugacaucuaauuucuuuuuuucuuuucuuucuuaaagauggggucuuguuauguggcccaggcugaagugcaguggcuauucacaggcauggucaugcacacugcagccuugaacuccuagccucuaggaauccucucucugcggccuccugaguagcugggacuacaggccugugccauugcaccuggcuuaauacuugauuucuaaaacuguaguauagccaucaaaaaaacagaacacacacacacaccagagaaagaaagagaaaacacagcagaagacagaaauaugacacuggauucaaagccuacuuacuagcucugugcuguugaacaaauugcugaaucucccugaaccucaguuuucuccccugugaaguggaacuaccauuuauugaacauuuauaugccagcacggugccaagcugcuuuuuuuuuguuuuuuuuuuuuugagauggaacuucacucuuguugcccaggcuggaguucagugguaccaucucagcucacugcaaccucugccucccggguuuaagugauucucuuaccucagccuucugaguagcuggguuacaggcaugcaucaucaugcccaccuaauuuuuguauuuuuaguagagauggggguuucaccauguuggccaggcugaucucgaacuccugaccucaggugauccacccaccucggccucccaaugugcugggauuacaggcgugagccaccacgccuggcugccaagcauuuuaaauagagcuauguauuugguucacauuuuaaaaucauguacacaaaggaucugauuuaauaacugagacaugauggcuccucagugacagcugccauuauuauuguuguuauaaauuuccaaguuaaacuuucuauaguuuauaggagagagcccuccacccucaugcuguugucuacuuaucugucaucccucugggaccagauagggacaggacccagaguccugccauucccaggauauaagguagcaaguuaaaacuugccaggaagaucaaauaugugggaucuuucuuuuuuuguuguuuuuuuguuuuuuguuuuuuguuuuugugucacccaggcuggcgugcaguggcgugaacauggcucacugcauuuuuuuacuuccugggcucaagugauccucccacuuuagcuccccccaagcagcugggaccacaggcacacacuaauacgcccgauuaauuuuuguguuuuggguagagacaggguuucaccauguuuccuaggcugcucuugaauuccuaggcucaagcaauccaccggccucagccucccaaagugcugggauugcaggcacgagccacugugcccagcaacaucuggaaucuuuccagcaccaaagggagucaagcgugagaaauaagaauauucaccuguuagagagcuugugugcaagacggcuggguggaaacaaagaugaugggaaccagugauaaagggcuacuugccuggccuaaacucagauauuggccccucucuagccuccugccuccaaaguugcccuuugcauccauucacgcagccacaggagcacccuagcuaaagcagauuuaaccauugggccucaggcuuaaaagucuugauuggcggccgugcgcgguggcucacaccuguaauuccagcacuuugggaggccaagauggguggaucacaaggucaggaauucgagaccagccuggccaacauggugaaaccccaucucuacuaaaaauacaaaaauuagcugggcacaguggugggugccuguaaucccagcuacucgggaggcugaggcaggagaaucgcuuaaaccugggaggcggagguugcagugagcugauaucgcaccauugcacuccagccugggugacagagcaagacuccaugugggggggugggggaagccuugauuggcuacccuuugucuucuaaacgaacacugugcagacaaagcccuaccuuccucuccgcucugcuauuuccauuugugauccuacaaacacaccagugauuucucgccuucgcuccuugguccuguucuucccccucccuaaaaaagagcccugcucuuccucucuguccaacuccuacuuguccugcagauuucaacuuagaugucacuuucuccaagaagccuuccuggguucccccagacccauuuagguuccucagggcccuguccuuaccccuaucacuggacuguaagcucacauggacaaguuucauagcugcccauaacagugucugggucaccacugguacucaggaaguguguguugaauggagaaauuaacauauaaguaacuccuacaacacgguggugcccuuuuucauugaccuguaugucuccucaacuagaccacaggcuucuugaaggcaggaaggucucagccagcguuauaggccuggugcccagugcuguguggacacauaggaaguauccaacaaauguuuauugaauguuugcauuaacacaugaguaguugaugaaugaacauucggauaaauggauggacggacagauugguaacuaaacugguauuugcuucagucuaugucuuuugggauuaucauuuucugaagaaauugaagaacccaaggcaguucugcagugaacauaaaucccgucgaucaguccucaagcccccagacgaagccaccaccaccccuacugguggcccuaaagaacccuacuccccucaacaucccguauacacaccugguccuuggguucuuggcuaaccaaccagaagaggaggagguuguuacagcugauguucacuucagggagggugucuagguaagucuucaggguggugguccccuuggucuggggugggggcugccucauggaugauggagcauugggcauccaggccccaaagucaugcuguggagacccccaucccaguugggucaguuggccagaaggggaguaucaccucccucuucaccaucccugauuccaccucugccguccuagaggugauaguugggaaaugaggggaucacggaaaggcaagagagcugggaaaugaggggaucauggaaaggcaagagaggaaaggguagggaguggaaagucccagaaguggggcaggaagccagcuuacuccuugucacuccccgcccaguguuccaggacucgguggggugagucacuagggaaggagguggccccagaguggagguaauccuagaaaagggccuuggguugccaugccacacagagcaagcugcuacuccaccuggcuggguucuaaccaugagaggagccccuaaguucuucucccaaauuaacaucaacuugaaucaccauuacaaccuuggacccagcuccacccagucaucacccaaugccaacccuucaccccacucagcugccacuccaaccccaagucuaaucauaaacccaccccaacgcugacccacccaagcucucaacccaaauucaggccucaaguccauugcugagaccugauguccccaggccugcccuuuguagccucaccugcccacuguugacagcagcgugcugggcagagcaauugaagaugauugcagugaggaacuucaccaucucuccuggggugcacagccggcuugggaaaccuggguguggggaggaaggguagaggguguggauggaagguacuggauuccuagggccagcucaggacuggggcucaccacagggggaaagugaggaaguagggaacaccgagccaugacugucuugucgggcugguuagggauggccaccaccaagauuuguggucucugaagugggucaggauaggagaugggggcugggaucuggccagaaaauccccggcaggcagggccaaugacagaggcagcuucaagcccaagugcccagcugccucucccugacuuccaaggcacuucaaucugcagccccuauuaggauguaaugauuuaauccuacccgguucaccaagauuuguucaagcacccaguauccaaccauccucugcugggcuuagcagcagagacccacgcagagggcguguuacugaaaagcucacaguaacagaagcagaaggaagcuucuaagaccagagcuuggcucuuugaggagagggcaagcagggcagaaaggggcaccaggagcagagugguuaguggaggccuccuggaggacaagaggggccuugugaguugaaagauggaugagccuccaauggaaaaaagacaacagagaaaagcauuucaggauuggagaggggagagcuccaaggcucagcccuugguccauucaugcugugccucacucaucucauccaaguccauggcucuaaccaccucccacuugccaacaacucccaaauucccuucucuggcugugccuggcgucugagcuccagacucagccgugggcauuacccuggaggcagcuuaccugacguccccaccuaagcaucuacaccaccucacacugcacacuggcaaggacaaaugcccgucagauuacgucaccccucgcuaaaacccucggagggcuucccaucucacucaccuugucauggcccuacuugauugggccccagccccuucucccacuucauuuccuuccuggcuguucacuuauucgacuccagcugugcaggccuuccugauaguucucaaaugcaccagcacauucagaauucagggccugcacacuuacuauaccucugccugcuacucuugccccaauuaucuucagaacuagcaccucuccuuccuucagcuacuaaugcaucagcuccugagaggccugcccuggccaccucccugaaaugaucucuuuaccuugacacacuguauccccugaugcuguuucaguuuuccucuuagcauucauaaccaccugacauguguuuguugauucucucuuucucucuccaaaagaauguuaagcucaacuaaggccagaauuuuugucuuuuucacuacuaaaccucagcaccuagaacaauacuuaauaaauaccaagagcccgguaauuauugguugaaugaaggaaugcaugagaggguaagaagccagagcaugggaggcagaggugggaggauugcucaagcccaggaguuugagaccagccugggcaacauagcaagaccuugucucuaaaaaacauuuuuuaaaaagguaacuggaugcagugaugugguggugcaugccuguagucccagcuaccagggaggcugaggcaugaggaucacuugagccugggaggucaaggcugcagugagcugugaucacaccacugcacuccagucugagcaucaaagugagaccccgccucaaaaaaaaaaaaaaaaaaaaaaagccagaguaggaaggcacgggguauuaacagggugagggaacagggaggggaccuaauuggaggugaggcugcagaggcaugcagggccaugugguuucugggcaguauuucagaggauuagcagggugguggcccugcaggcuuggcgggcaagcagcgagaggcugggagaggugggacugguugagaagcagcugccacaauuccagagcacuaugaggaagacuacaacuaggguggugacaguagggaucagccaccuaacuggauuuaggaagacagagagggaaacaugagucaaagagaacuaagguuuggagucaggcugacuggacggaggcugaugcaacagaacagagagguugggaggcaagaccagacauccgccugggagugugugggaguuuucugaagguucuguuccugguugagucucuaaacucggaggcugagaacaaaaaaguaaagcaggcagacacaccuguagugucagcuacuuggaaggcugagacaggagaaucaauagagcccaggaguuugagaccagccuaagcaacagagcaagacccugucucaaaaaaacaaaacaugagcaaaaacaaaaaauaaaaacaaagaaguggacagaccaucuauaggaacuuuuccguaguucauauugccuauuuuucccccauuggaauauggaaccugaccgaaauggugaaagaaaccccaucucuacuaaaaauacaaaaauuauccgggcgugguagugugcgacuguagucccagcuacucgggaggcugagacaggagaaucgcuugaaccgggagguggagguuaacuuguguguuuucccuuuuuaaauacuguaugugacucuauaauagguuuguacucauugaaagagcuguugucaaucugcagaauguucugaugcacuaacucagagaaaaaaauguaauaaaguaagauaggagaguugaauuaaccucagacugacugagguuaauaaguguguuuucccuuuuuaaaugcuguauaugaaucuacaauagguuuauacuuguuggaagagcuguugucaaucugaagaguguucugaugcauuaaaucagagaaaaaugaaauaaaguaagauaggagaguugaauuaacaguaauuagaucccccuuugggucuuaaguaggaaacagacaccccaaauaugaaacaacugcccaaggagggaggagcugucaggaucagcacugaucaugauuaauagcagguuugcaaaacacagggaagggucacccuuuaaaaacuccaaggccgggugcgguggcucacaccuguaaucccaguacuucgggaggccgaggugggcagaucaccugaggucaggaguucaagaccagccuguccaacauggcaaaacugcaucucuacuaaaaauacaaaaauuagccagaugugguggcagacgccuguaaucccagcuacucgggagacugaggcagcagaaucucuugaacccaggagguggagguugcaguaagccgagauugugccuccacacuccagccugggcaacaaaguaagacucugucucgcaccaggcgagguggcucacgucuguaaucccagcacuuugggaggcugaggcgggcggaucaugaggucaggagaucgagaccauccuggcuaacauggugaaauccugucucuacuaaaaacacaaaaaauuagcugggcgugguggcgggugccuguagucccagcuacuccggagguugaggcaggagaauggcgugaacccgggaggcggagcuugcagugagcagagaucgcgccacugcacuccagccugggcgacagagggagacuccgucucaaaaaaaaaaacaagaaagaaagaaagaaagaaagaaagaaagaaagaaagaaagaaagaaagaaagaaagaaagaaagaaagaaagaaagaaagaaagaaagaaagaaagaaagaaagaaagaaagaaagaaagaaagaaagaaagaaagaaagaaagaaaggaaggagagagagagagagagaaagaaagaaaggaaggaaagaaagaaagaaagaaagaaagaaagaaagaaagaaagaaagaaagaaagaaagaaagaaagaaaggaagagagguugguggcuggaggggccacguggcaggacaggaaggaggguuugagagaaaguucccagaauccucugaagucagagauggcucccacugcacguugcagaauauugacagagcucaggaagcugaaaugaaugggugggcuuguggaaaggucaagggaccagaggggcacagagcaguggaugcagcaauggcuuuggagacagucggagcuggcucggaacccgccuugcacagccuucuuugugccucuuuccauaucugcuaguuggggauauuaauaguaucuacuucaaaggcuggucaauaaauaacugaugggaguaggguguggccaagcaagugcuagcucaucagagcuacacggaaagugggauagagaggggauaccugagcuuucccggcccaggaacgccugagcaaaaaucucgccaguccaggccugcagcuccgaauccugcugcacagaugcgucacugggauaauaguagcccacgauuucugagacaaagcugcaggaaagagaugcugguaccacuggaguaaccacgggcucaguccuggccaggaaaccgaggcccacugcugcucaggcggcagagagacagauagccauggggguucagcagggacccccaggugcagcuggaaucugaguggccgggcuucccuuaagucccacucacuccugagccaugggugcuccacacuuccuuccugcacaggggccuggggggugggcaggggagugcacgaagagucugauucaugcugccaccccccuccccacccaggaggaaggaagaccugccugccacaggccccagcccaugcuuaaaugaugcaccagcccugauacucugacuccacuggacacccccuccuuccccugcauccacacacccccaagccccucucuggacggcagcuaccugccauuucagaagggaccccaaacucaauucauacccucaagaauucccuaugcuagggugugaaaacaccugaaauccccaggcgccaugagcgcagggaccacaaugucccaggccaggagacccuggugggacugcuggucccgccccgcaccucgcaccucucaauggccgcccagaucuucaggccgucgucucgguagugguaguuggggauagccaggacgccgcgggcccgcaggcuguccggaaggcagaaauugguguaggugaagugggccaggcccgugcucaugagguagaugaggccuugccucccgauggacgugaccugaggacacagcacagcucggcucccgggccggcccaauccccacccuagugucugggcacgagauggggcuggggacucggcccaaggagggccuucuucgguucaccaagcaauccacggaucaaauacccacgagggccugccugacgcaggcugcgcagcuugacgccccauuacgugcgugggaggagauccuuagguauuugguaacuaaaagaaugaacugaaagccggggagccuggcugggcucagggucagcugaggguagugcuggggcucaggaugaggcugcccugccuguggacccguggcccggcggggcugggggcggugggcgggggcggugaggcugcgggggcgggggagacagggucugugaagggggccgguaggagaccggagaccggcggagugggcggggcugguggaagaggcagugauuguacagguguucucacaccccagguguccucacaaggggcuugggcgcagaacagggcuugggggcggguagcggggcaaagcgucuucgggggcggagaucagugacccggcagggaggccgcaccugguccacgaggcccucgggguugagcagcguggcccucgcgaugguguucaccugcagcguguaucgagugugggggaguaggagcugcgagcggagcggaucacgugagcugaaggccggggacaaggccgcccggccccugccccgcugggcccccacccggggucgcggaccuuguagaugggguggcagagcggcagcuggcgcagcguggccauggcgaaggccucgcacagcaaaugcgugcacagaaagugcguguuguuuucgugcaccaggaacucagaguugcgcacccacgucuuggccagcagccagucccauucggagucagugggcaggaagauggggcugucaggcccgggggucuggcugagcugcguccgaaaggaacgagggaugauggggcuccgggcuggcgguuagcaccugagcccccaucccggggcggcggcgccgggcucaccuggauggccaagggcaccagcgcccccugggggcugagccacagcaggcacaguggggcggccacguacugcuggcggccguuuaggcagugggugggggccuccgccaggauccaguaguccgcuaggaagauguucccccucugcagaaggcacacagaggcugagugucccucccuacucgcgcuccacuucccucccauuucccugcccacuuccaccccagagaggagcugaggcccccagcugaggucucagaaauucuuggugccugaauuaauggccaaagugggguaccccgcccuucccaaaauguccggaaugagguccagcugagucccuccuugugcaacagcucgccugcugagacaagccagcguccucuccuccucaccucauaccuaguccuucccacucucaacucagauggaauccccuucugacaucugagcacuauguauccagcaacagcuaaaugaacacaugagaacugaccaaccaugucucuagcuuucuggaggagaaugccugagggcuugacugccccaaaaagacuggguuagccucgucuccgacaaccucagagcuccuaguucuccgugaucuucccugaugcaucugguggcccuaccauuggccuguccuaaaacagcuuuccucuaggccucagcaccucuucaggaggccucaaaacaagggcaagccuuccucaaagaugucccugcagccacccugcgcguucacaccauuucaccaggccccaucucaggccucaaagccucccaaccccagucugacccucauccguaucugcucuacuuaaagugugcaggaccauggcugcccagaggaugaggcccacaggugaaaugcagcccaggccauuuccauacccuccacacacaucccuuguccauaauggugacacacccaccucccaccuaucaggcccacugcccagauccuuacccaccucuagcucugucugcaggcauguguccugucccagcaagggggccaccaugucauuggugacaggcagcuugcugggcaagcuagagaugcaguggagcaugacgggauugacaccauucagguacugguacccaaagaagugaucuucacaccagugcucugugacauacucugggauacaagagaggggaccaguuggucuagaaacuacuucccuagauccuaguccugccaaguccuuugcuuaucauugugguuuagguuuucuucccaaaaacucuaugagguaggaaucauuauaucuucaauuuaauacuagacacuaagggucagagagauggagugacuugcacagcugaguggcagagcagggauuugagaaccuaagccuuucuggacccaaagcccggagcacuuggugguuggaguaggggaagagagucgugugucccugaugaggaucaagauucccuaaaugacugugacccucucccaggcaagcagagugucucucucuccugaauccccuguuuuuguccccuccucagagaaggugcuuuguucuccagaggaaucugggagaugccaccagugaagccaggagccccucccacucaaauccagcagucucccugggagggcugggagagggcccuuucccaggaaggagaggaaggggucugagcaugagauaaggugagggguagacaucuccugccuggcucugcucacuugucgugaaggucuuauggcaccagaagauguucugcaugucauccagcuucuuccaggagcccuugcgauccaacagcccucgaagcuucauucccaaggaccugaugggagaggaaaagaugagggugaggucugggggcuagagucugcugggaaucacugugugccccucugccuggaggaacugacgggguccauccccagaguagagaugccuaacaauccacaugggagaaaaagucuaguacccgguggaggcucuguggccucggaagacccugguucauaugcagccaucccuaagacaggucauugcacuugcacauaaaguuggcacacacggcccuauggugcagacaagccacccucacugguguuuuggccuguauucuccaagcugcccucuugucacagaccuccacuggcuccccucugccuacaggacagagccccagcugccaagccugacuagcccauggagauccccaccagccagcuucuaccaaccuuuccaguauuuucucccacccuaggcauuagacagggccaaccaagacccgcucuccaaacaugaucagagacaugcuuuguacacuggaagguagaagaggggcuggcacguggagagaugcauacucuucacuuuguggaugucugugcuguuugaauuuuuacagugagcacuauuuuuuuuuuccuucuuuuuaagaugggaucucccuguguuaccgaggcuggagugcaguggcuguuuagagacacaaucauagcucacugcagcuucaaacuccugggcucaagcaauccuccugccucaaccucccaaguagcaggcacuaccauguaguaccucccaaguagcagaugugccccaccaugcccugcaacauuauuuuauaauauggagaagcaugcuugaaauuaaaauggcuuucccccacuuccaggucuucauuuaaucuucaccucugguagaaagccaucuacuccaucucuaugauaaaaaucuaucucuucuaggcacagcucagaagcaaaguccuuuauggagcauugccugaacuccuccuugcacacaugaacuccuccaugaacacaugccuuggaucuuucacacucaucauuucccacauuguauuguaagcccaguggacauauauuauccccauuauacuaugagcuccucagggcaaggacuuggcuaugucugccccaccauauccaguucauaauaugcacucacuaaauaagcugaaucaaaggaaagggaauggaggccagaugcgguggcucacgccuauaaucccagcacuuugggaggccaagaugggccgaucaccugaggucaggaguucgagaccagccuggccaacauggugaaaccccgucucuacuaaaaaugcaaaaauuagccaggcgugguggugcaucucuguaaucccagcuacucgggaggcugaggugggagaauugcuugaacccaggaaguggagacugcagugagccaagaucgagccacugcacuccagccugagcaacagagugagacuccgucucaaaacaacaacaacaacaacaaaaggaauggaacauggaacaaguaggcguguggcaauaggucaauaacauaggauguauaaagaugugugggcugggcgugguggcucaugccuguaaucccagcacuuugggaggcaaaggcagauggaucaccugaggucgggaguuugagaccagccuaaccaacaugaagaaaccccaucucuacuaaaaauacaaaauuagccggcaugguggcaccugccuguagucccagcuacucaggaggcugaggcaggagaaucgcuugaacccaggaggcagagguugcggugagccgagaucgcggcacugcacuccagccugggcgacaggagugaaacuccgucucaaaaaaaaaaaaaaaaagugaugugcccugaaaagugugggcaccuggggaagggaggguggcaaggggggaugaaugaucggacaggcccaggaacgaugucaccugggcuccuaagcacucacucacucacugcacacacacucgcugggggcccaauuaacacccagugggugggaaaaccacgaggaguucaaucaugaaagcagaggcugaggagucugggggcagggagaggggaacuggggagcacaagggggagacaagggcaggaagggggcagggggcauguagagagggaagacuguggggcagggagagggaaugaguccagagaggagggacuggggcagggagaggggauacugggaauagggagaaggggcagucugggagcacggggagggggauggaugggcagagauguaagauguucauuagagggacaauggccuuacgcagggauggcauugaagagcagcgagaucgucuugguggcugaguaucgaacauugggcuccauguacaucagggaugggaugucaauuuucauggggaagccgggcagguaccgauucccacugcugggggucgggggaguagaaagacagaaaccagucagugggcccugaagcccagcugcucaacuccuucccucuuuccugccuuccaagucccugggucucucuuacucccggcuccuccccugcccucucugcuccugagcuaaaauaaccuccucacucuuguccccugugccagacccuuuggggccaucucccauccugaugcuugaaugaaacugcauugucauagaccccuaccccuccuuccuggcuaucaggaccccauccucccgacagaccuuccacuugacuuccuuuccccuccuucccaagcuuuaaucuucaccugucacccuggucuacacaaguugucgucuuugucaaggcaaauuucuugucugacuccaucuccugaaagcuguugacgucuaccaugcaggggaagccaggggcauagaucuuccagcuuccgagggaaagaggucagagguggcaggucaugcucgggauaaacacaagucuuagcuuuaaagacacggcuucagauuaaaacuucaaaaaccaccuacuuucuggaugagugacaaggaauuggacauuucuccaugaaagcacuggcuucacauaggguagcauuuaaggauggcauuaaugcccacacuggguuagagauggguuuguguugagauuaaaaucauggccgguuuagugggggaggcugagaaaggacugagauugguggauacuucaggucacuucugauauugggaucuggguuacaucagggacaguugagggcugaguauggauucauuggugguguugggacaacuguuacuauugguguucucaguucagauucagggucacuauuaaagugggguuagguccaaauaagaguccugauccaagcuaggcacccaagguugagaaugagguuagaguuaggaacaaucugauuaagacugaggucaggauaaagauggggaaagaagucaaauuaggccacccucaccgguagcauucuugucgggcccggagcucccguguccugugauccaggaggaggggaagagaguccugacaaauaguucuugcuguggggaaugaaaauuacucuugguauaagucucuuuuccaacaacaucuucugcaaaccuugccugaacccccugacccuugaacccaauccgacagccacaucccugugaaacacguggcggugcccccacguucuuuguguauucaucaguagaagggauucaagacagcuucacccccaaauuauagcaaucuucccaauuguuggcauguuuaucuccccuccagacuauaaacucccugagggcagaagucgucuuguauuccuuuuucuucuuuuucuucuucuguauucccggcuucuagcauggugccuggcaccauguguauaagaugcacuuuaaaugacugaugaacaaauauauuuugugaagcuauggauggaugugcuguggagauggaugagaguuuauagugaggucuauggaaaacuuauuacggaccaugggguaauauucauuugccucacuuugaccuagaauaucccuccuucauccugagccuccucccaacacccagagcagcccuacuguugccucuccagaucagauagcucuggaaacugaagaugcucaagcccagcaucugcagaaggccccagaaauucaacaaggaauccuagcagcaccucucagggaccucauccacacuagaaaagcuaguaguaggggagggaauggggccucuccagcuaaaaucucugagcagccagggcuucucuaccuguuaaaaucuaaugacucagggugcagguuaguuccucucuggggucuggaggaacucacucuggagaagugcagagggaggcuguggaaagcaaagugcuuccuauguguaugagagaagggugccugccuauaugaguguaugugucuaugugagucuccagaagagucaauaccgucugcaaaacccucgcauuucagggcuugagaggcucccuuuuuucagaaaacaucuacuugggagcccagaguuucugaccucaaucuuauucccuauacucuggggcucugugagaccccacuccuaaucccaaaggacaccuucugcaguacaguguaguccucgucucuggcccaccuguuccuggccucagcuccacggugcaguagccuucaauccacugauagcaggggaagugggauacacuaccauccgguucggugacacagaugcggcuacaguaccaagaguccuugcggaagaaagcguagcgcuccuuguguacacgcagcagcaagagcucacccagcuccgcugugcaacgcaccuuguacuucuguaccugaggggaccaagacagcaagcaggugagaggcggggaacugccaaggcgguccuugcgccuugcaagaugcaucuacaccuaagccuauucgggcauacaaaccugagcugcucccagcccauaccgggcuuuuguaugaauuagaaaaagcuuccccgggccgggagagguggcucacgccuguaauccuaacacuuugggaggccgaggcggguggaucaccugaggucaggaguuugagaccagccugcccgaugaaaccgcuucucuacuaaaaauacaaaaaauuagucgggcgucguggcaggcgccuguaaucccagcuacuugggaggcugaggcaggagaaucgcuuaaacccgggagguggagguugcagugaccugagaucacaccacugcccuccagccugggcaacaagagcaaaacuccaucucaaaaagaaaagaaaaaggugcccgagcacagugggcacugcauuucacuagcuuccuaggccggcugggaacucuuguggaggccaccuggggcuggcagaggcaggcagauccccucgauaagaggaaacccaggcucagagaggggaagcgacuugcccaaagcccacggucaauuaugggaggaguuuaggagccaggggaagucccucuacucccuguccaacgcuccuuccucuccacaguccugccuggauggaguucaucaucuccaggaaagacagggaccucaauagggaaggugaggaggucagggccgguauccugaguucagcaggaucucaagaguccaggaggaauacuccucccgccugcggccccugccccucugaggucgcgcuucccugucuccuuuguacucaccgauccaggggcgaagucccugcccauucgaucuagccgcugcuuggggcuuucaccacacgugcccaccagugugacagagauguuguccagugugccggcccucagguagggaccaguggucacacacaggcgguacacugccaugaugggaaggaggaagggaugccccggcaacgcuggccgcagcagcagccggccuggaggagaagagcggcacgccggacagggcuggguuucugggcggagggcuaggggcugcggggcuggguagggcugaggaugggcccagcucucucugggauguuccugggcuuucucucuccgaagcucccugcuggcggcucgggcuuccucucuccgcccacagucuugcacucuaauacuuguuugcuugccucugacacagccggucccucuggcuggcucacccagauggauaucaggagccuggguuccacugcggagggagggaucagaugcugagauggagaaaaggagguaacgccuguauaauugggacacugcccuccgccuggucagcggcccggacugaugcccuggagugcuuguccgcccacuccccaaugucccccaagaucuguuccuccccauucccaggcagagaugagcacagggcaccugcauuccuacgugugaaucauccgugugaaucacuaaacaguggagaguugcacuuggucauaaaucacacgugacugcagccacacgcaggugagucgcacacgcauuccagcacaugucaaauggucaggaacagcucccugucaccccauacaccgauccccccacgcauggcccucuuuguccccagccuuuggcacgcccgaccucauucucugcucug

SEQ ID NO: 16627 - RNA, 3002 nt, Homo sapiens
ugagagauugagagaggccagacacuuaguucacaaggcuauuauauuaaaaaauaagagauaaagccaacaaauauuuauugaguacauacuauacaguaacacugcuguuggcccuggagauaaaacagucacaggucagcccuugcucccauagggcuuacacuccaguggggacacccacaaagcaugaaaauaaaagcaguaaaaauaaaacagggcauuauguuacagaggggugggggaaaaggcucuacuauguugaaggcagaaaaaggccucccaaaagagggagcauuuaagcugagauguaaggacaggaaaaugccaaaauaggguuacaaaaauugagguuuauacccccauaaguguauaauuaugauuugucaaucaaaaauauuuauauuuuaaaaagauuggaggccucuaaaaaauugagguuaauaauaaguucacauuuuuaacuaagagaaaaauguuacauaguagguuaggauuucuuuagcaauagaauguuacuuuagaacuuuggggccgggcgugguggcucacgccuguaauccuagcacuuugggaggccgaggcaggcggaucaugaggucaggagaucgagaccauccuggcuaacacggugaaaccccaucucuacuaaaaauacaaaaaaauuagccaggcgugguggugggugccuguagccccagcuacuugggaggcugaggcaggagaauggcgugaacccaggaggcagagcuugcagugagccgagaucacgccacugcacuccagucugggcaacagagcaagacuccaucucaaaaaaaaaaaaaaagaacuuuggauaaaauaaucuaucagucauaccuauuaugcuuuaaauauucuaccuacagauggugauauccuaaagaguguaggaucuagaccaaugguacuuaaauuuucacaugcacacacaucaccugggauuguuaaaaugccagagucuggcccggcgcgguggcucacuccuauaaucccagcacuuugggaggccaaggugggcgccaucaccugaggucaggaguuuugagaccagccugacaaacauggcgaaaccccaucucuacuaaaaauacaaaaauuagccaggugugguggcaggcgccuguaaucccagcuacuccggaggaugaggcaggagaaucgcuugaaccugggaggcggaggcugcagugagccgagaucacgccacugcacuccagccugggcgacacagugagacucuggcucaaaacaaaaacaaaaaaacaaaaaacccugccagagucugauucaggaagucuggagugggauccuagagugagacugugcacuuccguugacaguacaccaacacugcugguccuugacuaugacuuuauggucauaagauacaggauucuaaaauagaauacauggcauauauacaacaggugaugucccauuaugggacacaaauuuuaaagacacuuaaaauuguauaaguaucuuuucaguagcgcuaguguguucccgugacuguaaagauaacacagauaauagcaaaaguuugaaauaugaugccuuucaaauggcucucccuuccuacuuugauaggcucuaauuaggugccucacauaaaugcccuuuggaauuucugauaccugcccuagcagguugaagggagauucugaaaugaagcaaggcuccuaaucauagucacaggcagggagccaucucaauuucuggaacacagaacugggaguggggagacagcaggcauaccagcacccuuacaugccagagaagugagauuaacaugacgcgaaaauuagccucuucucucccguuccaucuuaaaaaaaaaaaaaauucaaaccauugacaaagaauugcuaaaaugggaccuguugcucccacacaccagagccacccuggacaaaagccaacgucccagcuaagaaaacagucugucuucuucccacgguaacguaggcuuuguuuauaucaucccuuggccacuccauccugaaaauguaagacuggcacagucaguagaugggggcgaguucgucuaggagccuccccaacucagcaucaacaccucccagggcguucccuccugccuucggcucaucucucucaucacaugccaauccugggaucugagagagaguagucuugacaucagcccccgcgaggcugcagcucccaccuuccuucggcuguagcuuccgaguuccucgguuacaacgugcaacgggucagguggccaauguccuugaucuccgcacaguagagcacugggggaaagaagaaggguuaguggcagcaggagcaugccaacgaaccucgguauuccucggcgcucucuccccugcauccuccccgggcagccccucaccguugcuaggcagcggacgccgccagcgccgcgcaggccccaggacccugucccagagccgccggagcgcgcgccacccagcacuccuaggccccgcccccuucucgcucuccccuucuuccuccgccucuccgucagcgucgcugcuuuccuuggccggguucccagccucaucucguucgcacuuggcccgcgcuuuuuccuccaaucgcgaccacaaguccgagucaagagccaucuccgugaggccgccgcgagggagcugcgagggcgcgcggcagaaggggcacgugaccacgcggcgcaggcgcaccacgcgcgcggccgccccgccgccguccccgcgcgccgccagcucgcggaggcaggcggugcagaucguguggccgcagcgggcgcgcgccguuccgggcaggcggcggggcgcgcggcacccgagguugaaaggacgguagcagauguugcaguccagcucgccccgcuccggaagagaggguacccucaccaagagcugcaucgugcccgccgcggacucgaggacgucgcuaacgcggccagcuccgugaacagaacgagcacacucuccuggggccgggucggg

SEQ ID NO: 16628 - RNA, 2129 nt, Homo sapiens
cgcucuccagccgggguggcggcggcggcggcggcggcggcggcggcggcggcgggggaggggugcggcgggggaggggaggaggccuggccccgcggucgcagccgccaccgcccgccccgaccucccggaccgccgcggggccacgggcccgagccccggauucgcgcuccggauucgccucggcucggccgcgcggugggugccucgcccccgcccggcuucgcgcgcccgcggcucccacucgggcuuggggggggagucggggcgggcgcuuaccuggcggcgggggcggcggcggcgggggcagcgguggcggcggcggcggcggcggcgggaagagguggcagccgggggggcuguggcggucgcggccccggucguggcccggcccgcgcccgaguacucccucgucgucguccuccucaucguccucgucggccgccuccaccuccuccuccuccuccucgucgcccucuucuuccuccucuucuuccuccuccgacaccaccaucuccuccuccuccuccuccucgucccucagaggggaagccauccuguggcucuggcccccccaccacccccccacccaccgcccgcccgccucccccaccgcuaccaccaccaccuccuccuccuccuccuccuccuccuccuccuccuccucggcggcggcguccuccuccuccucaccgccucccccagccccccaaacccccgggccaccccccuccgaaacccccacccucggggccgccgucugaggaggggggccaaaccacccccaaaaauugucuuggaaaaaauugaggaaagacuuuuuuuccuucucucuuuccucccaagagaacaagaaagggggauuuaaaauauauauauauauacauauauauauauauauauauguauauauauaaaaguuuucgacuucucucugccccccucuccguugcuuuaaauauauuuaaauucugaggggggcgcucagaaauauuucucagagcugaggcacuaagauggccgccuugaaauuauuuuuaaaacaacccccccuccagcaccgccacccccuccauaaagaaagggagaggggggaaaauccccuuuucaaacaaaauggcuggcuuaauauuucauuuuucacccccccauucuccucccuguuacacccccaucuccaagccuuuacccagaaacccacaaauuucuccuuuuucauaacugauuagugcacagauuaauagagauauuuuccuuguguacugaaguguguguguguguguguguguguugggggggcaugaaggauuucugcauaaaacaaaaauggcugcugugacuaacuccccccuuauaaaaaauauuugagggggggcauuaaucaguacucaugcucagucugacaucagcauaaauuguuaaagguuaacuaguuagauacuaguccaacuagauuuaauuuuuuuuauuuucuuuacuagucucuuccuccccaccucccuucucuaaagaaaagcuuuuuuuuuuuugaauacuucagaagggagugguuugaugugaagguuuuuuuccccuucaggcauugaaaaggaaaaagaugaaauauauguuuauauauaacucuguuucuacauaccucauugaagucacaacgcauuuaauuguguacauaucuuuuaaaugagaagcgggacuggauuuuuuucugcuuucuuuaaaaaaagugauagaaauccuagugacuuuugggggagagauaugaauagauacgaugauugaguuuuuuucaaaggaguccauguuugauucuccccuuuacccagccuuuucagugauuuauaauuguuauaaauuuuaucuuuacucuuuuccccuuucccucgcuuuccccuccuccaauuguuagaauguaaaauucaacugacuugagaaauuaauuugggggguaaacaacaaauuuuuaggauaaagaggaaagagucaaaucugaagaucgugaaauuauguucucuuuucuuccguuucaguauauuugccuucccuccaugaucuccaacacuauccgauaaaguagaagcaacugagguaccgugaaagagaaaggagcuggaacugagaaaaagcagagg

SEQ ID NO: 16629 - RNA, 2129 nt, Homo sapiens
ccucugcuuuuucucaguuccagcuccuuucucuuucacgguaccucaguugcuucuacuuuaucggauaguguuggagaucauggagggaaggcaaauauacugaaacggaagaaaagagaacauaauuucacgaucuucagauuugacucuuuccucuuuauccuaaaaauuuguuguuuaccccccaaauuaauuucucaagucaguugaauuuuacauucuaacaauuggaggaggggaaagcgagggaaaggggaaaagaguaaagauaaaauuuauaacaauuauaaaucacugaaaaggcuggguaaaggggagaaucaaacauggacuccuuugaaaaaaacucaaucaucguaucuauucauaucucucccccaaaagucacuaggauuucuaucacuuuuuuuaaagaaagcagaaaaaaauccagucccgcuucucauuuaaaagauauguacacaauuaaaugcguugugacuucaaugagguauguagaaacagaguuauauauaaacauauauuucaucuuuuuccuuuucaaugccugaaggggaaaaaaaccuucacaucaaaccacucccuucugaaguauucaaaaaaaaaaaagcuuuucuuuagagaagggagguggggaggaagagacuaguaaagaaaauaaaaaaaauuaaaucuaguuggacuaguaucuaacuaguuaaccuuuaacaauuuaugcugaugucagacugagcaugaguacugauuaaugcccccccucaaauauuuuuuauaaggggggaguuagucacagcagccauuuuuguuuuaugcagaaauccuucaugcccccccaacacacacacacacacacacacacuucaguacacaaggaaaauaucucuauuaaucugugcacuaaucaguuaugaaaaaggagaaauuuguggguuucuggguaaaggcuuggagauggggguguaacagggaggagaaugggggggugaaaaaugaaauauuaagccagccauuuuguuugaaaaggggauuuuccccccucucccuuucuuuauggaggggguggcggugcuggaggggggguuguuuuaaaaauaauuucaaggcggccaucuuagugccucagcucugagaaauauuucugagcgccccccucagaauuuaaauauauuuaaagcaacggagaggggggcagagagaagucgaaaacuuuuauauauauacauauauauauauauauauauguauauauauauauauuuuaaaucccccuuucuuguucucuugggaggaaagagagaaggaaaaaaagucuuuccucaauuuuuuccaagacaauuuuugggggugguuuggccccccuccucagacggcggccccgaggguggggguuucggagggggguggcccggggguuuggggggcugggggaggcggugaggaggaggaggacgccgccgccgaggaggaggaggaggaggaggaggaggaggaggaggaggugguggugguagcggugggggaggcgggcgggcgguggguggggggguggugggggggccagagccacaggauggcuuccccucugagggacgaggaggaggaggaggaggagaugguggugucggaggaggaagaagaggaggaagaagagggcgacgaggaggaggaggaggagguggaggcggccgacgaggacgaugaggaggacgacgacgagggaguacucgggcgcgggccgggccacgaccggggccgcgaccgccacagcccccccggcugccaccucuucccgccgccgccgccgccgccgccaccgcugcccccgccgccgccgcccccgccgccagguaagcgcccgccccgacuccccccccaagcccgagugggagccgcgggcgcgcgaagccgggcgggggcgaggcacccaccgcgcggccgagccgaggcgaauccggagcgcgaauccggggcucgggcccguggccccgcggcgguccgggaggucggggcgggcgguggcggcugcgaccgcggggccaggccuccuccccucccccgccgcaccccucccccgccgccgccgccgccgccgccgccgccgccgccgccaccccggcuggagagcg

SEQ ID NO: 16630 - RNA, 1972 nt, Homo sapiens
ugcaguaccucaggcagccggucagcggaucuaugugcuugcggaucuuuaaaggaggguuuggggcgagggugucagagcagccauuaggcucuggcuagccuccgccuuuccuucccauccccgcucuccauuuccucuacccacaaucccagguuccagcauaacucacgucucuggucuuuggaucaaaccaguggcugauauccuggccugcaacuuccacgauggguuucagcagcagguucccuugaaaagagcagcacagccacugucaaugccagcccuucgagaaccaggcaaacgcgcgcgugcacacacacacacuccggccccggcccaacguguggcccuuacccuuguauuccugugccaaugacguuaggucguacacgcgucccagguaagauacccagaggucuucgggccuguuauguugggccaccuccgccggcgugaaauagcgacgcugaaaauacuccaagucuggcccagccaccaggccccggcgcggcauggcucuugcucugucggucacuggaucucuugguuacuccuuugcuccucagcacguacucacuacuacuacgaccuccgucgcguccgggagccgaggggagagcguuuauccgcugacauggaaaccauuguccuuuuccggccaccguccacugagauaaauaucaggggcgggguuuggacugcacguguucacgggaaacguaguaugagucccgcguggggcauauaaggaucaaguaauugaguugcgccgcuuucaggaguugcgggguggggcagagaacgaauacgcuccguuuuaauucaguggccugggcuacaugggauauuuaggacagacuaucucucugagacagaaaaacaagggaggaggcaguaugaaagaauguauucucgcuaaauuccaguuucuaaaggauguguaagaaaccagagguaaaggucucgcgauaucuuaagacauccggcguaguacgcuucagugagccacagcgcuagagaaguaggagaagcucgcgagaucugugccguugccgaggagacuaggagggggaggagaggggaucucgcgaaaggaaagaggucgggagcgcucgcgagaucucggaccacccaaccugaaaggugcuuaggaaguugaaaggcccagaggaggccuccgggcaaauggccggagcuggaccgaccaugcugcuacgagaagagaauggcuguugcagucggcgucagagcagcuccagugcugggguuagcacgggcucugguucugggacugaggggcagucaagcagcaagauggaggggguggggaacugcagcucccggcagccucugggcuuugugugagugccccgcgggcugccgggagcugugguuccgcgggcgggcagccugggcugcgcggucugagcgcuuguuacaccccgcgcaggauucggacggagagcgcgaggacucggcggcugagcgcgcccgacagcagcuagaggcgcugcucaacaagacuaugcgcauucgcaugacagauggacggacacuggucggcugcuuccucugcacugaccgugacugcaaugucauccugggcucggcgcaggaguuccucaagccgucgggucagugcccggggaaugcacacccgccugguaauguggcggaaccuuacgcaaggcauuuccccuuaagggccuggcugcaacccuuguuuucuggggcucguuuucguggcucagaggggcgggacugauucuggccuacuuuccugaugcucugauccuucuuuccagauuccuucucugccggggagccccgugugcugggccuggccaugguacccggacaccacaucguuuccauugaggugcagagggagagucugaccgggccuccguaucucugaccacgauggcgcuuaccuuucagacuucauuaaacuuaugaccgaaugggc

SEQ ID NO: 16631 - RNA, 1972 nt, Homo sapiens
gcccauucggucauaaguuuaaugaagucugaaagguaagcgccaucguggucagagauacggaggcccggucagacucucccucugcaccucaauggaaacgaugugguguccggguaccauggccaggcccagcacacggggcuccccggcagagaaggaaucuggaaagaaggaucagagcaucaggaaaguaggccagaaucagucccgccccucugagccacgaaaacgagccccagaaaacaaggguugcagccaggcccuuaaggggaaaugccuugcguaagguuccgccacauuaccaggcgggugugcauuccccgggcacugacccgacggcuugaggaacuccugcgccgagcccaggaugacauugcagucacggucagugcagaggaagcagccgaccaguguccguccaucugucaugcgaaugcgcauagucuuguugagcagcgccucuagcugcugucgggcgcgcucagccgccgaguccucgcgcucuccguccgaauccugcgcgggguguaacaagcgcucagaccgcgcagcccaggcugcccgcccgcggaaccacagcucccggcagcccgcggggcacucacacaaagcccagaggcugccgggagcugcaguuccccacccccuccaucuugcugcuugacugccccucagucccagaaccagagcccgugcuaaccccagcacuggagcugcucugacgccgacugcaacagccauucucuucucguagcagcauggucgguccagcuccggccauuugcccggaggccuccucugggccuuucaacuuccuaagcaccuuucagguugggugguccgagaucucgcgagcgcucccgaccucuuuccuuucgcgagauccccucuccucccccuccuagucuccucggcaacggcacagaucucgcgagcuucuccuacuucucuagcgcuguggcucacugaagcguacuacgccggaugucuuaagauaucgcgagaccuuuaccucugguuucuuacacauccuuuagaaacuggaauuuagcgagaauacauucuuucauacugccuccucccuuguuuuucugucucagagagauagucuguccuaaauaucccauguagcccaggccacugaauuaaaacggagcguauucguucucugccccaccccgcaacuccugaaagcggcgcaacucaauuacuugauccuuauaugccccacgcgggacucauacuacguuucccgugaacacgugcaguccaaaccccgccccugauauuuaucucaguggacgguggccggaaaaggacaaugguuuccaugucagcggauaaacgcucuccccucggcucccggacgcgacggaggucguaguaguagugaguacgugcugaggagcaaaggaguaaccaagagauccagugaccgacagagcaagagccaugccgcgccggggccugguggcugggccagacuuggaguauuuucagcgucgcuauuucacgccggcggagguggcccaacauaacaggcccgaagaccucuggguaucuuaccugggacgcguguacgaccuaacgucauuggcacaggaauacaaggguaagggccacacguugggccggggccggagugugugugugugcacgcgcgcguuugccugguucucgaagggcuggcauugacaguggcugugcugcucuuuucaagggaaccugcugcugaaacccaucguggaaguugcaggccaggauaucagccacugguuugauccaaagaccagagacgugaguuaugcuggaaccugggauuguggguagaggaaauggagagcggggaugggaaggaaaggcggaggcuagccagagccuaauggcugcucugacacccucgccccaaacccuccuuuaaagauccgcaagcacauagauccgcugaccggcugccugagguacugca

SEQ ID NO: 16632 - RNA, 1784 nt, Homo sapiens
uccagauuccuucucugccggggagccccgugugcugggccuggccaugguacccggacaccacaucguuuccauugaggugcagagggagagucugaccgggccuccguaucucugaccacgauggcgcuuaccuuucagacuucauuaaacuuaugaccgaaugggccugugucuguguguagcugggaugccggugcaggauagcacaccccaucccuagaggaaagggcucaucugaagucgggagcacccucaacccuccucucccaaccaagauguccaggggugccaaagguucucucaaguucagggguagagauggggggcagggcugaaugacggaccaacaggccccagggugggccccugcaucuucccucccacggcugcugcuccagaauuguggcgggagggggugucauccugcuccggaaggcccauuguuucccaccccggccuggcaacaccgaguuccucuaagcuggggucagagaacgggcucagguccccaaggggagcagcggcaggcggccgaggcugggccccuccacucuauugagggggaggugccuggggucaggaacagaucucugaggucuggccaggaagaacggacaaaagcgauaaggccagggggcucaaggaugcuccucucugcucauuuguagcccuggcacauguuuccuguuccucggcacagggcaggggugauaguacuugugccacgccucuguucgcagagcgcguucaguucguuaaaucuuuauugaugcguggacacuccuuccccuccagccccgccccccagccccagaaauacuagagaagcugcaccauaaaacgagggcacgagauuguugucccauucacgacggagcugagggggaggugugcagguuccagccuagauguucaggauugagaugugggucgugaaaggaaaguggguuuuccgggaugugggggcuuuucucagcacuggguccacugacgcugcugcucccaaggggaugcuaggacuccgcucaggcaggggugggggcagggcaggucggaagaugccgggcuucaaguccuugggccgaauaagagggagggcagccgucaggguuguucuugacucgagggucauuagacccagaccuuuccugaugugggaacggccugggacccuggugaggcccggauuugccgcggcugcggggcgcgccgacgccgauaaagggcucggcuguagggcacgaggcaaucggcuaggcggaggcgcaggcagaggcggcgguagcuggccagagcaagcacgagcagcggcacgaggagcaggaauccggugaccaguagggccgugaaaccggggucccgcaggugcgcggugcaagggggugccugggagcgcaggaacugugggagaagaggcgucaggcccaagccgaccaggcgauacugugcacgggguggaaacagcccaggcggguugaaguuguggcccauagaccccaccgccagcaucaccacacaccaacacucacacucacacgcacaccccggggcgcacgcucaccugagaguggcagaggaagccgaagcccagcauggugacagcggguagcaagauggucccuagcaccagcaccagcaggagaagauugaaggcagccaccagcagauucugggcuguuacaagaacagcgcaggcccaacaguccagggggucccggggcucugggccgucaccaggaaccgcucgcugugccccggggacauccgccauggcccgccug

SEQ ID NO: 16633 - RNA, 16418 nt, Homo sapiens
uuuuuuuucuccguuuauuuuuaauauuaauauucucacacaaaaaucaccgaaaauagggguaggguugggaagaccccucugccccuggggcagagagacagugcagugcgagggugcgggacuguaaaccccccaccccuccgcagccccagcguggagaaaaaacaaccaacaaaacgaaaauaaagccccagagaaacucaccccggggugucccugccccagugaggcccuggcccuggguuguuucacacuuaaaaagaaaagggggugggggugaaggucuguguuuuuuaaaguuggccggggcugggaaggacgggguuccuuuuccucauaguucuuucuuuaaaaccuuuaauuuuuuuauuuuauuuauuuuuuuuacaaaauaccauuucaguucccacuucuuccccuacaguacaggaguugcucacccucagguggggcuggggucgggucgggaguggggggacugguccgagaaagugcaggacguaggggaggggagcggguuugagcaccaugagaacccggcuggagccgcgggcggacggguggagacggucgggccgggcccggacacacacuggggcgcggggagagcccggcgacgggcggucccuggaggggcgggcaggauggcuugggggugugggaggucggguuuucccaaaaaugaauaaauagaggugagugggacuguuauaaauuaaaaacaaaaaaacaagaaaagaacaaaaaauacaaaucauaaccaagugaauaaagagacauguacaggggucacagcuagcauuggaaguaaaaaaggagguuccgggggagggguaaagcccauagaaagaaucucauuaaaaaccucggcugccguaacgucuauguacauacacgagccgcgugcaucugcgccgggcgggcgggcggcuggcagggugagggaacccguaugugacccccgccgccgccggagccugguccuugugucuguugcuaaaaaggccaaagucggugaggggaggcgcuggugggcgaggggcugccagcccccucccccgucucccauuuuuuuuccuuuuuuccucauauuugcuaaaaaaaaaaaaaaaguuuuucuuaauaaauuaagugaggggagcugccaaugggguggaagggcugggcccgacccccuucucggccacaggcgggaccuagguccagcccaggcaugugcugguggccccgcggcgccuugcgcgggcaggcaggcgggcggggcguccggccucaucgcgacgugcuggcuggggccuggggggagaaagccggcgggggcucagggaaaggcgcggccgggcucccgaagcccgucccugcagccugccccagugcccuccuccgcugcccgcgcgcccgccgggcccucaccagcgugaaggcgucguaggccugagccagcuccucagugcgguacugcuccagcaccaccacgcccugcaggccugcgcugcggcgccgggcacagcccucgcaguguaccagguacguguugcggcugccauucucacuugucacgaacaggauguuaaacaccuccaccuggggcagggaggacagugcagucagggggagggagggccacuguggacacucagggagagcagcagagccggcccacucacaucgcacucguugcaguaguaggcuggcucguccuugacacggcccugguaagcgauuuucuucccugcccgcaccaggcucucgcguugcaccuggcagugcuucauggacugcagcaggcagaaccuggggagcagugggguuguguugagaccaccggcaaggaggaggccugaggcagggcuggagcaagggcagaggggugggcagccccagggcccuccccuaggggccuccccgcuucaugucuaggucacauccucuguccugggcaucuguuauaggcgaaguuuccuguggcuuuugucuauuuggaccacuagaaaaggucaugacagcaaggaccuaguuagccuccccaacacaguaacacucggggcacaggcagacaaggauggagagagguaaaaaugggguggagucagacaggaagaacaagaaaagggaccagucaguggaggugggcucccacccaaauaggguccucacuugaucaucuugaacaagucggggucgcugauuuugaccgugcgagccacguuccaugacacgugaaucaugggcacgauggauuugacguucuucaccucauuccacucguaucguuccagggccagcugguacugauaggcugcgggccaaaggcgaucacaacaggacucucaaacagcccccagacaccuaggcccaagccccuucccucacugcuggcggcucuccaagccccagccucccaggcccuugccgcugaggcgccacaccacgccaacaccugccccacccucucaccggugaggggccccacguuccaggcaauguuguugcaccagccgguggccugcacccagugcacaguccccgcauuaauccacacgaggucuccgggucgcugcacgaagcgguacacaggaauauuggaugcauagagaucauccaggauuggccaccaggaacccgucaaguaguccacgccgugccugcgggguggccacaggucaggugggaacuggggaccgagggcggggacgcggcagucugacuugcgcaggacggcacgcaccgaucacagaaagcgcugauggucucccaguagugcucgugcaccgcgaaccacucgcagucgccugggccaauguugauguugacggagcagaaguuguuauucuccugguggccugcaggggucgacagagaacggcauggcuggccaggucggaacugcgauccccgauagccccgcccucugcccucauuggcugacggcugagcgccgccgccagccccuccucucgcgcuuccagcaucagcgcgcacaggcguggagcgcaccuggcguucggcugccgggcaccuucauguacagcugcaccguguucaugcccaggaugguguggcccacguggcucagcauguugcccguggauguuacccgcaugaaggcgggcagcuucagcagcuccugcagcuggggcuuccaccugcggugcggaagugcgacgagaggcuacaccccgcccccgccacgagguccuagcagcacuccugccccaacuucccuggccucagccccacugaccgcuuagcaucagacaagucgauguuggugccaaacuugaugaugugaugguucuucgggucuggugcgcugcugcuggggcgaagagcacagguugguggagagcagagggaggggaaggaagcaggaacagaaggggcacaccugcacaguaccuaggagggguuccaguggugcugucuggcuccucugacuccucauccucacucuccuucuccuccuguucagccagaggguaggcaggccugggucagagaccuuucgagagcccucccaccgcagccccgucccaggaccugccucuggccacguucucaucucaccugcagagacuccuggaaggaugaggccugguacugugcguacuuggcaaugguggugugggaacgggagcucucacaaggccagaucugccgagugccugucagaucccaguucucaucugagggcugcugcaccugggugcgaacuuccacgguguguucgccacucgcuuccaccagggucuugguggagaagaggcccaagucuggaagggagggccgagcagggugucggggcagaggcagaggauagggaccgaggacccaaucgacccuuucccuuccuacuccucuggcucugacaggguggucauagguuuagcagagcucagcccagaagaaauaggcaggagcccuagccccacaggaagcugggagugcuggccucuaucugcauccucaccagcccucuuucuccugcagcugcucaaggacucagccccuagaccaguguucccagaugugugcguggccaugugcaccgcaccugacagacacauaguaggugcucaaugaauggcagcuucuuuuuuccccauuuggagucuagucaaaacagcagcuucuuugaguuaccauuggauccaauuaaagauuaaagauucagucaagugaaagccugaaaugugcuucaaauaacucaguguggggaagggagaacauacagguauaaaggagacaagauugaccuuuguauuucuauacagcuuucucuaauuuuguauguguuugaaauucugcgcaauaaaagacugagagagagccccaacaucacagauuuucagggguuuucuaaaaucuguauuauucucuuccuuaaucaccaaaaaauucagaaaugacuaaucaggcccugacuauggccccuucucccuugccaaaugcuggagacagacagaugggagaagagcccaaggccagcagacccaucacucaguggacuccucacggccacugucaugagucuucaagugugggauuucucagaggguccuacaugccccagacccuuguagcccucccuaacacuuucugccccccauacucacugagccgcagggagcccgccaggccccggaucacugugaugggauuucgagggucuguacagaacugcagcaggacaggugagaaggcaucccguuugcucuccagcugagacaugaccaggagagcuggggucagagcccuggcccaggcucagagcaccccagcaguccccaacacugucuuagaacccucuggcaggggugguucugaggccaaguggcacacauacauagaugcuggguguagggggguugaguuuuucccggggcagcuucuccucaguguugaucuucgguuucacagacugggcaggggaaagguaggacucucgaaacuucccuuucaccuuggcauuccugcgggaggacaguggaaugaagacagaaacaucagggugaugggggaagggagccugucuccgggacaagcaagcaggcagccgacucaccugcuggcgcgcacgacgucagcagcacaguggcugauggugaggucugccaugcgcagccgccgcucuuccaccucagaggcgauaaaggucuccuugucaccacucucuaccuugaugagccggaucuucagcuccuuggggggccccucacuaagugagcgcagcuucagcaugucggcccggcugacacccgguggcccuggggcuuccucccgagccuucuuuccagggacagaggcugacgggggugugggcugggcagaaggugcaggagcugauggaggggcuggagcuguggguggcuuggccuuggaggccccgccaagaucgggccgggacuucucacgacccuggaucuccucgcucugcagguccagguuccccagcacccggcggcucuuuucuuuggggaccuuggccuuggccuuugcccugcccucacggggccgacgacccacacuguccuuacaggcccgccugugccgccgaugcuccuucugaugcuccuucugucgccgcuuacagcugccugacacugccgccaccccgccagccuccuccuuggccugugcggggggcagcagucgcucagucccacuguccgcuggcucugcuguguccacugggucggcugggucaguggcacuccggcccacccgcuccacaagggucucgcaagcccggcugaucucuucuagcaccucagacucagagcgagcagggggcagagauaggggugggggcgguugggugggggucauggggcccgggacuggcucuucgcccgcccugcgcucccgggcccagggcccgccugagguagagaacugagaugacgaggaagcagagggcuguggggagcccugggcgcuaggggccgcugaggugggcggcagggcgguagcaccugauggggggccaggggaauacugaguggugggcaagggcccaggccggguggaaacagcugcuccagucccccgauaacaguacuuuugucccuccagcacggaggccaaggauuugagcaggcuggccgggcugggggguggggguggugguggcuguggcugagaggguggagggaacuuggcuagaggcggugguggugguagggcuggugguggcuucuucuccucuuccuggguggccgugguggugguggugguggugguggugguggugacggcgacagcaggagcaguaguggugggggcugugucgguggggaaaggagacugcagagaugcaaagggcuccuucagcggggguuggggggccacgccugcuucguguuguugcuguuccucuuccuugcgaauggauucguccagcaucuucaugauguuggccagcccaucagguaggaucuugaauucggcuggcuccucaaacugguccuccagcggaguggggggaaaaucaaagagucgagggccucgggcaggcagcuccccaaccccgggcggcacaggcuggggggcuuuacucagggggccuggggguggccccggccccaccucgggggucuuugggaaggagacccugggccgggggcucuccgggcgccugaagcuuccugagguauuuugguggcaggaggaaggaggggcuggaggcagggcaagagucagggguacaagagguggguccuggggguucugugcugggcugggaggccggggaagggggucuauacuucuggccagauaggguggugggggaaaggacacaggcccagcagggcugcugcuguggcugccacuguugcuguugcuacugcuggugguugggguugggggagugggaggggugugagaauccugagugcccacagaaaagcgggaggccggaggccccaagaagcccucgcgaugggggaggggugguggggcagggcgggggggucccucagucccaaagaagagcucuucuaagaucucuccauccucucgggcugcccggcaggccggacccuucaaccaggcagggggugguggggggcguaagaggcggggacagggggguggagggggugaggaagguccagguggcagggauagguggggaguggcagcgggagcccccaagaacgguuuccgacugcugugugccgagggccccaggcggccauggugagagaccuccagcgcgggaguuugguaauggucagcgccgggcugcaaguguagaagcaggugguaggagcauugcucgggcugccucaagacaagcuccacccaucccccccuccacccucaguugucacucacaaugccuggguucggcuccacgccccggagaccaguguugcugcugcugcuacugcugcugcuggugguggugccggggaggccagggggccgggaaggggcguaaggcacgcaggcggugguugcugcuggugaaacgcuggaguccauccgcgaccucugaacucugcucucucuaaggucacuuccggggggacggguggcaggcaggcagccauggcucucugcuccuggggggcgggggccugggccugggggagcagccgggaccagccgguggccaggggggugcgcgguguacgcuggagcuggguauggauaugggugaggcagcgagugccgcugcuccuauaggagauaaacagggaugcaggaugaggaauagagagcgugggacuuguaggugagaggugaaaggcaacaggcaggggcucaccuggcgcucugggggugcugaacccuugcgcucugggccccaggcaucuccaugcaggguacuccacagcccuggcuugguuagcugaaauggggggcugguagccaggccaggcagggguggugguggugguggugguggugguggugguggugguaauggugguggaggcaguggcagcccugggggaaggccagucuaggagagaagagagugugagaaucccauucccaaguccugccuacuuacugccugcuggccccccuauacccacaccuguucagaguugcagccucuccuucgcuugccuccagggcugaggcccuccuccccugaggggccugagagugcugcaggaggcacaggcugcaccacuggggguucagcagcucgcuucaccgggggaccuccccgcuuggcuccauaguuccguuugugcugagaacaaaaagagagaagagaaaauggcacgggugcaggcacagccuggcucuccucccuaacccacccagugccagccucaccucaagguguagcaaguuccacacuugcuccagugggggcaggaccuuggcucggugcuggcaggagccaguaugaaaguuccagagcugggccuggggguggggggacacggggcaggggcagaugucagguggggcacugagccagaaggcacaaucguacaaucccgucccccacgcccugccuucuccuaccugcugcagucggccaaugcggggccccagcucagcgaagcuuccuccguaucgaagggcgcugugguagcagcguguggccuccucacuaucgugcucugacucguacaguugcccaagcuguucccaaagcccuggcugggcuggcucccggagcaaugccugcacacagccaugcagggauuccagcuucccauggaggggucuuggagugggcgcccuacagagcagaagggguggggguguggguggggguugggcuugaggggacucuuucaaggccccagccuuaccucccacucccagaaccuucaaauauccacucacccuggagcauaauaugguuugcuggggugcccagaacuacugccaugugaaggggguaggggagcaggaagcgggggcugcccaaugcuggcugagcaucuggagagagaaggagucuguuauauacggcaaaaaggagcagucuuguccuaccuaggcaggagggggcugaugcacggaagcccacagaaugacaggaacccauggagaaugacacagauugagggauacagagauggaaagaggugugccuggagacagagggccccaacuucucaccugccuccaggcagccaugcgcuacgaggagggggaugaggcgggcaggagcuccaggccccagcacagcucaggcccccaagggcaaaggcuucccgugcagcgcgggccccuggaggguccacugcccgaugcauccagccugaguuggggauaagaaauuaugcucuuacuggaggcaaaaccagagcugccaguguacauccagccagcucggccccagaguuucccuuaccaggucagcaguggccccaggagcccuggagauugggcacggcccccugccccagcucucugggacgaugguccggcuccagccgcucugauaagagugcccgcuacccccagauggcugccucaguccuuucacagccaauucuagagagaaggaaaaggagugagacgagcuggccagcacacagucaaggcccaggggcugggaugggcggacuguggcauccaccaauuugucauuugugcaaagggcccggccuuagcuuuccccaaagggaggcccggcccaaccacucccuagaggcccaggaguguggcugggagucaggacguguguggcagggaaccaaaaggccggucagagggacgggguggcugcgcugccaggcuuccaguccggagccacugggccgacccaaaacgcagcggccgcuuacccggccuccgugggagcguccucacaccgcgucggcaagcuccagagaucuggccaaucacaggacuuccucucuccccagaaagccaaucaucacccgugucuccgccucaguaacagccuggccggaaccaaugggagcgaggugagcccggcagcgguggccgggggaggaggggcgcgggagccggucagacgagcucagcccggggugaccccgaugugaccccgcggcucccaccuaggguccccaucuaggauccgacacuccggccgucagggccagaaggcagccaggacaagacgcaugcggaugaggccgguuagucgcaugcuccggccggcgugggggccggcgcuacccgcaagccucaagcacccagagccgccgguggccacggccaggcugcucgaguagccccacgcccggccaccguaagaccgacggacgacagacggaugcagaacgcaaaaaagacgucccuccccuuccucacuucaccucgcccagugacagaccucccuaccccgagcgccccuauuaacugcuuagggcuggccagccacagcgacuuccacggcacccaaacccguccgcgccgcuaucggcgcuccacccccaacgccugaccccgacccaaaccuuggucaagcccccagucucauacccaguuccuccagguccucuacuuccccuggcuuucugggucuucaauaccgaccgacccccaaaaucagaccccuuuuagucccccaacuuccgagaagucgcgcaccgcggucccgaguggccccucucucguggcucgcguauccucucugcccuuccccgccggggccacgcgguuccccacggcccacguggcccccgccccccaagggaggggggauuucggggguugcccgugacguggcuacuugcgcagcggaagcgguguguguaaauguacugcggggggggggguccugagggagggaggagggcggggcccgacaggcagugacaucacccuugucccacucucaccacccacucccuuaaagaacccagaacucguuucacuuccuccuucacgccccccccacccuuucgcuuuggugccgacuggacccccgacuggcacagcgcuccccucucuugggcaccuucccuuuagccccagcucuuccuucucgccucucugagcccaggagcugcguccccgcgccuccuccuugccuacccggcguccccgcagguagggagccgacucggcucccgggaucgguccauugagagucuagaguacaaagagcagcgagaggcgagugucgaguacaaagccgcgggggcggggccagcgcuccagcuggagcgagcgccgggcaggaagccgggggagagugcgcgacgaggggcuggggguggcuggaaaguucgcguucguugagagaagucugcgcuguggggaaauuuccacccagcccacaagggcagacggguuucuggugaaaagagccuuccuucccgaaggggcaaggucguuuguuugcauggaagcgcuuggacccuacaggucccugcgugccacucuccgccaagcccuuguggucgcuugggccccgcggacccucuccgcgguucacgugguauuacugucagaacucucuccucacuagaggcagcauccuuuccaucaguaaccaagccagguacggcgcugaacuguggucaaguauggcccuccgugacugcccccacccgaguaccgaggcaggggcggggaggagacccaagaaccagacguggagggggagccggggaaccagacaacagaggggcagaugccugcuugggaaguggucccgagagcgccgccaguuaccaggaaaggcagcuuccccuucggcgaugaugacacuuccccucugccacuuccccuuucccacggggaacugacucagcuuucccuaagucagugagugccgucccuccagcucccugcucuuccaccuuuauccacaaagccccacgccagcacccaagaauacaaagcccucacuugaagacaaaacuuccuguacacuaaacacacacucauucucgccagccaccucggauccuuguccgcacccgggacccaggcgcuggacuccucacucgcccccccgccccccguacaaagcccucccucggggucugauucaggcuuggggugggggagcgugagucacccagaaaaccuuccccucuucccacugacucagcccccgccucccugaacacacacagacacacagucagaggcagacacaacuccucagcccacacaccggcucaccaccggucccgcggaauuuccccucucgucuucccccacgauggccccuccccgugccgggcagccccgacgcggcgcuugcaccuguuccccagucgccgccagcucgcgcuccacucucaccuccacucucgcucuggggcaagaauagcccucccugacucccggugucuauacuaaccaagggaagggaaccacggacaggcacaaagacugacacccacagacuccucgaagacaggcgagagguagacgcacgcggccagagccaggcugggagaucgauauacuucugaggcagacauuccagccucucccgacccgacccacaaccucgggagccagcggcucugaaaggguuaauuccgcucccgccgaggccacacccucuccauccgggcacucccggcgaagcccagcuccgcccccuccauccgggcccuggacucgggacuuuaaccgacccccuaccccccgcccccgcuggagccccaagagagaacacuccaucaaucacacccacuuaacucucucugggcuugagccgaggagccccuccgcgcagcgccgcagccgcgcgggacgcgugguaagaggccugaagugcgcacgcaaacucacgugacggccagagacaagagcccgcagauaggguuuuaccuagccggcaaucagcgggcaugcugcgcgcgcgccgagguggggcgguccaggacccucgucgcaacccgcucccugcccguccucaucacgccugguggaagcgagggguuacacgcucgcuucuuaccugggggagggggaggcggaggggagggccgccggcugaggcuccgcugugacucagccacccgggcaggccgcccgcccgggauucccuuccccagccuucccccggcugccggccccuccccgccccccaccgaggagugacggugccggccccggcccgcuaugugucacugcaggccuugugucugccucugacugggcgcuguguucaccagucugucugacacggucggcugugcgugggucccggugucugucuccgcgugcaccugcauaucugcucaucuugucucccucugugccugugucugacgcguuccugucauuaucccugucuacaugacuccgcggggcugucucugucugugugucugccuagcuccugucucggucuuuugucugggucugccucugcaucacuagcgugaucacgugugucuccgcacaugcccuucuguguuugccuucauguuacugaacagagucggggcgacacuggcgcaggcccacccuccugacuccuugcuacacuccucucgauccugacgucucgcuggaucagugaucauucugucugagucaagaauuuggaggucugucugccuucaaucaaguucugucccaucccucgacaucccugcuuauccucagagcucccuguggcucccacuguggugauaacugcuagcauuuugugaauauuuguuacaugccaggcacuguauuaaguauuuuacaagcauuucuuuuacuccuccccaaaaccugacauaggagguacucugauuacccccauuuuacagaugaggaaauugaggcccagagaggcuaggugacuuggccaaagucauucugcaagugaagaaugaaagagcuaggcuucuuuccagagccacauucuuaccacucuuauguacugccucuguccuacucucccucccuugguuuuauccucacaggccaucuccugggucaaccuuccuuucagcucuacccauguuaccauccccaaugucucacguccucuagaggauaaaguaggaggcugugcagcaaaucucagaagucauagguucuucauaaugaagcucauucaguuaacauuauucaacacaaauccaccaugcaccccaaugugcaaaacaucaagcaaaauagugagagacacauagaagaaaacagucccacucgagaaaccccauauguaaugaggaagaacaacacagagagaacuuaagccccuggcuuagggauuaucuucccuuuucuccuacaaaggaaugggaaauaaagcagggccucaggcagagaacugacagaaggagagagggaagcagaagaguaagacuuagguaugggggcaaaugcuauagugcaguggggagagaaugggacugaaagagaucuggaaggaaaggugaaaugccaagacugcuguggcuggcagugaucuccacuaucuccccaaauaaauucugaacacccuccaaaagccaggguguucaacaacuccuauagggacaaagcuguuucccuaccaagaaaaaauuccuccaggguagcucauauccacuuuucagcuugcaaacucccucuucauuucaauaagcaacugaguuguagcacuagggagauaguggggaaaagauuuuuugguaguaguggagaggcuggugaaguacagggcugaaccauuuauaggagauagaagggagguccauaaaccaggagggcugaaccacucaagcaccacaugguggggugcuuagaauuggacuggaccauucugaagagugggcaugauccagaucauaccgagcaucuccaaccauguggugcagaguuagacugcugaggagagagggucacucagacaggacuuaccagauggaguuuggugugcccugucucauuggaaccaccaccccagcagugggguacaacagaccacaguggguggggugggcagugcuacggggcuggcauguugcccuggggggaaccuaaaagaaaaaagucaguuagaggugggggucuuccaggauggagaauuuuccugggcucccugccccccucauuaaggagaaaccuggcucugguggucagauaugaugggagaaucuuguuuccauggcaaccagaaaaagccauccccaaaguggucauccaaccuuccccuuugggaagcaggcucgaucaguugguaaggggccaugauauggcaucugaguaagucuacaguagaccccaaacccgugaucccucuucugacaggacgcuccugcugagacucccuggccugagucgccccagcugcccugacaucuguacacaagccagccugaguccuagcaccagggcaugcagacccucuuccuucagcucuguguccucuccaaccuuaucaagacaccagacagucaaccccacccucuggacucugcccccucuucuucccccaggcgggugcaggcaggucuuggcuagcagcacagguagccagacuagaugaacgggcccaacagggaggggccauccuccccugcaagaacucugacucugggccuaagccuggaaguagccuccacugcaagccuccccucccugccaaccccaaggcaauauccuguuuccccaucaccuccuuccucuuauguggccuaagaaggugauacaggcccacucccuucccaacccucauagacaagaagcuaggucuuuuagcauaaguccaaggccaagaaucagguguccaucaggggucagagcuaaguuggcccucaccucagacucgcuccucagggaccuauguuuucugcucccuuaaucauaguucucugcccuuauggacccaaacacuuggggucccaaucuaaucucuauauucccuagccuuccggcccccauccuuccccuugccucagagacucaggccucuagcccccagucuccaugaugcaauguuccgcaagcuucuguggcugcugaugacacugcccccagggaggugcuauuugugacccaccaaggccuccuuccuaagccaggguaguggucagcuguaggugguagaggucaggcaggcaaggcccuucugcucgggaagggagcuucaggcuagaacucuccaggacagggaggcucauaaccugggagcagagaguguguaucuauagucuguggcaucuguguucugcgguugugcuggggggagggacuaggaaagggcuagucgagagcagagugggcagacuuuaggacagaccaagaggaggagugagggggaagccuagggggucagagggugugugaggggugucuggacaacagagugggggaggggcuaacagccauuuaaagggccagccccagagcuuuaaucccucaccagcccuggccccaagccggaggcuguaauucaucuguccaacagcugggguguguguguuugugugugugugggggggggggcuuccucccccuucuauucccucccuccuccuccccgucccugagucccggagucaaac

SEQ ID NO: 16634 - RNA, 1702 nt, Homo sapiens
gcgcacgacgucagcagcacaguggcugauggugaggucugccaugcgcagccgccgcucuuccaccucagaggcgauaaaggucuccuugucaccacucucuaccuugaugagccggaucuucagcuccuuggggggccccucacuaagugagcgcagcuucagcaugucggcccggcugacacccgguggcccuggggcuuccucccgagccuucuuuccagggacagaggcugacgggggugugggcugggcagaaggugcaggagcugauggaggggcuggagcuguggguggcuuggccuuggaggccccgccaagaucgggccgggacuucucacgacccuggaucuccucgcucugcagguccagguuccccagcacccggcggcucuuuucuuuggggaccuuggccuuggccuuugcccugcccucacggggccgacgacccacacuguccuuacaggcccgccugugccgccgaugcuccuucugaugcuccuucugucgccgcuuacagcugccugacacugccgccaccccgccagccuccuccuuggccugugcggggggcagcagucgcucagucccacuguccgcuggcucugcuguguccacugggucggcugggucaguggcacuccggcccacccgcuccacaagggucucgcaagcccggcugaucucuucuagcaccucagacucagagcgagcagggggcagagauaggggugggggcgguugggugggggucauggggcccgggacuggcucuucgcccgcccugcgcucccgggcccagggcccgccugagguagagaacugagaugacgaggaagcagagggcuguggggagcccugggcgcuaggggccgcugaggugggcggcagggcgguagcaccugauggggggccaggggaauacugaguggugggcaagggcccaggccggguggaaacagcugcuccagucccccgauaacaguacuuuugucccuccagcacggaggccaaggauuugagcaggcuggccgggcugggggguggggguggugguggcuguggcugagaggguggagggaacuuggcuagaggcggugguggugguagggcuggugguggcuucuucuccucuuccuggguggccgugguggugguggugguggugguggugguggugacggcgacagcaggagcaguaguggugggggcugugucgguggggaaaggagacugcagagaugcaaagggcuccuucagcggggguuggggggccacgccugcuucguguuguugcuguuccucuuccuugcgaauggauucguccagcaucuucaugauguuggccagcccaucagguaggaucuugaauucggcuggcuccucaaacugguccuccagcggaguggggggaaaaucaaagagucgagggccucgggcaggcagcuccccaaccccgggcggcacaggcuggggggcuuuacucagggggccuggggguggccccggccccaccucgggggucuuugggaaggagacccugggccgggggcucuccgggcgccugaagcuuccugagguauuuugguggcaggaggaaggaggggcuggaggcagggcaagagucagggguacaagagguggguccuggggguucugugcugggcugggaggccggggaagggggucuauacuucuggcc

SEQ ID NO: 16635 - RNA, 1702 nt, Homo sapiens
ggccagaaguauagacccccuuccccggccucccagcccagcacagaacccccaggacccaccucuuguaccccugacucuugcccugccuccagccccuccuuccuccugccaccaaaauaccucaggaagcuucaggcgcccggagagcccccggcccagggucuccuucccaaagacccccgagguggggccggggccacccccaggcccccugaguaaagccccccagccugugccgcccgggguuggggagcugccugcccgaggcccucgacucuuugauuuuccccccacuccgcuggaggaccaguuugaggagccagccgaauucaagauccuaccugaugggcuggccaacaucaugaagaugcuggacgaauccauucgcaaggaagaggaacagcaacaacacgaagcaggcguggccccccaacccccgcugaaggagcccuuugcaucucugcagucuccuuuccccaccgacacagcccccaccacuacugcuccugcugucgccgucaccaccaccaccaccaccaccaccaccaccacggccacccaggaagaggagaagaagccaccaccagcccuaccaccaccaccgccucuagccaaguucccuccacccucucagccacagccaccaccacccccaccccccagcccggccagccugcucaaauccuuggccuccgugcuggagggacaaaaguacuguuaucgggggacuggagcagcuguuuccacccggccugggcccuugcccaccacucaguauuccccuggccccccaucaggugcuaccgcccugccgcccaccucagcggccccuagcgcccagggcuccccacagcccucugcuuccucgucaucucaguucucuaccucaggcgggcccugggcccgggagcgcagggcgggcgaagagccagucccgggccccaugacccccacccaaccgcccccaccccuaucucugcccccugcucgcucugagucugaggugcuagaagagaucagccgggcuugcgagacccuuguggagcgggugggccggagugccacugacccagccgacccaguggacacagcagagccagcggacagugggacugagcgacugcugccccccgcacaggccaaggaggaggcuggcgggguggcggcagugucaggcagcuguaagcggcgacagaaggagcaucagaaggagcaucggcggcacaggcgggccuguaaggacagugugggucgucggccccgugagggcagggcaaaggccaaggccaagguccccaaagaaaagagccgccgggugcuggggaaccuggaccugcagagcgaggagauccagggucgugagaagucccggcccgaucuuggcggggccuccaaggccaagccacccacagcuccagccccuccaucagcuccugcaccuucugcccagcccacacccccgucagccucugucccuggaaagaaggcucgggaggaagccccagggccaccgggugucagccgggccgacaugcugaagcugcgcucacuuagugaggggccccccaaggagcugaagauccggcucaucaagguagagaguggugacaaggagaccuuuaucgccucugagguggaagagcggcggcugcgcauggcagaccucaccaucagccacugugcugcugacgucgugcgc

SEQ ID NO: 16636 - RNA, 6301 nt, Homo sapiens
uguggggggcgugggccgcgggaugcugccgcccgcuccgccucgagcuccagcuccgguuuuucccuccaccauccucugccccuccccgccucuccuuuaacuccccccuccugggcucgggacugguuuccucccuuagcccgcugcccucaaucccagcgaggcuggggcuccggcucggcgcccccuuccucgcucccugguccggcgccccaugccgcccccgcccgguccccggcucccccagucccccacuuaggcgggcucacagaucccggggugcuggcgcgugggccgggggcgcguagggcgccugcagacggccccuggaagggcucugguggggcugagcgcucugccgcgggggcgcgggcacagcaggaagcagguccgcgugggcgcugggggcaucagcuaccggggugguccgggcugaagagccaggcagccaaggcagccaccccggggggugggcgacuuugggggaguuggugccccgccccccaggccuuggcggggucauggggcccccccauucugggccggggggcgugcgagucggggcccugcugcugcuggggguuuuggggcuggugucugggcucagccuggagccugucuacuggaacucggcgaauaagaggugaguggccugcggcuggggagaucccagacccuagggcaguggguagggaagcucugggggcuuggaggcgggcuucugugggcagggaggaggcgggagggaaggugcuggugcucugaugugugauggguuacuagacaggugaucuugggagccagacuccgggucccacgcagagcuggaugcggguggugcuauggaugucaggaguuuggagaccccaaaggggcaaggagaagaaaguucauggguagccgggagggcagugagguggguauuuggaucugugggaggccugcgucgggggcugggcuuggagggagccugguuacugucagcucucaggagagagcugcagauuaggugcugcgagucgcugaggggaaggcagggcagggugccucccucccccagagggacugcgcauccgagaugggaggcaaggggguuccguuugggggcucuggggacaacuuccccaaggcuccuugacucucuucacagucugucucccaacucuuccccacagccagagggucagugaacuguuggcugaacgauuucccagccagaacauauuccugccuuccuggcuugccggcaucuugcuggaagaagccuggagcccccugaacccuccuuccuucccuuuugcaucuggaggacuccauugcccccucccccaaucuuugcugcaaacucuuccaucagacccucuguuccauggcaugccagcuuugcucugaaaagaggccaggggucagaugaaacuucaagccacgcuggguaggacagaaccuucgggaggucaccugggucccuugccuacaugcggaucccacuucccgcucauaaaagaguucuguguuuugaaaaauuccuacuucccuggggagacugugugaggccaugggaagggggugggcuuuggagcucaucaaaucuuuggucuuaauccuagcucugccgcuuucagcuguguggccuugggcaugucacuuaaccuuucugaguuuguauccucaauccuuacagcuauuaugaggauuagcgguaagguguuugaauguauuaugugcucauuaaaggagagcuaggauuauuguuccucucuuuacuucccagccucccucacacuucucugcucugccaucccucccucucuuuucccuggaucucuuuggguauaaucucaaugucuuuucuguacucagucacccaccugccaacucccagcugcaaugugaguaucagguguguagcuugagaacauaagcuuguuuucacaggguagagaaaagggaguuaggguguccugggggcucuuucggauguggggugggagugggacacuugggagucugggaagauaucaaguagcaguccccugggacccaguccugagacccugucucagcagcuauugauguccaggaaggggcugcagggguuggcaaguuguggcugugcugggacaguggaugccugggugcacuggccaaggagauggugaaguguguugguugugguuagaaaagucaacuccuuuccuuuccaaagcaauagagcacuugccccagaagucuaagacccagugugggauucugagugggagaaugacucaggcagcagguuccuagacccugguucccaucagccccaaugauggucguggccaaaccaggcauuugccuucugugcuauuagcuggcuaacuuaggacacuggucuggaccacccuccacacagccccucccugaaccgccgcccccuuugcccggaaaucccugaaauucagugguggccugaaggaggggaggcucugcccgcaugguuggcugccauggaauagugaaaucaccugggaggggugggcugugugguuccagagaggccagcuccuugguaacuggcauccuguugccauggcaacggggcuggugauggagcgggagauggcggugugcauguggugagggcgggcugaagaguggagugcauuugggcacaccaaggggcaggagaccccugagccuggcuuccugcugcuuccaaugugaaugcacagaguccuuggugccugcucuauaagaagagacuuuccacucagacaaaggcgggcaagcgugagcugagaauugcuguccuggaagguuguggggugagggaaggaaaguucugggggccaggccucugacaucucuuccuuguccaccuuacccuccuccccauagguuccaggcagagggugguuaugugcuguacccucagaucggggaccggcuagaccugcucugcccccgggcccggccuccuggcccucacuccucuccuaauuaugaguucuacaagcuguaccugguagggggugcucagggccggcgcugugaggcacccccugccccaaaccuccuucucacuugugaucgcccagaccuggaucuccgcuucaccaucaaguuccaggaguauagcccuaaucucuggggccacgaguuccgcucgcaccacgauuacuacaucauugguacugcugggcagagggcacgauugaguggggggcuccugauacugagcagagagggagggggaccccugcagccaagagggagaucccagugcccucaggcaguguucacaccaggguguggggccagaaucagggcuagauucuggagugccaaccucuuccucuggcuuuucucucccagccacaucggaugggacccgggagggccuggagagccugcagggaggugugugccuaaccagaggcaugaaggugcuucuccgagugggacaaagugaguggggcugggggacaccuccugggcacgaagggacguuggggcaguacgaucaugguuggggcaguugucucagccccucucugggucuuccucaucuccagguccccgaggaggggcugucccccgaaaaccugugucugaaaugcccauggaaagagaccgaggggcagcccacagccuggagccugggaaggagaaccugccagguaggaaccaggggcuaggccccugccuuccccagcuuccucugcucucagaccccagcugcccugccgucacccucccucccucuucaguuuugggggcggugauacaggaaagaggagaagagaggaugggagggugggaggggaauggaaaccaaaugaggaaaagacucaauuagaacuaauuagccaagucagugcuucaaucagugcugucagagaaguggggaggacuccguggcaggaagcugaagggcuggacaccuggauucugagcagaguucggagggggaggagagaugggguccccaaggggccugggcgcuacaagggaagcccauggggacccccaggguuggguguccaggugcccagguggcuccuucagucccucccccucuuuccuccuucaccccuucccugccaggugaccccaccagcaaugcaaccucccggggugcugaaggcccccugcccccucccagcaugccugcaguggcuggggcagcaggggggcuggcgcugcucuugcugggcguggcaggggcugggggugccauguguuggcggagacggcgggccaagccuucggagagucgccacccugguccuggcuccuucgggaggggagggucucugggccugggggguggaggugggaugggaccucgggaggcugagccuggggagcuagggauagcucugcgggguggcggggcugcagauccccccuucugcccccacuaugagaaggugaguggugacuaugggcauccuguguauaucgugcaggaugggcccccccagagcccuccaaacaucuacuacaagguaugagggcuccucucacguggcuauccugaauccagcccuucuuggggugcuccuccaguuuaauuccugguuugagggacaccucuaacaucucggcccccugugcccccccagccccuucacuccucccggcugcuguccucgucuccacuuuuaggauuccuuaggauucccacugccccacuuccugcccucccguuuggccaugggugccccccucugucucagugucccuggauccuuuuuccuuggggaggggcacaggcucagccuccucucugaccaugacccaggcauccuugucccccucacccacccagagcuaggggcgggaacagcccaccuuuugguuggcaccgccuucuuucugccucucacugguuuucucuucucuaucucuuauucuuucccucucuuccgucucuaggucuguucuucuucccuagcauccuccuccccacaucuccuuucacccucuuggcuucuuauccugugccucucccaucuccugggugggggcaucaaagcauuucuccccuuagcuuucagccccccuucugaccucucauaccaaccacuccccucagucugccaaaaaugggggccuuauggggaaggcucugacacuccaccccagcucaggccaugggcagcagggcuccauucucuggccuggcccaggccucuacauacuuacuccagccauuuggggugguugggucaugacagcuaccaugagaagaagugucccguuuuguccaguggccaauagcaagauaugaaccggucgggacauguauggacuuggucugaugcugaaugggccacuugggaccggaagugacuugcuccagacaagaggugaccaggcccggacagaaauggccugggaaguagcagaagcagugcagcaggaacuggaagugccuucauccaggacaggaaguagcacuucugaaacaggaaguggucuggcuggaacuccaaguggcuuagucugggggaucaggaggugggagguggaugguucuuauucuguggagaagaagggcgggaagaacuuccuuucaggaggaagcuggaacuuacugacuguaagagguuagagguggaccgagaaggacuuuucccagucuucaguggcacuucccaagaucucccuucccuugugcucugugcugauuuuaggacagcuaagaugacugccaugugcuguggcaggccuaauuugucuuguucuuuccuuuccauaucccaguauaaucucuguuaaucaacaggacuaccccaagaacccaugugcucucccgaguaacccagauggcugucuuguucauuccauccuacauuucugacuccuuucagacucaacacaguucccuucuuagugaccaaaaugguggccuacuggcuggucuagcugacagugguacuuagcaaaggccacuguuuccauagugaccagcugauaccucuuccugcccucuagugugcaauuggguguugccucaguuuccucccagcucaguuuuauuagaucaaagcuguuguugggcaccagguuggccaccucaaucaccagccaagaugguugcuuuguccaccagaggucaaguucaccucucuggugcuguaguucccagcuccuuccugauuuuucuaaucgcuccuucuggggaacaggaaguugauauugccaugguggcgggguaugccgucaccucaguaguuuuacuguaaaagggaaauuugaacaacaaaaaccaaaaaaaauaaaaauaaaaaacuucaaaaguugacaa

SEQ ID NO: 16637 - RNA, 1724 nt, Homo sapiens
cagccaguaggccaccauuuuggucacuaagaagggaacuguguugagucugaaaggagucagaaauguaggauggaaugaacaagacagccaucuggguuacucgggagagcacauggguucuugggguaguccuguugauuaacagagauuauacugggauauggaaaggaaagaacaagacaaauuaggccugccacagcacauggcagucaucuuagcuguccuaaaaucagcacagagcacaagggaagggagaucuugggaagugccacugaagacugggaaaaguccuucucgguccaccucuaaccucuuacagucaguaaguuccagcuuccuccugaaaggaaguucuucccgcccuucuucuccacagaauaagaaccauccaccucccaccuccugaucccccagacuaagccacuuggaguuccagccagaccacuuccuguuucagaagugcuacuuccuguccuggaugaaggcacuuccaguuccugcugcacugcuucugcuacuucccaggccauuucuguccgggccuggucaccucuugucuggagcaagucacuuccggucccaaguggcccauucagcaucagaccaaguccauacaugucccgaccgguucauaucuugcuauuggccacuggacaaaacgggacacuucuucucaugguagcugucaugacccaaccaccccaaauggcuggaguaaguauguagaggccugggccaggccagagaauggagcccugcugcccauggccugagcugggguggagugucagagccuuccccauaaggcccccauuuuuggcagacugaggggagugguugguaugagaggucagaaggggggcugaaagcuaaggggagaaaugcuuugaugcccccacccaggagaugggagaggcacaggauaagaagccaagagggugaaaggagauguggggaggaggaugcuagggaagaagaacagaccuagagacggaagagagggaaagaauaagagauagagaagagaaaaccagugagaggcagaaagaaggcggugccaaccaaaaggugggcuguucccgccccuagcucugggugggugagggggacaaggaugccugggucauggucagagaggaggcugagccugugccccuccccaaggaaaaaggauccagggacacugagacagaggggggcacccauggccaaacgggagggcaggaaguggggcagugggaauccuaaggaauccuaaaaguggagacgaggacagcagccgggaggagugaaggggcugggggggcacagggggccgagauguuagaggugucccucaaaccaggaauuaaacuggaggagcaccccaagaagggcuggauucaggauagccacgugagaggagcccucauaccuuguaguagauguuuggagggcucugggggggcccauccugcacgauauacacaggaugcccauagucaccacucaccuucucauagugggggcagaaggggggaucugcagccccgccaccccgcagagcuaucccuagcuccccaggcucagccucccgaggucccaucccaccuccaccccccaggcccagagacccuccccucccgaaggagccaggaccaggguggcgacucuccgaaggcuuggcccgccgucuccgccaacacauggcacccccagccccugccacgcccagcaagagc

SEQ ID NO: 16638 - RNA, 6851 nt, Homo sapiens
gcucuguguaugauauauauuuauauauauaauugcucucauuuuauuuuacuuaauccucuuuuuacaguagaucugacacaggcauuaaauaacugcagagagagaccaugguagggcgggugcaggaaaacaugggggcccgaagggaagaaacacagauccagcuagagaaaaagggaaggguccaccuguggguggaguguggaggcugcagcauuaaaaaaagaaaaaggagguuagagaggaugaggaagugaagggaugcuggaggacaaaggguuaaaaugccucuacagcuacagaauauucagagcaggaggcaggaggccccucauuugacauucugugggcauuauggguuuuuuuguuuuuguuuuuguuuuuuuuuuaaaggcaaaggggucugaagagauggagccaagacauucagaggcuagauuuggaauuuucaggcuggcaugcagaggaaaaggaaggaguuagugauuaguugauaacuugcuaaaagaagccagagaaaggauggugggggcagaucugggcucaggggaaggagguggaauagucccaaagccagccgauguuuccaagguggccacuggggacggagccagaauggccgccccucccccagagcucccugggaaguggaacuugaaggauauucugggaaggcgaaugggggaagggagccauccauaaaaacaaaguggauauucagccuaggucaaccccgccccucuggguagcagcuauuugggugacagaacggccuaggaagaaacugaaggccgggcgcgguggcucacgccuguaaucccaacacuuugggaggccgaggcagguggaucaccugaggucgggaguucgagaccagccugaccaacaaggagaaacccccaucucuacuaaaaaaugcaaaaaaaaaaaaaaagaaagaaagaaauuagccgggcaugguggcacaugccuguagucccagcuacucgggaaccugaggcgggagaaucgcuugaaccugggaugcggaaguugcagugagcugagauugcaccauugcacuccagccugggcaacaagagcgaaacuccaucucaaaaaaacaaagaaagaaacugcugaagucgggggcugcuagaggauuuucaggaagggucaacacaggccucacuuccagucccucauuucccagcucacagagucaccagagggugagaagcagaacgugccagcaaagagggaaaaggccacagaaccaccuuguccucaauuacaaaggggugcauuucagaggagggaauagggauggagaggaggagaagaccugcccaggagccagauaaauucaaagucaccaagauggcgacuguguagacagggagaaaguaugagagaucaagggacgguggccagagcuuaggaauggaaggagggagugccacauucaucucuggaagcaaaggggucaaaugagacgcgugugcacguuuguguguguguguggcgggggguguaggugggugggugggucagugggcacuuccuauaacucucaggggauaugcaggcaggagaguggauagcucucacagcuaaaccagaacuagaaaggcuccuaacuccuccguggccaucuuagcccagcucccugucugacugaucugagguugggagaaguuggugggaaaggcgagugacggaaccgcaauggacuucaggcuggguugagaagucaaggaaaaggaugugaggcucagacaagucauagcucuguuaucaaaaauaccuuuggggugggugagggagggaucaggcagggucagggacauuccaggagcauccacaggagagagauggggugggaggaaggggccucagguuuuguugaugcggaguuugaaggccacgcggccggcgaacuugucucgcucaucgucuguggcgauguuggcggcguugaugcgacauucuacauucaccuccacguugggggucacauucaggaacuucacagccaccaggggcuguguguaguucaccugggccggaggagcagugcagggucuaggccuggggcaacgcggccuccuucccuagcucaccacccgcacccgccaucagccugggccuccccugggacuuacguggaacuuuuugccauaguaggggaaguacaugaggucgauguugccguuggcggggaacaugacgaaguugccgagauucucagcaucuucaucucgcugugggggugcaggaagauagggggugagccaguuagggauggcaggcacccaggagcucaccagacuuccauuuguucuuuuguucuuccuucgccccaauuauuccugucucaagucugccucccuggagcugugagucugugugugugugucugcaugugcguguguagaugaggggauggucugucccugucaucauucuaggaacuccugaaggcugcuaauggcacgaaagccuccuacuccacuccuaccccaaguucuuaccccauccucaggaaucaguuucuggagcagagccaagaaagaagagauacaugauuaaggguugaauaggaagcaaggaaggggauguggagggagcagccaguuucuagaaaggacagaccgggggggaagcggggaacagggucccaaggacaacgaacugguggcagauggugcuaacagaucagcagcuaccagacaccuagaaggaacugacgggugggggccauaugggagggagagcgaacgauacggacaaucugggaaugaaggagaagguggaagcguuagggagagaagccagaggccagggcguugguggaggagggcgugugucuggccccuaggagagcaggccucugcaucccagagagaagcaagaggagugcggggcccucggaguucaagcuacaguggagcccaaaagcccacucuuacccccuuguuucuauggugauggggccucuaggagcaaagaagauagggagagacaggugaauuacacagaaaccaugaaggacacucaggugagccacucaggugagcaggcagacaaggcccaacgaacucaccuucccagcacagguaacauucaugcucugguuugcuccugcauagaaguugaugaccuggagugaggguggaaggugaagagagucagaggaagaaguugucgaagaugggcauccagaccaagcuaagccggggacuguagucccaacuacuagggagguugaggcgggaggauagcuuaauuccaggaguucaaggccagccugggcaacauagcaagacccugucuaaaaaaaaaacaaaaggcauccagccuucuaacugcagagcuuagccuccaagagucccaccucucuuuuucucucagcuacacaaacauccaagucuuucucaugcccauuagccccagugaaaggaugcaauugucugcaggugguguccccagauccuuccuccauucacccuggggaccaaggucauagauacccgguucaucuugaugaagacacagggcugcccagugcuguaaccauaguggguggaguccccaaugccggagcaguugcccagcuggguccgguugaauuggcaggcacguuugggguaguugaggacuccauuaucuggcuguucguaauagcguccagggcggcagacaucauucuuuugggcuuggauagagucguuguaagcuaaagaggugggagggagagacucaggggccagauguuccacuuccaagguccccaguccccugcccgaagucuugaacugacacauaaccaggcccacacucacgcuccaagaacuuguugagcuucugaacaugcuggucccagcuuucagugucacugacauugacaaugacaucaagguucucagucuuggggcgaaucaucaagccuacagccaacaaaggcagaaguuggggguaucuauaagaugagggacugcacacagagggaagaaaauggacacagggaacaccagaguggggacagcggugaauaucugagaucgucuucaugggagggugaucuccuguggcuaucugccacaugcccaaaucacacagcucccaacugcaguaaaugggaagguggacagauuucaagaacuuccaagcacguggggauugggucaucaaaaucaaacuccuggaaggaacuaugaguuccuucuggagguuugggggcacaagagcaguuagaguagcuggcagggggagccuccacacucacccgguguggccagucgguccugguacuuggggguauggucggagacagucugcagcaucacccacauggugagggugaacauggcggugaggaacccauaaaaaacgagguagaagaggaggauaaaggcuagggaggaggaaacagggucagcagggcccaagguucccaccauaaccucaacuauccccacacaccccucuacccacucugaaguucugcacugggacugaucacagagccacagggaugucuuagagccuuccucuggaggcaaaaugagacaaacuggaaacaggcaguugugucuggcuucuagccaugacucccagcccccuccugguccuagggcacagugaagcccgaccuuguggaggucuguuauuuugccuccaauuacauuuccaacuucucaaccaugcauaguccugacaaggcacacaucuguuaccucugcauucguacucaugcuuaaagcugugcuagcauggugccuuuuaaagcggguacuggccaccauucacaagcaaacccucauaccaccccgcagagacuggacccucagauuugaauagcaacaucucucuccuggugcccuucagaagccaaacuuugaacacaguuccugaaaugaaagaccuaacacuagccuagcuacaaaucucucagagacggcuuguuagaaccuucaacagucaccccacccucaguucacacccagcacccugggcagaggcagggaggaaaggcagaaucucccacagccuucccuuggugggaucucuccauggcucccccgccugaaguaaggacccaagggccggcuguucccaccacccuggacucccaauccuuccaucucagaggacacuucuuccaugaaguccucuggcucucccaagcauugcuggauucuucucaucccaggggcuggaguuugaguucccugagggaauggauugcaugggacccacuucguguaggccccgaauggguggacugauggggacggugcccaguguggaaagauuguaaaucgugucacacaguguccucuguccccugugucucaacgucccagcuugaccaucccucuuggaagaauuccaccccucaccugcaccugugccggucaccagacccccuccacccccccaacccccgaccacuacagcucccugaguccugccauggucagccuggggaggcuuccaagucauccgacugucacagacaccuggcuggcugaugcacacaaaucaccacagcgaccacuccucccuccgucaccgacaugggagcaaaaccugcagccucgguaaaacucauacuaucagcagccccccaacccacaaagcagucccagaaggcucccaaggccaggcggugggauacagacaacuuccgccgugaagaaccccccuaacacaccccccaagacccgcccccucaugaacguucccaggguccagggggugggcacgagcuaaaaauagacggggcugcggagcuagugagagccggagggagggaaggggcgcucuuuggaggugggggacgcccguguggagcggacaggccccgagagggagugugagcgccggcgcggacacgcaggcggagcuggcgaccccccgcccgagggggcuccgcggggggcgggaaggcggcugugaccuacuuucuccgccuccgcacggccagccggggagauuagacuggcgauucggcccccucccagcccagagcccggcagggaggcuggacgccggggacccgggaggggagcuggggccgcgucggcgggacccugcgcccccgaggcgucgccccgcggcuuucccccgccccuugcgugccggcccugcguaccccagcuggucccggugcggcccauaaacuggugcguccucggguuccacacgaacuccuuccacuccucaaccaccugcccgcagcucuucuucucuuucuggaugaccaucuugguggcgcggggcgaguccgggcgcggggcgggggguugcggagaagcgggggcgccgcgcgcugaagcccuccacacacccaaaagcacggggagcgaaggcggcgcgggcaaaggagaccccccucagauaugcagcugcugcagauuccggggugcacgaccacgcgcugcggggugcuggcagcgcggcggaagaugcaccgauccuaggccccccaacugcgaugaaaaggggugcugucagagcaggggagaauaacaagaggaagggguaugaaugcagcuucaccccccaccaaaccgucuagaaacaaaacgaaauggggugcaaaaacagacggcuacaaaaaccgagcagaacgcagaaaaaaagcgggguacaaaaaggcagagagaggugggggagggggccgccccgaaauccaagaugcaaagaagcuguggaacgaagcucaaggcucgcuccgccaagcggagaccacugcaccggugguggcucagccgcggggguggggcggggacgcgcagcugggggacagccagggauggggggccccccaggcggaggcuccgcuccucagcagugcgagg

SEQ ID NO: 16639 - RNA, 6851 nt, Homo sapiens
ccucgcacugcugaggagcggagccuccgccuggggggccccccaucccuggcugucccccagcugcgcguccccgccccacccccgcggcugagccaccaccggugcaguggucuccgcuuggcggagcgagccuugagcuucguuccacagcuucuuugcaucuuggauuucggggcggcccccucccccaccucucucugccuuuuuguaccccgcuuuuuuucugcguucugcucgguuuuuguagccgucuguuuuugcaccccauuucguuuuguuucuagacgguuugguggggggugaagcugcauucauaccccuuccucuuguuauucuccccugcucugacagcaccccuuuucaucgcaguuggggggccuaggaucggugcaucuuccgccgcgcugccagcaccccgcagcgcguggucgugcaccccggaaucugcagcagcugcauaucugaggggggucuccuuugcccgcgccgccuucgcuccccgugcuuuuggguguguggagggcuucagcgcgcggcgcccccgcuucuccgcaaccccccgccccgcgcccggacucgccccgcgccaccaagauggucauccagaaagagaagaagagcugcgggcaggugguugaggaguggaaggaguucguguggaacccgaggacgcaccaguuuaugggccgcaccgggaccagcugggguacgcagggccggcacgcaaggggcgggggaaagccgcggggcgacgccucgggggcgcagggucccgccgacgcggccccagcuccccucccggguccccggcguccagccucccugccgggcucugggcugggagggggccgaaucgccagucuaaucuccccggcuggccgugcggaggcggagaaaguaggucacagccgccuucccgccccccgcggagcccccucgggcggggggucgccagcuccgccugcguguccgcgccggcgcucacacucccucucggggccuguccgcuccacacgggcgucccccaccuccaaagagcgccccuucccucccuccggcucucacuagcuccgcagccccgucuauuuuuagcucgugcccacccccuggacccugggaacguucaugagggggcgggucuugggggguguguuagggggguucuucacggcggaaguugucuguaucccaccgccuggccuugggagccuucugggacugcuuuguggguuggggggcugcugauaguaugaguuuuaccgaggcugcagguuuugcucccaugucggugacggagggaggaguggucgcuguggugauuugugugcaucagccagccaggugucugugacagucggaugacuuggaagccuccccaggcugaccauggcaggacucagggagcuguaguggucggggguuggggggguggagggggucuggugaccggcacaggugcaggugagggguggaauucuuccaagagggauggucaagcugggacguugagacacaggggacagaggacacugugugacacgauuuacaaucuuuccacacugggcaccguccccaucaguccacccauucggggccuacacgaagugggucccaugcaauccauucccucagggaacucaaacuccagccccugggaugagaagaauccagcaaugcuugggagagccagaggacuucauggaagaaguguccucugagauggaaggauugggaguccaggguggugggaacagccggcccuuggguccuuacuucaggcgggggagccauggagagaucccaccaagggaaggcugugggagauucugccuuuccucccugccucugcccagggugcugggugugaacugaggguggggugacuguugaagguucuaacaagccgucucugagagauuuguagcuaggcuaguguuaggucuuucauuucaggaacuguguucaaaguuuggcuucugaagggcaccaggagagagauguugcuauucaaaucugaggguccagucucugcggggugguaugaggguuugcuugugaaugguggccaguacccgcuuuaaaaggcaccaugcuagcacagcuuuaagcaugaguacgaaugcagagguaacagaugugugccuugucaggacuaugcaugguugagaaguuggaaauguaauuggaggcaaaauaacagaccuccacaaggucgggcuucacugugcccuaggaccaggagggggcugggagucauggcuagaagccagacacaacugccuguuuccaguuugucucauuuugccuccagaggaaggcucuaagacaucccuguggcucugugaucagucccagugcagaacuucagaguggguagagggguguguggggauaguugagguuauggugggaaccuugggcccugcugacccuguuuccuccucccuagccuuuauccuccucuucuaccucguuuuuuauggguuccucaccgccauguucacccucaccaugugggugaugcugcagacugucuccgaccauacccccaaguaccaggaccgacuggccacaccgggugaguguggaggcucccccugccagcuacucuaacugcucuugugcccccaaaccuccagaaggaacucauaguuccuuccaggaguuugauuuugaugacccaauccccacgugcuuggaaguucuugaaaucuguccaccuucccauuuacugcaguugggagcugugugauuugggcauguggcagauagccacaggagaucacccucccaugaagacgaucucagauauucaccgcuguccccacucugguguucccuguguccauuuucuucccucugugugcagucccucaucuuauagauacccccaacuucugccuuuguuggcuguaggcuugaugauucgccccaagacugagaaccuugaugucauugucaaugucagugacacugaaagcugggaccagcauguucagaagcucaacaaguucuuggagcgugagugugggccugguuaugugucaguucaagacuucgggcaggggacuggggaccuuggaaguggaacaucuggccccugagucucucccucccaccucuuuagcuuacaacgacucuauccaagcccaaaagaaugaugucugccgcccuggacgcuauuacgaacagccagauaauggaguccucaacuaccccaaacgugccugccaauucaaccggacccagcugggcaacugcuccggcauuggggacuccacccacuaugguuacagcacugggcagcccugugucuucaucaagaugaaccggguaucuaugaccuugguccccagggugaauggaggaaggaucuggggacaccaccugcagacaauugcauccuuucacuggggcuaaugggcaugagaaagacuuggauguuuguguagcugagagaaaaagagaggugggacucuuggaggcuaagcucugcaguuagaaggcuggaugccuuuuguuuuuuuuuuagacagggucuugcuauguugcccaggcuggccuugaacuccuggaauuaagcuauccucccgccucaaccucccuaguaguugggacuacaguccccggcuuagcuuggucuggaugcccaucuucgacaacuucuuccucugacucucuucaccuuccacccucacuccaggucaucaacuucuaugcaggagcaaaccagagcaugaauguuaccugugcugggaaggugaguucguugggccuugucugccugcucaccugaguggcucaccugaguguccuucaugguuucuguguaauucaccugucucucccuaucuucuuugcuccuagaggccccaucaccauagaaacaaggggguaagagugggcuuuugggcuccacuguagcuugaacuccgagggccccgcacuccucuugcuucucucugggaugcagaggccugcucuccuaggggccagacacacgcccuccuccaccaacgcccuggccucuggcuucucucccuaacgcuuccaccuucuccuucauucccagauuguccguaucguucgcucucccucccauauggcccccacccgucaguuccuucuaggugucugguagcugcugaucuguuagcaccaucugccaccaguucguuguccuugggacccuguuccccgcuucccccccggucuguccuuucuagaaacuggcugcucccuccacauccccuuccuugcuuccuauucaacccuuaaucauguaucucuucuuucuuggcucugcuccagaaacugauuccugaggaugggguaagaacuugggguaggaguggaguaggaggcuuucgugccauuagcagccuucaggaguuccuagaaugaugacagggacagaccauccccucaucuacacacgcacaugcagacacacacacacagacucacagcuccagggaggcagacuugagacaggaauaauuggggcgaaggaagaacaaaagaacaaauggaagucuggugagcuccugggugccugccaucccuaacuggcucacccccuaucuuccugcacccccacagcgagaugaagaugcugagaaucucggcaacuucgucauguuccccgccaacggcaacaucgaccucauguacuuccccuacuauggcaaaaaguuccacguaagucccaggggaggcccaggcugauggcgggugcggguggugagcuagggaaggaggccgcguugccccaggccuagacccugcacugcuccuccggcccaggugaacuacacacagccccugguggcugugaaguuccugaaugugacccccaacguggaggugaauguagaaugucgcaucaacgccgccaacaucgccacagacgaugagcgagacaaguucgccggccgcguggccuucaaacuccgcaucaacaaaaccugaggccccuuccucccaccccaucucucuccuguggaugcuccuggaaugucccugacccugccugaucccucccucacccaccccaaagguauuuuugauaacagagcuaugacuugucugagccucacauccuuuuccuugacuucucaacccagccugaaguccauugcgguuccgucacucgccuuucccaccaacuucucccaaccucagaucagucagacagggagcugggcuaagauggccacggaggaguuaggagccuuucuaguucugguuuagcugugagagcuauccacucuccugccugcauauccccugagaguuauaggaagugcccacugacccacccacccaccuacaccccccgccacacacacacacaaacgugcacacgcgucucauuugaccccuuugcuuccagagaugaauguggcacucccuccuuccauuccuaagcucuggccaccgucccuugaucucucauacuuucucccugucuacacagucgccaucuuggugacuuugaauuuaucuggcuccugggcaggucuucuccuccucuccaucccuauucccuccucugaaaugcaccccuuuguaauugaggacaaggugguucuguggccuuuucccucuuugcuggcacguucugcuucucacccucuggugacucugugagcugggaaaugagggacuggaagugaggccuguguugacccuuccugaaaauccucuagcagcccccgacuucagcaguuucuuucuuuguuuuuuugagauggaguuucgcucuuguugcccaggcuggagugcaauggugcaaucucagcucacugcaacuuccgcaucccagguucaagcgauucucccgccucagguucccgaguagcugggacuacaggcaugugccaccaugcccggcuaauuucuuucuuucuuuuuuuuuuuuuuugcauuuuuuaguagagauggggguuucuccuuguuggucaggcuggucucgaacucccgaccucaggugauccaccugccucggccucccaaaguguugggauuacaggcgugagccaccgcgcccggccuucaguuucuuccuaggccguucugucacccaaauagcugcuacccagaggggcgggguugaccuaggcugaauauccacuuuguuuuuauggauggcucccuucccccauucgccuucccagaauauccuucaaguuccacuucccagggagcucugggggaggggcggccauucuggcuccguccccaguggccaccuuggaaacaucggcuggcuuugggacuauuccaccuccuuccccugagcccagaucugcccccaccauccuuucucuggcuucuuuuagcaaguuaucaacuaaucacuaacuccuuccuuuuccucugcaugccagccugaaaauuccaaaucuagccucugaaugucuuggcuccaucucuucagaccccuuugccuuuaaaaaaaaaacaaaaacaaaaacaaaaaaacccauaaugcccacagaaugucaaaugaggggccuccugccuccugcucugaauauucuguagcuguagaggcauuuuaacccuuuguccuccagcaucccuucacuuccucauccucucuaaccuccuuuuucuuuuuuuaaugcugcagccuccacacuccacccacagguggacccuucccuuuuucucuagcuggaucuguguuucuucccuucgggcccccauguuuuccugcacccgcccuaccauggucucucucugcaguuauuuaaugccugugucagaucuacuguaaaaagaggauuaaguaaaauaaaaugagagcaauuauauauauaaauauauaucauacacagagc

SEQ ID NO: 16640 - RNA, 1627 nt, Homo sapiens
aaggucucucccucaauucugcucuuccaauacuugaggauaggcaccccuaacccuccuuccuccagggaggccucagcaucagugucuguggacguagucucugaagagugcuucagcugauggggaaggagaaacucaagacagagauccuccuagggauggcgucacuuuccugccaacuuucucguugccucuccuugaaagcagaagaagugccagcccucagcuuccgucagaucuugggcuccuagggccuuguacaaguccauggcccucugguuccaguccaggacggccaggcggaauugggagcagcccuuauccaaggccaccugugggagaagacaacacuaacuuuucuggggucaaaaaagaaaaagguuuucucacucccucuuucaacccggguccccccuccauauacccuugcuucuucagguccucacuugucgccccacccaucuccucaccucagccaccuuuuugauuauuuuggaaccaaucccuugaccuguuguggagagaaagaggcaaaaaauagcuauuguuugagcugaaggggaucagaaaaugacaccggcugggcucuggggacaggggauaacaguggggucuguggggugcuuugcucccaccccagccucagcuucugcccaguaccccgauauuccggcaucacauagauauccuccagauaaauggugcgucccuuccauguacuguagaugaaauaguauaucccauagcccaccacgcagggcccugagagagagaaaaggggaguaaggcuucuggaagccuguggggagaccucugaggccggcuggagagguggacuucuaagggccaggugcucuuacccaguagcuucccgggcgcuggaagaaucucugcuaccaaacagugauagaaaggauugucuccaaagccaucugcucucagggcugccgagauuggaguugugacaaagagauagagaaagaggacguggguguaugcccagccuggagcugucgccuggggaacccaucccucauuuccuccccagccuccgccagaaccugggcgcugagcccccaccuucuucacugaucuucaccugauccgagaguuuuucgaauucggcuagcuccuaaggcguggguacggaagcuagauuagagcagaagggccccgcugcuccccgagcagguucccaaggcgagccccucccccugcccccgccuccuacgaccccgcucuggccgcgccacucugacccccggguuaccggccugcagucuucacccgaaucagccucaggauaucuccacagucucccuccuuggccucucggauccgcacggaagccauccggauccccgcugucugggaccaaagucccagggccucgcaaacggcaacuagaccccuuaaagggccuacggacuuggauccugaagagccugagagagcgggguggcgggagucgggggggacggcgggguagccgcggccugguaaguggagcugggauuccggcgccguacgggaggagagaguaggccagcgaggcgauccucuguccgggcauagccccacccccucgaauucugucgcagcagggggcacaacugucagccaa

SEQ ID NO: 16641 - RNA, 1894 nt, Homo sapiens
agacucaguugaauaauacaaaacuguuuaauacuaccaaaaauauaauuguauguugugcggcucucccuggcuaucaugggaggacugcaggcugccucugaacuguaguccaacaggagaaaggguugacagccugggguaggggaugcugcuggauuaaaaaaggaggaugaggcccgucccgugaggucugcguccaugaggguuagagguggguuaggggcaugggggcaccagcaaggggaggguuguauggagugggagagccagggggcagguaguggguauaggugggcagcaguucccccuggagccuagggucacucugagggagggagcacggugagggggcuuccaguuugcagugggaagagcugcagagagaaacaagagguuagagggcacuucccuggguuggaggugagucuggccaguucugggcagacaggguagagcgugccacccacccagcccuggcuacccagcccgcugggcgcagcaggcauggaagccgaccccgggauggagagcccgcggcccuguuggggcacgcucgggagcgggcuugcgugcugcacggcuguuuuccucuuggggagucaggccaggaaagggcagaaugagcucggccucuccuugcccugggggcugggagaggaagcugggucacacacaggccagaagcaggggggaaacggggcaucuaacuaggacacagucgcauccaggggucagucaccugacccuacagggcccaccaccuucagacugagauggaaacgcccucugggagaacccugauccgccccacccuacacaggccccggagguacugggccugcgcccgccacaccuuggccgcgaguggccucugcuugggugggcucccguccuccggcauccgcccccaccaaggcuccagaagaggggcgcaugggccuccgucuucggcccgcuucccaggcacucacccauagcugccaggcagguaggcugucgaguagcuggggggucuguacccaaagccucugcucgguuggguggucgcguaccccggcccccagagcgggccgccgcuggccagguugccucuucccuguccgcagcgggaagguccggcgcccgagcucuuggccuugcgccgaggccgguacuuguagucgggguagucgcgcaggugucgggcgcggagccgcuuggccuccuccacgaagggccgcuucucguccucguccagcagcuuccacugcgcgcccaggcgcuuggagaucucggaguugugcaucuugggguucugcugcgccaucuggcggcgcugagcggagcuccacaccaugaacgcguucaucggccgcuucaccuucuccaggggcagcgucccgggggccgcggggcucccagcgcccucccgcuccuggggucccgaagaugaggaggcagcagccguggcagccggaggcuccaggcuccaggccugguccugugaggagccugguagcgccauggguugggagaagccuuaagagggcguccugaaugcccuccccucaacgugaagcgucgauccugaaaauggaaaggucuucccagucuggagucguugccgaggaacuuggguccuuaaaaaguguauuuuauccccaagcccagagcuuaaaccggagccuuugcuuccaaccuguucggcacacuuuggggagagucgaaugcaaaauccgcugucuggugccccggcacugaagagguguucugaggccuacugacugggggacccccggucccucuccccgacccgcagcugcgaucagaccgaccuuccguggaggggguaaaccauaaaccccuuuguggucuccggaguuccgacagcugccaggcgcggauaggccag

SEQ ID NO: 16642 - RNA, 2453 nt, Homo sapiens
aucuccaguacaggaagugagacuuucauuuccuccuuuccaagagagggcugagggagcaggguugagcaacuggugcagacagccuagcuggacuuugggugaggcgguucagccaugaggcuggcugugcuuuucucgggggcccugcuggggcuacuggcagguaaggaggaaggaggcugaggggagggggccccugggagggagccugcccuggguugcuaaccaucuccucucugccaaaagcccaggggacagggaaugacuguccucacaaaaaaucagcuacuuugcugccauccuucacggugacacccacgguuacagagagcacuggaacaaccagccacaggacuaccaagagccacaaaaccaccacucacaggacaaccaccacaggcaccaccagccacggacccacgacugccacucacaaccccaccaccaccagccauggaaacgucacaguucauccaacaagcaauagcacugccaccagccagggacccucaacugccacucacaguccugccaccacuagucauggaaaugccacgguucauccaacaagcaacagcacugccaccagcccaggauucaccaguucugcccacccagaaccaccuccacccucuccgaguccuagcccaaccuccaaggagaccauuggagacuacacguggaccaaugguucccagcccuguguccaccuccaagcccagauucagauucgagucauguacacaacccaggguggaggagagguaaagcuaaaacugggggaugagaggggagggaggcaggacuggauauaggcucagagggaagaaggaagaggggacagggaaccuuggccggcaucgcaugcagucuugugaccuuccagucuuuaacuuccgcaggccuggggcaucucuguacugaaccccaacaaaaccaagguccagggaagcugugagggugcccauccccaccugcuucucucauuccccuauggacaccucagcuuuggauucaugcagguauagccaugaccucagucucaccccucacucagccucccggcgccccuccccucccaaucccacacgcuacuccuuccucuguggagagggauaccaccugcgccuuccucuucgccccacaggaccuccagcagaagguugucuaccugagcuacauggcgguggaguacaauguguccuucccccacgcagcacguaaguaaccuccuucccuuucucauugcuaccacuagacgccaggguuccugaaaggacuaagcuggggccagggagguggauaggaucugacccuuccucacuccuccagaguggacauucucggcucagaaugcaucccuucgagaucuccaagcaccccuggggcagagcuucaguugcagcaacucgagcaucauucuuucaccagcuguccaccucgaccugcucucccugaggcuccaggcugcucagcugccccacacaggggucuuugggcaaaguaagaccuaccuacuccuucccuccuagaauccucccacugcacugaaaaccccuuccccaggcccauaagccacucaucucucuucuuaaccccccaaaucucgcucucccagcuugucauggcuacagggcagcuuucuuuccauccucuacaagacucugccaguuucccccuuuuaucacugcugagucacugcggugagcuccucaccaaucuccuacuccccagcauccccccauucccuccucccaccuuuaucccaaccagcacgucacugcaaauaccuaccugcccuauccuuccgccagguuucuccugccccagugaccgguccaucuugcugccucucaucaucggccugauccuucuuggccuccucgcccuggugcuuauugcuuucugcaucauccggagacgcccauccgccuaccaggcccucugagcauuugcuucaaaccccagggcacugaggggguuggggugugguggggggguacccuuauuuccucgacacgcaacuggcucaaagacaauguuauuuuccuucccuuucuugaagaacaaaaagaaagccgggcaugacggcucaugccuguaaucccagcacuuugggaggcugaggcagguggaucacuggaggucaggaguuugagaccagccuggccaacauggugaaacccugucucuacuaaaaauacaauuagccagguguggcggcguaaucccagcuggccuguaaucccagcuacuugggaggcugaggcagaacugcuugaacccaggagguggagguugcagugagccgucaucgcgccacuaagccaagaucgcgccacugcacuccagccugggcgacagagccagacugucucaaauaaauaaauaugagauaaugcagucgggagaagggagggagagaauuuuauuaaaugugacgaacugcc

SEQ ID NO: 16643 - RNA, 3187 nt, Homo sapiens
caaaauggacccgcccgcccggcgccgggugggcuccuggugccucacgcggccgcuccucgggguuaggcucaguccuggccgucaagaaaaccagcacacugaacggccgguuucuucuccccgacccguguuuuagccgcgacgaagugacuggaucuaaggaccaggcacccccgccucucgcgagugguaccgucagaaugcuccggaaccccgcgcgccgucccucccccggcacagggaggcaaccggaccugccggcucugggccacacauaguggcggccgccuccaccuuucuuucccacgccaggucgcgaccccgucucgccacucagcgccggggcuucgcgcauggcaccgccucgggucgaggccucguaacagaccucgcacgccugacccuagccgggcugucccuacccuccgccucgaccugguggccgcgucggccgugggucuucccccucgccccuccaagucggacccuccccccacccgguucgguuucucccgcaacccuggugggccucucagcuacccccggcgggcccgucggaagggggcggcaaaauaagcagccacaaucucuugcaaaugccuuucuuaccgggaauccuggcucgcagacaugauccuuagaaacuagggcggagugcccgccuaucgacaacuuauagagcgcccgacuccgccccggccaucgcauugguuuggccgccccggccccgccugccggcgcucagcaacucggcaugacguuaguuccuagucgcuccggcccgcaggcaccauuggauaacucgagugccuaucaaggugaaggcccgccccgcagccucauuggcuggagggcccgccuuucucgccgguacggaagugacauagaagagucaggccucgaggccuggcagccaucuuggggcccugcacucucacacgugcggaggcgacagugccuuggucauguggcuccguaggcccuaucacgcaaggggggcgaggucucagccuccagaggcuuccgggcucuggggguuaucacuucccuuuacuucugcucccggucuccacuggacucaaauguuauuuguuuuccccuguagcagagauggauucgacacugccuggacgugugccagggaugaaggaaucaacagcgauaucguagggaugggaggauuccccuggcuggaugguggagggauggaagaaaacuguaaagggcuuugggguacuaucaugaauccugguugguccccuccccagucccuuguguccaguuccccagcuucccucucggaugcccuuauucuugaggcuuaucuacuuucccuccuuccugcucucugcucccaucucggggauuuguuugggugaagacaagguguuggcagugccugagccagggauggaaagcugaacccuuuagucucaagagacuggcuggaaggucugagcuaagcauauccacuaauuugaagccccuuaaggaagaccaccacuuacguaucaacaaaggauccuuuauugaccagagcaggaccguggcauuuauauauuuuuauauauauauauauauauauauauauauauauauauauauauauauauauauauauauauauauauauauaaaaguuugaagaucuggcaggcagugauccuauuguccgcccaccacccccagcacugauuuccugcucccugcacggggaagggggaggaugacugcuccacccaggccacagggccacacuccccugcaaacagaggaagaaaggggcuuuucuguagccacccccugcacaucagaaaucaacaaguauucucucaaagaaaaaaaaauacagaaauugaaacauuuaaauaugaaaaaccaaagggaagugagugggaagaggcaagagaggaaaggaacuggaguuucuugggaagggacucccaugucucccuucccauuuaugggcuuggggucugggguacgaggcucacacagugaguuugcagugacacagcuccuuguagaucugccgacgaaguuugggcauguccugcugggugaagcugaauggcugagacagggccagaugcuugcaguacuggguguuaacaaagcaagccaugagaaaccccccgugucaggaccugugcuacacauuucauaugagaugugucuccauccuucagagaacauccccaaagggagccagggucccacagccugggguucaaaaacagccugacucuaaagcuaguguucuuacuugauagaauguuuuagauggagaaaauacacugaguuggagguuagcagggagcucuaugaaggccagaggcccaagacuagagacccagucccaaugugggauggagaaguccagaagagaaccagugaagccaguguuuugguguucuaaaacagauuacuuccugcuccacaacugacuaugagccaaaugaggggaugcauaacagccucccgacccuuuaacccaacugacuucagagcuaggggagguggccccaucaucugcuuaccugcaacacaaaagcaccacagucacugucauuauucugccuggccacauucuagagaagagaaagaaagcaggcccuucacauggagacucccagggguaggacuucaauuucugccuucuaccacuguccccaccaacacccuauaccccucccucaggaaacucaccauuuugaaguaaccuuuccagcccugguggaaauccagucggucuuucuuuaccgccucugccuguagauacuuggcaauaugcuauguggaugggggaaaagaaagugaugcccuaaguuucucaauugaacacaguaugguggguacagugcuggcagacaccaugcccaggucgccccucaaagacccaaagcccacccuucuuccugcaaugccuugccacugcaccgccccacauuuugcccaucucucuccuacccccucaaaccuuagggcagcggcgguuuaggguacgcugcgagucaaaauaggugauggugcgucgccucacaucaacagagaugagggaccaaugcaccuccagguggauggggauuagcaguagcuccuuauugaagauguccaccuaaagagauagugccacaggucagguacaacaaacagaagucuugccuuuugccaugaagguucu

SEQ ID NO: 16644 - RNA, 12532 nt, Homo sapiens
gcccggaagggcuuggaauggccugccacgccggggcaauggagcgcgugaaagccaaaccuugggacccgaagaguaauuugacugcgaaggcaccgucaucgucgggcacccccuguagacgggcgcauaauagcuacaucucuggagauagugauggaaacugggguccgauagauggagagaaggacguaggauaaggcuucuuguggggugaagaggcagagggcaccuggagagagguguggcauggagaaccagggguuuucccuagcagagggcggcuucguggacuucggccaaccggcgggugcuucccucgagcggccgcuagaugguggugcuguucuggaugcuuccagugggccccgaccaggucuggacaaugccuggcgcccgucccccgccccucaucuacacacacgcaagaauucggagcuccauggggaacagaagcaagauauccguaaaaucaaagucuagggggugggaaugaaaagggaaaagugaggaacggggagccaaacccaggaagacgccucuguuccugcacauucccucuccuuuauauacucagcucuuggcugucuccaguauguacccacccuggucuuccaagcugggagccacuuuuuauaacacaaucacaguuucacaaaccccaggaagguuccauguggagagagguuaaguuucgcccuugcccggggaauuaugacacucagaauauccccuugguguaaauggaagacaccugagaaaagagagaaaguagauucgcagugaagcacagccauccagaugcccuguuucccccugccuucuccagcuccaccguuccucugccuccuguaaggacccggcauucugcacuucacuccucagacccgccucuguuuagguuuccaaccucccuccuagcgguagcucccugcacugcuacccccggucagagacguccugcuuucggcugcccacacggcucucaccugcgcuauagcagcuguuguaggcccgguccgggugggagggcauacuucuuauacaucggaauagagucuccugccuuccuuggccuucucgagacaccaccugacccauggugaaagucacgucuugaaacaggaccuggcagggaagggagauguugaagaaaacaggauggccuggcucaguucugggaggccucaggagcgcuaacgagggaagaaagaagggucugcuggguuugguaugaauagaggggucaggaacccucaguagggggccaaagaggcccucugugaagcucagaguguggcugggguuaccuggcuauacagcagauaaacuccagcauccuggauucggacaccauauccuugggccuguaggccucucccacgccuaagagcugguugccacaucaccucugucacaucggagucaucuggaggugagagugugucggucaggacuucuuggcacucucaggugcuuuuugguucuuucccuuucaccuauaaggaccccuugagcccaagugccagcccgaguuccugguuauugccccuccccaaagccauuauuuaaaauagugcucacccuuggagguggcguuaaugggaaccaggugcaggacagagugcugcucugaggagagaaggagggaaucucagccgcauccacuuucccccguugugcuguuggcagccuccacccucacccugacucgggcuuacaauccccacgcugcuugaucaccucccaccccugcugcacccuggaagccucacucuucuguuuuugggugagcacugcucuccuuuuccgggaucucuccccauucucccaggcuuccagggcaucggaacucugcucauggaaagagggucaagguuagguuaagaugcgagggucccagccagccugccuucccagcccuccccugcccccgagaugccucagaucucucacgcaccuuuucccagcacccugaguguuggugcuggcugcccuccaggauuuguuagguaugagaagcauuaaccuuuaacaguuuccuuuccuggaauggccgcgccccugacuuccaaaccggagacccucucuugcacccccuugaaacuuugcagaccaggaggcccagagaccccccaugcuaaccauccucucccagacacccuccuccccucacucaccugcuccgggagacucugccagggauacccuuccccauucugggaggggccuccuguccccugcagccggcucaccucucuccugaggcucugcagcucuguuuguugggucagcagagccauggcacaagccacggcccccagagcugccccccaacucaaccagagggcaacugagagugccggcucucugacugggccccccauguugccuggaggcccuuugggggcuagcaagaaaggagaugaggcuggcaugagcuggggacccugccaacagcugugguuucaagagugggguagcaaggagguggcggggcggguaaggguacgggcaguggugcagaagggaagaagguuguuacgcaaggagaaauaaaaaggaacuugaaaauaaaaaggagggaggaggaaagcaagcuaaggguacuguuagugcuccuggcacuccgucguggggccagcguugccuugagacccuccacccucccucagccucaggagaauuagguuccagucccucuaggaaggacagggcugccagugacacccaggaggaacaggcagugcgcaggaacccuggggcggccccaggguugggggagggaagguuggcuggcuagagggcauugugccaggagcaggauggggggccaagcugggcaguguccagggucagggcgaggguggaagacccucggggucaagcacagcagagaucgcuggggcaguucacuaggggugacugaaggugggaaaggaggggugggcucgauggggaggagaaccaggggcacggaagcaagaaacuggcugaguucugggguuaaggcugggccggguguguuggaauaaggccugcacuacucccugugcugaaauuggcaagcaggacuuccuguuucccgagaaaagcucuuacauaaggcucuggacgaagagacaaagcagcggccucaagccccccggccacugcgggauuccuccccagcacacaggguuccggguucccgugugccugcugacucucagccccuccuccaggcuggcuccugcccgccccaccucccagccagggccugugccagcaccugcugaauguccgaggccaccaagaggaagggccccugcuccucccagccaggaagggauuuccccgcaggaggaagucugccuccuaggccaaggaggccgcuucugcuguaccuugggcggaggauugauuuuuuuccugggcagugugccuuccuaccucugcucccaccugggggcuggaggcauggagguccccgcccccaagccugaacaucaucccggaguuccagcugugccgcuccgcaacgccccccuucacguggcccccagcuacccugagaguguccccugagccccaauaaagagagagacuaugacuuauucuauuuaauauccauuuaucaacauuuugucacaauaauaauaaaaauaauaucuguuuuaaaaauccacagggaauucucaagggaggagcuugucuuguuucucgccccucacauuugggaacuccuggccuaggcccagucucuuuggcuuccugccgccagguccagccccucuuagugccugaaguggggucuucuggacccauccuugcccacagaguacagugaacacaaugcccugggggucuguggccaggggggagucgagaucacugggggccucaaagggucagggauuggggagcuagugagguggagagugggcggugggggaguuguaagauaagagugggaauacuguauuuaugugggauggaaaacacgugaacaggcccaggcagccucuagagggaggggcaggucuggagcaaagagcggcugaggguggggcagaggggaccgggugcccagagagcugucgaggggagccggcagccugggacgacugcggggagaccagggccccucagugaaccuggaagaguccgaaguaggugaggaagggggcagccuugagaugggcccaggggagggugcggauccgcagggaggacccuggccgcagggccaacagaccagacaccuggcagaggcggagcuggggcccgagggaacucgccgcaguggcugagaauuccuccaggcagcgcagggccagcacaccauccaccagcaaguccagcuucagguagacagccuuccccucaucaaagugcaccugggguggggacaacaggccgaguccaggccucugccugcccucgccucaauuuccaauuuccucagcgacgcaggcaucccaucccacccaaaccccaacucacccucccagcccuguagcuugucccccacucuccuggcaaacccuucgccacucucuuacugcguuacccaugcagccagauggggcuuaccugacaguacagguaguagagcccagcccgggugacuauaaacuccccgaucuggcgguuguagcgcagagggcuggagcuguugauucuggcuuccucccagccacucacugucccguccacaccugaacacggaugcucagagauaaggaaacgucucucuacaggacucccccacacuccccagggauccauugagcauaugaacauucggcgcccacuuuacccagaagacacauagaucaccccgggcaagggaggacccauccccuaugaugcccauaguugacuaggaaguuaugugaaaaaaucuaauguauauggccagagacauucagggcagauugucaccugcagucacuucuggggagaagaguagaacugaaggagaagcgugaggggauuuaauguuuuacuucauggauaucuauauuauuugcuucuuuuauauggaggauguaaacauacauuaucugaauuaguacaacuaaaaauaauaaaaugaaacccaauuguccaucaacaaaaugucuauccauauaauggaauauuauuuggccauaaaaagagugaaguacugauacacacuauggcacagaugugccuugaaaacaucaugcucagccaggugcaguggcucacgccugucaucccggcauuuugagaggccaaggugggcggaucaccugaggucgggaguucgagaccagccuggccaacaaggugaaaccccgucucuacuaaaaauacaaaaacuagcagggcaugguggcaggcaccuguaauccuagcuacaugggaggcugaggcaggagaauuacuugaaccugggauggggagguugcagugaaccaagaucaugccacugcacuccagccugggcaacagagcuagacucugucuccaaaaaaaaaaaaaaacaaaaaaaacgcucacugggcauuuuuauuuccaccaauggguucccacaaccugugcucugcagagucuccagcccugaaguuuccuucccuuccuuacccugccaacugcaccaucugaacagcaauagccccucaaacucaucucaaccaacacugagcugaccccccucaucccacucuugcuuuacugucuguuuuccacauuuggcuucugguuuugccaccagggggauauucaagccucccucuccuuuaccuacaucauuaaucgaucaccaguuccuaucuauccugccuccuaaauagcucucuccccucucucccccaucuggugccucugucugguuuucacagcauucccuguuuccauucuggcuuccuccaguuuauucccuacacaaagccacagaaugagucucuaagaugcagacguaagcccgccucgccucgccuuccuccuuccgauggcucaccucagaauaguucccacaugccaccguguggccuggcuucugucuccagccucauccccaucucgcuccucuagcacuuucugcuucugccacgcugaacuuagagucccccagccucaucaugcucugggcaaacccggggcuuuugccccaggggcugcuucugcuugcacccaccauucuugaccccuugccugucuugucuuacgcuccugcuucaaggcccagcggcaccuugcgaugcagggagagaaucccugacuccacagccaugucugucuuccccuguguugccagguaucuuggccacuuuuauuauuguucuugucauauuccacuguaauuacaaauuuuuuuuugagauggagucucacucuugucacccaggcuggagugcaguggcacaaucucggcucacugcagccuccgccucccggguucaagugauucucaugcuucagccuccugaguagcugggauuacaggcaugugccaccaaaccuggcuaauuuuuuuuguauguuccuguaauuacaaauuuauaugcuuguuuccucuccuagacagugacuccuuaagaguuggucugaggcugggcacaguggcucacgccuguaaucccagcaccuugggaggccaagguggguggaucacgaggucaggagaucgagacgcuccuggcuaacacggugaaaccccgucucuacuaaaacauaaaaaaaaaauuagccaggcgugguggcaggcgccuguagucccagcuacucgggagacugaggcaggagaaucacuugaacccgagaaggcugcagugagccgagauggcgccacugcacuccagcuggggcaacaagagcaaaacuccaucucaaaaaaaaaaaugggucugaccggcugggcgcgguggcucacgccuguaaucccagcacuuugggaggccgaguuggguggaucacgaggucaggagaucgagaccauccuggcuaacacggugaaaccccgucucuacuaaaaaauaaaaaaaaauuagccaggcgugguggcgggcgccuguagucccagcuacuugggaggcugaggcaggagaauggcaugaacccaggaggcggagcuugcaguaagccgagaucgcgccacuacacuccagccugggcgacagagugagacuccaucucaaaaaaaaaaaaaaaaaaaaaaaagagucuggauauuaguugcugugggcaccuagccuggccccuagcaaacaguaggucuucaaugccuguugagucaaugaaugaaugaaugucuggauaauugccaaaauaaguggucuauacagaggggaggaaggcugaucugggcaugaagaguagggagggcagagaagagagggcauuccuagcuacgaagccagccuaagcaaaggcugcuuguagccuaagggcauggugugcccaggagcacggagggcuugccugguauaucacuugucuccagccacaaaccucaccuggacauuccguccugccuggcaaucuuacauucccccacgaagcuugcuuucauaaucagcaaguugagauuuuguaccauuucuccucaaaucuccugucuccaucucccuaguuguccagaggaccuagaagucaucgagcaaagguucccucaucuccccccagcaaaucuacaaacccaccuggucucuuguucuccuuugacccucugguaauggugggagauguguccucucuucuuucuggaaacuucccucuccccuuuuuggauguggccccugcauggaccccucaccccugcaccagccaccucgccuuucaugcagaccauguccaguacacaggcacauucuagcuggguucaaaucuuggcuccaccacuuaguaucucauggccucagacaaguuguguaaccuccaucuguaaaauggagguaauuagaguaucuuccuuuuagggcuguugugaggauuagauaagaccaaacacaagugccagacacagugccuaucucaagaaagcccucaguacauguuagaucagaugaaaauaguauuguucacagaacuaaacuuuuccuugguccacacaccccuccaccuacuggccuauuucucugcuccuuguuacagagaaacuucuaaaaaggguuguccuaggccgggugcaguggcucaugcuuguaaucccagcacuuugggaggccgaagcggguggaacaccugaggucgggaguuugagaccagccugaccaacauggagaaacccugucucuacuaaaaauacaaaauuagccaggcgugguggcgcaugccuguaaucucagcuacuggggaggcugaggcaggagaauugcuugaacccgggagguggagguuacggucagccgagaucgugccauugcacuggauccagccugggugacaagagugaaacucugucacaaaaaaaaaaaaaaaaaaaaaaaaaaaaaaaaaaaaaaagguugucccugccuccaguuccuuauuucucauuuucuucucaacccaaugcacacugccuuccuguucuaacuaugccacugaaaccacccucuuuaaggucagcaggacuuucacguuaccaaacccagccaucauuucucuguucucauuucaugugaucucucagcugcauucaacacagacagccacauccuccuugaaacagugguuucuccgaauccaggaugccacccucccuggguuucuuccucucucuccagcuucuuuucagucucugcugguuuuccccucagcuccacuucaagaugcccaagagucucagggcuucauucguggggcccuucuuucuccuggcgucucacccaauccuguggcuuuaaaugccaucgauaggccgggcacaagggcucacaccuguaaucccagcacuuugggaggcugaggcuggcggaucaccugagaucaggaguucaagaccagccuggccaacacggugaaacccugucucuacuaaaaaauacaaaaaugagcugggugugguggcacccgccuauaaucucagcuacuugggaggcugagacaggagaaucgcuuggacccaggaggcagauguugcagugagccaagaucgaaccacugcacuccagccugggugacagagcgagacucugucucaaaaaaaaaaaaaaaaaagccauccauauggccaugacuccuggcuuuauccguccugaccuagccuaagcuagucgacaauguccagccauccauuucuggaauuuacuuuauugucauuuauccgcuuguuuauuuuagacuucucaacguuaauaauuaucuuacauacuucccaaccuauuuauuccuuggucaaucccuucuuaggaaauggcaucauucuucccagagauacccaaguuaaaaaucuagaagcuggcugggugcaguggcucaugccuguaaucccagcacuuugguaggccgaggcgggcagaucacuggaggucaagaguuugagaccagccuggaaaacauggcaaaaccccaucucuacuaaaaauacaaaaauuagccaggcgugguggcacacgccuguaaucccagcuacuuggaaggcugagacgggaaucucuugaaccugggaggcagagguugcaguaagccgagauugcaccacugcacuccagccugggugacagagcgagacugucuuaaaaaaaauaaaaaaucuagaagucaucugugauuccucccuuucuuuuauucuucaccuccaacccauaagucaguaauaucuucaggacacaggcugaacccauccacuucucaccaucucugcugugaaccccucggcugagcacuccucaugccucccugccucucacaguggaaagacauucuggugagggggaugguaugugcaaaguccagaagaggcacaccgggagcaggggugucagcgcagcaaacaugaagacagcauaagagugcagggaaauuagguugagaccagaccacgaagagacuggaagccauguagagagccaauaccacaagaaaagugaaguuuaggggcucagcauggcagcacaggucagauggaguggagggguagggaggguguggaguggggaagcagcaagaggcuggauuugagguucugaggucacggugcugagguagagggugggguagaaauggaaaagaugagcagacacuagcagcauuuagagaaaaagaucaucagaacguggaauauggaggagacagaagaaaaaagaaugaaaagugcuucuuggagaagaaugagggcugaaggagagagcugggacagugauuugcugggggaacugggcagaguucuggggaagaguaggggucuuucauggggucccacgccugggucacagagagaaccaagaccuucaugaacuggcuucugugguucugagacugauggccgggaagggagugggaggucaaagguuuucaagggcccuuuucccaggaggccagugcugugucgggggauggggucucaccugccugcgcuccguccuguccaggucguggaugaacuguaaaguacaggaaaaggcuggugagaccugcccugacccucugccaccugccccucuccuccuggguauggcucacccaucacccaccuucauaaugggcugcgaucgcucuucgagcccguguuuuccggccuuuaggugcugaggaucaaggaaagacagaugagcaaagcgggcccuagugggggucccagagcaacucucccagccccauuccccucucaggaacccuggcauccuuauucuuguccagacuccuggccuuagaaucucaggccucaucuuccucaguaaguagagugacuauaauuugucauccacacugggauacugcugagagcaaaacgggaagcugcuauuaaucacaccgagauaacaggugggggccaggacaacugcaugccgacuuggacacguggucauccggccaccccaucaucccauuccuaagucucuuugccuaccggggcccaggccucugacugccaggccuagucuccaucaggaucccaguaguucuucuaacucauggccacccugccuuccuguuugggguagggucugaaggagcacauccauaugacagaaggagcuucagaggagggcgagaaucccuagguuugagucuuggcugguuagcugcaugacucugaacuccuuucacccuccgugccucaguuucucccuguggauaaugguuuuugcucugcccgcuuccugagguugggauagagggaugcucaccacuucugcgaggccgaacuagucgguucaggaaaggcgcaggauccuggcuuucuucugucuggggauucaguuccuaggggaauuagggcaggguucaaccacagacucccagagauauaaagugagacauacggggccugucaggagagccaccagccagcaauagacacagaagucagggacagauuaagccccucagccaacuacagcuggggccccgggcaaaggugaagcugggagucaggccccaguccucacccuuuccucuagaccagcuacacuuucccacccacacacacaaccaacgcagacccugcauucaauuggcacauugcacacaugcccgcacccagucaccacgcacagaggauacacacccuguacacaaccgcaccccucuuccacgcagacucacauaucuuauacaaccacgucacccccagccaauaaacaccucagacucagguggcacaaccccagcacaaaccccucacacagaguugucaccacgcacacacaccccugcagacacgcacccaugcacgcacuguguucacacacacccugcacacaccucgaguacggcuggcacagcugcacacaccugcagccucggcugugcacacuucccaugccccagcagccugcagaccgcgcccacgcccacucaccgacggguccugguccuccucugccaccagcuccuccugggcaggcuccugcugggaaggagggagcgucacccugugccgcuccaccugacaucucacccuccacccauccucccuuccccuugccuucagcccacgcggcccccagcggccccucugcagucucagcuccugaugugcccaagaaggggugcgcagcggggccucaccugggcggacagcgaugcccggcuccccaaacugaccacggccagcaggaggccgaggcaggccagcgccaggcccaggcccagcgcgagcgggaccagcagggcggugcccggcuccccccggcgcccccuccgccucuggcuccgacgggcggccaugggggcggggggcugugccugccucaccgcccccccaucccgggacccgagggaucgggggagggggagccggcgggcggaucgggccggggagagggaggggcaagggaaacggggcgggagggggcgcuggggacaggaagccggacgcugugugugaucaaacuccgagccucucgccgggcgcugugcgcgcagcgaacggagu

SEQ ID NO: 16645 - RNA, 6173 nt, Homo sapiens
agauagugauggaaacugggguccgauagauggagagaaggacguaggauaaggcuucuuguggggugaagaggcagagggcaccuggagagagguguggcauggagaaccagggguuuucccuagcagagggcggcuucguggacuucggccaaccggcgggugcuucccucgagcggccgcuagaugguggugcuguucuggaugcuuccagugggccccgaccaggucuggacaaugccuggcgcccgucccccgccccucaucuacacacacgcaagaauucggagcuccauggggaacagaagcaagauauccguaaaaucaaagucuagggggugggaaugaaaagggaaaagugaggaacggggagccaaacccaggaagacgccucuguuccugcacauucccucuccuuuauauacucagcucuuggcugucuccaguauguacccacccuggucuuccaagcugggagccacuuuuuauaacacaaucacaguuucacaaaccccaggaagguuccauguggagagagguuaaguuucgcccuugcccggggaauuaugacacucagaauauccccuugguguaaauggaagacaccugagaaaagagagaaaguagauucgcagugaagcacagccauccagaugcccuguuucccccugccuucuccagcuccaccguuccucugccuccuguaaggacccggcauucugcacuucacuccucagacccgccucuguuuagguuuccaaccucccuccuagcgguagcucccugcacugcuacccccggucagagacguccugcuuucggcugcccacacggcucucaccugcgcuauagcagcuguuguaggcccgguccgggugggagggcauacuucuuauacaucggaauagagucuccugccuuccuuggccuucucgagacaccaccugacccauggugaaagucacgucuugaaacaggaccuggcagggaagggagauguugaagaaaacaggauggccuggcucaguucugggaggccucaggagcgcuaacgagggaagaaagaagggucugcuggguuugguaugaauagaggggucaggaacccucaguagggggccaaagaggcccucugugaagcucagaguguggcugggguuaccuggcuauacagcagauaaacuccagcauccuggauucggacaccauauccuugggccuguaggccucucccacgccuaagagcugguugccacaucaccucugucacaucggagucaucuggaggugagagugugucggucaggacuucuuggcacucucaggugcuuuuugguucuuucccuuucaccuauaaggaccccuugagcccaagugccagcccgaguuccugguuauugccccuccccaaagccauuauuuaaaauagugcucacccuuggagguggcguuaaugggaaccaggugcaggacagagugcugcucugaggagagaaggagggaaucucagccgcauccacuuucccccguugugcuguuggcagccuccacccucacccugacucgggcuuacaauccccacgcugcuugaucaccucccaccccugcugcacccuggaagccucacucuucuguuuuugggugagcacugcucuccuuuuccgggaucucuccccauucucccaggcuuccagggcaucggaacucugcucauggaaagagggucaagguuagguuaagaugcgagggucccagccagccugccuucccagcccuccccugcccccgagaugccucagaucucucacgcaccuuuucccagcacccugaguguuggugcuggcugcccuccaggauuuguuagguaugagaagcauuaaccuuuaacaguuuccuuuccuggaauggccgcgccccugacuuccaaaccggagacccucucuugcacccccuugaaacuuugcagaccaggaggcccagagaccccccaugcuaaccauccucucccagacacccuccuccccucacucaccugcuccgggagacucugccagggauacccuuccccauucugggaggggccuccuguccccugcagccggcucaccucucuccugaggcucugcagcucuguuuguugggucagcagagccauggcacaagccacggcccccagagcugccccccaacucaaccagagggcaacugagagugccggcucucugacugggccccccauguugccuggaggcccuuugggggcuagcaagaaaggagaugaggcuggcaugagcuggggacccugccaacagcugugguuucaagagugggguagcaaggagguggcggggcggguaaggguacgggcaguggugcagaagggaagaagguuguuacgcaaggagaaauaaaaaggaacuugaaaauaaaaaggagggaggaggaaagcaagcuaaggguacuguuagugcuccuggcacuccgucguggggccagcguugccuugagacccuccacccucccucagccucaggagaauuagguuccagucccucuaggaaggacagggcugccagugacacccaggaggaacaggcagugcgcaggaacccuggggcggccccaggguugggggagggaagguuggcuggcuagagggcauugugccaggagcaggauggggggccaagcugggcaguguccagggucagggcgaggguggaagacccucggggucaagcacagcagagaucgcuggggcaguucacuaggggugacugaaggugggaaaggaggggugggcucgauggggaggagaaccaggggcacggaagcaagaaacuggcugaguucugggguuaaggcugggccggguguguuggaauaaggccugcacuacucccugugcugaaauuggcaagcaggacuuccuguuucccgagaaaagcucuuacauaaggcucuggacgaagagacaaagcagcggccucaagccccccggccacugcgggauuccuccccagcacacaggguuccggguucccgugugccugcugacucucagccccuccuccaggcuggcuccugcccgccccaccucccagccagggccugugccagcaccugcugaauguccgaggccaccaagaggaagggccccugcuccucccagccaggaagggauuuccccgcaggaggaagucugccuccuaggccaaggaggccgcuucugcuguaccuugggcggaggauugauuuuuuuccugggcagugugccuuccuaccucugcucccaccugggggcuggaggcauggagguccccgcccccaagccugaacaucaucccggaguuccagcugugccgcuccgcaacgccccccuucacguggcccccagcuacccugagaguguccccugagccccaauaaagagagagacuaugacuuauucuauuuaauauccauuuaucaacauuuugucacaauaauaauaaaaauaauaucuguuuuaaaaauccacagggaauucucaagggaggagcuugucuuguuucucgccccucacauuugggaacuccuggccuaggcccagucucuuuggcuuccugccgccagguccagccccucuuagugccugaaguggggucuucuggacccauccuugcccacagaguacagugaacacaaugcccugggggucuguggccaggggggagucgagaucacugggggccucaaagggucagggauuggggagcuagugagguggagagugggcggugggggaguuguaagauaagagugggaauacuguauuuaugugggauggaaaacacgugaacaggcccaggcagccucuagagggaggggcaggucuggagcaaagagcggcugaggguggggcagaggggaccgggugcccagagagcugucgaggggagccggcagccugggacgacugcggggagaccagggccccucagugaaccuggaagaguccgaaguaggugaggaagggggcagccuugagaugggcccaggggagggugcggauccgcagggaggacccuggccgcagggccaacagaccagacaccuggcagaggcggagcuggggcccgagggaacucgccgcaguggcugagaauuccuccaggcagcgcagggccagcacaccauccaccagcaaguccagcuucagguagacagccuuccccucaucaaagugcaccugggguggggacaacaggccgaguccaggccucugccugcccucgccucaauuuccaauuuccucagcgacgcaggcaucccaucccacccaaaccccaacucacccucccagcccuguagcuugucccccacucuccuggcaaacccuucgccacucucuuacugcguuacccaugcagccagauggggcuuaccugacaguacagguaguagagcccagcccgggugacuauaaacuccccgaucuggcgguuguagcgcagagggcuggagcuguugauucuggcuuccucccagccacucacugucccguccacaccugaacacggaugcucagagauaaggaaacgucucucuacaggacucccccacacuccccagggauccauugagcauaugaacauucggcgcccacuuuacccagaagacacauagaucaccccgggcaagggaggacccauccccuaugaugcccauaguugacuaggaaguuaugugaaaaaaucuaauguauauggccagagacauucagggcagauugucaccugcagucacuucuggggagaagaguagaacugaaggagaagcgugaggggauuuaauguuuuacuucauggauaucuauauuauuugcuucuuuuauauggaggauguaaacauacauuaucugaauuaguacaacuaaaaauaauaaaaugaaacccaauuguccaucaacaaaaugucuauccauauaauggaauauuauuuggccauaaaaagagugaaguacugauacacacuauggcacagaugugccuugaaaacaucaugcucagccaggugcaguggcucacgccugucaucccggcauuuugagaggccaaggugggcggaucaccugaggucgggaguucgagaccagccuggccaacaaggugaaaccccgucucuacuaaaaauacaaaaacuagcagggcaugguggcaggcaccuguaauccuagcuacaugggaggcugaggcaggagaauuacuugaaccugggauggggagguugcagugaaccaagaucaugccacugcacuccagccugggcaacagagcuagacucugucuccaaaaaaaaaaaaaaacaaaaaaaacgcucacugggcauuuuuauuuccaccaauggguucccacaaccugugcucugcagagucuccagcccugaaguuuccuucccuuccuuacccugccaacugcaccaucugaacagcaauagccccucaaacucaucucaaccaacacugagcugaccccccucaucccacucuugcuuuacugucuguuuuccacauuuggcuucugguuuugccaccagggggauauucaagccucccucuccuuuaccuacaucauuaaucgaucaccaguuccuaucuauccugccuccuaaauagcucucuccccucucucccccaucuggugccucugucugguuuucacagcauucccuguuuccauucuggcuuccuccaguuuauucccuacacaaagccacagaaugagucucuaagaugcagacguaagcccgccucgccucgccuuccuccuuccgauggcucaccucagaauaguucccacaugccaccguguggccuggcuucugucuccagccucauccccaucucgcuccucuagcacuuucugcuucugccacgcugaacuuagagucccccagccucaucaugcucugggcaaacccggggcuuuugccccaggggcugcuucugcuugcacccaccauucuugaccccuugccugucuugucuuacgcuccugcuucaaggcccagcggcaccuugcgaugcagggagagaaucccugacuccacagccaugucugucuuccccuguguugccagguaucuuggccacuuuuauuauuguucuugucauauuccacuguaauuacaaa

SEQ ID NO: 16646 - RNA, 30249 nt, Homo sapiens
gcucagaagcgccgagagcgcggccgggacgguuggagaagaaggcggcucccggaagggggagagacaaacugccguaaccucugccguucaggaacccgguuacuuauuuauucguuacccuuuuucuucuuccucccccaaaaaccuuuuccuuuucccuucuuuuuuuuuccuuuuugggagcugaaaaauuuccgguaagggaaagaagggcuccuuucgcuccuuauuuccccgccuccuucccucccccaccuuccccuccuccggcuuuuuccucccaacucggggagguccuucccgguggccgcccugacgaggucugagcaccuaggcggaggcggcgcaggcuuuuuguagugagguuugcgccugcgcagcgcgccugccuccgccaugcacggggguggcccccccucgggggacagcgcaugcccgcugcgcaccaucaagagaguccaguucggaguccugaguccggaugaacugguaagcggcucuguccuccccuuccccccuccuccccuggcgggcggggccggacgggggcugcggaaacuuggcgcuuucucgcugcuuaugggugacgggccaggagcauggcucagcagcgccaaggccguguaggcgccagucucgggccucccagaguuauauuuugcaaagaguugagcaggcguagcgcuuuguccgagauggggggcuggcuggagggugagaaggagggagagaaggaugacugauuucacacuccagaguuaccgacguuaaaggcgauccgacgaauccuagggagucuuuacaaguuugguuaagaagccaaacccggguagcuuccuccucuucuguaauacaaauguuaacugagcaccugcucuguugaagacacaggagacucggguuacagaggugaacacgacagaccaggacccuaccuucaagagcacugucugugggaaagggcaagcaguaaacaugaauacaaugaaugaaugagauaauucaguuaauggcauuugucucgaauagagugaaaagggguaaucccauggagagucacugagcuggggcuacuuuauuuuuuuauuuuuauuuuauuuuauuuuuugagacggagucuugcucugucgcccaggcuggagugcaauggcacgaucucggcucacugcaaucuccgccucccggguucaagcgauucuccugccuuagccuccugaguagcugggauuacaggcaugcgccaccaugccccgcuaauuuuuguauuuuuaguagaggagggguuuugccauguuggccaggcuggucucgaacgccugcccugaggugauucucccccgucuuuuuuuuuuuuuuuuuuuuuuugagacggaguuucgcucuuauuccccaggccagagugcaauggcugaacuccugacuucaggugauccacccgccucggccucucaaagugcugggauuacaggcgugagcuaccgcgcccgucgagguggggcuacuuuagaugggauggcgucagggucugggaaggccuaucuuagaagacauuacccaaaugaugagaggcagccagucgucgaagccauaguuuggauggcgagagcuuuuccggcagaggaaauagcaagugcaaagggccugagggagaaaugaacuugggcuuguccuacagggugaaaggcggccgguguggcugagguuuaguggaugagagaagaguguuacagaaauaggcuggagaagcaugggauauuguauauuaugguaaggagucaggacuuaauuccauuuucaguagguagucguugacaauuauaaacagagugacagcacauuugaaaaaacuacugcuguaguugcucuaugaagaacugaugcgagaggaggagagaccagagagaggagggcagcccuaggggagagcuauuggugacuuggacuuuuucccuuguggcgcuaaguagaggagcccacuggcuggaaagaauggaguuaaguggcuguuuguggauagagaccauuuuugcugggagaaaguucagcuaugucaggagucagaacguccugaccucacaccauaccacagaaucaguuccagaugaaguuaagacuuaaaccuaaaaaaacccauaaagcacuagaaaaaaaauagaaggcuuuugcagggcugauaccagagacagaaguccuuaauaguagugaauuaauuauaggcaaauuuuauggagugccuaaaaugagcuaaacguuauauauaaggaagaccaaggcagauuucacuacauaaaaauaagagccacuucuguuuauagaggcacuguggcaaagcugaaaaacagaucaggaaacaguauuugcaauuacgcagacaagguuaaauuuauugauguacaaggaacacaaaucaguaaggaaaguaccuaucuacuagaaaaauggguaaaggagaugaauaggcaguucacagaaauagugcaaauggccaacaaagaguagacuuucuaauaaaaaaaauccagauuaaaauaaaauuuuuucucaucugauuuuuuuucccugcuggcaaaaauacugggaaauagacgugcuuauacauuguugguagaaagauagauugguauaaccuuuuuggaggauggucugacaauuuuuuuuuuuucgagauggaaucucacucuuguugcccagacuggagugcaguggcacgaucuuggcacacugcaaccuccaccucucggguucaagcgauucuccugccuuagccucccaaguagcugggauuacaggcgugugccacgaugccuggcuauuuuuguauuuuaguagagaugggguuuugccguguugcccaggcuggucuugaacuccugaccucagaggacccgcccgccuuggccucccaaagugcugggauuacaggcaugagccaccaugcccggccucuggucuaacaauuuuaucaaccuuuuaauauguaaaucauuugaucaagcauuaccacuuauaaaaauucauccuuagguuaaaaaagcuuaauuauccccucaaugaugccccuuucccagucuugcaugguucauuaaauaguuucuccauucauccauuugcucaggccaaaaaucuaaaagccaucuuugauucucuuucucacaaucuccacuuaguccaucugccagagugucaguccuaccuuucaaaauaugccuggaauccagccauuuaugaccaucuccaccaccaugucccaccauaucccacccuacugucaucuuuccuguggggugcuauagagcccuaauuggucuuccuacaguuuguaagaacagcuagaacaggcuagagagaucucuucaucccuucccuucauagaauccuuuccagagguuucaggacuccuuacucugaccuauaaagugcuguuuuaucuggcuccugcuugcuucuccaucucauuacuagucuccucuuugcuuuucuugaaccacgcugacugcuugcuccucuaacacugcaagcuuauucccaccucaaggacuuuauuauucacuauuccuccugcuuggaacaacguugcucagaccucugcucugcaugccuguuccuuuaugucuguauguucuguguugaaauggcauaucuuuuuuuuuuuuuggacacgggguaucccucugucccccaggcuggagugcaguggcucgaucccagcucacugcagccucuugggcucaaaagaugcucccuggccaggcucaaucacgucuguaaucccagcacuuugggaggccaaggugggcagauaacgaggucaggaguuugagaccagccuggccaaaauagugaaacucugucuuuacuaaaaauacaaaaauuagcuaggugugguggcacgccucuguagucccagcuacuagggaagcugagguaggagaaucaguuuaaccugggaggucgagguugcauugagcugauacugugccauugcacuccagccugcgugacggagugagacugucucaaaaaaaaaaaaaaaaaggccaggcgcgguggcucacaccuguagucccagcacuuugggaggcugaggcgggcggaucacgaggucaggagaucgagaccguccuggcuaacacggugaaaccccgucuccccuaaaaauacaaaaaauuagcagggcgugguggcaggugccuguagucccagcuaccugggaggcugaggccggagaauggcgugaacccgggagguggagcuugcagugagccgagauugcgcuccugcauuccagccugggcaacagagcgagacuccgucucaaaaaaaaaaaaaaaaugcucccaccucagacagacccccaacccccaccucaguagcugggacaacaggcucauaccaccaugccuaauuuuuaaauuuguuguagagauggguucucacuauguuaccuaggcuggugaacugggcucaagcgaucccccuccucugccucccaaagugcugggauuccaggcaugagccacugcgccuggccgaugucauaucuuuaggagcgcuucccugaccacucuguuuaaauagcaucccccgcccuucccuuguuuucucugaucauucucugcuauauuuuccuucacagccugucacuccagaaaggauuaguuuuucuguuucuugcuuccuugcuagagaaugaauuucaugagggacuuugucuguguuauucauguucccuuaguaucucagguagugccuggcacaugauagacauguaauaaaaauuaguugaauaaacaagugaaugaaauaauugggcaaauaugcauagauaauguagaaggacuuuuauugcaacauuguuugaaagugacaauuauaaauuacucgguauuuacuaauaggaauccuguugaauaacuuaggguguauucuuacaauguaauagaggaacuucccaauaaggucccacacugugcugaugcccugagacacuguggcacacggugggcacagugagguauuuuaaauuuccaagagaaacacagguacauuugucagauacccuggaacuccuaguuccugguaguucuguuucaacauuagauggugccaaaucccuuucuauaaugucauauuuuugugaaacuggguuuuuagcaguugcuaaguacaggcaaaaaucaguuuguagaagaaauaaagguggugcuguuuagucugauuccaagguuugagaggugcagugccuaacaggcgccauaagugagugagaugguuauuugguaaagaaauaaaaauguuauuuuguuuuaauauauuaauaguauuuucaacuuguguguauuuucucaaauggcuaguaaguuccuaggacauaaaugcuuaaguuguuugggucuaggugcuuaauaaauugcugucuuuucuuggaaagauggagucuugcucuguugccuaggcuggaaugcagaggugagaucucagcucacuguaaccucugccuccuggguucaagcuacucuccucccucagccucucaagcagcugggaucacaggcauccgccaccaugcccggcaauuuuuguauuuuugguagagacaggguuucaccacauuggccagaccggucucaaacuucugaccucaagugaucugcccaccuuggccuccccaagugcugggauugcaggugugagccaccgcgcucggcuguggcucucuuuugaccuaguaagugcugugagaguuacugaaaugguaagggcacugugggcuguugauaauguuagggaaucuauggauaaaugaaaaaguuacucagaaguaugcagagugaaggccuuauguuaaagugggaacguauuuacgguuuuuuuaaagcaugaaaaaaaaugcaugccguggcucaugccuguaaucccagcacuuucggagccugaggcaggaggaucauuugaggccaggaguucaggaccagccugggcaacacagcaagacccuaucucaauuuaaaaauaauaauaacaaaugggcugagcacgguggcucacuccuguaaucccagcacuucgggaggccaaggugggcaaauccccgagggucaagaguucaagaccauccuguccagccuagugaaaccccgucuguacuaaaaauauaaaaagcagcuggguguagucgugggugccuguaaucccagcuacuugggaggcugaggcauaugaaccacuugaaccugguaggcggagguuguacugacccaagauggaauaauaacaaauaaaaguaugggacacuguugacaaagcucuaccagagucaucucugggguguaggauuguugggcuucgauagugcucugcaugucuugcaguuuauacgaugucuguauuuugagggaccaacagacgguucaauuuuggguagaaggaugggugagggugaguaaggugccucuuguugugaaacaggugguauuuuaggcuaaaauguuuuacagaagucuuaggggucagaguguauggagguacggaggggucuuugaauuggcuuugagauagagcuguuguccuugcuguuagaagauggauuuagauguugcuaggugaggggaagguuacaaggcggguugguacuagagcuuuguaccagcgugugcacaaaauuuuggggaaagagggugcuggauuuccuucgcaguaguugaccccuauucauuaaaaacaacugucuaucauggaaugcauaacuuauuuauacccugacuuauuuaaauaaggauuuaaagcaguaaucuguucuuuuuuuuuuugauacggacuccagcucuguugcccaggcuggaguauaguggcacagucugugcucacugcaaccucugccuccuggauucaagcgauucuucugccucagccucccgaguagcaggaacuacaggagcacgccaccacacccagcuaauuucuuuuuuguauuuuuaguagagacgggauuuuacuguguuguccagacuggucucgaacuccugaccuugugauccacccaccuuggccucgcaaagugcugggauuacaggcaugagccaccgcaccuggccuaguuuuuguauuuuuauuagagacaggguuuuaccauguuggccaggcuggucucgaacuccugaccucaggugaucugccugcauuggcgucccaaagugcugggauuacaggcuugagccacugcgccuggucaauaauguauucuuuuagguagagugugggcuacauugaugagugagaagaugauccuuguuuucaaguuaccuauaaucuugugagggauuuccuauguaugcagcaaauaguuacugagccucaaccauauguugguuacugugcuaggugcugaggauaugaagagaaaacaugacccuugcccucaaggauuacaguccaaugagagagacagaugugucaccaaguaauuaaaauugggcugagaaccuugcuggggugugcauaagacuaggaagaguuagagaagacuucauaaggaggugaccucugaacugggucuuaaagaauaaauagaaguuuacucccaagggggugugugaagcaaaaggagauuugagaaaucuauuguauuuagaacauaaaugugggaggcggguaggagaaugugguaccaaauaaagcuguaaaagcaacuugaagccaaauuguaauaaggaccuuguuagcuuugcuaaagcagaggaaagaggacgaguauuuacugagauucaaugacagcccuuuuguuauuguggccucaggggcagaacccaaagagaacccagccugacuggccacccccucaaguguuuaaccuuuauccuguaggcagugagaaccauuguuggccgaaggguugggggcuaauuuaaaaugacaguuugaggccuggugcgguggcucacgacuguaaucccaacacuuugggaggcuaaggugaguggaucacuugaggccaggaguuugagaccauccuggccaacauggugaaacccugucucuacuaaaaauacaaaaauuagccaaguguggugagcaccuguaauuccagcuacuugggaggcugaggcacaagaaucacuugaaccugagaggcagagguggcagugagccgagauuguaccacugcacuccagccggggugacagcaagacccugucucaaaaaaaaaaaguaaaauaaaauaaaaaaugagaguucgugaacuuggugauggagggauagcucuucucauuaacaaggauaugcgugucugcugucuaggacacccccugacccggucucagaaagccugaaagcagaauuagucauuagaagggugguuggcuuggucggcauagacuuugagcagaaagagguugaaaauguugagccugauuucucuuaggccccucugcagugucuguuguggaggccagauacguaacugcuuccgcuuuuuuuggucucauucaaggugagcaaauccccuucauguuucucaccagacaaugcagcugaugagguuccagcuuugcaaauguagucauccaugaggacugucuuccugagauuucaucaggucauguugaugagaguuuugaaccugucugaggcugagaggugugcagaacuucuucagcuuugcaucuguagaccauuuugguuucuacccagcaguggccaaucagaccuauuaugaggggauuacugguuugacugucagaggguaaccucucuuuuuccaaguuuuuugaggguaccucccuccaguggagaguccuaagcaguaggucaauuuaacagacauuuguuaggagcccaccauguuucaggcaggcacaugggauucaggaugguugaggcauucugccugccugagaggugcuuauaguuauagggaagacagacccccauaggucauuuuauugcauuguuguaugugcagugauagagggcuguggaagcacagaggaggggugccugucuacuuugggcaggcuguggaaaggcuuccuggaggaagcagugccugagccgagucuugaaauaggaguuuugcagugggaagagcauuccaagcagagaggcacuagcauauagaaaaccccggaggaacgcagcacguguugcgcuggaugugauaggcgacuccagggaauuguuacugaggagugaacaggaagguguggagcaucagggaaaugaagguugagaacaucauaaaauccuuuugggaagcuguccugcugaguuuggaugucagucugaggacaagaggguaugaaugauuacauuuuuaguuuauuauuaauuuuuauuuuauuuauuuuuagcacacauuuuuauuuuagaaugagcaccccaguuguaauguagaaggauuggagagagacaggcuggugacccauaggaacgcucuguuguagacuacaaaggaagggccugaacuagggcaauggugguggggauggagaagagaggcaagauucaagaaacacuuaggaggccaggcgugguggcuuauguguguaaacccagcugagauucccgccacugcacuccagccugggugacagagcaagacuucuuaaaaaaaaaagggagguaaaagugaccaguaccuggugaaugacugaauaauaauaauguccauucauaaagcgccaauuacauccuggacuuaagcaagcuaauuaaguccuuaaugguuacauaguucauaaguaauauaggcagaauuccaaagcaagggugcccgacagcuaaguccauguucuuuggacuguuuugugcuugaagguaaggaaagguaagcauagguuucugaaucugggauagagacuaaaggaaaaagagaagcuuuuguggaaaagagaguuugcuuuuaaacauguuuaauuugauuuuuuggugugauguuugcaggggguucaguagguagucacauacgugaacccaaaguccagaagaaaaguaaggccuggaauuagagaguugagaaugaguauccaagcauaccuuggagauacugugaguuugguuccagcccaccgcaauaaagcaagucacauggaguuuuuugguugccauugugcauguuacauuaguacuaugcuguagucuacuaagucuaaguguacaauagcauuacaauuuuuuuuuuuuuuugagacggagucuugcucugucauucaggcugaagugcaguggugcgaucucagcucacugcaaccuccgccuccuggguucaagugauucuccugccucagccucccgaguagcugggauuacagguacccaucaccacacccagcuaauuuuuuuguauuuuuaguagagaugggguuucacuauguuggccaggcuggucucaaacuccugaccucaggugauccacccgucucagccucccaaagugcagggauuacgggugugagccaccgcacccggcccaucuacuucugaguucuucuguuuccuccuuuccuucauugaaauguccccaucaaguccuggcucuuccuuucuugggauuccagcuauucacuuuugcuucaaaucauuuccaccaaccuguuuuucuagcaccuguuucuccagucuuuuaauaaaaucucuggccuggcgcgguggcucacgccuguaaucccaguacuuugggaggccgaggcggguggaccaugaggucaagagaccauccuggccaaccuggugaaacccugucucuacuaaaaauacaaaaauuagcucgaugugguggcgcucaccuguagucccagcuacuugggaggcugaggcaggagaaucacuugaacccgggaggcagagguugcagugagcugcgauugcgccacugcacuccagccuggcgacagagcgagacuccaucucaaaacaaaacaaaaccaauaauaaaaucuccaucuggacacgaaaggguucaagcaguucaggccuugagaaggagggcaugacaaagaugagggaaaagaaacagggcugcaucucugagugccucguuucuuaucaggggcuugaguuggcggggcaugucuuggugcagaacaccugggcugucauggcgaggguacagguacagagaggcuucugccaggaucucagauucaugagcuugauuucugcuugggaggaacaaauaaagcauuguuuuguuuuuuuguuuuuccugaagcaacuuugauuucuuuuuguggcuaaauccuauggaugucagagaccuagaauucaacccagauggaagucugggguucaugucccaguagcaggugauuuguauggaacccaggaucgaccauuaucuagugugagugcuuuuccugccucagugacuggaauaagccucugacuugggauauucaacuuuggccuuuucagaaguguacacacaccaaucccccauuccccucacuccaggcuaaacuuaguucuucuguaaguaguucaggguuuucccagaccuuaguccagagcuccccagccacaaaggcuagaaacuaggaacgcuguucaguuguuggccuuucuuucuuugcagaagcgaaugucugugacggaggguggcaucaaauacccagagacgacugagggaggccgccccaagcuuggggggcugauggacccgaggcagggggugauugagcggacuggccgcugccaaacaugugcagguaagugcuggggggccaggugggaucccaaaggggagguggguuggguccucaaaacuagggcugacgguugacaccuggaggccucugagaugagugggagcugggaggaaagcacugggugugugucccacaggaaacaugacagaguguccuggccacuuuggccacauugaacuggccaagccuguguuucacgugggcuuccuggugaagacaaugaaaguuuugcgcugugucugcuucuucugcuccaaacugcuuguggacucugugaguggggaacaggcucuggucugggagcgggggugcuugguagggggcagggggacagcuucaacugacccugcucugcccuguccccagaacaacccaaagaucaaggauauccuggcuaaguccaagggacagcccaagaagcggcucacacaugucuacgaccuuugcaagggcaaaaacauaugcgaggguggggaggagauggacaacaaguucgguguggaacaaccugagggugacgaggaucugaccaaagaaaagguggcuggggcuggcggagacuuuugggaaggaggggucagaggccuggagggaggaaacuggaagggaaggaaacaggaggggcuggccugguguggagggaaauggcccacccucugggcucugauggccccugucucuccuuggaagggccaugguggcugugggcgguaccagcccaggauccggcguucuggccuagaguuguaugcggaauggaagcacguuaaugaggacucucaggagaagaagauccugcugaguccagagcgagugcaugagaucuucaaacgcaucucagaugaggaguguuuugugcugggcauggagccccgcuaugcacggccagaguggaugauugucacagugcugccugugcccccgcucuccgugcggccugcuguugugaugcagggcucugcccguaaccaggucaguggcuccagggcucugccucuuagcuggagggcgaggugucuaaagggaggaagaccuguagguggggauggguggauggaccuggguuugaaaauuccccugcuacuuacuagcuguaugaucuuuaaugaguccuuucacaugguuaaaggccacaaacguguuucugaaucuauaaaugauagugggcaguccugccuccugggguggugugaggaugagagcugugcugugugccugguacguuccugccgagcgcuggcagugguggcuggaccaugaugauucugacuuccugccucaggaugaccugacucacaaacuggcugacaucgugaagaucaacaaucagcugcggcgcaaugagcagaacggcgcagcggcccaugucauugcagaggaugugaagcuccuccaguuccauguggccaccaugguggacaaugagcugccuggcuugccccgugugagucagcaugcuccccaccccucuguguauuggagccagggugggggcuagcaugaggcuucagagcucuggaagagggcccagugcugacuuucuggauugcccccacccuguguuuuuuccucacaggccaugcagaagucugggcguccccucaagucccugaagcagcgguugaagggcaaggaaggccgggugcgagggaaccugaugggcaaaagaguggacuucucggcccguacugucaucacccccgaccccaaccucuccauugaccagguuggcgugccccgcuccauugcugccaacaugaccuuugcggagauugucacccccuucaacauugacaggugugccuccguuggaaagcccuuccuggaauggcuagggaagacauggccucaguggcaaggcuucgagagucugcuccuccuaccucgggcgugggcuuggagcaaggaggaauugaaguucugaaguuuaacuuccacucagggaggguggcugcagggguauuuuaggaagcauugaguucauugcaccucuuuccuuccuagacuucaagaacuagugcgcagggggaacagccaguacccaggcgccaaguacaucauccgagacaauggugaucgcauugacuugcguuuccaccccaagcccagugaccuucaccugcagaccggcuauaaggcacguagcaggccagggccucucucagccaccugagcagaaagcuuuccaagauagggcaggcuggguuaggccaucugagucugucucguucauugggauccagacuugacugucuuguuaaaggcuguugcugcccaggugugcagggagcuguuggucucuggcauucagggugggggugguauaaacccggggcagcuugcauauggcagggaagagggauccguggaggaacagugcagaaggcuuuauguucagaaucucucuugcuuuucuucuagacugaguuccuugagauuggugaaugcuguguauuauucaucccugauaaccugguguuuggcccagggccuuguccagaggaguguuuaauaaguguuucaagugaauuagcaccacgaugucaucucuuuucaguuuacaaaggacuuuuuuuuuuuuuuuuuuuuuuuuaaagaagacagucucgcucuaucgcccaggcuggaguguagaaugcagugcugugaucuuggcucacugcaaccucuaccucccaggcucaagcgauucuucugccucagccucccgaguagcuaggauuacaggcgcgcgccaccacaccuagcuuauuuuuguauuuucaguagagaugggguuucaccauguugaccaggcuggucucaaacuccugagcuuaagugacgugcccgccucagccucccaaagugcuuggauuauaggugugagccacugcacuggacuugcaaaggacuuuagguccauuguccuuuuauucuuagauaccuccuucacugagaccuuuuccuuaccucaccucucuagguggaacggcacaugugugauggggacauuguuaucuucaaccggcagccaacucugcacaaaauguccaugauggggcaucggguccgcauucucccauggucuaccuuucgcuugaaucuuaggucagucccuggcugagggaagcaggcuggaauuggugggaggcgggcaggcuggguggcuccucaagguuucgcugcagacaucuucccaacccugacuuuucucuuuaacuguagugugacaacuccguacaaugcagacuuugacggggaugagaugaacuugcaccugccacagucucuggagacgcgagcagagauccaggagcuggccaugguuccucgcaugauugucaccccccagagcaaucggccugucauggguauugugcaggacacacucacagcagugcgcaaauucaccaagagagacgucuuccuggagcgggugugugguccaaauggaaaccuggcuuaagugggcaguggggcucuggggugcaagguggaggcuagagaggaagagcuguguuuuuuuuccugacuuacccagcaguggucugugagauugucuuuucuggugggcgaacaaaaaggggguuaggaaaacucaggccaaaaagguguaaggcguuaauuccccauuuaauuccuuaaaauuucauguaauaccagguauugccuguaaaggaaagauaaagggaaaaauaaguaagaccuuguucaaauuuuauuuuucuauuuuaaccuucacuuauuuccuaauuauuaaaagaaauuuaugcuuauuguuaagaacaaaaacaaaaauuucaguauuacaaugaauuuuuaauuaaaaguuuuuggggccgggcgcaguggcucacgccuguaaucccagcacuuugggaggccgaggcggguggaucacgaggucaggagaucaagaccaucuuggcuaacacggugaaaccccaucucuacugaaaaauacaaaaaauuagccgggcguaguggcaugagccuguagucccagcuacuugggaggcugaggcaggagaauggcgugaacucgggaggcagagcuugcagugagccgagaucacaccacugcacuccagccugggcgacagagcgagacuccgucucaaaaaaaaaaaaaaaaaaguuuuugggacugggcauggugacucacaccuguaauucuagcacuuugggaggccgaggcaggcacaucauuugaggccaggaguuggagacaacucuggccaacauagagaaaccccgucucuaccaaaaauacaaaaauuagccggacaugguggcaggugccuguaaucccagcuacuugagaggcuguggcaggagaauugcuugaccccaggaggcggagguugcagugagcccugauugcaccauugcacuccagccuggguaaacagcaagacccugucucaaaaaauuaaagguuggaaaaaacuuuuccugucaucuuugccuccaaaaucuggcuuucucccuugggcagggaaaccuccccaacauuucucuaucaucccugagauguggggccugcacucugacuucugucugccuuacucuuugucuuacagggugaagugaugaaccuccugauguuccugucgacgugggaugggaaggucccacagccggccauccuaaagccccggccccuguggacaggcaagcaaaucuucucccucaucauaccuggucacaucaauuguauccguacccacaguacccaucccgaugaugaagacaguggcccuuacaagcacaucucuccuggggacaccaagguagggcuuggcuucuggauaugugaggacagaauuuggacgugggagccaggaccagagcaggggccuugagugggugcuuuguccuuagguggugguggagaauggggagcugaucaugggcauccuguguaagaagucucugggcacgucagcuggcucccugguccacaucuccuaccuagagaugggucaugacaucacucgccucuucuacuccaacauucagacugucauuaacaacuggcuccucaucgagggugagcauggaggcgugguaccaagacgucucugugaauucucuaacuucuuacuguccuuccaucccuuucuuuccuccuuggauuuggugcccccugcuucuacucucuuggcuauaauuccauuccauguuucuuagagguccaaagggguuugcugauguuuuucccugucucuaggucauacuauuggcauuggggacuccauugcugauucuaagacuuaccaggacauucagaacacuauuaagaaggccaagcaggacguaauagagguaagaggggaggccaccagagacggaauaagggguuuccagggacuucgaaguuagcaucaucaagagcaaagggaguguaagguuagagggaaggggcagagaguagggauugaugucucaccgagaacucugccuccaggucaucgagaaggcacacaacaaugagcuggagcccaccccagggaacacucugcggcagacguuugagaaucaggugaaccgcauucuuaacgaugcccgagacaagacuggcuccucugcucagaaaucccugucugaauacaauaacuucaagucuauggucguguccggagcuaaagguuccaagauuaacaucucccaggugagaagccuuguuuuuccauauacggggccgcugugaaguuugggaggaggaaggaagguguuuguauguauuagggucaggagaaucacgggaguugggggaaauuuugggaacuguuauucuuaaggcagagggaauucaguauacaccaccuuucuguuucccaggucauugcugucguuggacagcagaacgucgagggcaagcggauuccauuuggcuucaagcaccggacucugccucacuucaucaaggaugacuacgggccugagagccguggcuuuguggagaacuccuaccuagccggccucacacccacugaguucuuuuuccacgccauggggggucgugaggggcucauugacacggcugucaagacugcugagacuggugaggcuuuccucaggggucuuccuugggcuguuagcagggacugcugcaggcugagaaaccccuaacagguggggagcggaaaugcucaggcuccuauucccaggguauaauucuggcccuuguggaaagaauagagucucaagaguaggcaaacacccuuguuuggauugcugugcagcauugcacagugcagggacagagcuuccggggcucugccggccugucccaugggagugguuccugcugggcuuuuuguccgucuagugguagacacugaguuugcauucaaaggccucagacacagagaguacuagcugacucuucugacagucagguagguuaaggccccagccugggucuuugggcuuuaucauccccuuacuucccuccaggauacauccagcggcggcugaucaaguccauggagucagugauggugaaguacgacgcgacugugcggaacuccaucaaccagguggugcagcugcgcuacggcgaagacggccuggcaggcgagagcguugaguuccagaaccuggcuacgcuuaagccuuccaacaaggcuuuugagaagaagugaggaggcgggcaggcgggugguucucgccccuggggcucagggccugaguaguaggauucccauaccuauuccagagagauagccugguaugugucuugcacuagagcuuaccuuucagcauccuuccccaccuaucugaaacagcugugugacaugggggaggugguggauggagguggauuuaagauugguccccacaucgucccugcugauauuauaaagcagaugcagaggggugggccuguacucaggucccaguggcaguccuugggccugaauuuuucucuguccaggauucuugccuccaaaccacuguacuuggucggcugugcaccuuugggaaccuuacagugcguuuuguggggaccaaggucccagagcccaccuguccacuagcuaccccuugcacuuccagguuccgcuuugauuauaccaaugagagggcccugcggcgcacucugcaggaggaccuggugaaggacgugcugagcaacgcacacauccagaacgaguuggagcgggaauuugagcggaugcgggaggaucgggaggugcucagggucaucuucccaacuggagacagcaaggugcgugugggucgaagugcugaugcuagagaugugccucccuggauggcuguccccagacacagcccucccuccauuucccccucucucaggucguccuccccuguaaccugcugcggaugaucuggaaugcucagaaaaucuuccacaucaacccacgccuucccuccgaccugcaccccaucaaagugguggaggguaaguaccugcuuaggggucuccaagccaggcuaggggauaggagacugcugggcccuggucuaaugaucuccucaccuuuaauugguccccaggagucaaggaauugagcaagaagcuggugauugugaauggggaugacccacuaagucgacaggcccaggaaaaugccacgcugcucuucaacauccaccugcgguccacguuguguucccgccgcauggcagaggaguuucggcucaguggggaggccuucgacuggcugcuuggggagauugaguccaaguucaaccaagccauugugaguguugugcucuucacagcagucuucuuuuccuccuuuuaccuguugacuucugugguuuccaagagcagcccacuucuguccacaaccuacagaauagguucuguagguucugucccaccuaauaauagcucucauucauggagagacugcuuguaccuuaccaaguccuguguuuggcccauuaucgcuuuauaccaucauggcuuuaauacacuccuaguaggggaggguuuguuagucccauguugcagagacaaaaacugaggcuuggagagagugacuggauugugugauggucauauaggaaguaaguggcaugacugggauaugacauaggagaauuguucuuuuuuuuuuucucuacacucucugcugugugcagggucuaauuuagauaaagauagggaauuggggcuaggugggguggcucacaccuauaaucccagcacuuugggaggccgaggcaggcagaucacaaggucaggaguucgagaccagccugaccaacauggugaaacaagggugaaauacaaaaauuagccgggcgugguggcgugugccuauaaucccagcuacucaggacgcugaggcaggagaaucgcuugaacacaggaggcagagguugcagugagccaagagugcgccuuugcacuccagccugggcaacagagcaagacuccgucucaaaaagggaguuggagagaguaaauagaaaaaaagauuuauggcuauuggaaugugcuuucacuggcuuuaaggauuuuauaggauaguaagaggguaaagcacuguuacaggcguaccucugaaccuguuuacuguaagucaguuuuuauaaauuaaauaauuaaaaauguauuagggaacaccauagaacauggcugaaagaaauuguaaaagaccuaaaugaggccgggugcaguggcuuaugccuguaaucccagcacuuugggaggccgaggugggcagaucaccugaggucaggaguucaagaccagccuuaccaacaggaagaaaccccaccuuuacuaaaaauacaaaauuagcaggguauaguggcacaugccuguaaucccagcuacucuggaggcugagacaggagaaucaccugaacccggggauggagguugcggugacccgagauugcaccauugcacuccagccugggcaacaagagugagacuguaucaaaaaaaaaaaaaaaaaacccuaaaugaaagaccucucauauucauggauuggaagacuuaauauuguugaauauuaauauuguuaauauacuucccaaaauaagcuauagauccaauauaaucccuaucaaaauuccaacuggcuuuuucucagaaauuuauuaagcugauguuaaaauucauauggaaaugcaagggauauagaauagccaaaacaauauuuaaaaguagcaaaaguuuggagaacucacauuccugauuucacaacuuacuacagagcuacaguaaacaagacugugcuucugucaugaggauacguauaaagacugauagaguagaauugagaguccagaaauaaacccucacauuuauggucacuugauuuuuugcaagagucccaauuuaauuaaauggggugagaauacucuuuuuagcaaauggugcuagggcaacuagauauccacaugcaagagaaugaaguuggauuccuaccucauaccauguacaaaaacucucaaaaugccuaaauugaagagcuaacacuauaaaacucuuauaaggaaacuugaauaaaucuucaugacuguggcuuagcagugaauucuuagguaugacaccaaaagcauaagcauccaaaggaaaaaauagaugaauuggacuucaucaaaauuuaaaacuuaaugcuucguaggacacuaucaagaaaguaaaaagauaacacagagaaugggagaaaauauuuggaaaucaucugauaagggccauacauaaagaauauauaaaggacuauaacaauaaaaagucaacaauaaaaagucucaaaggauuucaacaaauguuuccuggcugggcgugguggcucacgccuguaauccuaacacuuugggaggcugaggcggguggaucaccugagguugggaguuugagaccagccugaucaacauggagaaaccccgucuguacuaaaaauacaaaauuagccgggcaugucggcacaugccuguaaucccaguuacucgggaggcugaggcaggagaaucgcuugaaccugggagguggagguugcgaucagccgagauagugccauugcacuccagcgugggcaacaagagugagacucugucucaaaaauaguaauaaaauaaaaaaacaggcugggcgcaguggcucacgccuguaaucccagcacuuugggaggccgaggcgggcagaucacgaggucaggagauugagaccauccuggcuaagacggugaaaccccgucucuacuaaaaaauacauaaauaaauaaauaaauaauaaaaaaaacauguuuccccaaagaagaguacuauucauguaaaugaucaguaagugcaugaaaagauacucaacaucauuagccaucagggaaaugcaaaugaaaccagagugaugugccacuucacaugcacuaggaugacuguaauccaaaacacagauaauaacaaguguugacaaggauguggaaaaauuagaacccucauacauugcuaguagaaaagguacaacugcuuuaggaaguuaaagcaguuaccauauggcccagcaguuucguuccuagagagauuauacacacacacacgagagaacagaaaacauauggccacacaaacauuuauacacaaauguucguaucaguguuacaguagcuaagcagugaaaacaaguguccauccacugaugaauggauaggcaaaaugugauauguccauaugagggaacaucauucagcaauaaaaaguaaugaacaggcugggccuacgugguggcucacgccuguaaucccagcacuuugggaggccaaggcagguagaugacuugaguuccagaccagcagccugcccaacauggugaaacccccaacucuaccaaaaauagaaaaauuaaguguggugcuacaugcuugcuaucccagcuacuucggaggguaaggcaggaggaucacuugaacccaggcagcagagguugcagugagcugagacugcaccaccgcacuccagccugggcgacagagggagaccaucucaaaaaaaaaaaaguaacggacagccaagcacaguggcugaugucuguaauccuagcacuuugggaggcugaggugggaagauugcuugagcccagaaguucaagaccacccuugggcaacaugacaaaaccccaucucuacaaaaaauuuagccaggugugguggagugcaccuguaaucccagcuacuugggaggcugaggugggaggauaccugaggccaggagguugaagcugcaauagugagcugagaucaugcuacuguacuucagccugggcaacagagugagacucuaucucaaaaaaaaaaaaucugucaagccacaaaaagacagugauaagccagaugcacuggcucauaacucuaaucucaacacuuugggaggccgaggcaggaggcucacgagagcccaggaguuugagaccagccugggcagcauaacgaaauucugucuuugccagugaugaaccuuaaauguauacuugcuuaauggaagaaauuagucugaaaaaguuagauacugugauuccaguuaaguuuaauuucguaugugacuaucucauaacacauacggggagcuuccuauuuagcuaacuguuauaaaaugaauauuuacggaguaauuuuaacauagguuuagaaauuuggaucuuggccgggcgaagaggcccacaccuguaaucccagcacuuugggaggccaaggcggguggaucaccugaggucgggaguuugagaccagccuaaccaacauggugaaaccccgucucuacuaaagauacaaaaaaauauuagcugggugugguggcacgcgucuguaauuccagcuacuugggaggcugaggcaggagaaucgcuugaaccugggaggcagaaguugcagugagccgagaucgugccauugcacuccagccuaggcgacggugagacuccgucucgaaaaaauuuggaucucagaugguauaguagcuuucuuuggaugugcugcauaccaggugccaaauggcguccuauaaauggaagcucuugugugaggaaggggaugaucaaauaagaguuuuguuuuuguuaagagucugucugccuuuuccgaacucaucuacccauguccuuuaagauuacaguccuggcccugugauaagccagaugcagauccacaucguacucauucacugaaagagaggcguuggcuuugucugaugcuagcuuuuucuuaggcgcaucccggggaaauggugggggcucuggcugcgcagucccuuggagaaccugccacccagaugaccuugaauaccuuccacuaugcuggugugucugccaagaaugugacgcugggugugccccgacuuaaggagcucaucaacauuuccaagaagccaaagacuccuucgcuuacugucuuccuguugggccaguccgcucgagaugcugagagagccaagguagggaucaggacugcugggcuuuuuggccggaagaaaagaaggagaacucaacuggguaugguggcucaugucuguaaucccagcacuuugggaggccaaggcagguggaucaccugaggucaggaguucaagacuaaccuggccaagguggugaaaccccaucucuacuaaaaauagaaaaauuagccgggcauggucgugugugccuguaaucccagcugcuaguuggggcugagacaggagaaucgcuugaaccuggggggcagagguugcagugagccgagauugugccacugcacuccagccugggcaacaagagcgagauuccaucugaaagaaaaaaagaaaaaaaaggagaacuuuuccccuugaauaaaggguuuuggauucccuugauaaggaggguuagaagagacguuuagagcuacucaguucccugugucauggacuucugucucuucccaggauauucugugccgucuggagcauacaacguugaggaaggugacugccaacacagccaucuacuaugaccccaacccccagagcacggugguggcagaggaucaggaaugggugaaugucuacuaugaaaugccugacuuugauguggcccgaaucucccccuggcuguugcggguggagcuggaucggaagcacaugacugaccggaagcucaccauggagcagauugcugaaaagaucaaugcugguaagccuaggagggcuggccuggcucaggagccccgcucucugggcuaccaccuaucguguucaccgcacuugagcccccaaagagcuacccacccucacccccaugcauguaccaguuccgccccuccgaggcauccuccaacucuccagguccccucugcacucccuuucucuucugaauguucucccuuccccuuuccaggggguucuaugaaaagaaaguuucugugaggagcggggagccaaaagagagccuugcucagagagagcugcgaguggacaguggcuggggccaguccccuuagcugcagccuuucucauggcuccucaccccaccagguuuuggugacgacuugaacugcaucuuuaaugaugacaaugcagagaagcuggugcuccguauucgcaucaugaacagcgaugagaacaagaugcaagagguaauggggguccuagaagucagcgugucacauguauaaaacgcaugaaucacguuagagaccaaagaaaagaagaugcaaucaacauugaggggcggccaggcgcgguggcucacgccuguaaucccagcacuuugggaggcugaggcggguggaucaccugagcucaggaguucgagaccagccugaccaacauggaguaaccccgucucuacuaaaaauaaaaauuagccgggcauggugguaugugccuguaauccuagcuacuugggaggcugaggcaacaagagugaaacuaucucaaaaaauaaaaaaaacauugaggggccagucauacccaccuaauuuagggauagggaauggugauuagcaacgauuuucaaaauccacagcaccggccgaguagauaaaacaggugguguugaaauaggagauaggagugccucccugucacgcugucacuuggcucuccucccccaaggcuccugcagcuugcuuugcuuagggaauacaagccccaccccugaggcaggggccagacuugggggcagguugggcaguaggcauugcuauguccuaggggaagucgugugacagccauaacaagacccaugaaaaggcuggaucagugacuucacuccugggcauggcuccugagauacuuguuuggcacauguugguaccuggugcuuuaguaauaaaaacugaagaacucaggcugggcaugguggcucacacuuguaaucccagcacuuugggaggccaaggcgggcagauuaccugaggucgggaguucgagaccagccugaccgacauggagaaaccccgucucuacuaaaaauacaaaaugagccgggcgugguggcgcaugccuguaaucucaguuacucaggaggcugaggcaggagaaaugcuugaacaugggaggcagagguuguggugaggcaagaucacaccauugcacuccagccugggcaauaagcgaaacuccaucucuaaaaaaacaaaaacaaaaaacugaagaacucacuaacugcugaacugcugucagagaacaguuauaaaagcauugauaggucuugauggaauacaguauauggccauuagaagugaucacugucaugccagcagcagccuagaugaacacacagugaagugccagagcagggaauggugugugcucggguacagcaguugggaggauaugacauguacguggagcccgccucucgcuaggcgcaggacugcacaagaguggaaguugugacgggguggugggauuugggugccuuuccuuaggcuucuuuuaauauuguaaaaucaggauuaaaagucucacuggagaauugcaggaacaugggagguagagguugcagugagcugagaucguggcauugcacuccagcccaggcugauaacagcgagacuccaccucaaaaaaaaaaaaaaaaaagucucacuggaacugugaggggcagagccuggugacugacucguuuggcccucaaagaggcuguaguuggaggcgagagcuggggaagagaccagaggaugccaagugcugaccucacucucacugcaggaggaagaggugguggacaagauggaugaugaugucuuccugcgcugcaucgaguccaacaugcugacagauaugacccugcagggcaucgagcagaucagcaaggucagccauccccucugccaccgccuuccuccucccacucccacacuccccucccugccuacucugagcacgcugucuucccacagguguacaugcacuugccacagacagacaacaagaagaagaucaucaucacggaggauggggaauucaaggcccugcaggaguggauccuggagacggacggcgugagcuugaugcgggugcugagugagaaggacguggaccccguacgcaccacguccaaugacauuguggagaucuucacggugagcccgugugugcugccuagcugccuuucguggaucucuggcucucaggccccucauucugugcuguccacucaggacuuuuucugccugauuccauuucugagugugggauauccuggcuccugacacccucccuggaucuggguggcgacagaagcagggaagagagcagaguugcucaguccuggcccuccccuccacuucccuccccugugccaggugcugggcauugaagccgugcggaaggcccuggagcgggagcuguaccacgucaucuccuuugauggcuccuaugucaauuaccgacacuuggcucucuugugugauaccaugaccugucguggccacuugauggccaucacccgacacggagucaaccgccaggacacaggaccacucaugaaguguuccuuugaggaaacgguaacaguggaauuucugaauagggcagaaggagggaguagugugagaagaagggcacacacuuugggcagcugggcuguggugaugggacagucaggugcuguguguggaggggucucauggggccggucugcucuguucagguggacgugcuuauggaagcagccgcacacggugagagugaccccaugaagggggucucugagaauaucaugcugggccagcuggcuccggccggcacuggcugcuuugaccuccugcuugaugcagagaagugcaaguauggcauggagauccccaccaauauccccggccugggggcugcuggacgugaguaugaggccccagcugcgguaccugcuugcgucggcgaggcgggggggcaggccaugggugcaagggugucaccaguccaugauugcuguucuugcuccucacgauuuccuguguuccucuuugcagccaccggcauguucuuugguucagcacccagucccauggguggaaucucuccugccaugacaccuuggaaccagggugcaaccccugccuauggcgccuggucccccaguguuggugaguaaccugauccaggaagagggcccuccaggugguucagagguggauaagcugggaucgugaacgguagccauuguuggaacucugaaggccgcagagggcuagugaaagguggggcagggagaauugggggccuuuggucucccgcucuggccuuaacuugcuucucucacucuauagggaguggaaugaccccaggggcagccggcuucucucccagugcugcgucagaugccagcggcuucagcccagguuacuccccugccuggucucccacaccgggcuccccgggguccccaggucccucaagccccuacaucccuucaccaggugaguugucgccaucugucaggccagguuuguuuccuccacaguucugggugagucuguccauugcucaucuccuuuguuggcugcuuccccacagguggugccaugucucccagcuacucgccaacgucaccugccuacgagccccgcucuccugggggcuacacaccccagagucccucuuauucccccacuucacccuccuacuccccuaccucuccauccuauucuccaaccagucccaacuauagucccacaucacccagcuauucgccaacgucacccagcuacucaccgaccucucccagcuacucacccaccucucccagcuacucgcccaccucucccagcuacucgcccaccucucccagcuacucacccacuuccccuagcuacucgcccacuuccccuagcuacucgccaacgucucccagcuacucaccgacaucucccagcuacucgccaacuucacccagcuauucucccacuucucccagcuacucaccuaccucuccaagcuauucacccaccucccccagcuacucacccacuuccccaaguuacucacccaccagcccgaacuauucuccaaccagucccaauuacaccccaacaucacccagcuacagcccgacaucacccagcuauucaccuacuagucccaacuacacaccuaccagcccuaacuacagcccaaccucuccaagcuacucuccaacaucacccagcuauuccccgaccucaccaaguuacuccccuuccagcccacgauacacaccacagucuccaaccuauaccccaagcucacccagcuacagccccagcucgcccagcuacagcccagccucacccaaguacaccccaaccaguccuucuuacagucccagcuccccagaguauaccccaaccucucccaaguacucaccuaccagucccaaauauucacccaccucucccaaguacucgccuaccagucccaccuauucacccaccaccccaaaauacuccccaacaucuccuacuuauuccccaaccucuccagucuacaccccaaccucucccaaguacucaccuacuagccccacuuacucgcccacuucccccaaguacucgcccaccagccccaccuacucgcccaccucccccaaaggcucaaccuacucucccacuuccccugguuacucgcccaccagccccaccuacagucucacaagcccggcuaucagcccggaugacagugacgaggagaacugagggcacguggggugcggcagcgggcuagggcccagggcagcuugcccgugcugcugugcaguucuugccucccucacggggcgucacccccagcccagcuccguuguacauaaaugccuuguggcagagcucccggugaacuucuggaucccguuucugaugcagacucuugucuuguucuccacuugugcuguuagaacucacuggcccagugguguucucacuccuaccccacccacccccugccuguccccaaauugaagauccuuccuugccuguggcuugaugcggggcggguaaaggguauuuuaacuuagggguaguuccugcugugagugguuacagcugauccucgggaagaacaaagcuaaagcugccuuuugucuguuauuuuauuuuuuugaaguuuaaauaaaguuuacuaauuuugaccaaaa

SEQ ID NO: 16647 - RNA, 12962 nt, Homo sapiens
gcucagaaaucccugucugaauacaauaacuucaagucuauggucguguccggagcuaaagguuccaagauuaacaucucccaggugagaagccuuguuuuuccauauacggggccgcugugaaguuugggaggaggaaggaagguguuuguauguauuagggucaggagaaucacgggaguugggggaaauuuugggaacuguuauucuuaaggcagagggaauucaguauacaccaccuuucuguuucccaggucauugcugucguuggacagcagaacgucgagggcaagcggauuccauuuggcuucaagcaccggacucugccucacuucaucaaggaugacuacgggccugagagccguggcuuuguggagaacuccuaccuagccggccucacacccacugaguucuuuuuccacgccauggggggucgugaggggcucauugacacggcugucaagacugcugagacuggugaggcuuuccucaggggucuuccuugggcuguuagcagggacugcugcaggcugagaaaccccuaacagguggggagcggaaaugcucaggcuccuauucccaggguauaauucuggcccuuguggaaagaauagagucucaagaguaggcaaacacccuuguuuggauugcugugcagcauugcacagugcagggacagagcuuccggggcucugccggccugucccaugggagugguuccugcugggcuuuuuguccgucuagugguagacacugaguuugcauucaaaggccucagacacagagaguacuagcugacucuucugacagucagguagguuaaggccccagccugggucuuugggcuuuaucauccccuuacuucccuccaggauacauccagcggcggcugaucaaguccauggagucagugauggugaaguacgacgcgacugugcggaacuccaucaaccagguggugcagcugcgcuacggcgaagacggccuggcaggcgagagcguugaguuccagaaccuggcuacgcuuaagccuuccaacaaggcuuuugagaagaagugaggaggcgggcaggcgggugguucucgccccuggggcucagggccugaguaguaggauucccauaccuauuccagagagauagccugguaugugucuugcacuagagcuuaccuuucagcauccuuccccaccuaucugaaacagcugugugacaugggggaggugguggauggagguggauuuaagauugguccccacaucgucccugcugauauuauaaagcagaugcagaggggugggccuguacucaggucccaguggcaguccuugggccugaauuuuucucuguccaggauucuugccuccaaaccacuguacuuggucggcugugcaccuuugggaaccuuacagugcguuuuguggggaccaaggucccagagcccaccuguccacuagcuaccccuugcacuuccagguuccgcuuugauuauaccaaugagagggcccugcggcgcacucugcaggaggaccuggugaaggacgugcugagcaacgcacacauccagaacgaguuggagcgggaauuugagcggaugcgggaggaucgggaggugcucagggucaucuucccaacuggagacagcaaggugcgugugggucgaagugcugaugcuagagaugugccucccuggauggcuguccccagacacagcccucccuccauuucccccucucucaggucguccuccccuguaaccugcugcggaugaucuggaaugcucagaaaaucuuccacaucaacccacgccuucccuccgaccugcaccccaucaaagugguggaggguaaguaccugcuuaggggucuccaagccaggcuaggggauaggagacugcugggcccuggucuaaugaucuccucaccuuuaauugguccccaggagucaaggaauugagcaagaagcuggugauugugaauggggaugacccacuaagucgacaggcccaggaaaaugccacgcugcucuucaacauccaccugcgguccacguuguguucccgccgcauggcagaggaguuucggcucaguggggaggccuucgacuggcugcuuggggagauugaguccaaguucaaccaagccauugugaguguugugcucuucacagcagucuucuuuuccuccuuuuaccuguugacuucugugguuuccaagagcagcccacuucuguccacaaccuacagaauagguucuguagguucugucccaccuaauaauagcucucauucauggagagacugcuuguaccuuaccaaguccuguguuuggcccauuaucgcuuuauaccaucauggcuuuaauacacuccuaguaggggaggguuuguuagucccauguugcagagacaaaaacugaggcuuggagagagugacuggauugugugauggucauauaggaaguaaguggcaugacugggauaugacauaggagaauuguucuuuuuuuuuuucucuacacucucugcugugugcagggucuaauuuagauaaagauagggaauuggggcuaggugggguggcucacaccuauaaucccagcacuuugggaggccgaggcaggcagaucacaaggucaggaguucgagaccagccugaccaacauggugaaacaagggugaaauacaaaaauuagccgggcgugguggcgugugccuauaaucccagcuacucaggacgcugaggcaggagaaucgcuugaacacaggaggcagagguugcagugagccaagagugcgccuuugcacuccagccugggcaacagagcaagacuccgucucaaaaagggaguuggagagaguaaauagaaaaaaagauuuauggcuauuggaaugugcuuucacuggcuuuaaggauuuuauaggauaguaagaggguaaagcacuguuacaggcguaccucugaaccuguuuacuguaagucaguuuuuauaaauuaaauaauuaaaaauguauuagggaacaccauagaacauggcugaaagaaauuguaaaagaccuaaaugaggccgggugcaguggcuuaugccuguaaucccagcacuuugggaggccgaggugggcagaucaccugaggucaggaguucaagaccagccuuaccaacaggaagaaaccccaccuuuacuaaaaauacaaaauuagcaggguauaguggcacaugccuguaaucccagcuacucuggaggcugagacaggagaaucaccugaacccggggauggagguugcggugacccgagauugcaccauugcacuccagccugggcaacaagagugagacuguaucaaaaaaaaaaaaaaaaaacccuaaaugaaagaccucucauauucauggauuggaagacuuaauauuguugaauauuaauauuguuaauauacuucccaaaauaagcuauagauccaauauaaucccuaucaaaauuccaacuggcuuuuucucagaaauuuauuaagcugauguuaaaauucauauggaaaugcaagggauauagaauagccaaaacaauauuuaaaaguagcaaaaguuuggagaacucacauuccugauuucacaacuuacuacagagcuacaguaaacaagacugugcuucugucaugaggauacguauaaagacugauagaguagaauugagaguccagaaauaaacccucacauuuauggucacuugauuuuuugcaagagucccaauuuaauuaaauggggugagaauacucuuuuuagcaaauggugcuagggcaacuagauauccacaugcaagagaaugaaguuggauuccuaccucauaccauguacaaaaacucucaaaaugccuaaauugaagagcuaacacuauaaaacucuuauaaggaaacuugaauaaaucuucaugacuguggcuuagcagugaauucuuagguaugacaccaaaagcauaagcauccaaaggaaaaaauagaugaauuggacuucaucaaaauuuaaaacuuaaugcuucguaggacacuaucaagaaaguaaaaagauaacacagagaaugggagaaaauauuuggaaaucaucugauaagggccauacauaaagaauauauaaaggacuauaacaauaaaaagucaacaauaaaaagucucaaaggauuucaacaaauguuuccuggcugggcgugguggcucacgccuguaauccuaacacuuugggaggcugaggcggguggaucaccugagguugggaguuugagaccagccugaucaacauggagaaaccccgucuguacuaaaaauacaaaauuagccgggcaugucggcacaugccuguaaucccaguuacucgggaggcugaggcaggagaaucgcuugaaccugggagguggagguugcgaucagccgagauagugccauugcacuccagcgugggcaacaagagugagacucugucucaaaaauaguaauaaaauaaaaaaacaggcugggcgcaguggcucacgccuguaaucccagcacuuugggaggccgaggcgggcagaucacgaggucaggagauugagaccauccuggcuaagacggugaaaccccgucucuacuaaaaaauacauaaauaaauaaauaaauaauaaaaaaaacauguuuccccaaagaagaguacuauucauguaaaugaucaguaagugcaugaaaagauacucaacaucauuagccaucagggaaaugcaaaugaaaccagagugaugugccacuucacaugcacuaggaugacuguaauccaaaacacagauaauaacaaguguugacaaggauguggaaaaauuagaacccucauacauugcuaguagaaaagguacaacugcuuuaggaaguuaaagcaguuaccauauggcccagcaguuucguuccuagagagauuauacacacacacacgagagaacagaaaacauauggccacacaaacauuuauacacaaauguucguaucaguguuacaguagcuaagcagugaaaacaaguguccauccacugaugaauggauaggcaaaaugugauauguccauaugagggaacaucauucagcaauaaaaaguaaugaacaggcugggccuacgugguggcucacgccuguaaucccagcacuuugggaggccaaggcagguagaugacuugaguuccagaccagcagccugcccaacauggugaaacccccaacucuaccaaaaauagaaaaauuaaguguggugcuacaugcuugcuaucccagcuacuucggaggguaaggcaggaggaucacuugaacccaggcagcagagguugcagugagcugagacugcaccaccgcacuccagccugggcgacagagggagaccaucucaaaaaaaaaaaaguaacggacagccaagcacaguggcugaugucuguaauccuagcacuuugggaggcugaggugggaagauugcuugagcccagaaguucaagaccacccuugggcaacaugacaaaaccccaucucuacaaaaaauuuagccaggugugguggagugcaccuguaaucccagcuacuugggaggcugaggugggaggauaccugaggccaggagguugaagcugcaauagugagcugagaucaugcuacuguacuucagccugggcaacagagugagacucuaucucaaaaaaaaaaaaucugucaagccacaaaaagacagugauaagccagaugcacuggcucauaacucuaaucucaacacuuugggaggccgaggcaggaggcucacgagagcccaggaguuugagaccagccugggcagcauaacgaaauucugucuuugccagugaugaaccuuaaauguauacuugcuuaauggaagaaauuagucugaaaaaguuagauacugugauuccaguuaaguuuaauuucguaugugacuaucucauaacacauacggggagcuuccuauuuagcuaacuguuauaaaaugaauauuuacggaguaauuuuaacauagguuuagaaauuuggaucuuggccgggcgaagaggcccacaccuguaaucccagcacuuugggaggccaaggcggguggaucaccugaggucgggaguuugagaccagccuaaccaacauggugaaaccccgucucuacuaaagauacaaaaaaauauuagcugggugugguggcacgcgucuguaauuccagcuacuugggaggcugaggcaggagaaucgcuugaaccugggaggcagaaguugcagugagccgagaucgugccauugcacuccagccuaggcgacggugagacuccgucucgaaaaaauuuggaucucagaugguauaguagcuuucuuuggaugugcugcauaccaggugccaaauggcguccuauaaauggaagcucuugugugaggaaggggaugaucaaauaagaguuuuguuuuuguuaagagucugucugccuuuuccgaacucaucuacccauguccuuuaagauuacaguccuggcccugugauaagccagaugcagauccacaucguacucauucacugaaagagaggcguuggcuuugucugaugcuagcuuuuucuuaggcgcaucccggggaaauggugggggcucuggcugcgcagucccuuggagaaccugccacccagaugaccuugaauaccuuccacuaugcuggugugucugccaagaaugugacgcugggugugccccgacuuaaggagcucaucaacauuuccaagaagccaaagacuccuucgcuuacugucuuccuguugggccaguccgcucgagaugcugagagagccaagguagggaucaggacugcugggcuuuuuggccggaagaaaagaaggagaacucaacuggguaugguggcucaugucuguaaucccagcacuuugggaggccaaggcagguggaucaccugaggucaggaguucaagacuaaccuggccaagguggugaaaccccaucucuacuaaaaauagaaaaauuagccgggcauggucgugugugccuguaaucccagcugcuaguuggggcugagacaggagaaucgcuugaaccuggggggcagagguugcagugagccgagauugugccacugcacuccagccugggcaacaagagcgagauuccaucugaaagaaaaaaagaaaaaaaaggagaacuuuuccccuugaauaaaggguuuuggauucccuugauaaggaggguuagaagagacguuuagagcuacucaguucccugugucauggacuucugucucuucccaggauauucugugccgucuggagcauacaacguugaggaaggugacugccaacacagccaucuacuaugaccccaacccccagagcacggugguggcagaggaucaggaaugggugaaugucuacuaugaaaugccugacuuugauguggcccgaaucucccccuggcuguugcggguggagcuggaucggaagcacaugacugaccggaagcucaccauggagcagauugcugaaaagaucaaugcugguaagccuaggagggcuggccuggcucaggagccccgcucucugggcuaccaccuaucguguucaccgcacuugagcccccaaagagcuacccacccucacccccaugcauguaccaguuccgccccuccgaggcauccuccaacucuccagguccccucugcacucccuuucucuucugaauguucucccuuccccuuuccaggggguucuaugaaaagaaaguuucugugaggagcggggagccaaaagagagccuugcucagagagagcugcgaguggacaguggcuggggccaguccccuuagcugcagccuuucucauggcuccucaccccaccagguuuuggugacgacuugaacugcaucuuuaaugaugacaaugcagagaagcuggugcuccguauucgcaucaugaacagcgaugagaacaagaugcaagagguaauggggguccuagaagucagcgugucacauguauaaaacgcaugaaucacguuagagaccaaagaaaagaagaugcaaucaacauugaggggcggccaggcgcgguggcucacgccuguaaucccagcacuuugggaggcugaggcggguggaucaccugagcucaggaguucgagaccagccugaccaacauggaguaaccccgucucuacuaaaaauaaaaauuagccgggcauggugguaugugccuguaauccuagcuacuugggaggcugaggcaacaagagugaaacuaucucaaaaaauaaaaaaaacauugaggggccagucauacccaccuaauuuagggauagggaauggugauuagcaacgauuuucaaaauccacagcaccggccgaguagauaaaacaggugguguugaaauaggagauaggagugccucccugucacgcugucacuuggcucuccucccccaaggcuccugcagcuugcuuugcuuagggaauacaagccccaccccugaggcaggggccagacuugggggcagguugggcaguaggcauugcuauguccuaggggaagucgugugacagccauaacaagacccaugaaaaggcuggaucagugacuucacuccugggcauggcuccugagauacuuguuuggcacauguugguaccuggugcuuuaguaauaaaaacugaagaacucaggcugggcaugguggcucacacuuguaaucccagcacuuugggaggccaaggcgggcagauuaccugaggucgggaguucgagaccagccugaccgacauggagaaaccccgucucuacuaaaaauacaaaaugagccgggcgugguggcgcaugccuguaaucucaguuacucaggaggcugaggcaggagaaaugcuugaacaugggaggcagagguuguggugaggcaagaucacaccauugcacuccagccugggcaauaagcgaaacuccaucucuaaaaaaacaaaaacaaaaaacugaagaacucacuaacugcugaacugcugucagagaacaguuauaaaagcauugauaggucuugauggaauacaguauauggccauuagaagugaucacugucaugccagcagcagccuagaugaacacacagugaagugccagagcagggaauggugugugcucggguacagcaguugggaggauaugacauguacguggagcccgccucucgcuaggcgcaggacugcacaagaguggaaguugugacgggguggugggauuugggugccuuuccuuaggcuucuuuuaauauuguaaaaucaggauuaaaagucucacuggagaauugcaggaacaugggagguagagguugcagugagcugagaucguggcauugcacuccagcccaggcugauaacagcgagacuccaccucaaaaaaaaaaaaaaaaaagucucacuggaacugugaggggcagagccuggugacugacucguuuggcccucaaagaggcuguaguuggaggcgagagcuggggaagagaccagaggaugccaagugcugaccucacucucacugcaggaggaagaggugguggacaagauggaugaugaugucuuccugcgcugcaucgaguccaacaugcugacagauaugacccugcagggcaucgagcagaucagcaaggucagccauccccucugccaccgccuuccuccucccacucccacacuccccucccugccuacucugagcacgcugucuucccacagguguacaugcacuugccacagacagacaacaagaagaagaucaucaucacggaggauggggaauucaaggcccugcaggaguggauccuggagacggacggcgugagcuugaugcgggugcugagugagaaggacguggaccccguacgcaccacguccaaugacauuguggagaucuucacggugagcccgugugugcugccuagcugccuuucguggaucucuggcucucaggccccucauucugugcuguccacucaggacuuuuucugccugauuccauuucugagugugggauauccuggcuccugacacccucccuggaucuggguggcgacagaagcagggaagagagcagaguugcucaguccuggcccuccccuccacuucccuccccugugccaggugcugggcauugaagccgugcggaaggcccuggagcgggagcuguaccacgucaucuccuuugauggcuccuaugucaauuaccgacacuuggcucucuugugugauaccaugaccugucguggccacuugauggccaucacccgacacggagucaaccgccaggacacaggaccacucaugaaguguuccuuugaggaaacgguaacaguggaauuucugaauagggcagaaggagggaguagugugagaagaagggcacacacuuugggcagcugggcuguggugaugggacagucaggugcuguguguggaggggucucauggggccggucugcucuguucagguggacgugcuuauggaagcagccgcacacggugagagugaccccaugaagggggucucugagaauaucaugcugggccagcuggcuccggccggcacuggcugcuuugaccuccugcuugaugcagagaagugcaaguauggcauggagauccccaccaauauccccggccugggggcugcuggacgugaguaugaggccccagcugcgguaccugcuugcgucggcgaggcgggggggcaggccaugggugcaagggugucaccaguccaugauugcuguucuugcuccucacgauuuccuguguuccucuuugcagccaccggcauguucuuugguucagcacccagucccauggguggaaucucuccugccaugacaccuuggaaccagggugcaaccccugccuauggcgccuggucccccaguguuggugaguaaccugauccaggaagagggcccuccaggugguucagagguggauaagcugggaucgugaacgguagccauuguuggaacucugaaggccgcagagggcuagugaaagguggggcagggagaauugggggccuuuggucucccgcucuggccuuaacuugcuucucucacucuauagggaguggaaugaccccaggggcagccggcuucucucccagugcugcgucagaugccagcggcuucagcccagguuacuccccugccuggucucccacaccgggcuccccgggguccccaggucccucaagccccuacaucccuucaccaggugaguugucgccaucugucaggccagguuuguuuccuccacaguucugggugagucuguccauugcucaucuccuuuguuggcugcuuccccacagguggugccaugucucccagcuacucgccaacgucaccugccuacgagccccgcucuccugggggcuacacaccccagagucccucuuauucccccacuucacccuccuacuccccuaccucuccauccuauucuccaaccagucccaacuauagucccacaucacccagcuauucgccaacgucacccagcuacucaccgaccucucccagcuacucacccaccucucccagcuacucgcccaccucucccagcuacucgcccaccucucccagcuacucacccacuuccccuagcuacucgcccacuuccccuagcuacucgccaacgucucccagcuacucaccgacaucucccagcuacucgccaacuucacccagcuauucucccacuucucccagcuacucaccuaccucuccaagcuauucacccaccucccccagcuacucacccacuuccccaaguuacucacccaccagcccgaacuauucuccaaccagucccaauuacaccccaacaucacccagcuacagcccgacaucacccagcuauucaccuacuagucccaacuacacaccuaccagcccuaacuacagcccaaccucuccaagcuacucuccaacaucacccagcuauuccccgaccucaccaaguuacuccccuuccagcccacgauacacaccacagucuccaaccuauaccccaagcucacccagcuacagccccagcucgcccagcuacagcccagccucacccaaguacaccccaaccaguccuucuuacagucccagcuccccagaguauaccccaaccucucccaaguacucaccuaccagucccaaauauucacccaccucucccaaguacucgccuaccagucccaccuauucacccaccaccccaaaauacuccccaacaucuccuacuuauuccccaaccucuccagucuacaccccaaccucucccaaguacucaccuacuagccccacuuacucgcccacuucccccaaguacucgcccaccagccccaccuacucgcccaccucccccaaaggcucaaccuacucucccacuuccccugguuacucgcccaccagccccaccuacagucucacaagcccggcuaucagcccggaugacagugacgaggagaacugagggcacguggggugcggcagcgggcuagggcccagggcagcuugcccgugcugcugugcaguucuugccucccucacggggcgucacccccagcccagcuccguuguacauaaaugccuuguggcagagcucccggugaacuucuggaucccguuucugaugcagacucuugucuuguucuccacuugugcuguuagaacucacuggcccagugguguucucacuccuaccccacccacccccugccuguccccaaauugaagauccuuccuugccuguggcuugaugcggggcggguaaaggguauuuuaacuuagggguaguuccugcugugagugguuacagcugauccucgggaagaacaaagcuaaagcugccuuuugucuguuauuuuauuuuuuugaaguuuaaauaaaguuuacuaauuuug

SEQ ID NO: 16648 - RNA, 1742 nt, Homo sapiens
cacaccaguucuuuuccagucacuucuccucccauguuugucuucagucuuugccucuauuuaucccugucccucccaacccccgggcucccaaguucuaucucacuccuccaccuucccuucccucucacagcugagguuccaggcugugaugauggcaaugcugcccagcacaaccccugcccccacgaugucagaaggugccacagucucauggagcauauaauacugcaguauaagggccaccaccaccucggaaugcaggacagcgcacaccagggcagggugggccuuggugaccgcauagcucacacaugugaaggagaccaaggcgaggauccccacugcccccacacaacuccaacucgggagaucacugggcaacacggggggcugcagcacaaagaggccuggcacagagcccagcagccccaccaagccagauaggaaggccacuguugggaggcaggagggaaagugcagagaacgauagaccagaagccccagggacagcgccaguccucccacgaaagccugcccauagcccagggcgguguagacacccgugauccccuccuguaguguccagaguccaggucccacaaugaugauuaguccuaggaugcugcccaacaguccacaccagucguagccacugagacccuggcucucaaggcagagggugaggacggcggagcagacgguggaagaaccuuugcgaacaguggcagcguugccagcgggcaccaccugaaccgcacuguaggcacauccaaugcugaggacguugagcagggcauagaaguaggcccggccucggaugucaggaggucccagaagggggucgccacgcaguuuaaguagcagggcaauagggagguggaagaggcaucgacagaugagcagcuccagcgagggcagguuggaagccugguaagccauaugagaaagggggcccacgaagccagcaggcaggcccccacccagcagggccaccagcaggccauugguggcaucagagggcuggcagcacuggugccagcggaggcuggguggagcggagggcggcgauggguguguggagucaggcggguucaaguaggggugacugccagccuguuagggagaaaggagcucaggguagacagcagccgcagcccaggcgaccuggggcagggcagaugccaggauggggucugggacccugugggacuguacaguguugggcuaucuugcugaggaacucuucggagcuagaaagggccuaaaagaugagugagauguuauaaugugggccuggagcaggaagcaaggagugagcaguccuggagcaucguuucccuggguaaguuguuccugggaggagaaaaaggacccaggaugcucucucggauugaggaaggggaggaagccucagaugcuaugcaucuguaugaugccacagguuccagagacaucuggguacaccauuaugaauucuauuuguggguaucucugagacagcuaaguuuuaggaaaggaggggaaauggagcaaccaggagcuauagggagggaguacuaggccccuggcccccacacucaccaucuuuccuuggacuuucuccucuccuccuggcucagggagccugggccccucagagcuccagccauugugacaugguuggagugggggugggguucuucccuggaacucuccugaggugguagcacgccuauuuucccgcugaguccaacucugcu

SEQ ID NO: 16649 - RNA, 5419 nt, Homo sapiens
cuucaguuguauaaaucgucuuuaauugagaaagcuggaguggagacccgauccccugggagcagugccaggaguuggguggagacugagugggguuugugugggugagggggcaucuacuccucuugcaacaagccagaaguagaacagccuaaggaaaagugaccugccuuggagccuuagucccucccuuagggcccccucagccuacccuauccaagucugaggcuauggaagucucccuccuaguucacuagcagguuccccaucuuuuccaggcugccccuagcacuccacguuuuucugaaaaaaucuagacaggcccuuuuuggguaccuaaaacccagcugagguugugagcuguaagguaaagcaaguucuauccaauuagaagcuguuggggcguaugaggucuggagugcaagaggccuucacccuucuuggccugaccuguaggggagaagggugagacuuauugcugaauuggggucuccucacugggagggucaaggcuguauccauuuguccuuuuuauuaaggacauauuacucuaaggaccucagcuuuaaaggggaccuggaaggaauuccugcugagguagcuaaguauucauguccacccaacacagaugcagguucagucaugccauaauuuugaccccucccccaucccagcuucccuacuaugagccagggauccuuccaaaauuccucugcccuucuccagacucugucucccuggcacgaccucagcuggguugaaggagcuagaaacugcauguaaaaauaagcuuagcauucuauauggaagaaucauauuuuuagagaauuaucuaggaaaaacaagaaaugguucuugauucauccagaaguguuuuuaugaaucauagcugggucuuuuccagaacucauccguaauagguaucacucaagaaggcgggaggguggggcuagaacuuacuuagaacaauaauauggcuauacaggccccagcuccauccuggguaaaagggcugagagucaugaucuauguccuagagcuaggauucagggggaaguacggcuccauaaagcucuagaauugggugucucugggauaagaagguuaaacccguggucaucugagacugguuccgguucaggccaaagccaacagcuagacaaggcccaaaucuagccucuuucuacuuggaaaccagggguccaucugagucaaugacagaggccugacagauccagagaaaaggcuggcagcaugccuggguuccagcacagagcccuagugcagaaguggcccuggcgaggguguccaguguuccagaauguguccagaccaagguagaagguagaguagggaaagaaggacacaugaauccugagcuccagugaaucuagaaauggcucaguggcaaugaaaaggggcacaggacuccaggaacuggcugagccggggugggaaguguuuaugcccuggcuguccaugugggaacucccagcgccaucucaggaaaaggcauggcguugugugaguguggaaagaaagaagugaucagccaggaccaucuucagacaucccccucucugacucccuccuaggcccaaagaucuaagggucucagcagccucggaagucacagucagccccuaggcucccucaggguagagcaccuagugggaccuggcugcucagggcauguguguggcagcaggggugagagcaggacugggagacagguuguggugguggcuggcucacugggagugcagggaaccuccaguccagggacuacauuucagggggcagggggacuggaaggggaggccucggggacacuguggagagaaggcuccugguacauggccacugugaaggggagaaagagaggagcagggaaggagaguuaggcacagagggacccaggcagaaccagugcuccaaaagggcucccuucccguacauucacccuccaagaaccccaaccccacaggaggaccgcacccaaacccccaaagggcaaagccuuccuggcuugaucugucacaaaggguccucuuaucacuuguagccugagcugucugccccuaaauguccauaucaaggucaauacccucuccuguggcccacauuuucuugagucuauacccacccuccaggagcuugggcagaaagugggcagcugccuuggucuucuuaacucgguuucccuucaugaccuggcccuccuuguccaggccgagguaccaggcccggccagaacgacgcuggcgguagagagcagaggcguacaggacguaguaauucucaaagacacacuccuuaaagcgacacucagcugugaaaugcggcuaaggagacaaagacccagaaaggcgcacaaagacagagagauaaaaagacacaucacugggcagaaaggagcucauggaaagcacaaauccuuuuugggggagggggaggacaacuucugaguccauguaggaccugggagcaaagggaggacaaggaagagggcugagggcuaagaacuaggcucugggccaagcacaguggcucaugccuauaaucccaacacuuugggaggccgaggcggguggaucaccugaggucaggaguuccagaccagccuggccaacauagcaagacccugucacuauuuaaaaaaaaaaaaaagaacuagacuuuuaggggucuugcaauaagauuccuucucuccacuguacucccagucucucacuauccccuauccuggaugacucuagggaagugaguaaugacaaaaucuggaggaggugggauaagaaguaggggcccuaaaaggcagaaagaguuggacauucaaagaaccuggggcuguuuugggggugugcaaggaguggggacuggagagacccuagaggagcuggucuggaaugggcagcgaugacaggccaucagcaaagcuggagggaggagucccgggcaaaaugucuguaguugaggaagguugucauucccucaagggacaaauugaggaaggggaguccccaguauuucccggccacucagccucauugucucaccgaacuguagagcagucccucagcauucauggccauguagugacccagcuuggcgcucuggauggugaccacacggaggcccacagggaucagguugaagugggcugcagguggagagagggagcaucaauacccaggccucugacccucaccugagcuccccucaucccagcuccacuuuuucccuuagaggucaggaagacggaucaauggcaacagaagcugaagagggaauaggauugucaucuccuguccccauucucccccuucccacccugcagccagcuuccccucucacugaaggagcugguauccucuggggugcccuggaugcuuccgucgggauucgccuggagguagaaacccuggcggcagaacaguuuggugacgaugccuuugagcugaggcucuggagagagagacauucaucuuugaaaaugacaucuccguucccagaaacauuccuacacuuggcaggauuagagggaagaaaggagaaugaaaggaaggaagagggucccagggccccagcucucuuauccuccaagcacgcucucucccaccucucuuucacuccugggaaagcuggugugggucccuucuguuuccuauaaccaggagcuuucaguguaauuuauugaaauuuauuuaaauggcuuaauuccuacccuacagcucaaccagaagggggaaggagugggggaggagggaggggagagauauaucaaaaggcagggacagagggagaccagcagggguacugaaggggcagcguguuugcgaaggugggggaucuuggcagcagcaaauugaccacaggguaggggcucucccucaggagugggggugggacugggccugacgcugacucagcaccugcugcggcugccgcuagcuuggcgagagccuugccuuggcccagcgccggccugucugacacugacccaucugucugucugucugucugucugucaguccgcuggcucccgggggcccaguucucccugaggcucagccucuccccuucggccagguaacucgccugggguaagggggaccuuaccaaggauauggggggugggagcugaggagauggagaggcaggcugagucacgugggggcccgguccuacucagagggugggcugcggauuguaccacuaugggcagccgguggcgcggggaggagggcgcgagguggcuacccuuaggggagcugggagcgggcgggagcagggccagagggacucccugacugucguacauggacggggaccaauucuaacucucacaacucuccucccccaucgcuugcucucugccgacuucccuguccccccuuguaggugguacgacccccgagucggcgcccaucucuagccgugaacugugucugaguuccugccagcguaggguccccugagccuacgggacccgauuucggaguggcgcggggguuaugggaggggugcccagcuccguucuugaagcgcaggucacaggaggagggcgcauagagggcuggcuggcgagguagcugcaaggacacccgagggagagcuggggagauuggcucggagccagcagagcucgaccaggaggaaccgagcccaggcguggaggagcgggagaaccggggcaggcgggggcugggggggggcgugcggcuggagcugcagaaauccuuggggugacccaggcaucuggaaacccccgggccccuccgcuccagauugaaagaaucgcgagaaccggcacguaggcggaggacgauggggguggggacugcuguguugggaaggggggacgagcaggaacuacgaggcuuucggggcgccaggcagccccucaagccuuccccuugaccucgaaaauaaggagacuccggguuauggacaaaagagaagggaaacugaggcacagucuggcagggacuuugucguccuggcccacccccuuccacuuucggggagccccucagccgggcccuauucuucagagucccuggccucaaucucccaggcagagaaaccucuggccgggagaccccgccccagccgcacucacccgggccgcgguccggccgcgcgggccgccccccgcacagucgcaccuuggacagcaggaugaggagcugcuucuggcaaagggacuuggugccgcggggacacacgcgccgcugcgccgacaccggccggcugcccccgggcucgcggaccucccgcuucugccggaucaggcuacuggccagcgccgccauagcgccccgggaggagacacccccaaaccggcaggcgcccggagcgcgcugggcucccccagaggagcccgcucacuagggcaugcucuugacgcucaggc

SEQ ID NO: 16650 - RNA, 823 nt, Homo sapiens
aacugcugucgccgccgccgccgccgccucagcuucccacagccgcugccgcugccgccgcucugccugguccagccaccggcccagugcucugacuucgccggaccggggagcucugcagagacacccucacuccuucccgaggguccgggacgccuagccgggcguggggggaagcuccguuugcgggggacagggagggaggagccuggagccgaagccagcgccacccgucgccggaucaacaggacaggacagguugaggggcgucgggaaaaggaagagggggugcuauaggcaaucccggggaggacgaggaagcccuguagcaggaagcugugauccgcucugacuuguagggggccuguucacaucuggggacuggugacaacgugggugcacuccucucuuggggggcugguuagauuggagggcgugggaucuaaacagcaccagcuguccccaagaaaauuuaaggggcagccaggggagaaaaaaacaaaaacaaaaacaaacacggaugcuccucauuuugagguggcggaaggcccuccagucaacuaccugguguauccacuaggaaggguggauuuggaggugacuucaaaaggagcggagggugugaaggugaagaaagggucuuggccgcuagaauucuaugcuacuagacaugggggggacuuggugaaaaagguauuauccagccagagggucugggagcccugucuuacugaaccugggcaaccuggauauucugagacauauuuuggggggauuucagugaaaaaagugggggauccccuccauuuagaguguagcaaag

SEQ ID NO: 16651 - RNA, 2947 nt, Homo sapiens
aggaacuacaacuuccaucaggcacuacuucagcggaacaggaaaggaugugggggcguggcuaccacgcccuaguagagcgggaaacuacaacucccaggauaacgcgggauuucagcagggccaaaagagugauugagcucugacuggcgacccgacccggcggaaaccaccucgacagccuccagaaaggggcguggcugaaaauguaggggcguggccacgugggcaucaggaagaaguaaccuguugaaucuauuucugcuccccacccuuacugcuucccauaagggggaagccgcagacuaauaagccucuuccaaaaaagagguaaagggagguagacaaggggcggcagcggaggcuggcuacugcauuccguaggaggagccaacaguuacuuuuuaccugcugaguccggugaaccaguucaugggggcggggaccugccuaugagaaaagggccaggauagaagagguauuuauuuguucauuuugaggacuaaauuuagaacccaucaucuacagacccauuuguagguugugucuggggcacucgcucggccucaggaagagggaagaacggggacgacuuuguggcagcaaagccaccucccuuccguguuuuccgcagcccaaagcgauagaaccgcauggcuuccgcagucugggggagugcccccugguggggcccgccgcccccggccccagcucggccgcucacggacaucgacuucugcuccggggcgcagcugcaggaauugacccagcugauccaggagcugggugugcaggagagcuggagugacgggcccaagccgggagccgaucuccuccgggccaaggacuuugucuucucuuugcuugguaaguaacccuacuugccuuugggaacucacagcucucagccucaccacgcccccgcccccgccccggcuuugggcgacgcccucacgauccguucccuuuuuuuaggucuaguucaccgccgggacccucgcuuuccuccccaggcagagcucuugcugcuucguggugggauucgcgagggcucccuggaucuggggcaugcaccccugggucccuacgcccggggaccucacuacgaugccggcuucacacuccuagugcccauguuuucacuggacggcacugaacugcaacuggaccuggaauccuguuacgcacaggucugccucccagagauggugugcggaacccccauccgggagauguggcaggauugcuuaggacccccagucccaggagcacgugauucgauccaccgaacggagagcgaagaaaguuccaaggacuggcaaagcucuguagaccagccgcacagcuacgucacugagcacgaggcgccggugucuuuggaaaaaucgccuagugacguuucagcguccgagucgccucagcaugacgucgucgaccuuggcucuaccgcaccuuugaaaacaaugaguagugacgucaccaaggcagccgucgaaagcccagucccaaagccgucggaggcucgggaagcguggcccacauuauguuccgcccagguggcugccugguucuuugcuacgcuggcggcggucgccgagucucugaucccugucccgggugcuccgcgucuggugcacgcagcucgccacgcggguuucaccaccguccuccuggcuaccccugagcccccucgccgccuccugcucuucgaccugaucccagugguguccguggcgggcuggcccgagggggcucggagccacucgugggccgguccgcuggccucugagucggcuuccuucuaccuggugcccgguggcggcaccgagcggccgugcgccuccgccuggcagcucuguuuugcccgccaggagcuggcgcucaaagcgcgcauaccagcgccgcugcugcaggcgcacgcggcggcccaggcgcuacugcgcccgcugguggccgggacccgggcggcggcgcccuaccuccugcggacgcugcuguacugggcgugcgagcggcugccugcgcucuaccuggcgcggccagaaaaugcgggcgccugcugccucgggcugcuagacgagcucggccgagugcucgaggccgggacguugccucacuauuuucugaacggccgacagcuccguacgggggacgacuccgcugcgcugcucggagaauuggcccggcuccgcggggacccggcccgggcccuccgugccgcgguggaggaggccaaaguggcccgcaaggggggcgguuuggcgggcguggggggcggggcccauuaaagacgcuguuccuaccaguggaaagugccucugugggcgagcgggacguggggggcccugcucgccccucgccagggggacugacugugugcccugggccugaagccccccuucuggaagaccucccuguugguuccuccucuacgcccacccgccugcccccgcacaaguugccccauuccagccucgcuauucuccacaucuguggccagcacuccgcccaggggcagcuuccagaaaccgucuguccccaguucuuuuggucauuucucuuaagggccaauagaaaugggagaaacauauuugcugaccaaacgcgaaaaggaguuauggagaccagggucugaucaauuuggcucacacaacggcagagauaugaaggaggccggauuucgcccaaggcuggaucucaccaccccccauccuccaucucuccaguucuucccccacuuuacucgugcgguucuuucuucacuaacaucccggccaguagggucucucucccuucucccagcguccgccauuccaucucccuuaggcccaaccucuccuuccuacccaggggugcguucaggaggccuuccugucccuccuccucugaaggcugagacgugcggccuugccucggcuuugccugcuuguaagacacaguccgcacu

SEQ ID NO: 16652 - RNA, 2341 nt, Homo sapiens
uuauuuuuugcgacucagagccauccuauuaccccucucaaaccccaaggaauguuugagugggguugauaugggugugaaaagacacagaauaaucugucuccagaggaacuacaacuuccaucaggcacuacuucagcggaacaggaaaggaugugggggcguggcuaccacgcccuaguagagcgggaaacuacaacucccaggauaacgcgggauuucagcagggccaaaagagugauugagcucugacuggcgacccgacccggcggaaaccaccucgacagccuccagaaaggggcguggcugaaaauguaggggcguggccacgugggcaucaggaagaaguaaccuguugaaucuauuucugcuccccacccuuacugcuucccauaagggggaagccgcagacuaauaagccucuuccaaaaaagagguaaagggagguagacaaggggcggcagcggaggcuggcuacugcauuccguaggaggagccaacaguuacuuuuuaccugcugaguccggugaaccaguucaugggggcggggaccugccuaugagaaaagggccaggauagaagagguauuuauuuguucauuuugaggacuaaauuuagaacccaucaucuacagacccauuuguagguugugucuggggcacucgcucggccucaggaagagggaagaacggggacgacuuuguggcagcaaagccaccucccuuccguguuuuccgcagcccaaagcgauagaaccgcauggcuuccgcagucugggggagugcccccugguggggcccgccgcccccggccccagcucggccgcucacggacaucgacuucugcuccggggcgcagcugcaggaauugacccagcugauccaggagcugggugugcaggagagcuggagugacgggcccaagccgggagccgaucuccuccgggccaaggacuuugucuucucuuugcuugguaaguaacccuacuugccuuugggaacucacagcucucagccucaccacgcccccgcccccgccccggcuuugggcgacgcccucacgauccguucccuuuuuuuaggucuaguucaccgccgggacccucgcuuuccuccccaggcagagcucuugcugcuucguggugggauucgcgagggcucccuggaucuggggcaugcaccccugggucccuacgcccggggaccucacuacgaugccggcuucacacuccuagugcccauguuuucacuggacggcacugaacugcaacuggaccuggaauccuguuacgcacaggucugccucccagagauggugugcggaacccccauccgggagauguggcaggauugcuuaggacccccagucccaggagcacgugauucgauccaccgaacggagagcgaagaaaguuccaaggacuggcaaagcucuguagaccagccgcacagcuacgucacugagcacgaggcgccggugucuuuggaaaaaucgccuagugacguuucagcguccgagucgccucagcaugacgucgucgaccuuggcucuaccgcaccuuugaaaacaaugaguagugacgucaccaaggcagccgucgaaagcccagucccaaagccgucggaggcucgggaagcguggcccacauuauguuccgcccagguggcugccugguucuuugcuacgcuggcggcggucgccgagucucugaucccugucccgggugcuccgcgucuggugcacgcagcucgccacgcggguuucaccaccguccuccuggcuaccccugagcccccucgccgccuccugcucuucgaccugaucccagugguguccguggcgggcuggcccgagggggcucggagccacucgugggccgguccgcuggccucugagucggcuuccuucuaccuggugcccgguggcggcaccgagcggccgugcgccuccgccuggcagcucuguuuugcccgccaggagcuggcgcucaaagcgcgcauaccagcgccgcugcugcaggcgcacgcggcggcccaggcgcuacugcgcccgcugguggccgggacccgggcggcggcgcccuaccuccugcggacgcugcuguacugggcgugcgagcggcugccugcgcucuaccuggcgcggccagaaaaugcgggcgccugcugccucgggcugcuagacgagcucggccgagugcucgaggccgggacguugccucacuauuuucugaacggccgacagcuccguacgggggacgacuccgcugcgcugcucggagaauuggcccggcuccgcggggacccggcccgggcccuccgugccgcgguggaggaggcca

SEQ ID NO: 16653 - RNA, 1952 nt, Homo sapiens
guuuccuggacucuguuucucuuuauuccucucccuccaugcccugccccacaccccacauccgccugcuggucaguugaguuucucggucuggcuccugugcagagagggccucaagguggagguggaagccgguggcagugagcuggaccuggcucugcucuucugcaccugccgcuucagcuccaggcugucguacaccugguaguuggcauugcccccuggauuccggcugagugggacaaacauggucgggggaggggcaggguccgcagccuggacuuugggccagggcugggaggaaugggggaccagcacugagcuuggagcugggguccguugaugggaggccucguccaacaccgugagggaggcagagguagucagaggacgccaggcgggcagagccucagcccagucagcugcccgacgccgcaccucacggggguccugggagcuguagcccaaggguuccguggauggguggggacugcggugggacuggccauaggcgugaccaagcaggcucugcuggugggacuguggggaguggugcucccggcagcccugggccucaggccgggcguuccgggacaccgaggcaggggggcgcucaaagcccuccgugccacgacgccgcugaucccaggagucauacagcauccagcccacugagggguaagggcugugccccacggggacccaagagggguuagggggcagccgguggggaggugguggagacgaggcccacugcucagccuccacauugccccacagucgggauugggaaccguggcgcccauaggacugcagccucagcucagaccuggccucuacacgcuugggcaugcagcgcagcucaggugacagguagagagagggugguggcagacuggccaggauaccacccugguggccccacagccccacauuggagggcaggcccgcucucugauaaaacccgccccagccgcgacguggguacuugggauacgggaagggcagguuguccuccuccuccagguaggaauccggguccuccugaucaaagaaaggcacucgguguaguugugacaucuuuuggcugcgauguggguuacggaagacugaguggcuaugggggauuugucuguaguucugcggccgcugcuggugguugcagcagcgacggcgacaacggcgguggcggcggcggcggcgacgaacacagcgaagaagacugcuacugugaugguuggagaaaugguggcaggagaaagaggaguacugcgugggucgggacaucuucaccugcacaggguccaggaugcaguggauguggacauccugagccuugucugggggaccacuugggggacuuucacuggccugaauuucaucuggggaaggcaagaguccaugaagucagggcaauugucagaagagcucaagguugggaacacuggggccuggguuucuagggccauugucagggguggggauggggguccccuaccucuccagcagccacacuuacuuuucugaguagcccaaucaaucaucuugucuaaggcguucuggaguccaugccacaucuggggcaggguggaagagagugaaggccaggcccuccgcgcccagcaccaccaccccugcccccgccccaaucuagaccgcaccugcagguggagauguaggcugcagcuggcucccacccuuggcccuguucacccccagagguaguccacaaucaucacugaccauaguugccacguugaugccaauguugacaagaacgaugaggcccagcagcaggaguaagauguccucggcaucgugggggcuuucuugguauugauugcaacaucucacgguguuaugccauagcugguuuuccauggaggggggguccuagggccaccugggccaccccccucugccccccacccccggccccaacccacacugca

SEQ ID NO: 16654 - RNA, 846 nt, Homo sapiens
cccgagcccgagcccggcccaagggccuaugaccgcuuccccggggacucacgggacuacuccacggagcugagcgucaccguggccgugggugccucccuccucuuccucaacauccuggccuuugcugcccucuacuacaagcgggaccggcggcaggagcugcggugcaggcggcuuagcccaccuggcggcucaggcucuggcgugccuggugggggcccccugcuccccgccgcgggccgugagcugccaccagaggaggagcuggugucacugcagcugaagcggggugguggcgucggggcggacccugccgaggcucugcgcccugccugcccgcccgacuacacccuggcccugcgccgggcaccggacgaugugccucucuuggcccccggggcccugacccugcugcccaguggccuggggccaccgccacccccaccgccccccucccuucaucccuucgggcccuuccccccgcccccucccaccgccaccagccacaacaacacgcuaccccacccccacuccaccacucggguauaggggguggguggggaggcccuccuccccggcccucccuggcccggccacuccgaaggcagggaggaggacuuggcaacuggcuuuucuccuguggagucgucacacgccauccagcagcgcuaagguggacaugggauuccucccugcgaugcgugucuuucccacgcagagaagcccagucucuucucuggaucugggccuuugaacaacuggggggcguuuucucccccccauugggacaccagucuucgguguguggaaugugguauuuucccgcguggaggugugcuuucu

SEQ ID NO: 16655 - RNA, 8722 nt, Homo sapiens
ccgccuccucggauuuagcccaggcagccugggagguuccgcagucgccgcuuccgccuugaccaggugaggguccggaccgagcagggggcccgggcuggggagagccggcggagcagccgucgcugggggcgcguccggggggcgcugggccuguccucuucuccugcguccuucccucccgcagccgcgcuuccuccugucucccuucugcgcuccccgcuucccaccgagcgcgcagggccgggucccccaggguccugggcuuucuccuucccaacccaacccuguucgcgcccgguucugaguccaccugcgcguuuccaacuaggcccagccucgauccucuucuuccuccuugcuuauaauguaggggaagggacggguccaggagugugcuagggaaagugugagcaggcugccaguacccagaggcccagagccuuauuuaacaaagguugguggaguugccuugaagccaaguuagaccgagugacucaggcugccagcaggcaucugugccuggggcugagcucagguaggugugggacuguguaccugacagccucaguggcuccauaggcagcaccuaagccuagcggccaucacaagugccugauuugauuucaaauguugcugccuccgguggaggagaggcaaugacuguggaccucuuuuggcuugaggggucccuaugcccccauagcucagguaugcugugugcacacuguaccucgaugucuguguguuguguucauguggaccuuugugucuuagccguguggggcaguguaucuagguguuuggaggcagugaacugccaugucccauggaugugacacguauguacaaggaacaucucauggaaggacacagaugagccugggcguuuuguggccgcaugcugaaaugucucagcguuaagacgacauauaucggccgggcgcaguggcucacgccuguaaucccagcacuuuggguggccgaggcgggcggaucacgaggucaggaguucaagaccagccuggccaauauggugaaaccccaucucuacuaaaaauacaaaaaauagccgggcaugguggcacgcgccuguagucccagcuacuugggaggcugaggcagaagaauugcuugaacccgggaggcggagguugcagcgagcugagaucacgccacugcauuccagccuagaugacagagcgagacuccgucucaaaaaaaaaaaaaaagaggacauguauuugggagucucggccauguuuugcaguauaucuguaggucucaguguguguguguggcagcaugugggaggcaguguaccuucgugugugugcgugcucuaccuacaugucugagguauggugugguugucauaucugagcaucuccagugugugugguaggcaaacaugucucauguuggaggaagggagaugucucauguuggaggaagggagaugucgucucagguguguaugagugaguuugugccacugcguagcucaggucuaaaagggcaguguuucuggguguccgggugugugaugugccgugauauuucagagucaggaugguaacauaccuggagucuguaguaggagcaggcaguaugcuaaaauugcaggugugagcagggcagguuacucagcggugaagggacagaguacccggaugccugggcacggggaacauucuaucugggauuugugugcgugaguggcagggauccuggcugucucugcugugucccugccucuguaccugaguguuucuaaugacuugcagguggagcuggagaccuggucucucuagggccuacccugagcucaccaucugaaggagagugccaucauccuuaggaacuccuucuccagacaugcuuccugaggcuggcucccuguggcuacugaagcugcuccgggacauccaguuggcccaguuuuacuggcccauccuugaggagcuuaaugucacucggccagagcacuucgacuuuguaaagccugaggaccuggacggcauuggcaugggccggccuggugagggaccccugccccgaggcccuggucucucuguccacagccuaucaguugccuucccccaccacaacccucuuccagcccuuuucuucccuguaagucucuccgcacucuuccccacacccaccuccacuccagcccugauucuggccucccacagcccagcgcagacuguccgaagcucugaaaaggcuacguucugggccuaagucuaagaacugggucuacaagguguguguuguaggugggcagcuugggccugggaaugagguggcuugaggggcagggaggggggcgcagggcucugcauaccggauuucccaucccuguuucagauccuuggagguuuugccccugagcacaaggagcccacccugcccucggacagcccacggcaccucccugagccagaggggggccucaagugucugaucccagagggugcuguuugcagaggggagcugcuggguucaggcugcuucgguguggugcaccgagggcuguggacgcugcccaguggcaagagugugaguguccagggagcccgcuucauccaggccagcugcccccucuguucuucaugcccgcaaugccuaaaggcgcuuccccccaccuccaggucccaguggcugucaagucccuccggguaggucccgaaggcccgaugggcacagaacugggggacuuccugcgagagguaucggucaugaugaacuuggagcacccacacgugcugcgucugcacggccuuguacugggccagccucugcagauggugagcagauccagccgcugguucccgggacagccgugcggcaggagcgugggcggccaggguccaauggguccggcucacgcggcgcgguguucccuccugcaggugauggagcuggcgccacugggcucccugcacgcgcgccuaacggccccggccccgacacccccgcugcucguggcccugcucugccucuuccugcggcagcuggcgggagccauggcguaccugggggcccgcgggcuggugcaccgagaccucgcuacgcgcaaccuacugcuggcgucgccgcgcaccaucaagguggcugacuucgggcuggugcggccucugggcggugcccggggccgcuacgucaugggcgggccccgcccuauccccuacgccuggugagagcggguccgcgggcggucgggcucugagccgggcggauccggagggcagcagccgagggagaucggagggggccgggcuucugagggaggcuuggaccagaaggguuauccuccuaggcaaagaggacuuuugugaaagaugggugcacucgggggugcuccguggagggugggccuccaaggagcacgugucccgccccuuucagcuccacuuccuucggcaggugugccccagagagccugcgccacggagccuucucgucugccucggacguguggauguuuggggugacgcugugggagauguucuccgggggcgaggaacccugggccggggucccaccguaccucauccugcagcggcuggaggacagagcccggcugccuaggccuccccucugcuccagggcccucuacucccucgccuugcgcugcugggccccccacccugccgaccggccuagcuuuucccaccuggaggggcugcugcaagaggugggaacccccgaccucaccagauacacagucccucuucccuccauucgcucucccaggguuccaugcgaagacuaacacaucuagaugucugugcugggcucugggacucagcucugagcaaaacagaugcagucccuaccugcagggagaucagagcccuggggaggcagcuuggggcuacacagaugcagacugaaaggcuggggucugugucugggccaggaaaggggcauagaggagacagcacucaguugcagucguguugacacgcagaggaagagaagggcucagcgugggaggggaaaauagaaauaaugaagccgcaggccgggcgcgguggcucacgucucuaaucccagcacuuugggaggcggaggugggcagaucaccugaggucgggaguucaagaccagccugaccaacauggagaaaccccgucucuacuaaaaaauacaaaauuagcugggucugguggugcaugccuguaaucccagcuacucgggaggcugaggcaggagaaucgcuugaaccugggaggcagagguugcggugagccgagaucacaccaucgcacuccagccugggcaaaaagagcgaacuccgucucaaaaaaaaaaaaaagaagaagaagaagaaguaaugaggccacagagagagcaggagcugugucauggagggcuuugcaaggcguguuaagcuaacacguagagcacuugaccugugcaggacacugcacugugcacuuuacaugggcgcuuaugcagauucgcucauuuaaugcucucaaccacuggaugagguaauuauuauuaguaguauuuuauuuugagacagucuugcucugucacccuagcuggagugcaguggugggaucuuggcucacugcaaccuccgccuccuggguucaagcaauucuccuguuucagccucccgaguagcugggauuacaggcgccugccaccacgccuggcuaauuuuuguauuuuuaguagagaugggguuucaccauguuggccaggcugguuucgaacuccugaccucaaaugauccaccugccuuggccucccaaaguguugggauuacaggcaugagccaccgugcccggccuggaugagguaauuauuaucuccauguuacugaugggcaguugaggcacugagaguuuaagugacuugccuaaagucacaugguaaguggaggaguugggauuugagccagucaguuugacuucagagcuguucccuaagcugcuacacucuaccacuaaagcuuagucuuuacucugaaggcauuugggagccagggaagccuauuaggcaggggaguuacaagccacucucaccaugacggcacucugauguggcgcaagaauggauuagagggaugaugcugaggcugggagaccagguaggcaacaguggcugugaagcagaagggagaugaagaggucuggaugaggguagaggcgguggggcugcagaggaguggaaauuucccagaggggcuugggaggcugcucugacaggccuggauguggagugaaagcaguguacaggaugacgcuccuguuaguccccccagguagagccagggcccuccucucuugcuccuugagcccugaccuguuugucaugggauccaggucugccucccucacugaauuacaauggggggacagggagagucccacccugggcccagcacagacuacauacagagcggagcuccucuuuauuccugcucccauauuaccuaucugacucaggccacaagcccagccacccuuuccucuugucuccacaggccgggccuucggaagcauguugugugagggaugucacagaaccaggcgcccugaggauggagacuggugaccccaucacagucaucgagggcaggugacagucccauaccucccaagcacccucaggaggaggauacccucccagccuaauuccugaucccuucucugcuucucuccagcuccuugaacccugaucuucugucucaucuccucuccccacuggguccugaaagcuccagcaugguccuggccucccugcuggagccacugcuggcccauagagccuuauugcauuagggaaaaggcuucccuuccuccaggcagaugcggcuccaaggcacauagccuagugagcugacugugggccagggcccagcccuaacucuugcccuuauucccauccuauuuaccagcuccucuuuccacagccccgacuccacaaucuggaagggccagaauggucgcaccuucaaagugggcagcuucccagccucggcagugacgcuggcagaugcggggggcuugccagccacccguccaguccacagaggcaccccugcccggggagaucaacacccaggaagcauagaugggugaggaccugaaagggugagggcagggguuggcugggagaacugaugagguccaggagcuucucuggaagagaagccuggggacaggaccagagugaagcugcagccuccacccugggcccugggucuccuggguuccccugugaguuuuuuugggaggguauauugaucugugggguggggagaguugguguggaggaugaacuggaucccucuccgacagagacagaaagaaggcaaaucuuugggaugcgcccccagcacggggccagaggaggaacaugccccuggagaggaugaaaggugggugugguggacuccagagucucugaggagaucaagaccaguccuucaauuccgacccccugcccuaaauccaugccuuugcaucuauuauuuccuuccucugaauucugucugcuggcauccuagcuauacugugcaaucuauuuuuuuuuuuuuuuuuugagacagaguuucacucuuuuugcccaggcuggagugcaguagcgugaucuuggcucaccgcaaccuccaccucccggguucaagcgauucuccugccucagccucccgaguagcugggacuacaggcaugugccaccacacccggcuaauuuuguauuuuuaguagagaugagguuucacccuguugcccaggcuggccuugaacuccccaccucgggugaucugccugccucggccucucaaagugcugggauuacaggcgugagacacugcguccggcccuauacuguggaaucuuaaaagauaggaagcccuccugccuucccuucugaagagcaccuccacacucugggcccugagcucugaguucucugggcccuccgccuaggccuugguguccacuugcccaucugucuuauugucccaccugacacaugaaccacccagggacagggcuggcuagcucaucugcaaaugcuugcaaaaccauccagcucagcacagaugaagacagagaguggggccaggcaugguggcucaagccuguaaucccagcacuuugggagcccagcguggguggauggcuugaguccaggaguuugagaccagccugggcaaugugccgaaaccccuucucuacaaaaauacaaaaauuagccagucguaauggcaggcaccuauagucccagcuacucgggaggcugaggugggaggaucgcuugagcccgggaggcggaggcugcagccagccgaguucaaguuguuuccuucucaacugugcaggcauuuccaggagucuggagucaguucugucccucgguccucgucccacagggggugguucaagccccccugaaauucgacaagccagagcugugccccagggaccuccaggccugccuccacgcccaccuuuauccucuagcucuccucagcccagccagcccucuagggagaggcuucccuggcccaaaagaaaacccccacacaaucaccccaugggaaugccuggagcccguaaagccgcugcccucucuggaggccucuuguccgauccugaguugcagaggaagauuauggaggugaggucucacugaaauggccugguguccagaaggggcuacaggcaggggcaggggccugagugaggcuuugucugucacagguggagcugagugugcauggggucacccaccaggagugccagacagcacuaggagccacugggggagaugugguuucugccauccggaaccucaagguaaagccagccccuucucuuggggucccuccucuccugccccugccgccuggcagucagcugcaacccacccuccugcuuccacagguagaucagcucuuccaccugaguagccgguccagagcugacugcuggcgcauccuggagcauuaccagugggaccucucagcugccagccgcuauguccuggccaggcccugagcucagcuucugcgggcacagacaccagcaugaaaagccuaggccccugagggccuggccacaugggaccaagcggaaccagaacaaggucccgacagggguagacguuccaccuggggagaucccaccugccguaggcacauggaggaggagcccagaguugggcacuggcaaaugucuccucccucccaugcuccuuggcuucugaaggcugaagcuccuuuggcugggccaagaaggaucuagucugcccacuacauucucaaacaagaggacuuggaagaaaagagcugcuauacaucauaugcagaggaagcuucuacgcgcuagagaggaucaaggggccacacuggaccaugugaacagccauccugaacugccaucagcuaccacacuggacucugcagggcagccauccuggaugauggaagccaccauauugacuugggguauaggcccaaacugccuucguuugguccagggccaucgugggugaugacgauugcucucuugcacucaaggacauuugaugcugguaguauggauuaugagauggacuagccccugccccagcccagcucucacauuccccuuuguuuuuucccauaccaacugcuucuacccuccccuauuacauacaucuuucaauguccaaaaaguuacaaaguuuauaugaauguaacaua

SEQ ID NO: 16656 - RNA, 20126 nt, Homo sapiens
ggccccgccccugccccucccagcacugccuggaaguguggggugagagcuccuccuaggacaccccuuuccccuuggggaaagaauugugcccccaggcccuuccccgcggaggucccucuccuccuucccccucaucuccccuuccugggacagaaagugccuccaccugcauccccaggggcccggccuccagggcccgcuggccccacagcaggcaagcugagaugacggucaagcuggauuucgaggagugucucaaggacucaccccguuuccgguaagugugaacuggucuggggggcuaaggaggggaaagucuaacacccccagcacacacacaccuuuccccaggccaggucuccuuccagggagcaggccucuaagaggcaggagcgagccugugggccaaagugguaccccagcugugaaagcaggguacuccaaugcucucugccccugcaugcuccuccuggccucugcaguuucccucaccccuagagcuggcauucccucuggccucucagugggaccccugccccucccccagcaccugcucuggggcgguuagcaacuuccugcccuggccacauccacccuccuucuacccuuccugcucuggccugggcugugguagcucccagacugcagagcgggcagagcacaaguagguggguggggggcgagccucucaacucugcagcuuucuccuccguacccaccgcccugcgacuccaucccgccugaugaggcagacagaccagauggacccaagcucucuucccaugacccccucuuucccagagccucuauugagcugguggaagccgaagugucagaauuggagacccgucuggaaaaggugacccugacauggagaggugacccaggaguggauuagguugagagggguagggccagggagaaagcuggagacacagaaugcaucccagggauuauugaauacuguguaggggagauauuuuggagacugcagagaagcaaaaaaggugguucuguaccgacaagaagcucaggaucuuggaaaacaagacuuacuuuugggccaggcaugguagcucaugccuguaaucccagcacuuugggaggccaaggugaauggaucaccugaggucaggaguucuagaccagccuggcuaacauggcgaaaccccaucucuacuaaaaaugcaaaaaucauccaggcuuaguggcacccaucuguagcuccagcuacucaagaggcugaggcagaggaaucacuugaaccugggaggcggagguugcagugagccaagaucgcaccacugcacuccaggcuaggcgacagagcgagacucugugucaaaaaaaaaaagacuuaauuuuggacuuccuuguucugcucuugagcuccugcauugugccaggcccugggcauucagggaggacaagaucauuucugcucccacggagcccaaaggcugacuagaagacaaaccagugaaacguuucaauucaagacaguaagguguccccugagcacucuaucaaacagcauguucacacaaauacacacucaaaugcucucucauuccccuuacuucgcuuuacuuuucucugcaacauuuaccucugacacauuauguauuugcuugcuauauauuaguucucuauugcuguguaacaaauugucacaaauuuagugggcaacauuguuuuaugggcaacauggugagaccucaucucuacaaauaauaauuuuauuuuuauuuuuauuuauuugagauggagucucgcucugucacccaggcuggagugcaguggugcgaucucggcuuacuggaaccuccaccucccagguucaagugauucuccuaccucagccucccaaguagcugggauuacaggugugcaccaccacaccuggauaauuuuuuuucuuuuuguauuuuuaguaaagacagggucucaccauguuggcuaagcuggucuugaacuccugaccucaaaugaucuaccugccgcagccucccaaagugcuggcauuacaggcuuaagccaccgcacccggccuacaaauaauaauuuuaaacaauggacuggauggaguggccacagcugugaucccagaugcuucaauacugggcucaagugauccucccuccucaaccuccccaguagcugugcuacaggcacaugccaccacgccuggcuuuuuuaaauuuaaauuuauuuuuuguagagauggggucucccuauguuaccuaggcuggucuggaacuccuggccucaaguaauccucccaccucagccucccaaagugcuggaauuacaggugugagccaccacaccuggccugaauuuuuuauuuugaguaaauuauugacucaggagacuagugaggagaggucucauguacccaucacccagcuucccccaguggugacaucuuauacaauacuaguacauuauuaaaaccaggacauuaauagugucacauuacaauuaacaauaaacucggccaggugugguggcucacgccuguaaucccagcacuuugggaggccaaggugggcggaucacgaggucaggagaucgaaaccauccuggcuaacacugugaaaccccgucucuacuaaaaauacaaaaaauuauucggguguggcggcaggcgccuguagucccagcuacucaggaggcugaggcaggagaauggcgcgaacccgggagguggagcuugcagugaguggaggucgugccacugcacuccagccugggcgacagagugagacugucucaauaaacaaaaacaaacaaacaaaaaaccccaauaaacucuagccaagcucaguggcucacgccuguaaucccagcacuuugguaggcugcggcagguggaucacgaggucaggacuucgagaacagccugaccaacaugaugaaacccccaucucuacuaaaaauacaaaaauuagccaggcgugguggcacgcaccuguaaucccagcuacucaggaggcugaggcaggagaauugcuugaacccaggaggcggagguugcagugagccgagaucacgccaccacacuccagccugcggaggucgcaaugagccgagaucgugccacugcacuccggcgugggcgacagaccaagacucugucucuaaauaaauaaauaaacucuauagauccuacuuugauuuuacauuuugcauauacucuuuuuugguguuuuuguguauaauucuaugguacuuuaucacguguauggauuccuuuaaccaucaccacacaccaauggacacaaggaauuccuuuacagugguacccgacacccuucccacacuucuuuaaucugugguaaccgcugauuuguucuccaucucucuacuuuugucauuuccagaauguuccauauauagaaucauacacuaugugacccuuugagauuuggcuucccccuccccccucacucagaauaaugcugcugccggguguggucgcucaugccugucaucccaacuacucaggaggucaagguaggaggguugcuugaggccagaagcucgagaccagccugggcaacauagcaagacccuugucucuaaauaauguucuguuuuguuuuuaaauuagccaggcaugguggugugugccuguagucucagcuacucaggaagcuaagauuggaggaucccuugaacccaggaguucaaggcugcagugagcuaugaucccaccacugcacuccagccugggcgacagagaccucaacucuaaaaauaaucauaauuuuuuaaaagaugaaugcucuugaaguuuauccaaguuguugcacauaucaacaguuuguuccuuuuuauugcugaguacuguucuauugaacagaugucccagucugucacuaguccaguguuaugaaaguuucuuacucaucuaagggggaggggcugagaugguaaggaaaaaaacuagacacagaguccucagauucacacagugauuugugaacauccuuguaccuugucacagacaacccauggugaugucugauaagauuugaucucggucaggccaggugcaguggcucaugccuguaaucccagcacuucgggaggccgaagcagguggaucaccugaagucaggaguucgagaccagccuggucaacauggugaaaccccgucucuacuaaaaauacaaaaaauuagcugggcgugguggcgggcaccuguaaucccagcuacucuggaggcugaggcaggaggaucgcuugaaccugggagguggagguuguggugagccaagaucaugccauugcacuccagcuugggcaacggagcaaaacuccgucucaaaaauagaaaaauaaaaagagaugggguuucacuauguuggucaggcugauauccaacuccugaccucaggugauccacccaccucagccucccaaaguguugagauuacaggucugagccaccuugccuggccuaucaagucucuuugucagucaaaagagccagauaggaugggccccaggaguaccccggcauuuccucuuggcccugacccguggucuagaugauggauuaauauuuaugagggaacgugcagugagcacagaaugggacaacuccuagcaguaaauacuauagauuuuauuuauuuauuuauuuuucgagacagagucucggucugucacccaggcuggagugcaguagcgccaucucggcucacugcagccuugaccucccggauucaggcaguccuccugccuuagccccccagguaacugggauuauaggcacuuggugccaucucagcucacuacagccucagccucccggguucaagcaguccuccugccuuagccucccaaguagcugggauuacaggcaugugccaccaugccuggcuaauuuuugaauuuuuaguagagaugagguuucaccauguugcccaggcugcucuugaauuccugagcucaagcgacuggcccgccuuggccucccaaaggguugggauuacaggugugagccaccacgcccggccaauacuguagaauuuaauagcaaccagguagagcauccagaccaugcaggaaucuccacggagcucuggaucuaagcagguaggcagggcaggaagagauaugugcgaguggacagggaaagauguuuuggagguaaggcugacagagguguuggcgacaggcugagaggaaugggcaggaauuggguuucaggcccaaggcagugggagcaaagacgcagcgauaagaacacagcagguauguguuagauacagggagagcuggaugagccuggagggcagugaggccaggcaggaauaggggagcgccgcccugggcaaggggagaggaaguggggcaggugugggggcaucaccaggugugaggaugauggcacagcucccuguuacccuccuucuuucccagcuccugaaacugggcacuggucuccuggaaagugggcgccauuaccuugcugccagccgcgccuucguugucggcauuugugaccuggcccgccuggguccaccagagcccaugauggcgguaugcggagggucugcaucugggagggaaggggucugggaugaggaggugaugcuguggaagaggagggcuggccuggggucugcagguuccaggccacagcagggcugggcugcuguccaugacagccguagcaggcugggucucgagucgggagggugcugccaccccaugccugguacucuuucugugccucuucuugccuaggagugucuggaaaaauucaccgugagccugaaccacaagcuggacagccaugcgguaaguaggggaagguaaggauugucggggugguggccaggucaccugugguccugaccccagucuaccaacuucuccuucccucaggagcuucuagaugccacccaacacacacugcagcagcagauccagacccuggucaaggagugagauggggccgggcgcaguggcucaugccuguaaucccaacacuuuggaaggccaaggcgggaggauugcuugagcccaggaguuggacaccaaccuagccaacauggcgaaacugucuccacaaaaaauacaaaaauuaggccgggcacgguggcucaugccuaugaucccggcauuuugggaggccaaggcgggcggaucaccugaggucgggaguucgagaccagccugucuaacauggcaaaaccccagcucuacuaaaaaauacgaaaaaaaaaaauuagccgggcaugguggcaggugccuguaaucccagcuacucaggaggccgaggcaggagaaucauuugaacccaggagguggagguugcagugagccaagaucgcacuacuucacuucagccugggcaacagagugagacucugccucaaaaaaaaaaaaaaaaaaaaaaaaauagccgggcgugguggcacaugucuguugucccagcuucuugggaggcugaggcaggagaauugcuugagccuggaggucagggcugcggugagccaugauugugccacuguacuccagccuggguaacagagcaagacccggucucaaaaacaaaaacaacaacaacaacaaaaauuuuuuaaagggggagugagaugggagagaagggggccuuauuucucggaaaccagcccugcugcccucuucccauggccacaggagccuccccagugacggaguugugagauuggggguuucugguguccugacuuccgucccagggaucaccuuggguuucccacguugcagagacuaacugaaaggacaugagggcuuuacccugggaaugcucugcuggggcagguggguguuagcugcgauucuguguuauuuucccauccucagaggucugcgggguuuccgagaggcucgccgggauuucuggcggggggcugagagccuggaggcugcccugacccacaacgcagagguucccaggcgccgggcccaggaggcagaagaggcaggagcugcuuugaggacggcucgagcuggguaccggggacgggcacuggauuaugcccugcaggugccugccccaaucugucuuccugggguaccagagccucaagugucaccucgaggcuugggggucuccagugugcagugggaaggggugcugugucuucaagacugaucugggguuuuuuacguccucuuuuacguccucagaucaacgugauugaggacaagaggaaguuugacaucauggaguuugugaguuguggcgggggugagggcaggguggagaagagccugcugccagcacaagggaauggggagagggguucuuccucagccuucccacugcccgccuugucccccaggugcugcguuugguggaggcccaggcuacccauuuccagcagggccaugaggagcugagccggcugucccaguaucgaaaggagcugggcgcccagguggggccccagggcacagcaggugguagagggagguuagggacuccuaacuggggggccuuggacaucugagaugcccuuccugugcccaguugcaccagcuggucuugaauucagcacgagagaagagggacauggagcagagacacgugcugcugaaacagaaggugaggggccaggugcgguggcccacgaccgucaucccaacauguugggaggcugaggugggaagauugcuugaggccuggaguucaagauuagccuaggcaucguagugaaacuccaucucuacagaaaauuuuaaaauuagcuggugugguggcaugcaccucuaguucuagcuacucaggaggcugaggugggaggauugcuugagcccaggaguucaagacugcagugagcuaugaucacacaacugcacuuaagccugggugaaagaacaagacccugucucuaaaaauaaauuuuaaaaaguauuucaaaaagcagaaaguaagggcuagggcugugggcaggaggcagaugccuauggccuuggugucugcccaucucaguugcccuuugauccucuugugccuccaggagcuggguggggaggagccagaaccaagcuuaagagaggggccugguggccuggugauggaaggacaucucuucaaacgggccagcaacgcauuuaagaccuggagcaggugaggagaggacacccccaaucagcccgccccacccaaugauguauuuucgagugguaauagcacacuaagcacugcaaggaaaaacagacgaaccccccugccucaguagaguuucauuccaucagcaaagacagaggauaaaccuaguauguaaauuacgugcuauguuagaaggugauagugcuugcuauaggagaaagaugauaaagcaagggauguggggagcuggguagggguuacaguucuaaauaguugggcagugugggcuucaugagaagguaacuuuugaacaaagacuugaaggauaucugggggaagaaaguucuagacagaagaaagagccagugccaaggcccugagauagcuggggaguuggaagagcagggugguggcccugggucuggacagagugagggaggaggaugugcaggagaugaaaucggagcuaaugggggcaugagucauuauagggcccuauagauuuuuguagggauuuggggucuacucugagagcaauugggagccgcuauaggguuuggaacaggaugguggcaugcugugacuugacuccuuucccuucuagggccacugcuagcccacaugggaucucuguacaaauuagaaaauggagcugcuuccccaagauacucuuuuuucuuuuucuuuucuuuuuuuuuuucuguuuuuuuugagauggggugucacucuguugcccagccugcagugcaguggcgcagucucggcucacugcaaccucuauccccugaguucaagugauccucccuccucagcauccuaaauagcugggaccacaggcgugugccaucacgcucggcuaauuuuuguauuuuugguagaaacaggguuucaccauguugcccaggcugguugcaaacuccugacaucaagcaauccacccgccucggccucccaacuugcugggauuacaggcgugagccacuguaccuggcccccaagauucuuucuuuucuuuuuuucuuuuucuuuuuuuuucuuuuuugauggagccucgcuauguugcgcaggcugcagcacaguggugcgaucucagcucacugcaaccucagcuuccuggguucaagcgauucuccugccucagccucccaaguaggugggauuauagccgccugccaccacgccuggcuaauuuuuguauuuuuaguagagacggaguuucaccauauuggucaggguggucucaaacuccugaccucgggugauccaccacccccaucagccucccaaagugcugggauuacaggugugagcccagccuaaauaguauuuuuuaaauuguagcaauagacauuuuauuagaaaaagaauuuuacugccaucugcuggaaaguugucuucauaacuauaugaaaucuggguuguccaagauaggaauagcauccuuuagauguuccaaucugcacaauuguccacccuucucuggaaugucucguggaacagucagcccaggugucuguccucucaguaagauccucaugggcaaaaagcacagccucucuuccgucccucauccuaaagcugccuaugucuguaaugauuuccuucucuuacagacgcugguucaccauucagagcaaccaacugguuuaccagaagaaguacaaggugaguggaccuggguccuggaugccugggccccagggagacucagcucuugccugcagcuggacaucuggccccuuaucaccuuauccugccaggacccugugacuguggugguggaugaccuucgucucugcacagugaaacucugcccugacucagaaaggcgguucugcuuugaggugguguccaccagcaagugagugcaauccccaggggugauacucuaauauaucuaaacaacugccaaucugaaaggcagggcccaccacaauggaggccccccaugcagcuccagacuuuaauuuaauucuuuggcggcuggacuggggggccauuguggaagaggguacagggugaugggggauauuuaggagaauauuaccaacugguacagaagucuuucaaugcaacuggaacugguugaauacuggcugaaugucagucugcccaugcugccacuuugcuucccaggccucagaccccucugccaucucccucacccuccuaccuagguccugccuccuccaggcugacucagagcgccuccugcagcugugggucagugcugugcagagcagcauugcuucugccuucagucaggcucgccuugaugacagcccccgggguccaggccagguaccuuaaccugggggugcggagccaggcugccuguggagauggggcacccuuuacccuaggccccuuggccacccuuucuuccccucucucccccagggcucaggacaccuggccauaggcucugcugccacccugggcucugguggaauggccaggggaagggagccugggggagucgggcacgugguggcccagguccagaguguggauggcaaugcccagugcugcgacugccgggagccagccccggagugggccagcaucaaccuuggugucacccucugcauucaguguuccggcauccacagguuacuccacaaggcccaugcgggagccccacuccuucgggccacagugcggcuccaauacagagcgcaucacaccggccccucuuccuucccuguccuggcuuccucucuuagcuucuggcuuugucacuggguaccaggccugggcccaagccucuggggugccaguuggacccaggcgggccuagccccucuguguccuagucuggccagaauugggggauacccagaauuuguuggcuugguuggaagaaguguggggucaaggcugcugagggugggggagccagugaagacuaggcagagaaacggucaugaggccuuagcaaguaucuaaggcccucgccccccaccucagugugguggaagggaggugacaugggagagguuguccaggccaaagugucacaagugucacuagagaagggagguggcuggagugaugagggccuugaaaugaaaccuaaggaagaaggaauggugacgaggcagaguccugccagggccaggucaaggcuacauggcgguuacauggccgcagcugcccugccuccugggccagcaccucugcacgggcccccaugccagccuugccucccagugucuucaggagcagcagcagcuccccaggccacugccccccugcacagggccugacccucccccucuggcccuccaggagccuugguguucacuucuccaaaguccggucucugacccuugacucaugggagccagaacuagugaagguaacuuagcguauugugaagauugggggcaagaacuugggguggggcaaggacauggcggugcaggggcgugaucccugaggagucacucacccccaccuucccugucucugccucugccugggccuccugaagcucaugugugagcugggaaaugucaucaucaaccagaucuaugaggcccgcguggaggccauggcagugaagaaaccagggcccagcugcucccggugagcuugggguuuagccucccaggggaaugggggaccccuggagcagaagagggaagacugcgugcuucuccccucccacaggcaggagaaggaggccuggauucacgcuaaauacguggagaagaaguuccugaccaagcugccugagauucgagggcgaagagguggccgggggcgcccaagggggcagccuccugugcccccaaagccuuccaucaggccccggccagggagcuugagauccaagccagguauaggguugguugggcauucauugagcaucugcugugugcucggcaucgugccagguagcgccgggaggcacagagugugaagcccaggccuuccgcuggacaaugucggagggaccggacugccguuucagggguuacgguggagugugacauuaagaaugagaaggaauguggggcugggcgugggcagggaggguaaggggugccaacagcacaagaaaaggagagagagaggggguggguuuggcuggagcgucagggguugagagcugaggccaagugugguuggaccagaugaggugaugaugccgucucucccccacacccuagggacucguacacaugcauacgcauacuuacacauacccacacuugcaucacucuauucccuccacagucccaagcuccccaucauuuagaagagaccugucccauuauagcauugggacacugcugaggguuuucuucccagacucggagcugcuucccccuaacagaaccaaaucccccgaacagagccccccucugaggaccugggaagccugcacccuggggcccuacuguuucgagcgucugggcauccuccaucucuucccaccauggcugaugcccuugcccauggagcugaugucaacugggucaaugggggccaagauaaugccacaccgcugauccaggccacagcugcuguaagagcccugcugaccucuccaccccacccuagggcucugacaccuacuccugacucugggcccugcccuuaccuccuuuccccaccaccuguucccuagggcuuccacccauagggagagaucaacaauagagacugguugcuaagagugugugauuuggaggcagagaaccugaguuugaacccaggcucucaccucuuacaggagacuuuuuuuuuuuuuuuugagacagucucgcucugucccccaggcuggagugcaauggugcgaucucggcucacugcaagcuccgccucccggguucacaccauucuccugccucagcugccugaguagcugggacuacaggcgccagccagcaugcccggcuaauuuuuuguauuguuaguagagauaggguuucaccguguuagccaggauggucuggaucuccugaccuugugauccacccgccucggccucccaaagugcugggauuacuggcgugagccacugugcccggccuacaggagacuuuuaacaaguuauuaaccucucagccucaucuguaaaauaguaacauaccucaaaagcuuguacuauggauuuauauaugaauacaugcaaagagcuagagccaagccuagcuugguuacaguuagcuguaaccccuuccacacuccugauuaccacacuccacccucccauucucugaacuggcgccacccuaagacaucuugaaauccaccacuagggaugccacccucaaccccccuucucgacuucuccaugcagaauucucuucuggccugugaguuucuccuccagaacggggcgaacgugaaccaagcggacagugcgggccggggcccgcugcaccacgcaaccauucuuggccacacgggguagggaugauggcauggggaggaaggcugggagaaguugggcggccggcugacccuggcucuucucuccaggcucgccugccuguuccugaaacggggagcugaucugggggcucgagacucugaaggcagggacccucugaccaucgccauggaaacagccaacgcugacaucgucacccuguaagaaugccugaaggggcggggcuggcgcugggacuccccccacccccgcccacccacguucgggcgggcgggcggggcugacgccgaaacagaagccugugcuguggggccucggaaaggggcugggccagcgccggggccaggcucgagaaaggcugcgcgaagugugcacugggacguggaguagaaggcaggcgggagggcgggcagggugcaaggaugcuuggcccacccugagaggcguaauucgcccaucaacauugcugucaggcaucuuuuuagcacuagacgugaccccgggggugggggcagaugaacggaacgcaacccagcucaaaggaugggaaguugugggggaggugaggauagucuuuuuuuuuuuuuuugagacggagucucacucugucgcccaggcuagagugcaggggcgcgaucucggcucacugcaacccccgccucccggguucaagcgauucuccugucucagccuccccugaguagcugggacuacaggcgugcgccaccacccccggcuaauuuuuuguauuuuuaguagagacgggguuucaccauguuggccaggacggucucgaucuccugaccucgugauccgccugccucggccucccaaaguguugggauuacaggcgugagccaccgcgcccggccaaagauagugucguucauuucuuaauucccuccucuucaggcuacgacuggcaaagaugagggaggcugaagcggcccaggggcaggcagguaaagaauacacccaccccaccccccaggcccaacaccugaacucugggcuucugguccacggugaccucucucccuagugcccagcugcauucauuccguuauuuaacaaaugcguauugggcgcaugcgacgugccaggcccuggcaaggcauaggugcuggcgcagugcccgcggcgcgcacguucccacccaggcucggagcgcgagguccccaggugggccccaaccgccggauccugcccuucugcacuggggcccagccgccucccggccuuuccucccucccccaggagaugagacguaucuugacaucuuccgcgacuucucccucauggcgucagacgacccggagaagcugagccgucgcagucaugaccuccacacgcugugacccgaggcccacggggcccgcgccugccucccuuccccgccaccgggcccucugccauuaaagccuccgugcuucgcucuucccuucugguucacuucuugggcgccaccuucgggcccguaggguguugggcgcugcggcucccgaggugcggggagcagcuggggguuugcgagcuccaguccagcaaggugcgacuccggggagcgaggcggcagcuucggccgcggccugagcgcagggcgcugcggggcgggggcucucgggcuggggcgacguggccagcccaguccugccgagggguggggcuggcccuggggcucgcuggccccgcgccgccgcggagagagcgcgcccgggccaccccggcuggaaggcauccccggaaugcggcggcucagcacccgcccccucgggaauuccccgggggagccgcugggagggacucggcucccgggcugggccggccgggccucgggcucugagcggugggauuagaggcuccagccccgccgacuugcagacgugagaucgggcacaccugagcggcggcggggcggucguggccacauccggggcgacgugccugagucaccccgucccgccagcgucugccaguccagccaguccgcccagucucucgcguccgagacucgccuccagccucccaccuccgcccgggccgcgcgagccucgcgggggcgggggcggggcgccaaggggcggggcugucucuuaaagggccccgggccgcugcccuuaggccacuuccugggggcggagaggaccucagcggcugcggcgacacccagggaaggcggcgcggccgggucccgaaacuccuggcuguuuccaucagagcccucggacacucccagcccgggcugagcacgcaucgucgcuccccggcggauacaagggggcuccgccauccgcucccgucaguucggccuccaucuccugggacccgcgccggcagccaggccaggccucugaguggccccagagcccuggcuggacucguccacggcggcagcgaucugcccggggucucggaggccaucccuucagagucggcccugugcucgccaccgucaccugcugguuggauuccggaaacccacugucugaagaccacagaggggugucgcugaccaccccaaaucggauacguccagaccucaagcucccuuccccucucuggcugcccucugcucuuuucaucucuucucucaaccuuuuggggauuucuguguccugacaccaccuccccauccaccaccaaaguagccggggugagccccaaaccuuacugggugugcuccaccugugccuccaacccagcgaaucugacagcuucgacccaauucugcacacacccaggaaguucugccuuuucuuuucuuucggugucuccuguacuucccaaaauuucuccuccuccugugcccucuucgccccccuccuuugggggccccgugacccugaauguggggggcacacuauauuccaccacuuuggagacccugacccgcuucccagacucuaugcugggggccauguuuagggccggcacccccaugccccccaaccucaauucccaaggaggcggccacuacuucaucgaccgggauggcaaggccuuccggcacauccucaauuuccugaggcugggccgccuggaccugccccguggguacggagagacagcgcugcucagggcagaggcugacuucuaccagauccggccccuccuggacgcgcugcgggaacuggaggccucucaggggaccccugcacccacagcugcccugcuccacgcagauguagaugucagcccccgccuggugcacuucucugcucgccggggaccccaucacuaugagcugagcuccguccagguggacaccuuccgagccaaccuuuucugcaccgacucugagugucuaggugcuuugcgggcccgauuugguguggccaguggggauagggcagaggggagcccacauuuucaucuggagugggccccccgccccguggaacuccccgagguggaguaugggagacuggggcugcagccgcuguggacuggggggccaggagagcggcgggagguggugggcaccccaagcuuccuggaggaggugcugcggguggcucucgagcacggcuuccgacuagacucugucuuccccgaccccgaagaccugcucaacuccaggucucugcgcuuuguccggcacugaggaugcuguucucaguuugacuguggggaggagagagaaugggguacuagcaccccugaagccucuuuccagcucugcuucaggagcuaugagagucgggacucuccugcaccugacuggagcucagaugugggcaggaauucccaaaccugagcccaccaaggacucacaagugguccagaaggucucaaccugugcugacccugggagggguagggaagguucucucagcuuguucuugccuaaggcugagcaccuccagucucuccuugauuuggagcucaguguuuaagggcuuggaaaaggggggaacaucucuuuacccagacuagaccuagcaaaacccuggaaggauauugaggucuggggaaaagggaggacuuugcauuuucccaaugcggucucuuggaccauggcuucuacuccugaagcuggguggccuggccuggccugaccaaugagaggccagaacacucuggaacaucggaagaggaguucuuugcuauguuccaagccaucuacugagggaggcagaaaggccacaacccacccuagguugauguaugggagcuaggacaguccccauggcaauggggcuggagcaucccucaucuggaagaaucccauacugauggcagggcuggccagggggaagaggguaguaucuguggguccuggccuuucuucaugugugcgugcauaucagcccguguggcugacugauguauaggucccuggcauccugguucauaucuguguugcugacuacagugucugugauguccgcauguccaggccuguuugggguugccuagcgacucuucuggcacagggugugucugugguauaccugugaggugguugacaauuaguaguuuaaucacaggguguguguguguguguguguguguguguuuaugugcacgcauguauaugcaucaccacguagccaggaggggccuguugggguuugagucacugggaucuuccuggugagagguaagagaagucacugggcuuagcugggccucugaggccuguauggaacucuugguugcugaggcaaccauggaccuguugcuaggagauagcuggggaaggcccaaggccgcccagggcagagagaggagacgaagaguuugggacagugggggaggagaugggaagggaugggauuucugggucccagagcgggugggauacucacgcacagcuucuucacuggugggggguggggcacacauuauuucucacuggucaugauuuacaagaagaaaaauaaaacugcuuuuggaaccacaaacuugugaaggcuguugagggccagguugggggugcuguccccucacaacagaagcccugcuuucucugcccaucgccugcuggagaugccuucuggaccccaguuccuugagccccagcuuuaccccagcugaggaugggcagugccauuguucauuguucuggaacauucuagaaccuccaggcaagggcuggagccagggcugcagagcauuccucggcucagcuggggcagcgccgccccaucccccagugguccucauguggaggcuggcacuaggcgggguuuuccuggcagccgcccaggcuugugucuucugucgccucccagcccacgacuugucaggccgccuggcucggcucugcagccagauggaggccaggcagaaggaauguggggccuccccagacuucucggccuuugccuuagguaggaccagacauccagggaugggcccagcaagcacucaccccccuacccccagaggguggcaugugaccuuccagcugugcccuccaucuguggcccuuucuggacaugcuggccuuucccucugagagagcuccauaucugggaaagucaggagagaccccagaaccugggcugaugagggaaucgcugguccuugcccaucuccacagaugagguguccaugaacaaagucacagagaagacucacagaguccugagggucaugggugaggucaaggggaaagagugaccuaggggcuugggaggauaccaaggagagggacgggugacagggguuggggugggcagggaaggguggagggguagagacaggagggcugaucagggaggggcugcgugaagagagggggaacuggccccgucgaggcccagggaaacggagcugcugucugccuccccagaaaucaaagaggcugucuccucacucccuucauauuggaguuggcuucgaaagaccaagcucccugaguacaccagggaagguaccgaugcgggaugggccucaaggggagccuagggucuuaaccaaaggaauguguggugagcagcucauccauucacacccccaccccuuccuugucuuucauuucagcucucuguccccccgccugccgugaguaggaaaggaaagggguagcaaggaccuggggccugcagggugucagaggagggccuggcagcugcaggaggaagcuggguaccaggcaggguggaggcccggccuccccuccccagcguugccucugcugucuccugcagggggcagcaccacgcuguacaacugcuccaccugcaaggggacggagguguccugcuggccccgaaagcgcugcuucccagguccucacgcccaucuuggccccgccccaccuugcccagaucccugagcccuugggcucccaagucggugcgugugggucccagaaucauucacugccuccuggguucccugcaggaagucaggaucuuugggaagccaagauucugcuccucuccaucuucggagcuuuccugcuucuggguguucugagccuccugguggagugaguuuugggauaaagacaggaauccuaccccgcccagugccuuccaccacccauccucccucccucugucccucccaggccccucccguaggcuucccacccucgucuucccucaggucccaccaccuccaagcaaaaaguggcuugugaa

SEQ ID NO: 16657 - RNA, 5506 nt, Homo sapiens
aaagaaaaucuuugggugggacacaaaggaaaggggcgagcggagggacccccagcccgagucucuauauagucuugauuccgcccgccgcagcucuggagcaggggagaaguggacccgggacugagcccgagcauccccggccggcagcggugggggcggggccaggggcggggcuacguggagccgggaggcgggucaggaucgcugagagcagccccccaguggggccauggagaagguggagucccuaggggcugcuggcggccucaaccgggauuccccuggaggggcagccagaggagugcccgcagcggucacaggagucgaggcaggcgcugggcagcccuccagaguagucuuguuucacgguucugggccccacgugcacucagggggcuccguaacucauaguacugguucaagcugucccuccggggggauagugguccuugguuccgggcccagucagcacccaagggaggcugcgaaccacagccuugggucuggcaggaacccugguggauucaacauccccgggccucgaaccaguguauccagggcuuccagccccgggccugggggaccugcagggcaagagguaaacagccccgggugcaguccgcacucugggccaacuugcuugaacccccaaaacucccaacaggaccggccccggagcauccuacgaaagaacagcuccaacuugaugcagaaaucccccaauguggagaaguaaggagcccagcucugcgggcagccagcccagagucgggaggguucaggacaccugagggugggagccagaaggaaaggggcagagccuuaagaaugaagaguuagaguaggugagggcaauugagugggaaguccgagguuccaggcuuucgggagaagagcaggugccccauaaaccguggcugcacaggacugugauuaucauuaagucugaccccauccccagccucaacaagguauaagaaaccuguuuugagucggaguggugacucaugccuguaauccuagcacuuugggaggccgaggugggcagaucaccugaggucaggaguucgagaccagcccggccaacauggugaaacccugucccuacuaaaaauacaaaaauaagccgggugugguggcaggcaccuguaaucccagcuacuugggaggcuaaggcaggagaauggcuugaaccggggaggcagagguugcaaugagcugagaucacaccauugcacuccagucuggaaaacagagcaagacuccaucucaaaaaacaaacaaacaacaacaaaaacuguuuugaaugccacgcaggguagcucaugccuguaaucccagcacuuugggagugcgaggcaggcagaucacgaggucaggaguucaagaccagccugaccaacauggugaaaccccaucucuacuaaaaauacaaaaauuagccaggugugguggcgcacgccuguaaucccagcuacucaggaggcugaggcaggagaaucacuugaacccgggaggcagagguugccgugagcugugaucgugccacugcacuccagcuuggucaacagagccaagauuccaucucaaaacaaaaacaaaagcaaaaaacaaaaacaaaaacaaaaaaaaccuguuuugaaugacugggaaaaugagggaggccuaugggggggucauuagaaggucuccucccccagccccagaaggaagucucagcacugggacgagaugaauauccuggccaccuaccgcccugcugacaaggacuauggauuuaugaugguggaugagcccaacacucccuaccacaggugcugagcccucagccccaacccuucaguccagagauucuucucuauuuaaaggaggggacagguggaggaggcagagcgccucagggacuggauacugccugacacccaccucccggcacugcuucccccuccucugcaggcugcaggacaguuuugaggaccucucugccggcuccuccugcucagugaauccuggagugcuggcagagagguaagaguccugccagagaucagccggguuauggggccucuuccuucccucagcccugaauucaggucugcagcgggucugcuuucugacaccugcagugggaggugcuacaauuuccaucaggccuggaugggggcagggguccgccaauuuggccucguuuaccaccuguccccauugcuauuuucuucucuugaugcccccaacuagucuccugccccuucaggauugccaugauggacaguaucugccccagguuccgccaggacugugcugacaggagcucagggccugcagacaacuuuuccaagauacaugauguaggguccagcccuauggggcuuagcggguguuccccaccgugugcagagacgagagauuguaauaaauuaagacacaagacaaagagauaaagagaaagcagcugggccugggggaugacuaccaagacgcggagaccgguaguggcccugaaccacugguugcgcugauauuuauugcauacaagacaagggggcaggguaaggagggugaaucuucuaagugauugacaaggugcagcaagucacgugaucacaggacagggggcccuucccuuuuagguagccgaaguagagagagaaggcagcauacgucagcguuuucuucuaugcacugauaagaaagaucaaagacauuaagacuuucacuauuucuucuacugcucucuacuacgaauuucaaagaggaaccaggaguacgggaggaacaugaaaguggacaaggagcgugagcauugaagcacagcaccacagggagggguuuaggccuccggaugacugcggggaggccuggauaauauccagccuuccacaagaagcugguggagcagaguguucccugacuccuccaaggaaaggagacucccuuucgcgaucugcuaaguaacgggugucuucccaggcacuagcguuaccgcuugaccaaggagcccucaagcggcccuuaugcgagcgugacagaagguucaccucuugccuucuaggucacuucucacaaugucccuucagcaccugacccuauacccgccgguuauuccuagguuauauuaguaaugcaacaaacaguaauauuaaaagcuaaugauuaauaaugucuauaauaaugauugauaauuguccaugaucaucucuauaucuaauuuguauuaugacuauucuuauucuaacuauuucuuuauuauacugaaacaguuugugccuucagucucuuaccuuggcaccuagguaaucuuucgcccacaacaugagaugaggguuguggauugaauggaaagggggagguggagcgagccuuuggcaagagugcggugggaaagccaagcucucaccauggucacagacuccaccgacuuugacaagcgccgcaaggcacacuaugacaaagggaaguuucucaaggcucagaaaaaccagcccuuggagaaugaagaggaugaggaugacaauggugguauuaucaguaucagcgguggcagucaaggcgugaugcuggacccagagcccaggccugugcagagaggcuuggcaggagaacuagccagaggagccaaagaugagccaggccuggucaccuggaggcacauccuugaagccgaggguuagcgauggcggggcuccagggacuagaggggguuguauuccagagcccguuccucacuucucuaccacagucugucuuccucaguggcuaucagcccaagacucugcugccugacagggagguaaugcugggaaguaaccccagggaagaaagagggcagcuggaggaaggaccccacucaggauaguccccggagauuauuggcuguugaggaacagaaagucugauugggggcugauuuguuggccaggcccaguggcucacuucuguaaucccagcacuuugggaggauugcuugaggccagaaguucaaaaccagccugggcaacguagggagaccucaucucuacaaaaaaagaaaaagaaaaaaauuguuuuuaauuagccaggugugguggcgugcaccuguaguccaggcuacuggggaggcuaaggugggaggauagcuugagcccaggaguuugaggcugccgugagcgaugauggcacuaacacauuccagccuggguaacauagcaagaucuugucucaaaaaauaaauaaaaaaauaaacaaaaguccgagacaaccauggggggagguggagcggucacugaaguuuuucuaaaaugggaaggguaagagaagucagugagaugaggaucuggggccugagcuucuccccucuggugagggcccacaacagacaccugggaggcauggauacaccagauggcuagaagacuuggauucauuugauugauuccucagauuccuccaccuacagaaaucaguccccccagcuguggccacuaucauauuggggcaggagauugcucugcagcacaaggaauaugauggcaaaggacuauaccugagguccugcucccacccagagcuuguagaggacguggaagaugagcaucaggauggugagaaccugggcaggccagccuagggggcaggagggcugggaaugcacagccugauggguacccgagcccugaucccugauucuaggcuccacaagcuugaccuaggugauugagaaccccguaagcacugaaguccaccuacuggaccacaugggaggccccuuuagggaucacaaggccacggagagcucccugauggcaacaaugacaacauugcagccuguugagggcaccaggccaccaucucccuggggcugucucuuggcaagcucccaucucccagcccuccaauucuuucaggccaguacaucagcaacagguggaaggagaggcccugaacagccucaaguccaagguccacauuggacaggcgaggaaccagggagacucagaggcgguugggacccccuccagcuuggcaccacacacuggcuccaugccuccuccuucacuccucugccacaccaccccacuccagguauuucucuguccuccaaagacagugagucucaagugguguccagcugguggcuggggggcugagcuggcaaagcccaaggaguucagagagggagaguggaagcaaccccaacuccucaagccagaacaagcacagccuggcacacugagccugggcagaggcaaggggaugcauacacuggccagggagguagaggagcugaguggggagguucuaggggauccagagucacauggacaagaucucaugccugcuacgagaaagccaugaacucaaacucuucucuccagaugaaacccugggacuucaauggacucaagaaaaggaaagcaaacaauggaaaauggggcugguugggggcggagugggggcaaccuucccuucaugaccacccuaugaauagaaauaaagagcagaagagcaagagucugggagcugu

SEQ ID NO: 16658 - RNA, 2730 nt, Homo sapiens
gcaguggcagguagauuuuauuggccugggacacacaggggauacccucacccacgaugggguggggggugugguguugaagauauaaucugauggucacuugugguagaaucgcggguucuggcuguguuggaugaaggggagccgagggccagguuggcugguagcugcaaagcccgacuggugguggugaugaaaagagggcuuugucacugggcauacucucccuuccacuuaauacccuacugauaaccacccccaaagaggaaggaaaaaccagaugaugugggccaccuguccuaccuaauccugcuuuuccggaucccuaguguagggauucugacagguaaauucuauuaccauucuuaccuuuccugcuggcugcaucugcacagggagcuggggggaagcaaggaguccaggggcuggaugcagagccugggggugcauggggcgcagagaggacugcagagaacagagucagggccugaggcauacugaagcuccccuuaacauaucccuaacccugaccucccaaggugccauacucacugagucggagaagccagucugcugguuagcauguuccaucugcuuuugcaaggacagggcaccaccaggcuggaggaaaccuagguggggaagaggggcaugugagaugagaaugaaacagggaggggaggaccugagagcuagagcuccugcaugggauguuaucaccugucugagugggcugaaaguggccaugcacagcauagggcuguggcuguggcugagauagguacugcacugcagggaaugccgaaggagcugagaaaggaaaagacagagccauuaaaaucuuuuacugaauggcauuccuccuuugaccuugaggaaggccaagccccaucccuccuauuacucaccucugagcugcugacuaggacuauaagcuggcugugugggcccauagugaggugggggcugagcagucccauaggcaccaccaggacugccuuggaauuguccaugcucuggugucccugcaaaagcagcugcugagcccacguagugccgggucuaaggaaggagaaugagaacucgccuacaaacuccuugaaagcugaaacccagugacuuguguguaucuguaugccccguuucccccuaaacuuaagugcuugauauguuugugacuugaauacugguggcaaggaugcauggauggaaguacuaggggcuaggcauccaauccuacucucaccguaagcacuugggguccaaacauuuguuuggcucugucagcugccaugagggugccugggcgauuguguccuccagggcucccuagaaagggagaagggcuucaugaugcugaaaugggaggcugugaccuccaagaaggccgguuccaucuggugguuucuuuaguccucacccugcaugcugaggagaugaguuccugugugaacagucaggcucugcugguaugcagcugauguuaggguggucaggucacuggagugaaaggaagacaggucaaagucaaggacagaugccuucucuuuugccauuaaacacugguucuuuuacuaccugaucccaguuccacuuggcccccauuucaguuuuuagcacucugaucccaccucuguuccuuucgccuccguuuuucuuccucauguaaaacuuucuugagcugcaggaaaagcuggugcuucucuuccuguagagccaaaagcuucuccuccaacuucagaaucugggauggggugggaaaagaagaugaaggcagggagagucaaacgaagaaaucaaagcugggaaaguucaagggacugcuuacuuguuccuuggucuccucuaaugacauucucucuuccaucuccuuuuucuuccuucucuccuguucuuccuucaucuucuguuccaucaucuuauccaccucuucuuccucuggagaaucaggcagaaugaagaagaggcaggguagugaaaacaauuccaacguuacagauugaagaccagcaaaacccagucaucccaacacgccuguaugcucuuugccucgaggggacaagcuccccaucgcggcaauagggaacggaaaggcuuuaucaggugcucuccaagguccuucccaucucaaggguucuggagcguggaacaggacgcuuaaaucccaccacaacggggcuauuccuucccuccucugcgcucggcagcgggcgcgcugguuggccgguggguugaggccagccuugagguacaggagccauucugggccgugcgucccccugcuauggccccggcucacccugccgcuugcgcucccgcuccaucauaaugugccggugcagcgcccuggccauggcguuggaaagcuuggggcgcuccaggagugcgggcauggugcugccgugggcgcucgggccgugggcgcccggcugucucugacugccagaccucagacggggccugcggggaggcgggcgcucagagggggccgcgcccggcccaggcggaagcccguccgcccggcccgcucgccgccccggucacgugucccaggagcccgccacccggccgggaccgcagccccagucccaccgcgcgcgggcggcgccgggguccccggcucgcugcugccgcucccugcccagccagcgcggacgacugcccuuccuacccgccuucucugcgcuuucucagcggcuccgacgcgcccuggccccugcgucacauccg

SEQ ID NO: 16659 - RNA, 6249 nt, Homo sapiens
gacuggcuucuccgacucagugaguauggcaccuugggaggucaggguuagggauauguuaaggggagcuucaguaugccucaggcccugacucuguucucugcaguccucucugcgccccaugcacccccaggcucugcauccagccccuggacuccuugcuuccccccagcucccugugcagaugcagccagcaggaaagguaagaaugguaauagaauuuaccugucagaaucccuacacuagggauccggaaaagcaggauuagguaggacagguggcccacaucaucugguuuuuccuuccucuuugggggugguuaucaguaggguauuaaguggaagggagaguaugcccagugacaaagcccucuuuucaucaccaccaccagucgggcuuugcagcuaccagccaaccuggcccucggcuccccuucauccaacacagccagaacccgcgauucuaccacaagugaccaucagauuauaucuucaacaccacaccccccaccccaucgugggugaggguauccccugugugucccaggccaauaaaaucuaccugccacugccccuggcugcugcuguuuguguugccucccacccaacugucuggaauaggucaagguugcuuggaggguggggggauggcuggcagguccacagcaagucaaagugauagacagcggguuccagugaacucaguggcagaguucagucuuuuuguggcuuccaaauacacccauuuaauucaaauaagcagcugaguugggggcuucauauuaaacuuguaguuuuauucagguuugauuuuaacaaaugugucggggagagagcccgcagggaaggguaaagcccaugggggcagggcccucccagaugccugaggagggggcagguccccuccccucuccuccucuucccuccccaucuaaagggguuuggggagagacacaggcaggcgagggggcugguccccagucuguugggguggugcucaggguaaagggcuauaggcaacaggggaccagaccagggaugaguggggagggcacaaggaccauuugccagaauccaccgcuuucugauuccagauugaauuaaaaaaaaaaaaaaaaaaaagacuaaaccacaagcagcacccacccccuucucccccaccagggcuguagugugaggggagaagaggagggcagcuucaccaaggccacagcuucgcucgcuccuggccaagggagcuaggugaagggcaggggcuccccgacagauugaggggguggggaaaaccaaaauaaaacgucaaauaaauuguguaggaggaguccagcuuaggaccgggccagagccaggccaggcucggggagggggccucugcagguucagaggaucacugcugccaccaccgccacccuagguaggagagagaaauuaguaagacaggauaauaccuucaacaggaaggauagggaggacagagccaggcuaggggcagaaaguaagccugaaacaauuaagacuacagcagcucugcugaggacaacaaaaugugaaggggacagugagggauuugucacacucaccugggagccaguuauuuugccauggccuugauugcaacagcugccuccucugucauggcagacagcaccgugaucuggagaagcaagagggauagccaagagaugucugagcucaggaagaaacguacagaacaaagcugagcacagaagcagggagggaggcaccauaccaggaucucuucuccacagucguacuucugcucaaucuccuugccaaggucucccucagggagacgaagguccucucguaccuccccgcuguccuggagcagugauagguacccauccuggaugccaaucagcugggggcagauagggaaggaggcugaagguaguaggcccagggaggcugacaugacaguaaaggcucugauagacaaacuggacugauagcaaacuaauaccaaacacccucuccugccauuucccuccucucucccagcacaagcucuccuggucagucccuaucccccaaccccucccuccaccauaaaccgcuaacccauccucauccagaccaucuacauaccuggaagucauuccuuuugauguuggggacauccauauuaugaguugacgggcagauaucuucauauuucuucccaguaaagaugucaauaccaaccagauggaccuguauguaugcaucacaaagagaaacccaaccaaacucuaaaacggaggaaauaaaggcucaaauugaccuugccugaugagggaagucagaauuacauuguuggggcaaagacuggaguguuggaauugaaccagucaacucaagaaacaguaaagccucuuaaagaaaaaaaacagaggcuaaaaaaccaccguugagauugggguugacagcacaauagaaaacugcauggcaggcuuggagaagacaguuaccuugauaaaagauaagaugcuaagagucuaggggagugggaggagucugaguaaaaguuucgaagaguuuuccggacaccaggagaaggagcugagaaacuggggaauaaggaagguagaagggaaaggauaagaaacuaagaaaugugaaagagcugaagaaaaggacuugcagggagaucagaaauaacuauguagcuagaaaauaaggaagccagaagagcacagagagggauccagacacuagagaauaauccaagaucaaugucaagucaaaagauggaaaaacugauuaaggaaaaacaccacaagaaauucaacaagaacgaaucagguugaaauucuaaagagacaggaaaagucugaggugaugagggaagugcuagcaagaauguuaaaacccaugaaagcauggaggcucaaggaacccaaggagagugggauggggcagguaggggcaguuugauccugcgucagaguuccaaagggaaagcuagaacuggggaacgaagcagcaaggugaccugaaagcucagaauugacgcaggagucccuccaggggaaggcguagaauuggagaaacccugggcaacgugauggaagcaaccacuuaacaacggcucaagggaagaaagaaaaagugaaaaccaagaauaaggaaggagcaacugaauagcuagagcauaaaggccuaugaauugaagagauuggcacaaagcuggagaaacggagggacugccagagaaugaugcggggacagaaggguaaccacagaagaggcugaagacuggggagcagguguaguugucugaauggguaugaaggcugagcgcuaaacaaaaacaaucagacaguaaaagcagaguuaaaggaaagucagcacuguuggcagcuugcugcugggagcgccaaagauacuggaggcauggggaaggcaagaugcggaggugaaauucuaaccuuggcguggccgugcuugccagucuucgaaguagacaucucgacgaucuuacauggccggccuuugagcaccacaaagccauucuuacguaaugcugagcacugcauugggaagguggcugaggccccugcaucuccugucucgaaguccaagucaucugccauuuuaagaggcuucgauuccaacuagagccaagaagagaacugaagugaauaagcauggaggucaacaggaccuccaaucuaucccauuucucuccagaaacauuuucccaacucuuuauuccauuacccaccuaaaauaaagucaaaguuccugaacuuaaaauacugacugggcucaaauauacucaagaacugguguguguaugggaggguggaauagcugguuucucccccauaaaucaaagcuaaagugguggcuugggaaaggaaggcucuagggagcuggaaugucaaaucucagagaugagaaaaggccuacuuccugggaguggggaggacucagguguuacuugccacugaaaccaaccaccccucuuccccacauauagccagggcuauaauuaggugagcagcuaugauccagcaaaagggcagggcuaauuggggggggggaggguggagaccggaggacaaggccccacccaucuguuacacugcccccccccauccacacacaaaccagucacugcuacaggaaaccacaaggccucuuugggggauucccgccucgccaacaugcacuugcaacaagccaagggggagaaagcaaaguuguuuccgaaaugaucccccugccaaacaccucgaucuugguucccaaagagaacccaggaacccagccucuccuggaaggcccucccacuuuucccaggaugcaucuguccugucggcuuuucaggccgggccaguacagucaguagaaagugggagaggugggggguggugaaugacaauaaaaugaaagcaaaagguugguaguagugaguaguagaaaaucauacuaggcuaguagaguuaaggacuucgaaaccguggaacucccaaaccaguuacaacaggaagacagugacaaggugaagaacgccuaucacggugggaaacucaucugccugaggcuuuuaggcgcuguccacccaggccgacagaaaaguugggcuccuguccaaacgcccuguuuccccauuucuccggccucccagcucgaaggggugccacuuacaccuggcugaccgccacacuucacaggaggguuuuucaggaaagcuccuggggcccuugagguugggaagcgcuaacauaugccugcagcaggcccuccggggugauuaggacccgagccuccggcuuccacuccucaaaaucucaggcccccucggaacccccgcgaggacuagcuccccgcgcuaggggcugccggcuccugccgaccauguggccguuccgggcuuccgguggccgggaccuggggggagggguccccgcgcugccaugcggccccgguccacgcuuggccaugcggccugcgaccccgagggcagccucccguggggggcacuuccggugccgcggccgcccccuccucagagacugcgccaggccggagccacgccgccuccccuccccccggccguccgccaaccccccccaucaugcccucucaccgaauagcccccucccccaccucacguggccgcgcugagccggguccucaacggcccagguacccuugccccggugggccgaucuggccccuggcccucgccccggcguggccgccuggcggccucucccgcguggcugccucgcggcucgccgucccccgcccugcgucgcuccaacgucaccgggccaaccccaaccgucaccccgcgcgccaaccggggcgcgcgcccgcgccucuccucaccucgcgccgcucucuggccgaacccgugcggcggcggccgccgcuccccucugcccccuccccgacccccgcgcaguuccaucuucucccgggcccaagccaagguaccgcgcacacgcgcccugcccgcucucaccucgcgcgaacgcacugacucgaccccguccgcucgccgcgagcccaaccgcugccuccgagcccgcugccgccgccgccgccgccucuaccgccgccgccgcugcugcacacgggucuuaguacgcaggcgccgacuccccacugaccaaccaagcagcccuaugacagccgcgcaagcgugcuaucuaucuccuccgcccuccacccccgcacugcgcaagcgcacacacccuacccaucuccacccucccucccaccgacccguccaaugacgcgcauacgugaccccgccccucacaaacccugagcguuuucaacuaaucugcaacgcgcaggcgcacccgguuuuuuaaucucuucaaccucaucuucccuccccuugauagaccgcucguccuaccgggcaguccuugcgccugcgcaauaaggagcccugcacuccacacccucuaaaggaaacgccugggucucagaacgcaugcguguucggaauccuaaacaaccccuuccaccucagacgccgucaguacgccaggcguugaaaagaccacgccgcuagaucacuugucucgucuagaacgcaugcgucucaggauacgccccaccucggcuuuaacuggacuuaaacgacucacacguuucagaaaacuugcucuguggggugggcgccuugucuuggaaucaguccccccaguuccacacaugcgcgggagaugucuuuccgccccacucuucuagcgcgcuaguguggucggguucccacccaucu

SEQ ID NO: 16660 - RNA, 6239 nt, Homo sapiens
gggcuucucgcgucuuuucccccagccccgcuccaccagauccgcgggagccccacugcucuccggguccuuggcuuguggcugugggucccaucgggcccgcccucgcacgucacuccgggacccccgcggccuccgcagguucugcgcuccaggccggagucagagacuccaggaucgguucuuucaucuucgccgccccugcgcguccagcucuucuaagacgagaugccgucgggcuuccaacagauaggcuccgaaguaggauucaucaugagggggcggggcgggggggcacgggucccgcuuuucuugggcuggggucgcgguuggggucagcugggggugguuccugcgcaggcgcagggggugaagguagggggcuggcuauuuauacccggccuggacaacccgugacugugagauuccaauccuaccaaaaggcagagugggucuggagggccuuucggggcacaggcagcaaguggauucugcgagccaggguucacccccuugccuaguaggcggcgcggcgcuccggaaucggggacacccugcccucgauccgacucgggaaagcagauccaggcgggucuugcccuccgggagcuguccguccgucuucgcucacgggcaguguuucgaggaccggaggcucuccgugggcccccacccccacuccuggccgcccuccaggacgcugaacuuucccuuggccccaugguugguggaggggcagaggggacugucagcccccccuccuccagcucagguuuccgcuuggagacagucugugccgccagcgagcggccaccacugccaccgccccucacacuaccuuccugcccuccuccccugggcauggcucucccaggcagaaccccuggacggcccucccugcacggagguuagagggggagggcaggccacgacguagauagagaaggccaccccuagaugaccgggauguccuuucuggaacagcacuucuugguccuguugggggccuccuggagcuggcugacagaacccccagaggggagggaagaggacaguggcugaugauaauaaugcacguguuaauuuaugaaaccagcacugucaaggauauuguuaacaugugauguugauuuucacaacacucucacagauagguaggcaaggcaggcaacaucacccccaucucacagaggacacucagguucggggcagggaagugacuuggccaaggucacacaaaucugagcucuuaaggccaagccugucucaaggucacagaagaauuuugagacaaguucucaaacauuucucugccuuauggacccaaacauccaguuucuccuuuaugcccagguugcaguucagcuccuguuuacauugagaucuuugugcaauuccuaauauggcccaguuucccucacccaacauguuggguggagcccaguaucuucaggcuccagcugggcccgggccccuagcggaaggaaaaaaaucaugguuccaugugacaugcugugucuuugugucugccuguucaggauggggaacccccucagcagcgagugacugggacccugguccuugcuguguucucugcggugcuuggcucccugcaguuuggguacaacauuggggucaucaaugccccucagaaggugagggccugcagcuggcaggguggggguacccaaacgaggaggacaggugucucgggggugguggaaaggggacggucugcaggaaaucuguccucugcugucccccaggugauugaacagagcuacaaugagacguggcuggggaggcaggggccugagggacccagcuccaucccuccaggcacccucaccacccucugggcccucuccguggccaucuuuuccgugggcggcaugauuuccuccuuccucauugguaucaucucucaguggcuuggaagguucgcagcuggagggcaggggugggggaaacaggaagggagccacugcugggugcccucacccucacagccucacucugucugccugccaggaaaagggccaugcuggucaacaauguccuggcggugcuggggggcagccucaugggccuggccaaugcugcugccuccuaugaaaugcucauccuuggacgauuccucauuggcgccuacucagguacucacgggcaccacagcccugccuagcgcccuguucucuuucaccaugccugggcuuucagaugggaauggacaccugcccucagcccucucuucuucccucgcccagggcugacaucagggcuggugcccauguacgugggggagauugcucccacucaccugcggggcgcccuggggacgcucaaccaacuggccauuguuaucggcauucugaucgcccaggugaccggagcaagccucaugggugccugggcagugguuagaguggggcucuggagaauauggugggcuuccaagguaaggcagaagggcugagugaccugccuucuuucccaaccuucucccacaggugcugggcuuggagucccuccugggcacugccagccuguggccacugcuccugggccucacagugcuaccugcccuccugcagcugguccugcugcccuucugucccgagagcccccgcuaccucuacaucauccagaaucucgaggggccugccagaaagaguaagcucucccgcugcagccuggcccaggcccaugccuccgccucaucuugcuagcaccuggcuuccucucagguccccucaggccugaccuucccuucuccaggucugaagcgccugacaggcugggccgauguuucuggagugcuggcugagcugaaggaugagaagcggaagcuggagcgugagcggccacugucccugcuccagcuccugggcagccguacccaccggcagccccugaucauugcggucgugcugcagcugagccagcagcucucuggcaucaaugcuguauguguggagcagccuccaggcagggcacagccccgggaggguagacgagaguggggagcaaacccccuccaccaacacccaggguagggccagccuguuguggcuggaguagaggaaggggcauuccugccaucacuucuucuucucccccaccucuagguuuucuauuauucgaccagcaucuucgagacagcagggguaggccagccugccuaugccaccauaggagcugguguggucaacacagucuucaccuuggucucgguaacugcucaccucuggaauggcccgagccacuggcuucaccucccugggugucccggagguccugcucuugguugcccucacccacgcggccccuccuacuucccgugcccaaaaggcuggggucaagcuccgacucuccccgcagguguuguugguggagcgggcggggcgccggacgcuccaucuccugggccuggcgggcauguguggcugugccauccugaugacuguggcucugcuccugcugguaaggccuggaggcuaggaggggcuagcagcccaccccaugggaaugguccugugagucucugugaccagccagggucccuucuuaacacacaugcuuucaauccuggcgccagcuccggaccaggacuggggcugacuggcuccagaaucugcugggauuguggucugcuccugagggauuugggcugcacugggaggcagcuguggcacaacucuggcagccaggagggagagccccugucaagccucaggaacaaucauuccuaaggacccagcuuuagaguccagggagagcugaccgucauaagaacugagaggccauaacauuuccucugccuugaacccacuugggauagccagcagaaugccagucaagggccugcucuaacccgggacagcaggcccccuacaagcugcugcggaggggguuagguuucacuucucugaguugagggcaagggaagaucagaaaggccucaacuggauucuccacccucccugucuggccccuaggagcgaguuccagccaugagcuacgucuccauuguggccaucuuuggcuucguggcauuuuuugagauuggcccuggccccauuccuugguucaucguggccgagcucuucagccagggaccccgcccggcagccauggcuguggcugguuucuccaacuggacgagcaacuucaucauuggcauggguuuccaguauguugcgguagguccccccgccccagccucccacaccguaggccagaggugggcaucacacagcuagcccaccugcuuccccgucagggacuccuccagccacagaccaugggucuuugggucaguuugguggaccaccugcuccacagaaucaaagcaaggaagggagcugaccuagauuggauaguaacugaggugucugaaacgcaccaguggcauaacuuaccuuacuccaagaauaaaaugauacacuuugcauuaauacuacaaacagcugggacucuccucugagugcaguaacugaggauggugaagagggcgaaaacuaagaguguuugggguucagagaauccucuuuucaguguaaauucucauuccugcucauuucccuugucccuggaggaggcagcugcugucugccguccccccagcucccuaugaaggccuuuagcuccugguugccugaaacuaccccuucccuccccaccucacuccgucaacaccucuuucuccaccugucccaggaggcuauggggcccuacgucuuccuucuauuugcgguccuccugcugggcuucuucaucuucaccuucuuaagaguaccugaaacucgaggccggacguuugaccagaucucagcugccuuccaccggacacccucucuuuuagagcaggaggugaaacccagcacagaacuugaguauuuagggccagaugagaacgacugaggggccaggcaggggugggagagccagcucucucuacccggcccagagaccccuuccuuuccucugcagcacuuuaacccucucuucccuauuauuuccggguggaaaagaaucccugcagccugguagaauugggaagcugggggaaggguggucugagcacccccucauuccccucgugugacucucuuggauuauuuauguguugugguuuggccguggccaucagggugggccacucuccccucccucuuccuucccccauccccuuuccuccccaccuuccccagacucagcuccagaauaccuucuucgcugcuagagaagggggauuggagggaagacaggucuagacuuucucagugggacaaaccagagcagagagcaggacaggagacaagaaauccaguuucccaccaccuuggacuccucccacaaucugggacuuucacugaauucuugccacgcagacucugggcaaagggguuuuuuuuuuuuuuuuuuuuuuuuuuuuugagacagucucgcucugucgcccaggcucgagugcaguggcgugaucuugcuucacugcaagcugucucccagguucacgccauucuccugccucagccuccggaguagcugggacuacaggcgcaugccaccacaccuggcuaauuuauuuuguauuuuuaguauauacgcgguuucaccauguuagccagaauggucucgaucuccugaccucgugaucugccugccucagccucccaaagugcugggauuacaggcgugagccaccgcgccuggcgaagggaguucucucuugaccccugcagggaaaaggacucaccucccucacugcaggcucagccuuccagggcaagagggaacaggaaaguaugugcccauguguggcaagauggaaggacggcaggcucccgccucuaggcuuggggcucuaccccgaugguuucccaaggcugccaagaaggagcccuaacuuucuuccucucccuuccuggaagggugcugcauccacaggcuuuugaccaacuaaggcaaagaggggauuugaaaggcugccuggaaacacugggcugggaggagccuuuggauauuuuuauauacguuugaaaaggggauugagagaagaaaccaaaggucgguuguacuaaauguauauauauagauacuucuauaaagucacugcugaagacaagcauccuauuguggagguacuugaggaugggcugagacagggaccauaacucuucaccccucuuccucccucuguccugccucagcucaaggccucagaaucuucuggaugc

SEQ ID NO: 16661 - RNA, 4534 nt, Homo sapiens
ggcuauaaacacaaaagagcccacucugcuuuauuuacaacacgcaggcugucuguacaaacagcggccgauauuauuaaaaacaaaagaggugagugagaaucgucaccuuucugcuuuccuuccucacuuggccaggcucuaguacuccaccuuugagcugccaugcccaauaggggaaguccaaaauuaaaaauacaaccgguguagaagaaaauaaauggggagugaaauagaagaaaagaugagggaggggagugcuaauauuuacacuagaguuuuauagacaacugucccauuccaucccaauuccaauccugacccagaaagugaugguggcagguccaagagacagagauuaugugucgggacacagacagccucccauccccaaccguaauggauucaauuucaaguccacagaguggggaggaaggauagggugggaaagugagacacucauuuucaaacaagucucccuugagaauuccugccuugaagugcagacaguauccaagcuccaggggauaggcugaggacccugaggcucaguucccaaaucauguugucauuuggaaguuccaggcuaaaguuggugccaucagggcucuccagauuugggaggccccccuaaccgccgggccucuggccucaguuccuugcauuucuggcaauaaaagaagucggggacguuggucuucuuaaucuuagcacaggagagguggauccacgucccacacaggcugcacucaaucaugggccgcccugcaaagggcuuucgacaguaacaugugaucagaucccaugagucaucaccuggggaaaaaaagguuuguuugguauucugccugagcuguuggauccacaacacccucaaaccccucgccccagcccgaaccucucaccugauucuaccaugauguccucguccaugacccgcaucucgccuucacuggagcuggcaucuccaucuuggcuuguuucagugcugcccaccuccuugcuuucacugucagcaggagggacuccuucagggugcacuguggcagggggccuaggagccucaggggguguuggcagcacagggacuggggcuucacccccuaccacuguugccaucucuucuucuucuuccucuuccuccucuuccuccuccucuucagagucuguaucacuggggggugccuggggaggcccaggaggugggagucuauccccccguucugccuuuuuuaacuuccgcuucuugcucuucuugauucgagaucucuuuuccccauccccaggaguuggccgaggccuccgaagcaccccaaagccagccccagcuccuggccccaacuuucgguucuuucgguccuucuuucgaggaggaugggagaggucccccugggaaaggggcacggggguaagagcagcagggggccgggagguaugugucagggaugugggggacaaaggagaugccacuuugggcccauccagaucaaagagagaguccuugagcuucaucuucucaagcaagguagcacugucgggggccugcagacgagagaaaguggaccuuggggguccuggcugggugggaccugcuugagcugcccuucucuuggaugacuuugcuuucuuaacaaaagucuggaugguucgaagaucugagggggccgagucccagccaucacugucggccgcacucucuccucgcaauggagagcuggagccagaggcuggccagucacuuuccuuaaaagggggaagagaccagggucagcagaaccccagugucaucucagccccuccacaaacccagcuugaaaaggagugacuggauuuaccccaaaauguccuaccucaaccacuaaaucccacuguacuccaaaaacuucuccccaccccaauucccaucagcauguccucuugaccaguccguguuaccucuacccucaagucugacaccucaccgcugccccugcccagggccuguggaacacuguaucacccagaccggagccguuauguccuuagcucuuuuucuguauagccucauuuguuaccauuuucaucucccuaaaauuuauccauaaacaccuuccauucacagcaccucaagacuaugccaaaaucucaaccagcgacuccaaaucccccuuccuuuucacugcuguucaagcuagcuaucccggccauccacuccccgcauaccagcuuuccuaccacagcccuaagagucuccaacuucccuggucuuacauauaauuucuaagggccuccuucuauaaagcaauacaguucuguuugaacaacagucacucuauagucccaccacaccagccucaagucaguaauucucuugccccuaccucuuugcuagggggaauguaaccagcauaugccaaaacaaaacugcagaauuuguugaaauccucaauuguucuccgccguuucucugguggcugaaaggaaggagauauggaucacaugcaaagccacacaguuuaagaauggcauucccagaaacacagucccuaagugaggucuagaaaaggggggcggggggcguugucaggcagggcuacuaggcugcaaagguaaggcaaaccucaccugagucucuggcuuaagggucggagguggaucuggaaaagcaauaaaagcugagucaagacacuaggaacaaucuguguaaaacucccccucuaaaccccguuguuccuaagugaacccccugcucucccaggucccucugccaggccagcaggcccccagcuguguuggauccgccccggcucccccuuccgccccgcgaggggcggagccugggcgcggcgcccucugaggccucgcuauagcgcuccccuucccccaaccggaggcccggcgccccgcccccccaacucacggucucucucgacuccagucuacucggaucccucagcgccccaccccaccguaccgcucccggggccgcguccgggccgccgccagccgcccccguccuucacacgcgcccggagccccgaguuccuacccggccgcgcuccaccgccucgggcccuccgagaccgcacacgccgcccgccagcccccaggguccaggaugaccacgccgaaccgcuccccgcccuccggccccuucuacucgagcacgcggcccggcgcgccccucacccccaccccagacacacacaggcacacgcauccaacgcuacuucacggccgggacagacccgggagcucuaacccggacgcggcccccaccugcccccccccccccgcccauaccgcgcuccccacaauuucgccgucccuccgcccccauccggggcuuuggccccuccccgucuccagcuuuucgggcuccccaccgggccccccggcccuguuccuagcccucuccggccgccgccccccccuccgcccccguacucaccacccaguuacuaggcuauggaccccucaacucuggccccuuccccccaaccagccacucucucucucucuccacagcagccaccgcugcugccgccgaugccccccucacccucagcaacucccaggcucuuaacccucgcggaccaacccuacccccccgcccgacaagucgccggucuuaaccccccccaccccgccccaccacccccuacaacuacccagcucgccucgcuuccuggcucgcucucuccacaacuaccccccgguacagguccgucugccguagacaauacccagacccccucuucuccccacaacuaccugcccaccucuccgacaaucaccgggcauucuccggcggcaacuacucggagcuccgguaccaccgccacaaacuaccccaccucggcgaacuaccgggccccucacucagccucuucuacguccucccuccugagcaacucuccggccacuggauuccccuaaccuuccaguuccagggccccaaucugccgguggcccuuucgggcccuaacccccgaggcuccggguuucaagcuccuaucccccgcacccccacaccgucugaucuccaacuaccccagcccaguuucccacuccucuuucuccaaggucucucaacucgucgcucucccaccuccagggccagccucccgacccccuccccgaacucccccgcugggcuccggggcucgaccuccaaguuugccaauugauuccucgcccgccccccgccggcucagcgcucugcaccggucgagagcucaccuucgggacugggcuccgccauggcuuccagcaucgcccccuccccuccucccgguccggcgccccccuccccggagccggggaucccggugccgccucuagugcucgaugcucccacugcuucgcuccacagaaguguccgccucagcccgguugagacucgaguccgcuagccgcugccgccaccucccucuaccacugccucccgcacucccggaccgggcccccuccccccgcgccgccggccgccugcucccuccuccuccuccuccaccuccucucuccucccucccuccucuucucucccuccucc

SEQ ID NO: 16662 - RNA, 12317 nt, Homo sapiens
ugccuuuaagucacgugacaugaggagaggugggcggguaccuggaggaagcucgcggcgucgguggcgguggcgcgcggcggccgcugagaccggggcuuugagucgcaccccgcggcccgccccccgccgccacccucgcagauccgugcuuuuuccccuuugcuucucucccguacugggucaguccuguccgcgcucgcgcgucgguuugcgggugugcgcaggcgcggcaggggccauuagcccuuugggugggcgguggagcccgggagcgcgcgggcgagaccauggcggguagcagcacugggggcggugggguuggggagacgaaggugauuuaccaccuggaugaggaagagacucccuaccuggugaagaucccuguccccgccgagcgcaucacccucggcgauuucaagagcguccugcagcggcccgcgggcgccaaguacuuuuucaagucuauggaucaggauuucgggugagcgcaaggccuagauaggaccggcgggggcuuugcuagaguggauugggcgacauggaggggcacacgucuacuuugggccacacugggauuuucuggccuaugguggagcagauuguacuaugcugagguagguugacuaucccaggauggacaagguuaugcuuggauagauugaggcacacggacagacuaggauauccuaaaccagauuagacaagauuaggcuuuacuggaauaggugggggcauacugguuuauguuggaguauucuagucuguacugaguaaauugauccauugucugguuguuuaguacguucucaggaguccuguaacgccuguaaucccagcacuuugggaggcugaggcgggcggaucacgaggucaggagaucgaggccauccuggcuaacacggugaaaccccaucucuacuaacuaaaaauacaaaaaauuagccgggcgugggggcacgcgccuguagucccagcuacuuggguggcugaagcagggagaaucucuugaaccugggaggcggagguugcagugagccgagaucgcgccacugcacuccagccugggcgacagugcgagacuccgucucagaaaaaaaacaaaaaacacuugggccauuauggacucuacuggguuguauugguuaauccugguuucucuuggggcaagacuugguuuuauuggagcacucgguauaggggcagacaaggcuguuggggccugugcuagcacaggcagccguauugggauguuccaaucuagacuggugcagacagcugcgugugggggcauuguaggcugugcuagaauagauugggcuauccuaggguaauuugggacauucagggcuaucuuggacuagauuggcguguaaauaaugcagagaaagcccuuuuguguuuauggucuuuggggcugagccuucuggguccucaaccucugcuuuuuuuuuuuuuuuuuuuugagacagucucgcucugucgcccaggcuggagugcaguggcgcauucucagcucacugcaagcucugccucccggguccacgccauucuccugccucagccucccaaguagcugggacuacaggcguccgccaccacacccggcuaauuuuuuguauuuuuuaguagagacgggguuucaccguuuuagccagacuggucucugacuucugaccucgugauucgcccgccucagccucccaaagugcugggauuacaggcgugagccaccgcgcccggcccaaccucugcuuuuuugaaggcaggcuggauuaaguugggauagcauggguuuuagaagaacugaacaaacuggacucuagcuagaaagauuguuugacauggggaugcugauacuaucuugggaguuaucuuggcuuuaaggcaagguuuuucuaguugucagcaauguaaucuuggacaauuuauuuaaauuuugugucuugaucucaucugugacauggagaaaaucacagaaugaaaugguuaguucacguguguggcacacgggaaauucuuggugaaugguaauuguaauuagcauugaggcugaccacucuguaaaguagguuauggugauacagaauaauuugccucagaguggaccaagcugugcugagauuguguuauguugggaagaauccuacauuaugcugagacggguuaguagugacugggcuguguugucacguugacagcaaauggauuauguugauauauauccuggcucccaugaccauauuaggcuaacggguuaauuagacaagguguccuaauuuggggcuaagguuguguguggaaagagagagaggaacaacuaggguagagagucugaugcuuuauacguuuauucauuuagucgacaguauuuguuaaugcuuaagugucagugugugguguguggcuaggacaugguguugaccagaguaaguguucaugguuugaugucauggucaagaagaaggggcaaguccgguccaccacagggaacccauuggagagaugaccccaaggcugggcuuugggaucugucagguugagcagauugcuuugugcagaauuuugugcccagugaggcacaggggaaugggaaccccagcuugcccucuccuugggagcuuucagucuaaugaggaacuuccauuguuuguuugauccaaugggugguuuuuuuuuuuuuuuuuuuuucugagguggagucucacucugcccaggcuggagugcagcggcgcaaucucagcucacugcaaccuucgccuacuggguucaagcgauucuccugcuuuggccuccggaguagcugggauuauaggugugcaccaccaugccuggcuaauuuuuauauuuuuaguagagaaaggguuucaccauguuggccaggcuggucuugaacuccugaccucagguaaucugcccacuuuggccucucaaagugcugggauuacaggugugagucacuacgccuggccucuaauggguguuuuuacucaagaaaggacagucuucuagaaaugaauuagagaaaacuaaaggaaaguauaagaguagaggcuuugaugaggaccaaagccuuuuuuggaagguuuuuuuuuuuuuuuuuuuugagccgcccaggcuggaaugcaguggcgcgaucucgacuuacugcaaccacugucucccggguucaagcgacucucccaucucagccuccugaguagcugggauuauagacacccaccaucaugcccggcuaauuuuuguauuuuaguagagaugggguuucaccaugcuggccaggcuggucuugaacuccugaccucaggugauccgcccgccucagccucccaaagugcugggauuacaggugugagccaccgugccugaccuuuuuggaagguuuguaaggaacaggggugggguugagaggaggccaccagccagucucauuagauagguaucucaggcagccgcaucagcgugcgggauugcuuuugaaacuggacuaagagguuugagucagacucaaggaagucuuuggagcagcacugugccccugagggugcguuagggagaggagaaauaaggaaaggggauugaguuuggagauuucuuaggugucggagugaguucuuucaauguaagagaagaccugaacagggcaggagaaagucaacauccuggagccaggugaagauugggagaaaguuugaugggggucgggguggggaugguugguccagcucacugaccucuaccuugucgcuuggcaggguggugaaggaagaaauuucagaugacaacgcccgccuccccugcuucaacggaagggugguauccuggguaagagguucugacaccgaggaccaggcccccucagcauugccaagcucccucaagccucagucuguuucuguauccuccccaggccgcgcguuagcagcccuggcucuuuaccuccugucuguuuggagagccggcgagaggcccucagccuucuccuucuggagucucuaauacuugcuagguuuuuuugcucuucuccagcucucugagacccuuucucauucuuucacuuacugccaccugucacacccugacucccaagugagccacuguuuaucauuugcacccuucuagcugguguccucagauaauccccaacccgagauggccccuccaguccaugagccucgggcagaacuggcgccuccagccccaccuuuaccuccuuugccacccgagaggaccagcggcauuggggacucaaggccuccauccuuccagugaguccuucagauucuugacugcaggggagggaggugaggagggaacccaggccuuugguaggggacgccuaggauccggagcccuguucuccugauguggguuggaaaccaucucugccuguccagcccuaauguguccagcagccaugagaaucuggagccugagacagaaaccgagucaguagugucacugaggcgggagcggccucgcaggagagacagcagugagcauggcggugaggggcaggccugggggccgggaagggcugggccagaccccagccuugguggggugagcagggggaagcuugguucuugagcuuccuguccauauguagcugggggccacaggacugguggccccucaaggcuggagcgccaccuggccggauacgagagcuccucuacccucaugaccagcgagcuggagaguaccagccugggggacucggacgaggaggacaccaugagcagguguggcuccgcacagcucuccccagcgcacccagccccgucucgucuuccagucaauccucuuguucuuucucuuggccccaugaccacuuuggccuacguuugcucuccuucccaaccuccugguagguucagcagcuccacggagcagagcagugccucccgccuccuuaagcgccaccggcggcgaaggaagcagaggccaccccgccuggagagggugagggguuccuacaggaaggcuggugcugggagaagguggggcaugggcuuugguuugggcggugccaggacaccggcagcaccccaggguugacccuggguuauugaagggcacucuggcuccuuuucccaccacagacgucauccuucagcagcgucacagauuccacaaugucucucaauaucaucacagucacgcuaaacauggguauggggagagccuguggcuagggcguggggagggccuggucucuaggguuccgggcguccuguggcaggggcuccucuuuucacauggccucucuccacagagaaguacaacuuccuggguaucuccauuguuggccagagcaaugagcggggagacggaggcaucuacauuggcuccaucaugaaggguggggcuguggcggccgacgggcgcauugagccaggggacaugcuuuugcaggugugcugggguagggccacugagcugcccugcacgggggcccucagccucucccaccgugucucugacccacuugccgucgcuuccaggugaaugacaugaacuuugagaacaugagcaacgaugacgcugugcgggugcugagggacauugugcacaagccugggugaguugccaagcagguugccgguccucaguccucuuuuuuuuucucuuucauguuuuguuuuggaauuuuaauaaguacuaagacagccgggcgugguggcucgagccuguaaacccagcacuuugggaggcccagauggguggaucaccugaggugaggaguucgagaccagccugaccaauguggugaaaccgugucucuacuaaaaauagaaaaauuaagugggcaugguggcacaugccuguagucccagcuagugagguggcugagacaggagaaucacuugaacccugggggguggagguugcagugaaacgagaucacgccacugcacuccagccugggcgacagagcaagacuccgucucaaaaaaaaaaaaaagugcuaagacauaacguucaaaguacaugaaacaaaugcaugacauagcaaauaauacuagaguaaauauccaugucacugccaucuagaucaucaaauaggagauugcugauacccuagaacuuccuccucagaugucccuuccugcucccaaaugccucacugccccagggguagucacucuccugacuucuuuggccaucaccauaacaaagaaaagcuuugccucacuggauaguuaccacccuugcacguauccuugaacacugcaguuucguuuuaccuguuuuuggacuuucugugaauggaacuguacagcguguacucucuugucucacuuggcaguauguuuuuaagaguuuuccauguugaugagucauccacauuguggugccuuccacccucaccuucucuagcccagccgcgaugugcuugcuucucccccucuuugugucucuuaauccauccuugcuucagacccccgcccuccugaggccuccucuuccccugcgcccuugacuggacuucucuuccccauagccccauugugcugacuguggccaagugcugggaucccucuccucaggccuauuucacucucccccgaagugagugacacucagggaggggccugaaguugggggugggggcugcccaggaggcuggggccgggccuguggucauggggaaugggugggaggaggguccaggcagagguggaacaggaggcugagucagggagggacugggcuggcuuuuggggacugagaaugggucauuuuggugccaucuuugucccagaugagcccauccagccaauugacccugcugccugggugucccauuccgcggcucugacuggcaccuucccagccuauccagguuccuccuccaugagcaccauuacaucuggaucgucuuugccugauggugagccgccagcccaccucaucccacccucccagcagaaggcugucccgcaguggucugauccauugcccuugugggagcgaucccugacucugguuacccguugucuccucugccaggcugugaaggccggggucucuccguccauacggacauggcaucggugaccaaggccauggcagcuccagagucuggacuggaaguccgggaccgcauguggcucaagaucaccaucccuaaugccuuucuggguauggcuggguccugggcagguggcuggagaaggggaggagguggugaccaaagccaggaauggcacaggcagaggcgagagcaggaguuggaagaagaaccugaggccuuuuuccacugugggugcucccaggcucggaugugguugacuggcucuaccaucacguggagggcuuuccugagcggcgggaggcccgcaaguaugccagcgggcugcucaaagcaggccugauccgacacaccgucaacaagaucaccuucucugagcagugcuauuacgucuucggagaccucagugguggcugugagagcuguaagucccccugccccaacucugggaguguggcuuugccuaccuuguucugccucuccaacccuagaccuagcccagaaaccgcagccagggccaccauggauggucgagcagugugugucccgcacuagguccugcacuggccgaggaugggggcugacguccacccaugugcugcuggacaagccaugugccaggugcaggacuguguccaccgggggaaggugcaccucuuaccugagucccgcaaagacgugggcuaguggcugugccccugcccucauggcagaaguagaugggaguuucuugucagagacccuugugaaccccuguuuugagccccaucgugggugggucugggagaacuguucccaguuccucuccauucggugucuuggggcccuagccucuugaagcagugauuucuuccucucuucccuugcuuuccagaccuagucaaccugucucucaaugacaacgauggcuccaguggggcuucagaccaggauacccuggcuccucugccuggggccacccccuggccccugcugcccacuuucuccuaccaauacccugccccacaccccuacagcccgcagccuccacccuaccaugagcuuucaucuuacaccuauggugggggcagugccagcagccagcauagugaggguaagucauccccacauaccuguacggccaggaucugaggguggaugagaggggagccagggaggagccugggugaggacucaguugccccuccccucccuccacaggcagccggagcagugggucgacacggagugaugggggggcagggcgcacggggaggcccgaggagcgggcccccgaguccaaguccggcaguggcagugagucugagcccuccagccgagggggcagccuucggcgggguggggaagcaagugggacuagcgaugggggcccuccuccauccagaggcucaacugggggugccccuaaucuccgagcccacccagggcuccaucccuauggaccgcccccuggcauggcccuccccuacaaccccaugaugguggucaugaugcccccaccuccaccuccagucccuccagcagugcagccuccgggggccccuccagucagagaccugggcucugugcccccagaacugacagccagccgccaaagcuuccacauggccaugggcaaucccagcgaguucuuuguggauguuauguagcccacuguggggccaggcugggccgggcgcuccuggugugugacuggguguccuggccgucaugugcuugcucuuacagugccugggcucagccuaccagcugcugccauacaggagauuguggccacugugacucucaccagcagugccugguuccucccccuucccucagggguagacaagggaccuuugauuauuuuuagcuuuguuuuuuuauaagccuuuuuggggguuaaaauagaguuucuuacauuuuugggacuuuuuuaauaggcauuuccucuuuuauaugaagaauucccauccauugggccccuucuaaccccagaaugugaccuccuccuccaguuacccacagcccugcccuuugcaggguuggggguggucagcgguaccccgggguuaggcauccuagacagcagccugaggaagcugggagauuugggccauguagcugccuuuguuacucuauuuauuuuagucacuuguauaaaacaccaaauaaagcaauagaggcaaacuccccacgccucuggcuccuuucuuugggagggaggcaggcagcagggggaaagaaccgucacacaggagcaaagcaugacuggcuagaaauuuuuauuauuugcgaggcaguaagugcucuugagagcaggcacagugcugggaacacuaggccccuucgggacaaaccagggccuuaaggaaaggggcuucggcuuuggcuugagggaaggcacauaacugggacaggcccuggccgggaguauucagaagccaaguggguugcuggugaccacaccaccccgcuccaccaaggccuuggagaugcuuuugaaguugcgguagagcucuugcugccaggggucagacugcagggcggccaugcccucucggauccgagcugcagccuggggagagggaaggagggguugggccugcaccuccagcccucaccugagcuuggcagccccgagucucaccucgauacaccaggugucacagagcauuuucucaugcugggccgugggguggcccucacucagggaucuugaggcccuggcaggaagcaggagaugaaaauaaaucugggccggcugggauccaggcccaggcccccugcggcucaggcauucccugccugccuccucaccucgagagaaccaccaccauggcauagaggucgauggccccgucugccagccgcugcagcagaaacuguucaucuguccgguagguggggugggggugggggugggggcauuagucucaaggagaggaaagggaggggcggaaugguguagagcucacuuacugacaauccccuucuuguguuuuaucagcuuggccuccaccacaguggcaaacugcuccagagcccguacugccuuaagagauggggacagugcggggcucagaggggccaucggcugcagucccugaugcaggcucuccuggaccccuggccacuuaccagcucgccacuccgacucaacuccggguggacaaguccgcugagacucaggccgcugcccagcccugcccgccugagaggaagagggagaaugacugguuaguugccauacaccacccugcccuccccuggcucuggcccuaagccuaccgccucagcuguuugccugccucuccuagcaggaggccagcauucccaaagggauucuuuagagcacugccaagcccagagagcuccuuuccuuuguccuaugggggaagaggguccagcagucaggacucacuguccuccccaccucuacccccacccaauucucugucuuaccauacagcccugcagagccacaaacagccgaagaaugucauuuguccccucaaagauccggaagaugcgaagaucucggagcacacgcucuacuccagguuccuagcacagggccacacaaauuauaugcccgugcugagaugugccuacccaccccuggcccagccgaggcucugcagaagaccguccuguaccuucaugaagcccauaccccccaugauuuggaugcauucaucugucaccuuccaggcugccuccuagggacaaagaacagaugagacugguuuugggagcugagcacccaaacuggacucccucccagcaugccugggaccucaccgagccaaagauuuugcugauggcggccucuaucuggaaguccguggcucccugguccauguuagcacucaccauguaagccauggacugagguugcauaguugggacaugggaaggaaaauugcaaagggcuuugucagacuuggccucaucacccagaucuccaagauaagggcugaccuagcuugucaggucaggcagauacuuguucugggucaguucaucaggugcuuccagguauuuguuuucuuaaaagggguggauguaagggaugagguagaauuaacuucugguacugcuggcaggcaccugagcagaacaucauugcugucucucuucgcagaagcugagcugacuaugccuccccgcauccccuagggcauugguguaaagcuggagacccacugccccaggugcugcuggggguuguagucugacccgacugggaagaaagccccagggcuccagggagaggggcuugggaggcccucaccucaguuacauacugcagcauaaccauccgugccagcuucuccuggaucagcccaaaguugugaauuuucuccccaaacuggguacgauuaguggcaugaucuaccuggaagaggguccacacaucccgcugugguucagugugguucugcagucucccuaggagaggggcugggcuugcgccagagggauggguuuugcauacaaccagaguucagucuacgcuggauggagaccuaagcuagcaagucgggcugcugguaggggaggaguuucuaguguagggagugccugcaagugaucagggacacauggcaagggggacagugagacuucuguuuggguuaccuagggacucgggcaggguacucaccgccuuagcaaugaugccucucaugguaccugccagggccgcagccaugccaaaccuuccauuguugaggaugugcauggcaaccuugaagccacucccaaccucacccagcacguucuccgauggcacccguacuccaucaaagaacaccucugcuguguuugaagccuugaugcccaucuucuucucagggggcccacugugucagggcagugugggaaagcagagguguguucaacagguugucacugggggaaaaacugcuccuucgcuccuuaugcaccagggaggaaugacgaccacuagacuauuagaggcuacagccaccacuuccccucaggcccugagggcuaaggaggccuggcuauguccuauuuuguguuggacuugguugcuggagccaaaacuuuagcucaguugcauacauauuagucccaaaggccacauucaguccaccugcuuuggcuuuugcacacguccccagggugacuugcaacagccaucugcccaggagcccaguccugccccucaguccuaagcucccccaacccaaauucacucacuggguaaugcccccgaagccccucuccaccacaaaagcugugaucuucuccuucacggcuccugugg

SEQ ID NO: 16663 - RNA, 5396 nt, Homo sapiens
aaagcaugacuggcuagaaauuuuuauuauuugcgaggcaguaagugcucuugagagcaggcacagugcugggaacacuaggccccuucgggacaaaccagggccuuaaggaaaggggcuucggcuuuggcuugagggaaggcacauaacugggacaggcccuggccgggaguauucagaagccaaguggguugcuggugaccacaccaccccgcuccaccaaggccuuggagaugcuuuugaaguugcgguagagcucuugcugccaggggucagacugcagggcggccaugcccucucggauccgagcugcagccuggggagagggaaggagggguugggccugcaccuccagcccucaccugagcuuggcagccccgagucucaccucgauacaccaggugucacagagcauuuucucaugcugggccgugggguggcccucacucagggaucuugaggcccuggcaggaagcaggagaugaaaauaaaucugggccggcugggauccaggcccaggcccccugcggcucaggcauucccugccugccuccucaccucgagagaaccaccaccauggcauagaggucgauggccccgucugccagccgcugcagcagaaacuguucaucuguccgguagguggggugggggugggggugggggcauuagucucaaggagaggaaagggaggggcggaaugguguagagcucacuuacugacaauccccuucuuguguuuuaucagcuuggccuccaccacaguggcaaacugcuccagagcccguacugccuuaagagauggggacagugcggggcucagaggggccaucggcugcagucccugaugcaggcucuccuggaccccuggccacuuaccagcucgccacuccgacucaacuccggguggacaaguccgcugagacucaggccgcugcccagcccugcccgccugagaggaagagggagaaugacugguuaguugccauacaccacccugcccuccccuggcucuggcccuaagccuaccgccucagcuguuugccugccucuccuagcaggaggccagcauucccaaagggauucuuuagagcacugccaagcccagagagcuccuuuccuuuguccuaugggggaagaggguccagcagucaggacucacuguccuccccaccucuacccccacccaauucucugucuuaccauacagcccugcagagccacaaacagccgaagaaugucauuuguccccucaaagauccggaagaugcgaagaucucggagcacacgcucuacuccagguuccuagcacagggccacacaaauuauaugcccgugcugagaugugccuacccaccccuggcccagccgaggcucugcagaagaccguccuguaccuucaugaagcccauaccccccaugauuuggaugcauucaucugucaccuuccaggcugccuccuagggacaaagaacagaugagacugguuuugggagcugagcacccaaacuggacucccucccagcaugccugggaccucaccgagccaaagauuuugcugauggcggccucuaucuggaaguccguggcucccugguccauguuagcacucaccauguaagccauggacugagguugcauaguugggacaugggaaggaaaauugcaaagggcuuugucagacuuggccucaucacccagaucuccaagauaagggcugaccuagcuugucaggucaggcagauacuuguucugggucaguucaucaggugcuuccagguauuuguuuucuuaaaagggguggauguaagggaugagguagaauuaacuucugguacugcuggcaggcaccugagcagaacaucauugcugucucucuucgcagaagcugagcugacuaugccuccccgcauccccuagggcauugguguaaagcuggagacccacugccccaggugcugcuggggguuguagucugacccgacugggaagaaagccccagggcuccagggagaggggcuugggaggcccucaccucaguuacauacugcagcauaaccauccgugccagcuucuccuggaucagcccaaaguugugaauuuucuccccaaacuggguacgauuaguggcaugaucuaccuggaagaggguccacacaucccgcugugguucagugugguucugcagucucccuaggagaggggcugggcuugcgccagagggauggguuuugcauacaaccagaguucagucuacgcuggauggagaccuaagcuagcaagucgggcugcugguaggggaggaguuucuaguguagggagugccugcaagugaucagggacacauggcaagggggacagugagacuucuguuuggguuaccuagggacucgggcaggguacucaccgccuuagcaaugaugccucucaugguaccugccagggccgcagccaugccaaaccuuccauuguugaggaugugcauggcaaccuugaagccacucccaaccucacccagcacguucuccgauggcacccguacuccaucaaagaacaccucugcuguguuugaagccuugaugcccaucuucuucucagggggcccacugugucagggcagugugggaaagcagagguguguucaacagguugucacugggggaaaaacugcuccuucgcuccuuaugcaccagggaggaaugacgaccacuagacuauuagaggcuacagccaccacuuccccucaggcccugagggcuaaggaggccuggcuauguccuauuuuguguuggacuugguugcuggagccaaaacuuuagcucaguugcauacauauuagucccaaaggccacauucaguccaccugcuuuggcuuuugcacacguccccagggugacuugcaacagccaucugcccaggagcccaguccugccccucaguccuaagcucccccaacccaaauucacucacuggguaaugcccccgaagccccucuccaccacaaaagcugugaucuucuccuucacggcuccuguggcuggaucuguaacuggugucuuggcaaagaccgugaagaugucugcuaggcccccauuacuguggaagaaugggauauucagggcguggaggacggggagcaguggggccuggaauugggcggaggagaaggggagaaaugggaggcagguugccugauccaaagcuugcuuccauugaggguauaguauuuuccacaggggcugggcacagcagagguucggauggaggcugcaucugacccgcuugagggcucgguuagacagaaagcggccacagucuccccuguuggggagagagcuacuuuaccccaaguucugaugagcuucaaaguccccucggcccacuuccccaucccuccagcaggcaguucccccuuaacaccugggaguauccaguucuuuugcaugucccaaccagcacacugugaugccuccccaaaaccuucccccaacugaaaugcucagccaucugauaaucuaagugccaacuggccuaaucugugccaagcccagugugccccccaaucccuggcucuccuaggguugccucaccagaugccagcuuggggagguauuuuucuuucugggccuuugugccaaagagcaggaugccuuugaaaccgaugcucugaugggcccccaggguaaugcccacgccaaggucaugcaugcccacgaucuccaccaaacgggcguacuggaggggaagcaggaaucugggguugucacuggcugcagggggaccugaccuuaacaggagagugugggcaacagggcaguuccugaccuagggcaguuccugaccuagggcagugccugaccugggccauccccaguguguagaaaagaaguggggugugcaaagggcacagcagagaaugcuggucugucuuaggucuagguaggagggugacuugcuacuagucagucuauuguuaggcaauccccaacuuagagauuuguaaggacuugggaaccagggugaggcccauggcucaggccuaggggacugcauguaaauuguguuauguuuggacaguuaacauccaucccacaggcacccagggcaggugcuuagaagagaccuuagcccuagucucuaggucuauggcaaaagagcugagucugccaagcugggguauggcauacugggauguggcgauagggcgcccucaccuggguguugcaaaggcccacaccacccagcucacugggcacuugcagaccaaaggcccccagcuccuugaggcccugccaaguggucuccuccaccaucuccagagcgucauucuuggcgggaucguucacuuccuggggaaggcacaggaucccacauccaggcuccuuuugagcuuaacaucuccaaacaccucaccagggaccaagccccgagucauuccuuaccucgaagaaacgggacacaggcuccaccagcucuuuaagaaacugugucugcucuucguugagcacugcagagggugggggacaggcuggucaggccaggcuggcaggggaaaccacccuggccccacccagcucugauuaucccuucccuuaccggacggguaugggaacaccugaucuguggugagcuggccuuugaacauucccacagcaaaggacuuagauuccugggcagagagaggcaaauuucagggcucugguugggucuggcuaagguccaccuggccucggggcuaccuaccgccuuggccgguuuuuuccuggucagagcgucagaggggugggaaucugacuuguccagagccagcugggaaaagagacgguuagcaaguucagggaagggacuuccgcugugucaaggggagaacaggcgagagccgcgcggggaggcggcgcgaagcggugaccuuuccccuaguuucgcccuagggcacccuggcuugcccuuuccccuacuuucggcgacugagcaguaggcagguaccuggcaccaagagggagaucccugccgauggcgggcgccgaagcggaccgccgcucccacacccccuugccaaggcugcggugacuuaccugagcggcacccccggcauagggccgccgggcagggccgggccggggcugccccaggagcgccgugagccgcgagcuguggggaguggggguucagugccggcccggugcccagggccgcugcccaccgucccucuugucacacacagaccuuccgcccccgagccucagcagcugccgccccaagcucgcggccauccgagccgccugcaucuccgaaucucuccgggcgccgcuggcucgagcucugacccagcucuggcguccugcacgcccacguccuggcgccccuaacccugacucaucguccacagugcaccg

SEQ ID NO: 16664 - RNA, 2348 nt, Homo sapiens
uggcgagcuccaggguggcccggcccggacaccccagugauaaaauagaucaucuacacggaaacuggcgcgcuccagggguggggcccaaacucaguuccacccucuggcucccagccgaacaccgaaccgggaccgauccggccccggcuugaacuagcucagcuccgagcucgcggaaccacgcccccgggagacucuggcccggccagcgcgggccaggucuucaguccuauaucgccccgccuugggaaaaggugcaggggccucucgccgccucgucgggcccuuccucucuaccugccucuccaaccccucucggccccgagccacccggcagcgggggugggugugcagaggugcggcguccagaacccggcuccugcagaggcucuggguggcagcagcccuguuaccgcuuagauggcgcgcaggacagagccccccgacgggggcuggggaugggugguggugcucucagcguucuuccagucggcgcuuguguuuggggugcuccgcuccuuuggggucuucuucguggaguuuguggcggcguuugaggagcaggcagcgcgcgucuccuggaucgccuccauaggaaucgcggugcagcaguuugggagugagugcggcgccuggaucuggcggacugcgacccucggaagggagagggaaugcggcgacugggaaguggaagggcgaggggcgggagaugcugggggggagaccccugagaucuucucgcagcgccccuuccacuuccucaggcccgguaggcagugcccugagcacgaaguucgggcccaggcccguggugaugacuggaggcaucuuggcugcgcuggggaugcugcucgccucuuuugcuacuuccuugacccaccuauaccugaguauuggguugcugucaggugagagccugcacaagggcaggagagucaaaugcuuagaucguuggauguucaccuccuuccugcuccuuccaaaggguucggggagaagcugagggaaaguuuagcuagcaccuguacccagaagggaauucuuaauaggaaugacuaaagcgacaaacauggugaggaauuaggaaauucaaggaugaugaaaccuggccgggcacgguggcucacgccuguaaucccagcacuuugggaagccgaggcggguggaucacgaggucaggaguuugagaccagccuggccaacauggugaaaccccgucucuacaaaaauacaaaaauuagccgggccugguggcgcuaaucccaguuacucgggaggcugaggcaggagaaucgcuugaacccgggaggcggagguugcagugagccaagaucgcaccacugcacuccagccugggcgacagagcaagauucugucucaaaaaaaaaaaaaaaaaagaugaaaccaaguauacaagcccagaagcccagggcuaaugggacuggaguguaaaaggaagaauuacuauaaaauggugcuaggggccaggcacgguggcucacgccuguaaucccagcacuuugggaggccgaggcgggcggaucacgaggucaggagaucaagaccauccuggcuaacacggugaaaucacgucucuacuaaaaacacaaaaaauuagcugggcgugguggcaggugacuguagucccagcuacucgggaggcugaggcaggagaauggugugaacccgggaagcagagcuugcagugagccgagauugcaccacugcacuccagccugggcgacagagcgagacuccgucucaaaaaaaaaaaagaaaaaaaaaggugcuagguacugugacugugaaaucgauaucauuauuggauuuacagcuggggaaaagcuuuaaagcuuauacaacuuggcaaaugaaggucacacagcuagaaaugguagagcccaggucuaacuccaaaguucugugcuaguuaccuuacaaacuuugucucuaaucuuccacaaucccaaaaaguguauuauuacauuuugcaguugagaagguugaggcuggggguguuaaguaaaacacacaagguuacacagcuaugaaguauccaagccaagauuguaucccaggucugugggacuccgaagcaagugcuacauucugcugcugggcaaugcggggauuacugugugccuugagcucccuaagaguucucaacaccacuucuuccuuuuugacaggcucuggcugggcuuugaccuucgcuccgacccuggccugccuguccuguuauuucucucgccgacgaucccuggccaccgggcuggcacugacaggcgugggccucuccuccuucacauuugcccccuuuuuccaguggcugcucagccacuacg

SEQ ID NO: 16665 - RNA, 6638 nt, Homo sapiens
caucccggccagauaaaggagccgaggccaagaggggagagagaccccgccccccuuaagaagagaagccgcggccccugcaggacggggguaagaacaagagacugagggagccagacuccugggucccccaagaggguaggagcuuguguggagcuugccaucagcgagccugagucccagaaauugggcuaaacuagggauuggggacuagauaggagucgcagaauuccguaguucggggaagggagccucggcugggauuuggagguguguggacggcaggccgugagaucucgaggcaggguuggacaccugagacacaggcgcgcagaggggaguggcggugcuggaggggcacugggggucgaacccagggcgaugggcgcgggauuccccacgcucgccaacgacgccgcgguguggaaccuucaacuggcuccaagcgcugugggaucuggaagaggcaagggagcgagggugucguagagggcagaaugaacaagaagaauuaggagggaggcugcgugugccggggcuaggggcuggaaguccuggcucuaguugcaccucggaaggaaaaggcaaacagaggagggaaggcgucuuaggacugccuggauccagagcacuuuccacggccucuacaggccugugucgcuauggguucccccgccgccccggagggagcgcugggcuacguccgcgaguucacucgccacuccuccgacgugcugggcaaccucaacgagcugcgccugcgcgggauccucacugacgucacgcugcugguuggcgggcaaccccucagagcacacaaggcaguucucaucgccugcagguucgagggguggggccuggggcggggccaaaugggaaaggggugggaccacagggccguugagagggaauccgaagccaagucuuucagaagcaggaggcggagcgucccagaauugggggcggggugauagugaggaggcgggacuuuuucagggggcggggcuuccugaagcugcgcaugucucccuugguuccccagcccccaaaggacuuaucugcucucucucuaguggcuucuucuauucaauuuuccggggccgugcgggagucgggguggacgugcucucucugcccgggggucccgaagcgagaggcuucgccccucuauuggacuucauguacacuucgcgccugcgccucucuccagccacugcaccagcaguccuagcggccgccaccuauuugcagauggagcacgugguccaggcaugccaccgcuucauccaggccaggugagggacccuggcucggcguucucugugggugagguguuaagggcaaaggcagaguuuaggaaauggcacuaacguucaucacacuuuccccagcuaugaaccucugggcaucucccugcgcccccuggaagcagaacccccaacacccccaacggccccuccaccagguagucccaggcgcuccgaaggacacccagacccaccuacugaaucucgaagcugcagucaaggcccccccaguccagccagcccugaccccaaggccugcaacuggaaaaaguacaaguacaucgugcuaaacucucaggccucccaagcagggagccuggucggggagagaaguucuggucaaccuugcccccaagccaggcuccccaguggagacgaggccuccagcagcagcagcagcagcagcagcagcagugaagaaggacccauuccugguccccagagcagguacagagucuagaaccucaagaauuugucagagcuggccucagcuagaagacagagucauugggccuugauggucaggaggaagggagauaggugguggguuucagagacacuagcucaccuuaaggagcuggccagagaccagguuuauucagcaggguggcacuugggcaguacaauggauguggcucauuggucaacaauauuggcucacccugagagggcaggccuuuggcuccaaauuucccaggagagaacccccaccccucaaccguacaaucucuuuuaacccuuuccuugccaucugccuaggcucucuccaacugcugccacugugcaguucaaauguggggcuccagccaguacccccuaccuccucacaucccaggcucaagacaccucuggaucacccucugaacgggcucguccacuaccggguaagagccccucuuucuuggcuuuucucccgugacugcuccaggcaaguuugugccaaaaacucucccagaaaggccuauuccaaugguuccuaaacuuuauuacaaauuagaaucaccuaggaagcuuuuaaacucccacugcccaggucacacuccauagauuaaaauaucuggacaugggacgagucaucaguauuuuucuaaagcucucccagugcuuccaaugagcagcaaaguuugagaauuucuggccuauccccuuucagagcugaauggucagcccaaagcuugucagggccucucuggcaggcugucauucagaguggugcaagugaggaggagauuuuagccaagcaugguggcucaugccuguaaugccagcacuuugggaggccagugcaggaggaucacuugaauccaagagcucaaggccagccugggcaacauagucagauguggucucuacaaaaaauaaaaaugaaaauuagccgggcacgguggugcacaccuguagucccagcuacucaggaagcuaaaguggaaggaucgucugaacccgggagguggagauugcagugagccgagaucacaccacugcacuccagcauaggcaacacagcaagacucugucucaaaaaaaaaaaaaaaaaaaaaaacaggaggagaaacaaaacuccucccacuagcaggggccuccaccuaccaccacugcuuuuauuuuauuuauuuauuuuuuugagacggagucucacucuguggccaggcugaagugcagugccgcaaucucgguucacuacaaccuccacaucccagguucaagcgauucuccugccucagcuucccgaguagcugggacuacaggcacgugccaccacacccagcuacuuuuuguauuuuuaguagagacgagguuucaccauguuggccaggauggucuccaucucuugaccuugugauccgaccgccucggccucccaaagugcugggauuacagucgugagccaccguaccuggcccccaccacugcuauugaagaggagauuagcugaguacucgagucagacagaugugcagucagaucuggcucaucuuacuaucuucuuacuuggccuugagcaagucaaaccagccccagaagucuuaacaauaaauugggaaacagaaagccugcuacugugugguuugaggauucaguaguaccuagauagcccucauuaauaacuaugguugccgucacccauuccccuucccaggaagugaauuuuucagcugccagaacugugaggcuguggcagggugcucaucggggcuggacuccuugguuccuggggacgaagacaaacccuauaagugucagcugugccggucuucguuccgcuacaagggcaaccuugccagucaucguacagugcacacagguaggggaagagagggcccuggccuucaagcccacagcuguccuagggcaaagucccugaucucccauguucucugccuccaggggaaaagccuuaccacugcucaaucugcggagcccguuuuaaccggccagcaaaccugaaaacgcacagccgcauccauucgggagagaagccguauaagugugagacgugcggcucgcgcuuuguacagguacggagccagccuccaaguggcuuccaaggcaaaccugcaagagguggggugggccaauagggaggguucuguuccucccagaggcaggacuugaagucuccucccucccagguggcacaucugcgggcgcacgugcugauccacaccggggagaagcccuacccuugcccuaccugcggaacccgcuuccgccaccugcagacccucaagagccacguucgcauccacaccggagagaagccuuaccacguggguacccaaccuggccugcccacugccuuagaauuaccucuccuuugccuaggggugggcucugagaggugcgggccuggcugucccuagaucucuuagaaaugagcgguggccggaagaguccaagcaaauaagggguggaggcugggagucaggaugggcagguauagaagugaugcuccugggcugagcacuguuuucucagagaggagcugagaagugggaaaaccuuugcuaaauaaggcggggccuauccccucagccaccccugaggauuugggaggaugugagagucaaagagcugaucuuccgcuggauaguucccaccugggagagcuggacggccgcccggcucaacaccuaaaaggugauuguggauggggcagggccugacuuggcuguccucccacagugcgaccccuguggccugcauuuccggcacaagagucaacugcggcugcaucugcgccagaaacacggagcugcuaccaacaccaaagugcacuaccacauucucggggggcccuagcugagcgcaggcccaggccccacuugcuuccugcgggugggaaagcugcaggcccaggccuugcuucccuaucaggcuugggcauaggggugugccaggccacuuugguaucagaaauugccacccucuuaauuucucacuggggagagcagggguggcagauccuggcuagaucugccucuguuuugcuggucaaaaccucuuccccacaagccagauuguuucugaggagagagcuagcuaggggcugggaaaggggagagauuggaguccuggucucccuaagggaauagcccuccaccuguggcccccauugcauucaguuuaucuguaaauauaauuuauugaggccuuuggguggcaccggggccuucauucgauugcauuucccacuccccucuuccacaagugugauuaaaagugaccagaaacacagaaggugagaucacagcucugcuggcagagauuacuagcccuuggcucucucguuuggcuuggguauuuuauauuauuucugucauaacuuuuaucuuuagaauuguucuuucuccuguuuguuugcuuguuaguuuguuuaaaauggaaaaagggguucucuguguucugccccuguaauucuaggucuggaaccuuuauuuguucuagggcagcucugggaacaugcgggauuguggaauugggucaggaacccucucugguauucuggauguuguagguucucuagcagucuagaaauggauacagacauuucucuguucuucaagggugauaggaaccauuauguugagcccaaaauggaaguaauaauaaaugccuccuggaggcugugggugugggggauucuguaucuggauuccguaucacuccaaguggaggcuggcagguuuuucugcaagaugguccagaaucuaaaaugucccauuaaucuggucacuuggguuuggcucugcuguauccaucuauagugguagagacccaccagggcucaaguggaguccaucauccucccacgggggccuguucuuagcacugaguugaucgcuccaugggggagagaucagacauuccuuaucagagaugaugugaccuuuucugacucugcccagucucuaugaauguuauggccuagggaagaaucaugaaacucuuuagcuugauuagaugguaaacaguguuaacccauccuuuacuacagaggcauauggguuugaauguuaccugggguucucucuauugaguugagccccuucuuccuuuaguggguuuuggacaucuucuggcaaguguccagaugccagaaccuucuuuuccucuagaagggauggugcuugguaaccuuaccuuuuaaaagcugggucugugaccuggucuucccaucccugcauuccugucuggaaccagugaaugcauuagaaccuuccauaggaaaagaaaaggggcugaguuccauucuggguuugcuguaguuugguugggauuauuguuggcauuacagauguaaaagauugacuagcccauaggccaaaggccuguucuaguugaccaaguuucaaguaggauuaagagguugguugaggggugcaguuucugguguaggccagguagguagaaagugaggaacaggguugccucuuggcuggguggagucucugaaauguuagaagaagcgcugaagccuugauugauaguucugccccuuguugcccuggggcuuaucugauuaugggacgaggguagaaaguaagaagcacuuuugaauuugugggguagaacuucaacaauaagucaguucuaguggcugucgccuggggacuagugagaaagcuacucuucucccucuucccucuuucuccccauggccccacugcagaauuaaagaaggaagaagggaaggcggaggagucuauaagaaggaaucaugauuucuauuuagcagauuggaugggcagguggagaaugccuggggguagaaauguuagaucuugcaacaucagauccuuggaauaaagaagccucucugugcugccu

SEQ ID NO: 16666 - RNA, 4917 nt, Homo sapiens
aagcugagagggaaaucuuuauuguuuucuguauaaaaauguccaucagaugaaggucaaagggguugggggcagaugcuuaugcgggaauagcgagguggcagccccagcagccuuucagcccucucucgugcaggccuugcucggagucccaggagauccacagguccggcaugaacagugagaggucagagguggaaggcucagcaggagaggagaggaggaucagcagaggucaugagaaggccagaauccagggucaggcugucuggaacaggaaguaaaaugggccgagauggagcgagcccccagugugcuuccaaggccacucccaccucccugaaacacccugcuacguacugauccaaugcccugcgcuguguaugagagcaccuucucuucugaaaccccuauacaagggaggggccccugcggagaccgugcccugccauccaggugagcccuuucuccccaaccccgucagcugugugggaggaggaggacuccuacccuggucgaaguugaguuucuuagcuggaggaguuucuccuagcccuucaauauccaccacgucacuguuggcaucggagucguucagagcacugagugucacaucugggaagggggcauaagcuagguucuagguuccccugacagccucucccccagccccaagcuucccaaagcuuugugccuccucuccccuccccucugccccucucugggaaccuccacagggacaggaagagagacugacccuucuuugacccaggcccaauucucucacuaaaccucagaugggaccuuuaaccccuaggcagcaacuccacagcccucaccagccuucuguuucuuuauggggggacccccggccucagggacacuggagcugcugggaggaggggcagcuggaggaggugacaagacaccagaugccaccuucuugggcccuuucuugggugacucagcuggaagggggaugccagaaucuucauauaccuugcguuucacaguggccuuuaucugggcccugaagaaaagagagaagagguuaggaaaggagucaucagagagacuaacagaagaggggacgggaggggaagggguucugggagucccuucauaagaauccaggucggggccccaacccauugguaggguucucacuuucucgaaguuuuacacucacucaggauggauggaguguggagaguggagucccugaacugaguagugggaaaggcccaucuccuaauucucuucugggagagacaucagguagagcuuggugauuuacagguggauugagauuuacugaucaacuaguucagggucaccauaucccuggaaacacugcagugggguccucaaacauuuauauaaauaaccaggggacuuccaucaucaaauacaauaacagcaucucaggcaaccuaaauucacauucuuggaaggauuaccacagcauuuuaggaacuucugaccaacugugacaauucuauucuuucaguccucaaggggauucuaaaaaacuagugacaaaguagggaagcagcugagcuggaaaggaguucugaggacgauggaaccuuggguaaggaggaagaaggcugcccacccgcccuuuucuggcagccacccucccucacacuguccguuccuugaugacacagcugaugugauuaagaucguccccaaaucgcuucacagcagcccucagcaucucuauuuccgucuccguccacuucgcacugucagaaggggagaggggggauagcaaaaaugggaggggggguguggagcccgcccacaggcuaugcaucccacagccaaccagccgccuccuuccgauuucugggaccccuuccacggaugcauaaagagguccuccguaaggggaggcggaaagcucuugaggcccugcgggaaccgggaggaccccaaucacaagaaaucacaaccaccuccaccuuagacaccccuuuccaccaucaacguuaaacggcugcuguacacagcacacugaaaccaacucgccaggaagggcuuuucaaaacagacccaccaacacagccugcagccgucugggggaauuccaugaacuggggugguugggaguggcggugguuuguggucgacccguucgcagcagggagaacugugaaacaggagucugggcuaugggccugucuguauuuuuaucugucauucauucccucacccaacgaucauuuauuaacaccgacucugugcugugccacgcacaaagggaaacuaaugucugucccugugcuagagaggguccgugucugugaccgaguccaagcgcccgcucucagcguccacgucccaguccgggcucacguaccccgcaggagaagagucggccacgggaugcagcugcaucgucagcuccccgagcuucgugaaggcggcgccggccgccgagaagaucucuccgaccugggggcggggcagcgucacggggggccggcgcccgcccuccccgucccgcccggagccccuagccccaccccaggcucggcucccgcccgccccccgcccggggcggaagagccgcgagccaaguggggggcccgcccucccguggccgccagggagcgcuguccgcgagggaggucgaaccuuuguggacgcugacgucauggccccgcgcgccuccucacggagacgccgccgccgccgcuacacgcgagccgggaccacggagagcagggagacugagcggcucgggcccccgcgcaggaagucccgcccuccccgcagcggauaggcucaacccggcggcuccccgccccaucagacgcagucgcuuagaccgcucggcgcgcccagucgauggggaaagccuucgccucacuuccgcgccacacuucgcuccacuuccgcucagacaucgggacuuuccaggcagaggccgaccucuagucucagccccgugcucgcccccacucaagcacagacacagggcugaagagagcagauucucuuuauugagauacgggacacagcgaaggguggagaaacggaacagccccccagccucagcccucuccacgggggccggaugccagagaugggagaagggauucagucucucgcccgggaaacccagucccgcagagggcgccggcaagggugggacgcgaccugggugacacggugcagggagucuuuaaauagaggaggggcuggagcggggaaacgcgccggggcccuagcgcaccauguauuccuugcgcuuauugagccgaacuuggcagaaagagaagccuccgaggaggagguaaaggccugcagcgaugaaacaguuguagcugacuugcucguaaagguuguauauguucugggggccauuccugggggugggaaugaagcaaaggggucaaacuuuaauaggagccaacauuuucugagcacuaugugcccgacaccuguuuaggcgcuguuacguguauuacuuuauucaaucuucuugaccauccuauggggugagaucugucauagccauuuugcagagguggacugagaagcacagaaaaguaaaauaccuaaagaggucacaccuaaggugguggguuugggauggccgcugaggucugacucccuggcuccuaaccacauucucaagaaagccgcucuccucuccaaguccucuaaccuaggggcccuaagcaccgggccucccagacguaauucugacccuaggccucgccaccucccaccugcucccagcccgccucccccacccgaauacuuacucaaaaucuuucuccgugaagggaacguccucaaucaacacagcggaauggacauugaaaaauauuccgagcauuaucuggaaaaggggaauggguagacuguugaauucaggcaccugaccucauguucacuucguaaaccccucccauuuccaauguugcuacaacacccgagccugagauuaaccaaaacgagguggugguuacuggauucggacucagccaccuggaacagggcgugagguggugacauugagacaaguggucgaggcaagggugggaauagugaccaagccaucucucccaggaacccagauuaucguccucucuggaggcgucaucaucacgggacagugcggaagaggggagggagaaccggcacuucuucauaucauuucuucuugaaguggcgguggguggauuacugggaaaacaaggcccagcuacacauuucuggaacaagcacucucuuuuccucccauguccuccauucaacucaagcaccucucaggcaccccgcucuuguuucuccuaccuugaggggucuccaccuuuaccagcccuggcuccucccacuccagggcccuccgcuccaguucccuuuuuucuuuuucuuuggggacggagucucgcucugucacccaggcuggagugcaguggcgcgaucucggcucacugcacccuccgccucccggauucaagcgauucuccugccucagccuccugaguagcugggauuacaggcgggcgccaccacgcccggcuaauuuuuguauuuuuauuggagacgggguuucaccauguuggucaggcuggucucgaacaguucccauuuuucaauuucagucugucuccuucuccggggccuguagauccccggccccuccggccugccugcggcccagaguuuccucgccucccagcccucccagcccggagccccucaggcccucuccgauccuugccggggaguccccucaccaacaugaucacuccccaggcgcugaggacgaugccgcaggcggccagcuucggcccacagcacaggagcgacgccauaaagaagggagucggggaucgccgaggugcaagcgggcucggaaagcggugggagaaagcccaggaugcccucgca

SEQ ID NO: 16667 - RNA, 4917 nt, Homo sapiens
ugcgagggcauccugggcuuucucccaccgcuuuccgagcccgcuugcaccucggcgauccccgacucccuucuuuauggcgucgcuccugugcugugggccgaagcuggccgccugcggcaucguccucagcgccuggggagugaucauguuggugaggggacuccccggcaaggaucggagagggccugaggggcuccgggcugggagggcugggaggcgaggaaacucugggccgcaggcaggccggaggggccggggaucuacaggccccggagaaggagacagacugaaauugaaaaaugggaacuguucgagaccagccugaccaacauggugaaaccccgucuccaauaaaaauacaaaaauuagccgggcgugguggcgcccgccuguaaucccagcuacucaggaggcugaggcaggagaaucgcuugaauccgggaggcggagggugcagugagccgagaucgcgccacugcacuccagccugggugacagagcgagacuccguccccaaagaaaaagaaaaaagggaacuggagcggagggcccuggagugggaggagccagggcugguaaagguggagaccccucaagguaggagaaacaagagcggggugccugagaggugcuugaguugaauggaggacaugggaggaaaagagagugcuuguuccagaaauguguagcugggccuuguuuucccaguaauccacccaccgccacuucaagaagaaaugauaugaagaagugccgguucucccuccccucuuccgcacugucccgugaugaugacgccuccagagaggacgauaaucuggguuccugggagagauggcuuggucacuauucccacccuugccucgaccacuugucucaaugucaccaccucacgcccuguuccagguggcugaguccgaauccaguaaccaccaccucguuuugguuaaucucaggcucggguguuguagcaacauuggaaaugggagggguuuacgaagugaacaugaggucaggugccugaauucaacagucuacccauuccccuuuuccagauaaugcucggaauauuuuucaauguccauuccgcuguguugauugaggacguucccuucacggagaaagauuuugaguaaguauucgggugggggaggcgggcugggagcaggugggagguggcgaggccuagggucagaauuacgucugggaggcccggugcuuagggccccuagguuagaggacuuggagaggagagcggcuuucuugagaaugugguuaggagccagggagucagaccucagcggccaucccaaacccaccaccuuaggugugaccucuuuagguauuuuacuuuucugugcuucucaguccaccucugcaaaauggcuaugacagaucucaccccauaggauggucaagaagauugaauaaaguaauacacguaacagcgccuaaacaggugucgggcacauagugcucagaaaauguuggcuccuauuaaaguuugaccccuuugcuucauucccacccccaggaauggcccccagaacauauacaaccuuuacgagcaagucagcuacaacuguuucaucgcugcaggccuuuaccuccuccucggaggcuucucuuucugccaaguucggcucaauaagcgcaaggaauacauggugcgcuagggccccggcgcguuuccccgcuccagccccuccucuauuuaaagacucccugcaccgugucacccaggucgcgucccacccuugccggcgcccucugcgggacuggguuucccgggcgagagacugaaucccuucucccaucucuggcauccggcccccguggagagggcugaggcuggggggcuguuccguuucuccacccuucgcugugucccguaucucaauaaagagaaucugcucucuucagcccugugucugugcuugagugggggcgagcacggggcugagacuagaggucggccucugccuggaaagucccgaugucugagcggaaguggagcgaaguguggcgcggaagugaggcgaaggcuuuccccaucgacugggcgcgccgagcggucuaagcgacugcgucugauggggcggggagccgccggguugagccuauccgcugcggggagggcgggacuuccugcgcgggggcccgagccgcucagucucccugcucuccguggucccggcucgcguguagcggcggcggcggcgucuccgugaggaggcgcgcggggccaugacgucagcguccacaaagguucgaccucccucgcggacagcgcucccuggcggccacgggagggcgggccccccacuuggcucgcggcucuuccgccccgggcggggggcgggcgggagccgagccugggguggggcuaggggcuccgggcgggacggggagggcgggcgccggccccccgugacgcugccccgcccccaggucggagagaucuucucggcggccggcgccgccuucacgaagcucggggagcugacgaugcagcugcaucccguggccgacucuucuccugcgggguacgugagcccggacugggacguggacgcugagagcgggcgcuuggacucggucacagacacggacccucucuagcacagggacagacauuaguuucccuuugugcguggcacagcacagagucgguguuaauaaaugaucguugggugagggaaugaaugacagauaaaaauacagacaggcccauagcccagacuccuguuucacaguucucccugcugcgaacgggucgaccacaaaccaccgccacucccaaccaccccaguucauggaauucccccagacggcugcaggcuguguuggugggucuguuuugaaaagcccuuccuggcgaguugguuucagugugcuguguacagcagccguuuaacguugaugguggaaaggggugucuaagguggaggugguugugauuucuugugauugggguccucccgguucccgcagggccucaagagcuuuccgccuccccuuacggaggaccucuuuaugcauccguggaaggggucccagaaaucggaaggaggcggcugguuggcugugggaugcauagccugugggcgggcuccacacccccccucccauuuuugcuauccccccucuccccuucugacagugcgaaguggacggagacggaaauagagaugcugagggcugcugugaagcgauuuggggacgaucuuaaucacaucagcugugucaucaaggaacggacagugugagggaggguggcugccagaaaagggcgggugggcagccuucuuccuccuuacccaagguuccaucguccucagaacuccuuuccagcucagcugcuucccuacuuugucacuaguuuuuuagaauccccuugaggacugaaagaauagaauugucacaguuggucagaaguuccuaaaaugcugugguaauccuuccaagaaugugaauuuagguugccugagaugcuguuauuguauuugaugauggaaguccccugguuauuuauauaaauguuugaggaccccacugcaguguuuccagggauauggugacccugaacuaguugaucaguaaaucucaauccaccuguaaaucaccaagcucuaccugaugucucucccagaagagaauuaggagaugggccuuucccacuacucaguucagggacuccacucuccacacuccauccauccugagugaguguaaaacuucgagaaagugagaacccuaccaauggguuggggccccgaccuggauucuuaugaagggacucccagaaccccuuccccucccguccccucuucuguuagucucucugaugacuccuuuccuaaccucuucucucuuuucuucagggcccagauaaaggccacugugaaacgcaagguauaugaagauucuggcaucccccuuccagcugagucacccaagaaagggcccaagaagguggcaucuggugucuugucaccuccuccagcugccccuccucccagcagcuccagugucccugaggccggggguccccccauaaagaaacagaaggcuggugagggcuguggaguugcugccuagggguuaaaggucccaucugagguuuagugagagaauugggccugggucaaagaagggucagucucucuuccugucccuguggagguucccagagaggggcagaggggaggggagaggaggcacaaagcuuugggaagcuuggggcugggggagaggcugucaggggaaccuagaaccuagcuuaugcccccuucccagaugugacacucagugcucugaacgacuccgaugccaacagugacgugguggauauugaagggcuaggagaaacuccuccagcuaagaaacucaacuucgaccaggguaggaguccuccuccucccacacagcugacgggguuggggagaaagggcucaccuggauggcagggcacggucuccgcaggggccccucccuuguauagggguuucagaagagaaggugcucucauacacagcgcagggcauuggaucaguacguagcaggguguuucagggaggugggaguggccuuggaagcacacugggggcucgcuccaucucggcccauuuuacuuccuguuccagacagccugacccuggauucuggccuucucaugaccucugcugauccuccucuccucuccugcugagccuuccaccucugaccucucacuguucaugccggaccuguggaucuccugggacuccgagcaaggccugcacgagagagggcugaaaggcugcuggggcugccaccucgcuauucccgcauaagcaucugcccccaaccccuuugaccuucaucugauggacauuuuuauacagaaaacaauaaagauuucccucucagcuu

SEQ ID NO: 16668 - RNA, 1562 nt, Homo sapiens
aaugaguugcacaauugagaaggcacuugcugaugcuaaaacucuuguugaaagauuaagagaucacgacgaugcagcagaaacucugauugagcaaaccacagcucucaauaagcgaguagaagccacgaagcaguaucagaaagaaauucaagagcuuaaugaagucgcaagaacaucggccacgguccacguuaguuaugggaauccagcaagaaaacagacaaaucagagaauugcaacaagaaagaaaagaauugcguacaucccuggaagaacaucagucggccuuggaacuuacgaugagcaaguaucgagaacaaaugguuagauugcuaauggcuagcaaaaaagaugauccgggaaaaauaaugaaguuaacaaaagcagcacuccaaggauacaggcacauguugaccagauaaaugaaauauggcagcaguaaugaagaaagccauugaaauugacaagcaacaggauugcaaggaacaagaacuaauauuucaacuugaacaagaaaacaaaggcguuagagagauccuauaaauaacucgagaaucacuuuugaaccuaaggaaagaagaugugucggaaaguacuucuuugucagcauuagugaccaacagugacuugagucugaggaagagcugaagagcuucugagucugugagcuucuuacauggcucccaguggucaaauaagugaaugaaugaaugaacagaaaauucaauccauuauuuuuuucucuuuaaauauguacaguguacuggcuaugagauagcaacaaaaacgcauaguuaauggucauagaccuuuuuccaaaacauaauuggaaaauagaaacugagccauugccaacugguaaagaaaugaaagguuuucacagugacuacuaaauauagaacuuuuggcagugcugcuggcuuucugggugauuaauuagguaaacuugaauauucccaauaaauaugugagaauucauaaaauuauaucaauuuaaaaauauaaaguuuugccacuguuuugugaauggaagauuugcaugcuaaauuucauccuuauuuggcguuaaaguuaacacaaaguuuauguaccaugagacuucagcuuuagugauuaccuacuuucacauuuauuuaaauuuuugugaaagaaaauucaguuuuaaaggcuauaggaauguguuauauguaccauaaacaaaaaagguaauuuuagcaauuuaccauaacugauacuuagcuaacaauuguccauaacuuguuuaaguauaagaaauaccauuucaggaaugaaaaagaaggaauacuacuuucuaagaaagaaaaucuuauaauagacauuuuaguagguuaaacuucuccuuugaaagaauaaguuuugguucgaagucaguaaugaagaugagauuuguuuuucucuucucuggcugauuuuuaaggauacuauguaguucauuuaauuaacagaauugaaguguuugauauggcaaaauagguaugguaauuucaaagugaauugggaauuccucuggcucauagaacucuuuuaaauuaaaauuu

SEQ ID NO: 16669 - RNA, 32893 nt, Homo sapiens
cgccaccacuggaacccgggggaagauggcggcagccguucugagugggcccucugcgggcuccgcggcugggguuccuggcgggaccgggggucucucggcagugagcucgggcccgcggcuccgccugcugcugcuggagaguguuucugguuugcugcaaccucgaacggggucugccguugcuccggugcaucccccaaaccgcucggccccacauuugcccgggcucaugugccuauugcggcugcaugggucggugggcggggcccaggugaguccguggcccgcgugcccgcggcccuguggggaggauggcgcggcaccugugcgccgggauuacggugcagugcaagugcgauagggagguugaaggaaggagagcugcgggcagaaaggggauccagguaucaguccggacgggaugcacguauuucuccuuuaucggccaugaguuucuccaggggaaaaaugggccuuauuuuucuguuguuaggcuauuggucggcacacaggaaucgauuagguuccaggcccggucacucacuaguuguauaaucuaaaagucucuuuuuccucuggcaauaucuguuucggggauuguuucgacugacugaaugacgcauucaacaauaaacauuuaccgagcucuuauugagggucagauacuguacuaggcgcuccgguuacagacgugguggcgauacacaaaaugcugcgaaacaagaugagaauugaauaucaggggucucuaaccuuaucugaagacuggcagagauuuuuccaaagaaaccggcguuuaagcugagacccuaaggaugaauagggguuggguagggaaaaaauaugggaggggcuguucagucagaggagagcucaugugggaagacccugugguaggaaggaacuggaaagaagggcaucguuccuggggcucagauguggaggggaagagaguggguacagaugagacuggugagauggguaggcaguggucgggucaugcagagcguuuuaggccggguuaggagccuuuggacuucuauaagaauggaaucugauaaccauucaguucugcaagcuagacacucaaguaauucuaaacucuucuucauacaccuccauaagcaaucugucaaguccuguugauuuuauccuuugaguaguuuucagaucuguccacucuuuuccaucuuucucauugcucccauucuagcuugaacccccaccaucuuguccgggugaaggcacugauucuaagaaggcauauuucuagcccauaauagcugcuccuuauaacaaucuccuaucuucccuucucucccacuaaaccucccccaaauucuacccauccuucaagacccauaaacacgagaucuucuguguccacccuucauuccugggaccuuccuagcucuaugcuaccuuccaggaagaugguugucacaauuugcugggugggucaauaaccuuagccccagauuuaucacagauaacccuaucuguuugucuuuaacauuacucugcauaauugagggugacaaaacuauaucucugcuaucucagcccaauaucagaggcuggagcugauuauguauuuucucuugucucuaaauuccccucuucuaauuuaugugguuuucaucagucaguuauauuacagugggguuuuucuguuuucuuuaucucacaauagucccagaauuauuauuauuuuugagacaaggucuuacucugucacccagguuggagugcaguggcaugaucuuggcucacugcaaccuccauuucccagccucaagggauccucccaccucagccuccagaguagcugggaccacaggcaugcgccaccaugcccggcuaauuuuuguauuuuugguagagacgggguuuugccauguugcccaggcuggucucaaagucccgaguucaggcgauucacuugccuuggcuucccaaagugcuggaauuacaggcacgggccaccaugccuugccccccagaaauuuuuuuuauaaguauuugugaaauauuaccuaucccgccuauaaaugugugauuucuuucaucaucucuuucaggacuuccucuccucccucaaagucaacuacaugaacuuaacgucuugcuuauuuuucuuacaugucugaagucuaguagaauuuugaguaaagaagcuaagagugaugugggaaacuagggccgcccuuuaauauuuccugugcuacuuguuuagauacauccugccuugaauuuuuuuucuacuuguguccuuugaauugggauuauguggaggauuuccuuuccuuccccaaagguuucauucaacaaacauuuauugaguaucuguuauguuuuacguacuguuccucgucucuagguagauaaauaagacaugguccuuucccucagagaauuucuagucuaguuaagaugagaaaugaaagucagcaauagaccuggagcuugcgagcaagggggauccacuguuugaucauccaccuaccaacauggcuuuuccgcagguacugcaagcucaguaguuccaaaauggaaugauccuagcacagugcuccauaucuagcuuggaguauauuauagcaacaaucuucuaacgggucuccuuaccuucagucuugcccucuguaauccguuccccacacaguagcuggagugagcuuucuaaaguaaaauucugauccuguuugcagcuuuuaaaaauccuucagccucuggguguucuuuccucagaggcuuuguacuuacucuucucuuggaaucccucccugugcagugcccccacccccccaacucucauccuccuucccagucuucucaauucuuugcuuauuugucacugccuuugggauauauuucuuggccaccuaugauugacugcucuuuauccuacugucuguuuauuuauuucacauauacuuauaaccucucuccccuacauucagcaagucuuugauuuguucuuguauguaauuaauaaaacuuauauaaaauuucagacauaaauaguauuuuccccaccccacccuaugcugcccccaucacucaaauuuaacagugaacguuugccaauguuauuucauuccucccauagcuuggcuuuuuuuuuuuuuuuuuuuuuuuaguggaacuuugcuuuuucuuucuuucucuuuuucuuuucuuuucuuuucuuuuuuuuuuuuuugagauagggccuuacucuaacucaggcuggagugcaguggccagauuauggcucacugcggccuuggccucaaccucccagguucaaguaauccuuccaccucagccucccgaguagcugggacuacaggugugccaccaccccuggcuaauuuaaaaauuuuuuuuguagacaugggggcuuuauauguuguccaggcuggucuugaacuccugaacucaagugauacucccgccuuggccccccaaaauccugggauuacagaggugaaccaccgugcucagcuugguggaccauuuuaaagcaaaucccaaaugucauuuauccuguauauucuuuugaaggacaaaaacagugucuuguucugucuucuacguaggccucagccuccugaguagcugggauuacaggcaccugccaccauacccagcuaauuuuguauuuuuaguagagacggaguuucaccauguuggucaggcuggucucgaacuucugaccucaaguuauccuccccacucgaccucccaaagugcugagaauacaggcaugagccaccacauccggccacuuuuugucguauuuuagaguguacuccuacuuaaauaaaaaaaucuuccugccucagccucccaaaauguugggauuacagggaugagccacugcaccuggccucucuuuuuguuggaucauuuucaucagcauacaggcucaaaacuucauccucggccaggcgugauggcucacgccuguaaucccagcacuuugggaggccaagguggguggaucacaaggucaggaguuuaagaccagccuggccaagauggugaccccgucuguauuaaaaauacaaaaauuagccaggcgcaguggcaggcaucuguaauccuguaaucccagccauucaggaggcugaggcaggagaaucgcuugaacucggggcagagguugcagugagccgagaucgcgccucugcacucuagccugggugauagagugaaacucugucucaaaaaaaaaaaaaaaaaaaaaaaucacccucuagggcugggugcagugacucacaucuguaaucccagcacuuugggaggcugagauggguagaucauuugaugccaggaguucgagaccagccugaccaacauggcgaaaccucaucuuuacuaaaaaugcaaaaauuagcugggcguggugacgcaugccuguaaucccagcuaaucaggagacugaggcaggagaauugcuugagccugggaggcagacauugcagugagccgagauugcgccugcgaacucuggccugggcaacagagggagacuuugucucaaaaaacaaacaaaucacccucuagcuacugccucauuugccauuuguguacuuccuuuuauggcaaaaacuccuugaaaguguuaucuguacuuuuugucucuccuucuucuucuuuuagcguuacuuugaaauaacugaaaauuuacagaaaaguuggaacaauauuugaaagaauuucaauauauacccuucuccuagauucuccauuuuuuuuuucuuuuugagauggagucuugcuuuguugcccaggcuggagugcaguggugcgauuuuggcucacugcaagcucugccucccggguucacgucauucuccugucucagccucccaaaguagcugggacuacaguugcccaccaccaugcccggcuauuuuuuuguauuuuuaguggagacgggguuucaccguguuagccaggacggucucaaucuccugaccucgugauccgcccgccucggcacucgaagugcugggauuacaggccugagccaccgcaccuggcuggauucuucaguuuuuaaaugcauauuuauguuauucugauaaugacagaucuccuaaacuaucauucugagaauaacauaaaugcacauuugaaaacuggagaauucugggugaagaggauacaggaauucuuucagauauuuuuucuggguccauuuaggaguaaguugcagauauguccuuuuacuuugacauauuuuaguguguauuuccuuaaaaacaaggacauucucuuacauaaucauacucuaucaucaugaucagagaauuaauauugguacaauaaauuauuuaaccuacagaucuuuuuuaaguuuugccaucaguucuccuaaaggcauccauuauaacaacaacaacaacaacaacauuucuaguccaggauuuaaugcaggaucacauguugcauuuaguuguuuuuuuuguuguuguuuguuuugccuuguuuuuuuuuuuuugagacaaucucagucuguugccuaggcuggagugccguggcaugaucuuggcucacuggaaccuccgcccccuggguuuaagcgauucuccugccucagccucccaaguagcugggauuacaagcgccugcuaccaugccuggcuaauuuuuuuucuuuuuuuuuuuuuaguagcgaugggguuucgccauguuggccaggcuggucucgaacuccugaccucagaucauccacccgcguuguccucccgaagugcuggcgugagccaccgcgcccagcuugcuuuuaguuauaaugucucuuuaguauucuuuaaucugaaauaguucuucagccuuugucuuaugaucuugauauuuuuaaagaguacagaauaguuauuucguaggaugccccucagguuaggaucuaaucaugaggaaacagcagacaaauuaaacuggagauuugugcguuuucagcaagaauacugcagaagucguccaggugcaguggcucaugccuguuaucccagcaugagauucagaggcuuagugggaggccgaagugggaggaucacugagugcaggaguucaagacuagcuugggcaacauggcaagacccuaucucuacaaaaaaaaaaaaaaaaaaccuugcagaaaugaugugucauucuuggugcaucacaucaggagcacguauucuagguuaagcaggucucugccagauuucuucacuguuauaaagguaugauuuuuuuuuuuuccauuuguaguuaagugucuuggggggagauaaugugaaugucuuaggucuugucaaccuuucacccacucauuuuaacaucuauuaaagguucuucccugaaugaauuauuacuaugaugguuguuccguugaacucauuacauucaggcuuuuagccuaaaugcugccgaaacaacccuuugcugggugaaaugguaacucuugaagaucacugguguccaucaagacauuaaguucaaaggucaauuugggucaucauauuugacuuaucgcuaccauuugauacaguuaauuauacuuuccuauuuaaaaaacugucuucacuugacuucugggauaucucuccccugucuuuuuguuuuuguuuguuuguuucauugagacagggucucgcuguguugcccaggcuggagugcaguggcgcgaucauagcuuacugcauccuugaucuuccaggcugaggcaguccgcccugcucagccuucuggguagcugggaccacaggugugugcccccacacccagcuaaucuguuugauuuuuaguagaaacaaggucucgcuauguugcugaggcuggucuugaacucuugagcucaagcagucuucccacuuuagccuccuaaaguacugggauuauaggcguuagucacccucccagccccucuccucuccucucgauucuccuguuaucacacugguuacuccuuuccaguaaagacugaucccuccucaccucugugaccucugaagguuugagugccuacaacccaggccuugcacuguuucucuucucuuuacucuuauucccuuggugaacugauccagucucaaggcccacaccucuugaguuuacaucuccagccagaaguucucuucacacuugucuagccggugccuauuuggcaucuccguuuucauguuaaauacacaucacagauugaacagaucugaaacugagcucccuauugucaccccaaaaccugcuccuccugcauuaguucccuucucggugaauggcagcuucaucuuucuaguuguucagcaaaaaaccuuggcauuaucuuggacccuucuuuuuauuuuccacccauauccaguuugacggcacaucccguuggcucuaccuucacaguacuuccugauuuugacugcuuuguaucgccacaguuaccacauucuucaagcugcaucaucauuugucuggaauauuacaguaaccuucuaccucaucuguuugcuucugccuucucaacaagacaacacaaaugcuguugauuaaaaacaaagcaaaacaaaaagcaaaccagaagucagauauugucacuccugugcgcaauuucucucucccccucguggcuuuuaucuuacucagggugaaagucgguaaucaccuauaugucucugcacagucuggucccacucccuuaaccuucaucauugguuacuccucuccaccuugcucacuuuucuccaucaacaauuugucuccuuguuguucuuuggaaauaacgaaguaugcucucaucucauagucuucgcucuuuuuauuuuucuuuuuugagacaggauguugcuuugcuguucaggcuggaguguagugguggcgaucauggcucacugcagucuugaccucccggggucaagcagcccucccaccuuagccucccaaguagcugugaccacaggugcccuccaccauguucggcuaauuuuuaaaaauucuuuguggagaaugggggucucccucgguugcacaggcugaucuugaccuccugggcucaagccauccuccugccuuggccucccaguguugggauuacagucaugagccccuugcccagccuguuuuuuuuuuuuuucuuuuccuggaacacucuuuuuuuuaugguuaucaguaugccuuuuuauaaaaacagcuuuacugcggggguucauggugguucacuccuguaaucccagcacuuucggaggccaaggugggcggaucaccugaggucaggaguuggagaccagccugaccaauauggugaaaccacaccaccacgucuggcuaauuuuuguauuuuuaguagauuuuuagauguuuaguuucgccacguuggcaaggcuguucucaaacuccuaaccucaaaugaucugcccaccuuggccuccccaagugcugggauuacaggcgugaaucacugcccccugccagauuuuuuuuuuuuuuuuuuuuuuuuuuaagagagagggucucacucuuuugcccaggcuggaguauaguaguguguucauagcucacugcagccuugaacgccuggauucaagcgauccuucugccucagccucccgaguagcugggacugcaggugcaugccauugcaccuggcuaauuuuuaaaaauuuuuguagagauggugucucucuguguugcccaggcugguauggaacuccuggccucaagugauucgccugccuugguuucccagaauuuugggauuauaggccaccgugccuggccaaaacagcuuuauugagaaauaauucacaaaccauacaauuuagccauuuuauuuauuuauuuuuuccagacggagucucacucuguugccgaggcuggagugcaguggcgugaucucggcucacugcgaccucugccucccggguucaagcgauucuccugccucagccucccuaguaguugggauuacgggcgcccgccaccauguccggcuaauuuuuguauuuuucaguagagacggguuuucaucauguuggccaggcuggucucaaacuccugaccucgugauccacccgcuucggcugcccaaagugcuggaauuacaggcaugagccacggugccuggccuuuuauuuuuuucgaaauggagucucacauugucacccaggcuggaguacaguggugcaaucuuggcaaacugcaauuucugcauccuggguucaagcgauucucccggguucaagcgauucucccggguucaagcgauucucucagguucaagcgauucuccuuccuuagccucccgaguagcugggauuacaggcgcccaccaccacgccuggcuaauuuuuguauuuuuaguagagccgggguuucaccauguuggccaggcuggucuugaacuccugaccucaugauccaccugccucggccccccaaagugcuggcauuacaggcguaagccaccgcgcccggcccauuuuauuuuuauuuuauuuuauuuuuuuugagguggagucucauucugucacccaggcuggagugcagugucacgaucuuggcucauugcgaccuccgccucccguucucaagcgguucuccugccucagccuuuggaguagcugggauuacaggcgccugccaccacgccuggcugauuuuuuuuuuuuuguauuuuugguagagauggcguuucaccauguuggccaggcuggucucaaaccccugaccucagguggucugcccaccuuggccucccaaaguacugggauuauaggcaugagccacugcgcccggccacaguucacucacuuagaguauacaauuccguggauuuaguauauuugcagaguugugcggucauugcugugcucaguuuuggaacauuuucaucacuccauaaagaaauucuguacccacuuacagucauucccauugcccaccaagcccucccuggcugccuccagcuuuaggcaaacaguaaucuacuuuuuuucuuuagagauuugccuauucuggccauuugauagaaaugaauuguauaauauguagccuuuggguuuggcuucuuucacuuagcagucaguuuucaagguucauccaugugucaagacuuuauuacucuuuucuguuuugcuguguugggucuuguguugccuaggcuggauucaaacucucaggauuagucaagugauucuuaugccucagccucccaaguagcugggacuacaggcgggugccauugugcccggcuaaaacuucauuccuauuuauggccuuuuaugcaauaguccccucuuaucugugcuuucccuuuccaugguuuuacuuaccuguggucaaccguggucugaaaauauuagguggaaaauuccagaaauaaguaauucauaaguuuuaaauuacgugccauucugagcagcgugauggacucucgaggaguucugcuucauccuaccugggacgugaaucggacaugaaucauccuuuuguccaguguauccauguugcacaugcucccugccugagggucaucuuguaaccaucucggugaucagauccacuguggcgguauugcagugcucguguucaagucaccuuuauuuuacuucauaauggcccaaagcguaagaguagagaugcuggcauauuauuauaguugcuguacuguauuauuagugguuguuaaucucuuacugugccuaacugauaaaaucuuucauaggcuuguauguauaggaaaaaaacaguuuauguaggguuugguaguauccgaaguuucugagguuucaggcaccugccugggguuuuggaagcacccccugcagauaagggggcgcugcugcacuauauuugaucuguucaccaguggguggacguuuggguuguuuucccauuuugguuauuaugaaugaugcugcugugaacguccauguacaaguuguugugaggauguagguuuucauuucucuuggguauauacguaggguggaauggcugggucauguguucacucuauguauaacuuuuugaggaacugccagauugcuuuccagaguggcugcgccauuuuauauuugugguaaauauuugagaguaucaauacaucuuguucucacuuuccuuuaggucucugcuaaauggcuuuuucuuuuuuugagauggaguuuugcucuuguugcccaggcuggagugcaauggugugaucucagcucacugcaaccucugccuccuggguucaagcgagucuccugccucagccucccgaguagcugggaugacaggcgcgugucaccauaacuagcuaauuuuucuauuuuuaguagagacgggguuucaccauguuggccaggcuggucucgaacuccugaccucaggugacccaccugccucggcaucccaaagugcugggauuacaggcgugagcuaccacgcccggccuaaauggccuuuuuggagaugcuuuuuguaucuacucuccuaaauaaaauccuguccccuuugccuacucugggcacuccuuuccuuccuuacucugcuuuauuuuuccuuggaguucuuagcacccucugauauacuauguauuuacuuugucaguuguuuauuuucugucuccucuuaacuagaaaauaaguaccuggcaccuaaaauaaggucucacaugaaguauauaucaaguaaauauuuucuuuuuuuuuuuuugagacagagucucgcucuguugcccaggcuggagugcaguggcaugaucucggcucacugcaaacuccgucuccuggguucacgccauucuccugccucagccucccgaguagcugggacuacaggugcccgccaccaugcccggcuaauuuuuuguauuuuuaguagagacgggguuucaccauguuagccaggauggucucgaucuccugaccucgugauccgccugcuuuggccucccaaagugcugggauuacaggcgugagccacugcgcccggccaugucaaguaaauauuuauuuaacgaauaaauauuucccuccacaaaagggagagaccuuauuaauuuuauucagcucuguauuccuucacguaaccucaugcauaguguauguguuggaagaaggaacgaugcacgccguuagggagacgcgggugccgugagaggaggcuggccauuuggggcauggagagguuaccuggggggcugaugaggaaacaucuuucgugggcuuccagaaugugagagaaggggagaacuggaaggaggauucuuguugacucggucuguguuggcauuuuuacagcuguaaggaagccaggaauagggggaggaggauuuguuugagggugaaggaaggauaauggaugaguucaguguccauucagcaagcauuuauggaugucuccuauuaggugcugcccagacauauagaggugaagcagacccaucuuugaagucugguagugggauuaguugggcuguccuguguuuggcacuacuuggguggggcauggagggaaggaucaggcaaaauauaacuugaggaaaggccgagaaacagccuuucccacaggaaaaaaggggaaaagcucaaggcuucuagugggauggccuuuuggccucagaggagaugugacuucagaaaggcuucauaggugcugggacagagaagggcuugaagaaucuucugcauuuuuaacaucccguuugugacucgcuucccuguuuucuuuccuccagaaccuuucagcucuuggggcauuggugagucucaguaaugcacgucucaguuccaucaaaacucgguaagucuuuggcccuuuuuuuucuccaggggcguguucccuuaggaagugggcauauguacaucuuugcuuucauugucaccguccccaggauucaagaccucucucuauucccaagaguguggagaguuacauuccuuuugugagcucacuugauuugaacccuaccuuuuccagcucccagauguccuauuccacccugggauuaccucugcucccuucuuucuuugcuucuuccaccucauuccaaguauuucaggaguuggaaaccacaguggaucuggggaugaagucuugcuguagccuagugagaauaaaagagcagucacuuucucugaagucuagccuccgcccacuuaacaugacucucuucuuucuuugaagguuugagggccugugucugcugucccugcugguaggggagagccccacagagcuauuccagcagcacugugugucuuggcuucggagcauucagcagguguuacaggugagguuucagcugcugcccuacuuccuccuccucccccaucuuauuccccaucuuggauguggcauguucuuuucaacuuggacauguaguucuggggacagaauaauuggaaacaauucccugauagcagagaggauaagcuucaaauagaaacuuuuuuuuugagauggagucucacuuugucacucaggcuggagggcaguggcaugaucuuggcucacugcauccucugccucuuggguucgaaugauucuccugccucagccuccugaguagcugggauuacaggccucugccaccacgccuggcuaauuuuuguauuuuuaguagagacgagguuuuaacauguuggccaggcuggucucaaaugccugacuucaagugauccgccugccucagccucccaaagugcugggauuacaggugugaggcacugugcccagccuauauauauauuuuuauuucaguaguuuuggggaacaggugguguuugguuacauggauaauuucuuuagugguaauuucugagauguuggugcacccaucacccgagcaguguacguuguacucaauauguaguuuuuuaucccucacccaucucccacauuuccgcccgaguccucagaguucauuauaucauuuuuaugccuuugcguccucauagcuuaacucccaguuguaagugagaacauacgauguuugguuuuucauucuugaguuacuucacuuagauuaauggucaccaacgccauccagguugcugcgaaugccauuauuuuguuccuuuuuauggcugaguaguauuccaugguauauauacaccacauuuucucucucucucucugucucugucucucucucgacagaguuuugcucugucgcccaggcuggagugcaguggcgcgcucucagcucacugcaaccucugccucccggguucaagcaauucucuugccucagccuccugaguagcugggauuacaagcgugcgccaccauuccuagcuaauuuuuuacauuuuaguagagaugggguuucaccauguuggcuaggcuggucucaaacuccugaccucgugauccaccugccuuggccucccaaagugcugggauuacaggcaugagccgccacuccuggcccacaccacauuuucuuuauccacuugcugguugauggguauuuaggcugguuccacauuuuugcaauugugaauugugcugcuauaaaauauugugcgcaagggucuuucucauauaauggcuucuuuuccucugguagauguccaguagugggauugcuggaucaaaugguagugauguuucauguuuguuggccauuuguauaucuucuuuugagaauugccuguucauguccuuagcucacuuuuugaugugauuauuuguuuuuuucuggcugauuuguuugaauucuuuguaaauucuggauguuaguucuuugucagaugcauaguuugugaagauuuucucccgcuuuguggguuguuuacugauuauuuguuuugcugugcagaggcuuuuuaguuaagucccaucuauuuaucuuuguuuuuguugcuuuuggauucuuggucaugaacucuuugccuaagccaaugucuagaaggguuuuucugauguuaucuucuagaauuguuaugguuucaggucuuagauuuaaguccuugauccaucuugagcugauuuuuguguaaggugagagugauccaguuucauucuucuacauguggcuugccaauuaucccagaaccauuuguugaaaaggguguccuuuccccacuuguuuuuguuugcuuuguugaagaucaguuggguguaaguauuuggcuuuauaucuggguucucccuucuguuccauuggucuaugugccuauuuuuauaucaguaucaugcuguuuugguaacuguagccuuguaguauauuuugaagucagguaaugugaugcgcccagauuuguucuuuuugcuuagccuugcuuuggcuuuaugggaucuuuuuugguuccauauaaauuuuuggauuguuuuuucgaguucugugaagaaugauggugguauuuuggugggaauugcauugaauuuguagauugcuuuuggcaguauggccauuuucacaauauugauuguaccuauccaugaacauggauguguuuccauuuguuugugucgucugugauuucuuucagcaguguuuuguaguuuuuccuuauagaggucuuucaccuccuugguuagguguauuccuaaguauuuuauuuuauuuuuugcagcuguuguaaaggugguugaguucuugauuuuauucucagcuuaguugcugaugguguuuagcagugcugcugauguguauacauugauuuuguauccugaaacuuuaccggcuucauuuauuggaucuaggagcuuucuggaugagucuuuaggguguucuagguauaugaucauaucacuggugaauaacgacaguuugacuuccccuuuaccgauuuagauguccuuuauuucuuccuuucuuccuuuuuuuuuucuuuuagauggagucucucauucuguugcccaggcuguagugcaguggcacagacuuggcucacugcacccuccgccuccuggguucaagcaauucuucugccucagccucccagguagccgggauuacaggugccugccaccccgcccggcuaauguuuguauuuuuaguagagauaggguuucgccauguuggccaggcuggucucaaacuccugaccucaggugaucugacugccucggccucccuaagugcuaagacuacaggugugagccacugugccuggccuagacgcccuuuauuucuuucucuugucugauugcucuggcuaggacuuccaguacuauguugaauagaaguggugaaagugggcauccuugucuuguuccaguucucaaggggaaugcuuucaacuuuucccuguucaguauaagguugguugugcguuuuucauacuuuguugcucuuuuaacguuuuaauuuuuuuccccuacuuuuacauccuuugauaacaucuccacuuaguuauuuaacaagcauuuucugagcacauauagcaggcaguguaccaagcucuggagagacagugagauguacauggacccugcuuucaugguacucagagucuagcgcuuuuucuaugaaguaaauguuuacaaauaggaaauguuuaugcuuugugaaccacauauaguuucuauuguauauuguuuauuuuccaauccuuuaaaauguaaaagccauucuuaguuugugggccaugcaaaaacaggcacccauagaccaucauuuacugauuccuguucuaguugaagauacuuuuuuuuuuuuuuuuuuuuuuugagauggagucuugcuguguugccuaggcuggagugcaguggcgugacugccucagccucccaaguagcugggacuacaggcucccgccaccacacuuggcuaauuuuuuguauuuuucguagagaugggguuucaccauguuagucaggaugaucucgaucuccugaccucaugaucugcccaccuuggccucccagagugcucggauuacaggugugagccaccacacccagcgaagauacuuuaauugaauaauuauauaaaugaaugugaagugauaaacugagguaggugcuguggagguaaagacuauaguucuuggaaaacauguaacaggagaaucugacuucagcuggggugguguggguguuugugaucagggccagcaguccagggagagcuuuucugaacugaucaauagaaguuaauuggguuaagaaaguguucuaaugugccaaagccaugagagaagaggagcauggccuguuugaagaauuccagcauguggcuagaauugaugagauguggcuggggagauaggaagacuggggaccaaguuguguauggccuuauagaccaugcuaaggguuuuggcuuuuauucuuggaguaguggcaacucauggaagguuuuaagcagggaugaggagguggugguggugauugaaaguaucucucugaggccaggcgugguggcucacgccuguaaucccagcaguuugggaggccgaggugggcggaucaccugaggucgggaguucgagaccagccuggccaacauggugaaacccuguuucuacuaaaaauacaaaaauuagccaggcaugguggcaggcaccuguaaucccagcuacuugggaggcugaggugggagaauugcucuaacccgggagauggagguugcagugagccgagaucgcgccacugcacuccagccugggugacagagcgagacuccaucucaaauaagaaagaaagaaagaaaauauaucucuggcugccuguggauaauggauuagaaaggaacagauuggaagcagaaacucuauguagauggcugcuaaaguaaucuaggagaacauucauaguagcuuggacuaggguuguggcaguagaacugaugagaacgauacagguuugagacagauuuagugucagaguggcagaugcugaggauagauuagcaucgaguagaacacauguccagggugacuccuggauuccugaacacuggaagacagguuuggaggugugggaagaaaauaccauggcuguggccuugagcauucaguagaagcaccauuaguaacuaucccccugauccggcaucaguggaaguggccgggcaucucaguguagccuugaugguucaguggguggaggcuuuaguuggcuuuuuuuugagguggagucucgcucuguggcccaggcuggagugcaguggcgcggucucggcucacugcaaccuccaccucccggguucaaaugauuuuccugccucagccuccugaguagcugggauuacaggcgccuaucaccacacccggcuaauuuuuguauuuuuaguagagacgggguuucaccauguuggccaggcuggucuugaacuccugaccucaagugauccacccaccuuggccuuccaaagugcugggauuacaggugugagcuaccaagcccagcccuuuuuuuguucuuuuuuuuuuaagacaugguuucauuuugucaccugggcuagaauauaguggugugaucauggcugacugcagccuugaccucuggugcucacaucaguaccccccaccgcacccaccaauagcugggacuacaggcguguaccaccaccccccgcuaauuaaaacauuuuuuuuuguacagauggguucuugcuauauuguccaggcuggucucgaacuucugggcucaagcaguccucccaccuuggccucccaaaguguugggauuacaggcaggugcuaccgugccuggccuggcaucuuuuacuagggggaagagucuucaguguuuagauggcaguugaagcugaggaugaggugaucaaaaugagcccuuuuacggacuggauuuuaaagcacaccacacuuaauggucagguagaggaagaugaacugacuaaggagacugagacaggccaacagaaagaagaagauaaccgggauugcgggcugggggggccaagcgaagacuacuugagggacgagggaggaguuauuuccgugugugccuccugaggugggacaagacgcagacugagaauuguugaucagauuagcggcacgggugguaagaccauagugagagugguuuugcuggagcaguggacacugaagccagacuggcacgggauaagaagcgaaugggagaagggaaauggaaggagagaagaugggaaaucuuuucgagaugcugggcucuaacgaugagggagagaaauugggugauuacugggauuuggcaagugaaguaugggcucaagaaaagacuuuuuugguggcucaccccuguaaucccagcacuuugggaggccaaggcaggcagauaacgaggucaggaauucaagaccagucuggccaacauggugaaaccccaucucuacuaaaaauacaaaaauuaacugggcaugguggcaugugccuguaaucccagcuaggagggaggcugaggcaggagaaucgcuugaaccaggaccugggaggcggagguugcagugagccaagaucacaccacugcacuccagccugggcuacagaaggaaacuccaucucaaaauaaauaaauaaaauaaaaaagacaagauuuuuuuaagaugggagagacuugagcuguauaaaugucagugggaagagucaugugguggggacugguuagaaauucaagggagauaaagcgagugacaguguaagguucugagaggaagggaggaagauaguauugaaagcacagcggagggacugucuuuggguaggaagagggcaggagaggguggguaggaugaagaugaaauuucgaaguuugggagugggaagcgaaggcuguuuuauuagguuggugcaaaaguaauugcuguuuuuauaguuacuuguaauuaucucugggcuucaguuuuuucugugaaguuaugggcaagguuaaacagaggugacaguggugggagaaguagcgauuuggaaauuggaggagaaaacuuuaguagcagcguuaaccagagaaaugugguaggauuacuggacagggaugagggccugugucguugguaggccugccuguuuuugcuucauaaguauuuucuuuuuuugacacauggccucgucucgucuagcaggagauauaugcuggauguuuuuccuuagauacauauuaauuuucuaaggaaguccuuuuaaauucaaauuguuuuuucuccauggguuccaggguggguuugagccaguuagcaacaaccucgaagagauggcacagucuuguuaugguugaggcuuauuuuucagucugaaaagugcucuucucccuuucuagcagggaacauuaguaugauaucaucggaaaaucuuuccagggcugcggugagccaagauugcgcuacugcacuccagccuggaugacagagugagacccugucucaaaaaaaaaaaaaaaaaaaaaaaaaaaggcugggcacuguggcucacgccuguaauccuagcacuuuggagucugaaguggguggaucacuugacucccagaguucaagaccagccuggccaauguggcaaaaccccaucucuacuaaaaauacaaaaauuagccaagcaugaugguccaugccuguaaucccagcuacucaggaggcugaggcaugagaaucacuugaacccaggagucagagguugcagugagcugagauugccccagugcauuccacccugggggacagagcaagacucugucucaaaaaaaaaaaaaaaaagaaaagaaaacucagcugggcgugauggcucacaccuguaaucccagcacuuugggaggccaaggcgggcagaucacgaggucggagaucgagaccauccuggcuaacauagugaaaccccgucucuacuaaaaauacaaaaaauuagucaggcgugguggcgggcgcuuguagucucagcuacucgggaggcugaggcaggagaauggcgugaacccgggaggcggagcuugcagugagccgagaucgcgccacugcacuccagccugggugacagagcaagacuccgucucaaaaaaaaaaaaaaaaagaaaacucuucaguuaaucaggucuuuaagguauagcuuuguuacucuuuuuuucccccacacaaauuccuaggaccccagauacccguaauaguaaaauguaaacacaguauccgugucuccacacccucuuuucugccagguaguggcuuggauggucagacugacauuaaccguggcauuccucagaaggcuuguauuuucuccugcugcucuuuggugacaaucaaggugaggcuggaagcacgagacauuauuuuuuucuuuagacccaggacccgccugccacaauggagcuggccguggcuguccugagggaccuccuccgauaugcagcccagcugccugcacuguuccgggacaucuccaugaaccaccucccuggccuucucaccucccugcugggccucaggccagaggugagaugucucccuggacccuuccccauggccccccgcaguccucaccuucacacacuguuuaauuguuugauggaagugacuggggaauaggauugaagaagugagaagagggaggggccaagaaaaagugauuucuggagaagggcccuuguggggugcugggggagauggaauauggugacauggugcucgcagccucucguuucucccuuuguuuuuccuacagugugagcagucagcauuggaaggaaugaaggcuuguaugaccuauuucccucgggcuugugguucucucaaaguaaguauuuaugcacucuucuccccaccaguguaagcguugagagcucuuaccucagauuccuguccugagauuccuaagcaccuaucuucugauuauccuuuaaaguuaccuaucuccacaaguacacuucuaccacuuuguagcacuuaccucauuuaacccucguuuuuccaaagaaguuggaaucaagaacuugcuaagaucagcaggcacuggaaccuguaucuguuugaugccuaagccagacucugaaccaugggcuccuuccuuuuucugccuugccuuuucuguaucucuuaaaaugcccuacccacuuuucuaccaccuugucuuuuuuuugagacagggucuuacucuguuguccaggcuggggugcaguggcacacacuuggcucacuguagccuugaccuccugggcucaagcaauucucccaccucagccucccaaguagcugggacuaaggcgugugccaccacgcccagcuaauuauuaaauuuuuuguaggggggucucgccauguuacccaggcuggucuugaacuccugaccucaagugauccuccugccucagcuucucaaagugcugggauuauaagugugagccacugugccuggcccccuaucuuacuuuauucauuuuuuuuuuaaauuuuuaacguucaaccaauucacaucauaucuuauuuuauuaauuuuguuugagauggagucucacucuguugccaggcuggagugcaguggcgugaucuuggcucacugcaaccucugccucccggguucaagcaauuguccugccucagccucccgaguagcugggacugcaggugcauaccacuacgcccagcuaauuuuuguauuuuuaguagagaugggguuucaucauguuggccaggauggucucgaucucuugacuuugugauccgcccgccuugaccucccaaaaugcugggauuacaggcauuagcuacugcgccuggccauuuuauuuuuuuuugagagagucucugucgcccagacuggagugcaguggugugauaucggcucacugcaagcuccaccucccagguuccaagugauucucaugccuuagccuccgaguagcugggauuacagauguaugcaaguagcugggauuacugacauaugccaccacgcccagcuaauuuuuauauuuguuguagagacgagguaucacuauguuggccaggcuggucuugaacuccuggccccacgugauccucccgccucggccucccaaaguguugggauuacaggcaugagccaccugugcacccagccuuuacuuuauucuugaaggucuuguaauuuucucugggaaugcuuucugacauaucacuucccuaggacaauugcccuaacacuucuuucuguguauauuccuguuuaaacucccucugucgcuuccugaccccuuccucccaguugucaugacacauacaaggugacuacaaaagagccuuaguaggucagacaggcaggucaggguguaugugggucagaugauggaggaggucaggagaagaauuacaguguuguuuuuagggagauacaauaacaaacaugaaugguuuacaaauucugccuaagcagucacaguuaaagggccauucguaauuggcacauuuguuguuugcaguauaauuggaugccaacuauaccuaagaacaaguagguauuccccuguagauuaaauguucucuuauuuuguuauauucaccauugguuugacaaacgaucggacaccugcuuacucagauggaaacacaaaucucuagagagcuggaauuuguggcaaauuaguaauuuuuuguuuaacugguggaguuaacuguauuugccauuaguauuguuaguuaagggggaguuugcuauucagguugucuugaaagugagauuaugaggcugggcgugguggcucaugccuguaaucccagcacuuugagaggccaaggcgggcagauugcaugagcucaggaguuugagaccagccugggcaacacagugaaaccucgccucuacuaaaauacaaaaaauuagccaggcguggcggugugugccuguagucccaguuacuugggaggccgaggcaggagaauugcuuggacccaggaggcggagguugccaugagccgagaucgcaccacuguacuccagccugggugacagagugagacucugucuccaaaaaaagaaagaaaaugagauuaaugugguucugugaccaaagcaagaaaguaaguucuuggagggaaagggaacuggucuuuagugggugcccacugugccauucacucuccugagugucuaagauguguugugucauuuuaucauuguaauuauucuguggaauuuguaucacugcauuuuacagaggagaaaaccagcugagagggacuuaagugacguaaccaaagguuauauuaucugguaauuguaaaaccagggcagguagcagcucuagucaauuguuaguggcuguguagcucgcuggccugggaaggacugugagucagaguuccaucggccugagcgcugugaucagggagugaugccugcagugucguuaguaacugguuacucgcaguaucugaaaagugccugagcagaugcuaguucugagugagcgagggguuguguccuugcugguuccuucuuuucaugugaaugccucuaaucacagcuaauagaaucuuuggguaggcagggcaggacauuuugucaagaagguauuuggagugacucaucgauuuuauuaaagauuagcagagguuauuuacugagguuuuacuaaguuuaguaaaaacugguuaucuugucaaauguucuguaaguuaaccucucaaaugacacaggccagcaguuugucccugaacaaagguuugguuuuacugcaaaaguguauuuugauucagcucuguuagguauuaucuuuaucuaccugcaucccccaugaaaguggaggggaaauugaguguuacuuaacaggauagaagugugaauaguaagaguuaaggagacuagaaugcuaaguguucuucugcuguugcuuuuuuauuuucagugugaguagucaggagaauuuaucuguaauucucaaccuuuugucagacaguugaacuuaaggccugcauuuugaguacccuuuccaaacuaacaaauguuccuguguccuuccagggagugucuuaccuuuauuucccuaagaaucaagugccaucugccaggaguuugagaucagccuggccaacauggugaaacccuaccucuaccaaaaauacaaaaaaauuagcugggugugguggugugugccugugguuccagcuacuuagaacauugaggcaggagauccccugaagcugggaggcagagggugcagugagcugagaucguggcacugcacucuagccuggguaacagagugagacccugucucaaaaaaaaaaaaggucaucuggagaacuucccucuguugaggguguugaggguuuuggcuuugucgguugccagcacuucagauaagaaucugucaugcagaggcuccaggggcaauuugcacuuggaaaaucucgcagacuaguacuuaggaaaacugauaacugccguuuugaagugucuguguuuucuguuacauuccccggauacucucaggguaauuguagacuccaagcucaggauuacuacucccaaguaaugugaaucaagcauucugaguccaugaggucaauuccugcagagacuugaacucacuuccucguccuugccacauugaugagcaguuccucggaaugggugggaagacugaccuacucuugagagagccccaggacaugcugugugugugcgcguuuugagugaacuguuccaagcgagucauugcuuugguuugcuuugugggucagccaggguaaccugugguuagagccgugucgcuucaccguacacugcuuuauugcagucacauaagcagacuucuguuggcuucaguccagcuuuuugagccguuuuuggagauagggucucgcucugugacccaggagugcaguguuaagauuguagcucacuguaaccuugaacuccugggcucaagugauccucccacgucagucucccaaguagcuaggacuacaggugugcaccacuaggaugucucggggaaagcgugagccugcucuuuccccuucucuguauguugccaguguuggcuccagauucuuguuuuuccauaugcuugucuuguuauccuuacuaauucuuuuuuuuuucugagacagagucuugcucugucacccaggcuagagugcaguggcgugaucucggcucacugcaaccuccgccuccuggguucaagcaauucuccugccucagccucccaaguagcugggauuacaggugcccaccacugugcccagcuaauuuuuguacuuuuaguagagaugggguuucaccauguuggccaggcuggucuugaacuccugaccucgugaucugcucaccucagccucccaaagugcugggauuacagguaugagccaccgugccuggccuuuuuuuuuuucuuuuugagacagggucucacucucaucacccaggcuagaguacacugacuggcaugaucucgguucugggcuugggugguccucccaccucagccucccaaguagcugggacuacaggcaugcgccaccacacccggcuaaguuuuuguauuuuuaguagagauaggguuucuccauguugcccagacuggucucaaacuccuuggcucaagugauccgccugccuugaccucccaaagugccuggauuacaggcgugagcuacugcacccagccugugcuuuuuuauugacauguuaaguaauaagaucuagaagcaggucuuacaacgacuauaauugcaaauuagugaugcaugugaaugauauuucaggauguguuacaauuauaaugugacaugaaaaugauucuauuagugacagucacagguacugcugauacuacuguggcuauuugucugcauuuauaagugaaggaaacacuacauuuuacaaauaggcuagugggaguaauuuuuuuccccauccaugaucacaggcccccuaugauuguauauccaacuaaauugugguucucagguuaaacacuccugcccuagcaccuucacacagcaggcagagaaagugccgaaugacagauugcuacuccgagacuugcugccuuacuucugcucuagcagccuucuuuuuugaccuuguccugcccucauaccucugguuagugucuuaacuuccagcuuggacccucguuuuugugugugagcugguagagaguuggaguguggagacuguuuuuuaguacuauguccuuuuggcuugagggaaaaauuuugcaaaaacugucaaggaggaagcccagcugucucugggacagggccaggcccuuuucgcucccaagcaggaagccgaggaccagagcuggcguugaggagucuuuuaccaugaaagcauguccgugcccgguguugaugccccauagagggcuuugcuucuugugucuacaggaaaaagagaccugggcuuagagucugcugcugggaacggaugggauguacaucucuggcucucagagcuggcucacuggccucuuccuuuuuuccuccacauccagggcaagcuggccucauuuuuucugucuaggguggaugccuugagcccucagcuccaacagguaaagggcagggagggagagggagagcccggggaucugagccuggauugucucuugcugcuccuccucuagcuuuucuguccugccuucauaugcccaucuguguccuucggccucauugucccaucucagguuucccucagagcucucucugaucuccaucucuuuugggugucaguggggcuggggguucuguggcugggcuggauucccaucugaccagguuucuguccuuucucccgcaguuggccugugaguguuauucccggcugcccucuuuaggggcuggcuuuucccaaggccugaagcacaccgagagcugggagcaggagcuacacagucugcuggccucacugcacacccugcugggggcccuguacgagggagcagagacugguagggaccagggcugcuaguuaguggaacaauagugaggaagcguggcaggaaggaacaggaggggagcccagagacauggggcaguugguuuuuggggaaaauggguuagaauacaggcaggucguccaccagaaaugacagaggaggggauggaagaaagacaguguacaggguaguugugcuucugccagcuccugugcagaaugaaggcccugggguggagaugcugcuguccucagaagauggugaugcccauguccuucuccagcuucggcagagguuuucgggacuggcccgcugccuagggcucaugcucagguguguguggguauuggagggagcggaggcguggagcaggagggauugaugagggagugucgccuucaucaggagaaaggagaugaaggugggugugggaguuaugccagggagccugcucugaaggucucccugcucugauucucuuuagcucugaguuuggagcucccguguccgucccugugcaggaaauccuggauuucaucugccggacccucagcgucaguagcaagaauauuguaagugggauuugucaucucuucagagcccuugcucaggauaccaggcaaccaggaaaguacuggggaccugagucuccccaaacagugucauccuggagucgucccagagagcuuccuacuuuuguccaaauaacaucacuuccuaugugucgugacacaggagcacagugucagaguguagcaaaugcuuccuugggggagggugaauuuggggaucagcugagucauugcugagaggcccagccauccuucuuaccuuccauccagggucuauuuuagaggauagggguuugauuuuguugggagagcugagaucagggguuggguuucuuaccuauguguacauauguaaauggucauucccuguuucugucucucucuggcucucacuuucuuccuccacucuuuaucucugccccuuuuuucuccagagcuugcauggagaugguccccugcggcugcugcugcugcccucuauccaccuugaggccuuggaccugcugucugcacucauccucgcgugagugggauugggcuggcuguggugaagggauagggcgugccagaaacgagggucaccauuccuucucugccccagguguggaagccggcucuugcgcuuugggauccugaucggccgccugcuuccccagguccucaauuccuggagcaucgguagagauucccucucuccaggccaggagaggccuuacaggugaccauccaggaaggcaggaagggaauaaagaggagaggggggugagggggugcaggugggcuggggcuucuggcauguugaccccccauucauaacugccaucuuugcucaugacacagcacgguucggaccaagguguaugcgauauuagagcugugggugcagguuuguggggccucggcgggaaugcuucagggaggagccucuggagaggcccugcucacccaccugcucagcgacaucuccccgccagcugaugcccuuaaggugaggaggccucagcuccgccuuaggacucauccugugcccuuugaccaagugugccugcucaggaaacacugucugcuguggcugucuugccuuguuguuugccuguggaugugauuuauguuuucucugccuccagcugcguagcccgcgggggagcccugaugggaguuugcagacugggaagccuagcgcccccaagaagcuaaagcuggaugugggggaagcuauggccccgccaagccaccggaaaggggauagcaaugccaacagcgacgugugugcggcugcacucagaggugggugaggccugugcccuggaccacuggggcucaaacgggaccccauccuuuccccuagugggacuccccuaccuacuauacccuuaggugaaacuuuuguggggagagugccuagaccagccuucguccacugcgauaagugaucccccaaacagcaggugaaggggaaggugccugugaaaugcagagccaggcggaagcccgcagagaggccaggaggaggcacccaagcagccgcccuguugccagggcugcaggcggccucggguccugcgguuagaccgggagcucugguagccgacacagccccuccaaggccuucgcuuccuccggcguucagcacguccuugguguauccacuuucuaucaggcagaguuccagcaugcggggaaggcuccucccugugaagcugacauucuuccaagggcaggcugccugggggagcucccugcucucaccguaaccacugaccuguccacagguugcuagucggauacugugcaguuaauggaugccuuuccucugggucccauauauuucacugccugccaccccaucccaugggaaggggagaaccgauuguucccaaauauauaaaugcaaaauuauaaaauuuauaauuuuuuacuuacauugucucaauuaaauaccgucaguggcccuauacaguagagguacuuuuaugauccccauuuucuaguugagaaguuaaaugacuuggccaagauaggcaguggcagaguugaugcccauuuugggcuguaugcuucagaagcccuugccgucagucuguugggagccuacccuuuacacaccauucuucuuccccaggccucagccggaccauccucaugugugggccucucaucaaggaggagacucacaggguuaguggagccucgucuccguggagauaggggaaggggccccugcucuguacacauugggggguguggcccagagguggguccauuccgaccugggaguaggcucuggagaaggguuggguggucuuggggauguuuccaggugugcucuguccuuuucagagacugcaugaccugguccucccccuggucauggguguacagcagggugagguccuaggcagcuccccguacacgagcucccgcugccgccgugaacucuacugccugcugcuggcgcugcugcuggccccgucuccucgcugcccaccuccucuugccugugcccugcaagccuucucccucggccagcgagaagauagccuugagguaacugugaugggccaagccccucuuugguuccuggagucucuuguuuccaagagacucccaguauuucuggugcucacacuugcccuuucuucuuuccucaggucuccucuuucugcucagaagcacuggugaccugugcugcucugacccacccccggguuccuccccugcagcccaugggccccaccugccccacaccugcuccaguucccccuccugaggccccaucgcccuucagggccccaccguuccauccuccgggccccaugcccucagugggcuccaugcccucagcaggccccaugccuucagcaggccccaugcccucagcaggcccugugcccucggcacgcccuggaccucccaccacagccaaccaccuaggccuuucugucccaggccuagugucugucccuccccggcuucuuccuggcccugagaaccaccgggcaggcucaaaugaggaccccauccuugccccuagugggacucccccaccuacuauacccccagaugaaacuuuuggggggagagugcccagaccagccuuuguccacuaugacaaggaggaggcaucugauguggagaucuccuuggaaagugacucugaugacagcguggugaucgugcccgaggggcuucccccccugccacccccaccacccucaggugccacaccacccccuauagcccccacugggccaccaacagccuccccuccugugccagcgaaggaggagccugaagaacuuccugcagccccagggccucucccgccacccccaccuccgccgccgccuguuccugguccugugacgcucccuccaccccaguuggucccugaagggacuccuggugggggaggacccccagcccuggaagaggauuugacaguuauuaauaucaacagcagugaugaagaggaggaggaagaggaagaagaggaagaagaagaagaggaagaagaggaagaggaggaagacuuugaggaagaggaagaggaugaagaggaauauuuugaagaggaagaagaggaggaagaagaguuugaggaagaauuugaggaagaagaaggugaguuagaggaagaagaagaagaggaggaugaggaggaggaagaagaacuggaagagguggaagaccuggaguuuggcacagcaggaggggagguagaagaaggugcaccuccacccccaacccugccuccagcucugccucccccugagucucccccaaaggugcagccagaacccgaaccugaacccgggcugcuuuuggaaguggaggagccagggacggaggaggagcguggggcugacacagcucccacccuggccccugaagcgcuccccucccagggagagguggagagggaaggggaaagcccugcggcagggcccccuccccaggagcuuguugaagaagagcccucugcucccccaacccuguuggaagaggagacugaggaugggagugacaaggugcagcccccaccagagacaccugcagaagaagagauggagacagagacagaggccgaagcucuccaggaaaaggugagaggccaggcagggaagguuccuugggcgagaagguggggcuggcgggagaagggguggcagcugcuucucuuaggagagguuugcccagccugaaccauucuucuguguaugugugugugacuauucugaaucuuguaucuuugugccuaaaaggagcaggaugacacagcugccaugcuggccgacuucaucgauugucccccugaugaugagaagccaccaccucccacagagccugacuccuagccaucuucugcaccccacucuuuguuuccaauaaaguuauguccuuagauagcgacugcugcuucugccuuuugccacaccuggguccccagccagaagcucaagugucugcugggcuuuucaggguguccauaguauuccccagaugucuccauagcuguccucuuuuugacgauccagagaggaacaacugac

SEQ ID NO: 16670 - RNA, 11308 nt, Homo sapiens
caaucgguuucaagggguugcagcggggcggggagaugggcgggaggagugggagcuggccccgcgcgcgggggagggcuaccaggcugggaaggagcgcgaagggcugggggcggagccaauggccccgcgugucugcuaggagagggcgggcagcgccgcggcgcgcgcgauccggcugacgcaucuggccccgguuccccaagaccagagcggggccgggagggagggggaagaggcgagagcgcggagggcgcgcgugcgcauuggcgcggggaggagcagggaucuuggcagcgggcgaggaggcugcgagcgagccgcgaaccgagcgggcggcgggcgcgcgcaccaugggggagaaacccgggaccagguaagggagguggggccacgcggcggggcaugggcggcggcucggggcgggggcugggacggucccagacgagggcgcagcggagaggaucugggggccggacgccugggucccuagggacagccauccggggccgcacgcgcagguccucgaggauaaugagggugggggggaaaugcccgggccccugcagaaagcgaggccugagggggaucagaaaaaccggugucgggguucucgcagggauguggggccagacuacugggcucucccgugcaggcugcgaugcagggauggaggaaggaggagcagguggcuggccccgaggggucguguacggggaggcuggaugccgggacgggggggauccacuccagacucgcgccaagccaauggaaagccuccuauccaauaucccccagguagucgcgcugcccacaccugucccgagggccggguggcuccucacccaaacuucuaccuucccuuggguugccaggagcaacagcuucaucuugggggagccgagugcguggcgacccucccugaaacuagaucguaucccucucucugggggugggggaggcaguauucacccugggcgcgcguccacuccccggauguuuucugugcaaucgaggcucuuuccuuccacugauaccccgaguucucuuuuuuggucucuagcaaaauccacuuccuguugugacucaacacccccaaggggcaagggguggaugccugagucgcaggggagcgggagcaaaagacgaaaagguuggggcuguaggccucaacucagaggguaucaggaauagggaauugguccugagcucuggcuugcucugcaaaacaucauaucaaccccacuuccaaccuauagaguaugagaacccggguuucugagcaucaaguagacgagcaucagaaagagaucaucagagagaugauccgucuccuggaucaggguuuaaacaucccagagaaaggggaaguugcugacuugugggaggccccugauuuccgucaugugguucagggagugggacggauggaccaaaggagacugcuaacuuggcacaauuucccucacccccaugaaauucugggccacaggaaauggagcgaauagcaggaagugugaaaggacaucugcuucagcuaccccugcucccacugggcaccucccuggucauccccacacucugccuccuuggccagccuaguauaugcacgcugcuccuccccagccuggcaggagguggcuggguuaggauccaaagggcaagugccuugcagcugcuccagggcaauugccccagaaccacacuccaguuggcccacugauuguggcugucacagcccugugccagggcuccuaaugggaggacacccugggacaaagaggaaaaccagaagcaaaggggagggagagccuggaugaugccacggcacucagcucccaaguugggaugaaagauaggguguuuauucuagcggcuaccauaucgauguguauucucuuuuauugguuaggaauaccuggggcccuccauacccuuugccuuacaaccuuuggacagcuuggcuuucugggaagaaggggcaagugaaguuguagcagaaacugggccuaugguagaaaccauguagggccaaaggccagggucauugcucuccuauaugcuccagcugucagagcuggagaccagauggaaagaugguuaggucuuacccagacacugugguaaccugcccauugggguccucugggaauggggugguagacuuggaagagggaugggcuaguuggcaggauuucacguuucugcuaucuaucugaggauccuuuccagggaucacugcugaggcagaguggauuggaaggaguaagguggugcuucaaagaacaggcccacaauuggccagaucacugggguugccaaacacuuccuuacccucccagcaauggguggaguccaggcuuaaauuguuucagcaacuggaaagcaaauaaccuucaauucaacaaacuauuuaugccaacugcagagacagauaguguaauauugaucgagaggauggacucggagccagacugccuugguuucuauuaauucccaccauuuacucccucugugaccuugaaacacuugaccucucucugccucaguuuccucaccuguaaaacagagauauuaggagcuccaucacugggugguuuuauuuaauuuaauuaauuuauuuauuuauuuauuuuuugagacaaagucuugcucugucacccaggcuggagugcaguggcucaaucucagcucacugcaaccuaaggccgggcacgguggcucacgccuguaaucccagcacuuugggaggcugaggcggguggaucaccugaggucagaaguuggagaucagccuggcuaacauggggaaaccucgucucuacuaaaaaaauacaaaauacaggccagacacagugacucaagccuguaaucccagccuucugggaggcugaggcgggcggaucacuagaggucaggaguuugagaucagccuggccaacauggggaaaccccaucuauacuaaaaauauaaaaauuagcggccgggcgugguggcucacgccuguaaucccagcacuuugggaggcugagacagguggaucacgaggucgggagauugagaccauccugacuaacacagugaaaccccaucucuacuaaaaauaccaaaauucgccgggcgugguggugggugccuguagucccagcuacucgggaggcugaggcaggagaauggcgugaacccgggaggcagaggucgcagugagccgagaucgcaccacugcacuccagccugggcgacagagugagacuccguuucaaaaaaaaaauuagccaggcaugauggcaggcaccucuaaucccagcuacucaggaagcugaggcaugagaaucgcuugaacccaggagguggagguugcagugagcugacagcgugccacucuacuccagccuuggugauagagugagacuccaucuccaaaaaaaaaaaaaaaauacaaaacauagccgggcaugguggcucacuccuguaaucccagcuacucaggaggcugaagcaggagaaucacuuaaaccugggaggcggagguugcagugagcugagaucgcaccacugcacuccagccugggcaacagagugagacucugucucaaaaaacagaguauuacaagagaugacacauuugaaacacuuggaacagugcugggcauggaguagucacucugaaauguuagcagcauuaccaucuucaugauauggcuggcauugugcuggagaugccuaaauuaauaaggccucugaggcucacagucugaggagggagggagcuaacuauccuugugugcuaccacaccacaaguaaaacauaaacaaggugugacaggaacccaaaacaaggagcgaccagggucugggcugggucagcuuccuaaaggcugggccuuaaaagacaaauaggcuuuuaagcucuugaggucggaguuggggacaguuggaggugaguagagucgaacuuggguagggccugugguagaaacuaucugagggccaaaggccagggucauugcucuccuauaugcuccagcugucagagcuguagaccagauggaaagaugguuaggucuuauccagacacuguggcuaccugcccauucggguccucugggaagagccugggugguuccuagggcaaccaguggccauuacuggggagggaaggggacgaaugaggguggacaagacaaggggcauuuccccuugccaccacguuagaaauaggaaggaccuuccgggaagaaggguuccccuugccaccacguuagaaauaggaaggaccuuccgggaagaaggguuccccuugccaccacguuagaaauaggaaggaccuuccgggaagaaggguuccccuugccaccacguuagaaauaggaaggaccuuccgggaagaaggguuccccuugccaccacguuagaaauaggaaggaccuuccgggaagaaggguuccccuugccaccacguuagaaauaggaaggaccuuccgggaagaaggggaaaggggcagagcugggcaaagccccacagccucaggcaggaggccugggugagcacugcuucucaggccugggagggagaggguccugguguggggucccugcugagucugagggaggcagugggguuucccuuucuguuuuguuagggucuucaagaagucgagcccuaacugcaaggugagucuccacagcacuuacccuuuugacccucccugggccccaacaaagcccagccuuccccuagacgauccccaaccuacccaaagaugauccccaaccccuagcuccccacuuccugugacagcuaagcgccgacuuccuucccuccugaagccccuugccgcagaggcugcucagccugagccagccacagggcuggguggggcaggcuuggguccccaagcaagaccacagaggaggaggccaaaagcaagccaugugccuguagcccuccuaggagccaacccaaggugcguggggcugggaaaaccuaacagcccccgggcuauggccuauuuauccuagagccccuugaggggaccuagugaggguggcagcugcucucuagcuggcugguugggcugaguucuccccgaggauccaaacacacacacacacagacacacacacacauacacacauacacacacaccuggcugguugggcugaguccucccugaggaugcaaacacacacacacggacacacacacacacacacggacacacacaaacacaccucgcugguugggcugaguccucccugaggacacacacagacacacaugcacauacauguucacacacacaccugacugguuggcugaggacacacacacacacacacacacacacacacaaacacacacacaccgggcuggugggcagaggugugcagagauaaaggagcagcucaaaagccuaaagguccacuagucugagaaacgccaccacccucacuuuccaacacuauugggaggaaaccuggaacaacuccuuccugauagcccagccuggagauccccgggcagggcagccaguuuugagggcuccgaugcccugucaccauccuccccaaucuccccugugaccccuugacauccucagcucaccguguacuugggcaagcgggacuucguagaucaccuggacaaaguggacccuguagguaaguuuucccagaaagggacagcucguuccccaagaggggaagaaguucccgggcccaggaaagcggggagcggcccuuucaggaagugagcuggugugucccccuccuagauggcguggugcuuguggacccugacuaccugaaggaccgcaaagguacuggccccaaguccagggggcccagggaaagugggggcuagggaagugaaaugggcuggccuuggaagggcgccccagagagauggaggcuggagguggaagccaggaguaggguucaggcaagucuuaugcugcugagggaggagcagcggcugcuaggugccaggggacuggggaaguggggcuccugaccacucaucucacccucccuugccaguguuugugacccucaccugcgccuuccgcuauggccgugaagaccuggaugugcugggcuuguccuuccgcaaagaccuguucaucgccaccuaccaggccuuccccccggugcccaacccaccccggccccccacccgccugcaggaccggcugcugaggaagcugggccagcaugcccaccccuucuucuucaccgugaggaugccccugcccucugagggccagggggcuggggcugggacugugucugggguggggguaaggcacugcugugggcagaucuggaagaaacagugaggcagggacccuagauccacuucccuucagggucccagugcauucaggaagcccuugauuaucugccuccucucuggggccccuuccuucuucccuucucauccccaggaguccuuucuccagccucuuuuuuguuguuguugagacaaagucucgcucugucgcccaggcuggagugcaguggcacaaucuugguucacugcaaccuccgccucccagguucaagugauucuuaugccucagccucccgaguagcugggauuacaggcacgcaccaccacacacgacuaauuuuguauuuuuaguagugaugggguuuugccacguuggucaggcuggucuggaaccccugaccucaggugauccgcccaccuuagccuuccaaaguguugggauuacaggcaugagccaccacacccagcgucuccagccucuuagguugagauuuggaggaagaucugggggcuuucuggaagaacugaagucuucuccuuccuccgccacagauaccccagaaucuuccaugcuccgucacacugcagccaggcccagaggauacaggaaagguacgggaggaacagcucugagggcuccuagggcaggacaugggccagcaggagccuggaggcacagcugagccagagggugaacugucgagaugccaggguggggccgaggguaggccagugucccccguggaaguggggcguaugugguggucauugugcacgcaugacacugccuccugcucuguggacccgcauggaucuggggaugggggcuccccuugcacuaccaugaccaagccucugccagguucugggcuuuggagaggaagaagacuuaguccccagggucgugagaccacaaugaggcaagagucccugcccgagaggagggaagggggaggaagaaagggcagugaugguggcgggagccuccgguaagauguggccuuuucuccccuccccgaggccugcggcguagacuuugagauucgagccuucugugcuaaaucacuagaagagaaaagccacaaaagguaagggaagugaccuccucugugguguaagaggaggcuuuccuccccgcuuccaggagcccaggccccgugcgggggaggaguaggguuggggugugugaggaaugaccccuccugccccuacucugaucccaggaacucugugcggcuggugauccgaaaggugcaguucgccccggagaaacccggcccccagccuucagccgaaaccacacgccacuuccucaugucugaccggucccugcaccucgaggcuucccuggacaaggagguggggcgugagagggugacacggaugccacggugcaguuuagacccugggggaggggcgaagccacacaucaagaggacauuuguaaaggagguugccuuggcuggguguggacaguugccgugggcuuggguuugaggggagggggccagaacaaugugucuguguuuggggacacacugaugaugggaacagugaaaaccaguuccaauucacaugacccccuccccccaaaagcuguacuaccauggggagccccucaauguaaauguccacgucaccaacaacuccaccaagaccgucaagaagaucaaagucucugguaggaggugggguuuggaagggggucuucggggagggcguuacugcacagguggcuccuggugugaucucagcccaggccauuucccagugcgggagacccaccagggcucaaagaauuuagguuguuccauaaugauacggggagccucgguguuuacugcuucaguggggagcaugggggggccacgccacggggucuggaguugugguguggugguggcuugugcuccauccagagcugccugaccccgucccaccccacagugagacaguacgccgacaucugccucuucagcaccgcccaguacaaguguccuguggcucaacucgaacaagagugaguaucgggagagacccauguuccaaucuaggggagaagagcaggaucaggagaaugugagguggaggaagaauucuuccugagccaucuccaccuuuuuuuuuuuuuuugagauggaguuuuugcucuuguugcccagccuggagugcaauggggcaaccucugcucacugcaaccuccaccucccggguucaagcgauucuccugccucagccucccacguagcugggacuacaggcaugcaccaccauacccggcuuauuuuuaauagagacgagguuucaccauguuggccaagcuaguugcgaaccccugaccucaagugacccacccgucgcggccucucaaagugcugggauuacaggcgugagccgccgcgaccggccaccaucuucacuuaaaaggguauucccuccacagccaggcuccaggcuguuaauuuucuugagcacguugagccaaaaccuacucccuugugaccugugcccaaagaaacaagggacuagugagggggagaugcugcuugggggucauaggccgccccuugcccagcccagcgccccuaagcaucuuguucucuuguccccacccccagugaccagguaucucccagcuccacauucuguaagguguacaccauaaccccacugcucagcgacaaccgggagaagcggggucucgcccuggaugggaaacucaagcacgaggacaccaaccuggcuuccagcaccaugugaggguggggcuggggcggguccccugcaggccaggggccagacgucgguucagugcucuauccuagugugccagggauguaucagugaacagaagagacaaaaagaacucuuacauucuaggggagggaggauagccaaaucugaucaguggucacuguacagcagguuuagugacaaguaugaaggagaaaaagccaggcagagaaggaagggauggggggcagugaggugcgaaggugaauucggaguaaggacccagcggaaguaagcaaugugggugagcaggaaaggaggguucugggcagagagaaaacaaagacucagagguggggcagccugggguguuggaggaauggggaggugccaucgugcccucgggcaggagcagcccuggagguccccagcuucacaaagggcuggauuucaccucuccggaugccuuuguucaggguucucacugcacagccacacacagcaggcccggagggcaacuuagggagaagaacuaaguaccaggagaggaggaggaggugaggucaggggcuaauggagagccagacggugcaaggcuguuagcggagaaggacgucagcuuuuccuggagaggagccaaggaggcucugagcagggagugcagugcgcacuguaccauaaccgcacggccugggcugcuggggcccugggggccugugcgaguuugugguccugcccagaguccccgugggaaccccacggugggccaggugacagggugauaggcccuggucugacuccaacacccucaauugcagcgugaaggagggugccaacaaggaggugcugggaauccugguguccuacagggucaaggugaagcugguggugucucgaggcgggugagugucaugggggagccugggugggggucacacuggcucucucuagucccaugucgucguccucuucacgaugccucuccccuuccccagggaugucucuguggagcugccuuuuguucuuaugcaccccaagccccacgaccacaucccccuccccagaccccagucaggugagcacacuacccaccccaagcccucagagggagggccugaagcagggccaguggaggaaaacuggcccuuccagcacccacccccacacccccucuucccguccccccagccgcuccggagacagaugucccuguggacaccaaccucauugaauuugauaccaaguaagaaacucauuccccuacuugacccucuugggacaaagauuccuauaacauucaaaucugcccucauaccucuuccuugcuuuugguggggagaagcggauuguagcaucaaaucaagaugccuuagccuugugaggcugccucuugcugccuuuucuuugucccuuccuguaaauaccucuggucccacugcuguucgaacgccucugucccagaggccuagcuucggggagggcagggagugggaggcugggacaagagucagaagcccucaccucacaacccucuuucccaccaccaagcuaugccacagaugaugacauuguguuugaggacuuugcccggcuucggcugaaggggaugaaggaugacgacuaugaugaucaacucugcuaggaagcggggugggaagaagggaggggaugggguugggagaggugagggcaggauuaagauccccacugucaaugggggauugucccagccccucuucccuuccccucaccuggaagcuucuucaaccaaucccuucacacucucucccccauccccccaagauacacacuggacccucucuugcugaaugugggcauuaauuuuuugacugcagcucugcuucuccagccccgccguggguggcaagcuguguucauaccuaaauuuucuggaaggggacagugaaaagaggagugacaggagggaaagggggagacaaaacuccuacucucaaccucacaccaacaccucccauuaucacucucucugcccccauuccuucaagaggagacccuuuggggacaaggccguuucuuuguuucugagcauaaagaagaaaauaaaucuuuuacuaagcaugaguguguguuuucucuguaguguuuagagaguguauggugugcuuauccaugauucuguuagcuugugggggaggacccagucucucuucugcacccaaaagccaccugacacggaggcuaucagcaaauguuuauuggaugacugugcuguggcuguguuccaggguaaacaucaa

SEQ ID NO: 16671 - RNA, 2201 nt, Homo sapiens
ucuuguuuuuauuguuauugcuuuuauuauuauugcuuuuauuaucauuaaaacucuaguucuuguuuugucucuccgaaugaagaaguauguauuuucauuaggccaagucugcgggaaggcuggggcagcagcaugaaguguuugaggaaguggguuggguaugucaguuuccaucuccucucugagccugucaggguguuucuggagugcagagcaggagcacccugcuggagaggccaaagcauagcugugggcaggcucgggcuucaguuuuuccaugcccaccauuugccccuuuguccuaggguacuuugaccagcaggguauguuggugcucauacuccccacccuacauguucccagguucugucccauggcacaggugauggucucccucucagcucuggguccaucucccuggccuaguucuccagcaucugcucacagguucgagccacaucacugagcuugaggcgggcauaguccacucgcuucagagccaucugacaguccuuccucgaagaguagcuggagcccucauggggcugcccuguggccaccuacaagacagacuaucaauggagcaccaucuccuuuacccuaacuccaaccaggcaucaggucucgucucauuucuucccugaguuugaauuuguuaggccaucugguagcuggguaaauaaaucauuuaacuuauguuaaucuugucuguaaaaugggggugacaauaacuacuuccuagaguuguugaggauuagauaaaguaaugcagaguaucuggcacaccguaaaaauuaguaaugguaguggucccugcgacgauuucagaaccuucucaauccugucccucuucucaggauauaaggauuugggaccucguggccuggaggucaggccaaguuuccagugacaaaguucuguaguucuagcauuauuuacacaucuucugcuaggcacaugugauguuacccagugagguaugcagggccaccuuuaauucuuucauuuuauuauuuauuauuuuuugagacagaguuuuugcucuguuacccaggcuggagugcaauggcaugaucucggcuaaguacaacaaccuccgccuccuggguucaagcgauucuccugccucagccuuccaaguagcugggguuaccgguacucaccaccaagcccggcuuuuuuuuuuuuugagacagucuugcuuugucacccaggcuggagugcagugcugcaaucuuggcucacugcaaccuccaccuccuggguucaagcgauucuccugccucacccuuccaaguagcugggauuacaggugcccgcuaccagcccagcuaauuuuuguauuuuuaguagagacggaguuucaccauguuggccaggcuggucucgaacuccugaccucagaugauccacccgccucagccucccaaagugcugggauuacaggagugagccaccgagccuggccuaauuuuuauauuuuuaguagagacgagguuucaccguguuggccaggcuggucucgaacucugucaagccacugcgcccggcccauucuuuccuuuuagaggaagaaacccgcucuggauggccggcuggggaggucugguccugcccaguuaaugcuccacccuggaucacccaagccugaggcuuugacccagagcugggguucgcucgcagaaccccccagacacaccgaccugggugagguagcggaucugagcugacagcuccgccuccacguguugcacugaagcggugaaggccgccgccugccggucuaggagccgcucguuaguuuuuuccuuggacaauucuaggaucacaguaccugccagggcggagagagggcggggacacacggagacugccaguguagccucucccuaggccagccccucucagucccgcccuuucgcugcgcacgcacguaggauucccuccccaacccugcuccaagucccaggucaggcugccagugcagcccggucacgcuuucgcuccccgcuguccagguugucgcaucccgaaccugcauucugaaggauggcgccgauuucccguucaaugucuuccagagcgcguagucucucguucgccaggcuguagguagccauuaucacucugggaauucucaccaagaguuucuccucagaaacgcgacgcuuguuccggaaguggcucucggugugcgc

SEQ ID NO: 16672 - RNA, 1084 nt, Homo sapiens
cacagacgcuacaggauggagcggggcgcaggagccaagcugcugccgcugcugcugcuucugcgggcgacugguuucacaugugcacagacagauggccggaacggcuacacggcggucaucgaagugaccagcgggggucccuggggcgacugggccuggccugagaugugucccgauggauucuucgccagcggguucucgcucaagguuggggcucaggcguagguccuggagagggcggagaugcgugggaccauagagccaaggaugauaauuccgugacucgcccuugccccucuccucgauacccagguggagccuccccaaggcauuccuggcgacgacacugcacugaaugggaucaggcugcacugcgcgcgcgggaacguccuaggcaauacgcacgugguagagucccagucuggaagguggggcgcaggggucgaggaucccuuggggugaugguaugucccuuacccucuauuacauacuccgucgcaacaggcaggcuggcuccgccagagcuacggggcaguauagaccggggaggcgaaggguggauggaagaccccuccuccgcuccucggcggaggucggggagcacccagcccaccaggucauauacacagcacuuggcuuggaaagucucaagggcuuggugaauggggggcccgcagaggcaacgcaucucccuuugccuugcagcuggggcgaauggagugagccgcuguggugucgcggcggcgccuaccuaguggcuuucucgcuucgcguggaggcacccacgacccucggugacaacacagcagcgaacaacgugcgcuuccgcuguucagacggcgaggaacugcaggggccugggcugagcuggggagacuuuggagacuggagugaccauugccccaagggcgcgugcggccugcagaccaagauccagggaccuagaggccucggcgaugacacugcgcugaacgacgcgcgcuuauucugcugccgcaguugaacggcgccgccgccgccgcucucucccgggccaggaggcuagucccaccucuugcuauuaaagcuucucugaguugac

SEQ ID NO: 16673 - RNA, 1602 nt, Homo sapiens
gucgacgcugccaaauauugcuuuuuuauuccucacagcuccucccgucuuuccgagacugcggacagagggagcucaacgccauucccugccgggggcggcccucgccgcggcgacgucacggaagaggcgggauacggaggcggccgcggcgcgggcugcaggacugaccccgggcugcgcggccccaccccgggcgguccgcuccguucccgccgguccccgcagccgccgucuuaggccagcuggagcaggccgcgcucggccagcaggcucugggugcgguuguagacauccuccaaggugccggcggcccggaccagcgcggcccgcgccuccgccucgguggcuccgggacacgccagcuccagcaggcggcggcgacccgggaaggcgaggaaggcgaggcgggcggucugucggaccagccaggggugaugcggacccagggccgcacgguaggcgucgcugcacugcacgcccgcguccgggccucccagcgcgccggucgccacccgguggaggcagagcugggaccagcgcagcgcgcggugcagcaggagcagcgugcgagagcccgagcuccgggucgggucccggggggccgcccccggcugcuccagcagucccgcccuccgcucccacgccgccauggccaccagcgaccaguagugcuccgcguccgggccgugcacccgagccuccaggucugucaccuuggugaaggccucccuaguggcgaaggcgaagacggagccgaggggagucaggaaccugcgggcgagacgauuugagagaauggagauggagccgccaaggaggcggggaccggcuggggggcgggaggccacucacucgacgagugcccuccaucccgccagguacggcgacagccccacauccccuucggguuucagacuggcguggaaccgccucaucaugcggcccagcaucccccgagggcccagacacggaggcuguuuccucuccggggccuccaggguucccgacuccugccggaccugguggggagacacgaugggaagaggugggagcagauucugcccugaagaaauuguuccgaagguuuagcuggcggcucuucugcugugcgcucagcuuccgacgggagaggguagaccgggggaggacccgcccuuugccggacccucagccuggcuccacgucccccuguucuggucccuccuggagcgcccgcgcccaauccugcgccuagcguaccuggaagggcgccguuuccccuggaacgcagggcugcgcccuggguccgcagcccgagcgggcgccuggguagaggagaagcggagcggugagggcucgagaaagaggcuugagucgugagggccuggauuccgggcuuccucccggagcaagugagggaaggggcagcucaccuaggcuccgaacacugagauaaagcagcagcagcgcgaagauagcgagaggaauugaguggcugaaccagugccgcagggcugggggccgcgccgccacucccaugccugcugcugggaccgccgcccccucaccagcgccuagccaguccgugucccuccgccuccaggaggggacagaagcccg

SEQ ID NO: 16674 - RNA, 2518 nt, Homo sapiens
ggaauaaagcauucauaaacuccuuucaucuccucuccaacuugcucugaguucagugcaaugguuuuuacaaauaggaaugggccagacaaauucggacuugaagucaaaaaaaaaagaaccccaaaguacaaagauucucugugacaaacuuuauuaaauuuugcaucaguacagggcaucucuuauugcauacuagaaucccaggauucaggcgggugguaaaguggcaacggcgaauuuggguaucuggucucccaaaaguacuugccgcucuaccccugacucugcaauggcugccaggcggaucacuccuccacuggagccaucccgcuccauggccaaagcgagagcuguggauaaaagaagaaagcuggguucagauucagaugccgggaucacugcaaggaaugaggaaugcuggccuggcuuggguaguugggguugaagcucauaggcccagaagccuaagcucucaccauuggcagugaauugcagacacucuuccuuggucaugccuucccgguagguagcaucaacauagccauagauguaggagcucccggagccuccaauggcaaaggacugccuuaccaucauaccccccauaggcacugaguacaccugccagauagaaggagaggagucaccagucguauccucccuccaacacacguacauucaccuguccauucugcuauuggucugaggcacguuaauaguaagaauaagugagguagagacuggaaagaaaaagaaaauggcuggggagaggauaaaaguccuggcucaagugugcucuggucggguggggaucugaccugcccuccuucuugagggucccagccugcgaugaugauucccgccaucaggucuucccgguaucgguaacacaucuccuuaaagaggcuggcugcuguguggaccaguggaggcucauucaguucaaugcuagagggucagggaagucacagagaaaguuucaagaccuagaagucaggcuauuuagcuccucagcuuccaacucccuucagauacuugccccuccccugcccacaagcaccuguggaaaccgagcugguaggugacagcaucagcuacugccuggguaucagcagcugagccugagcgacagcagaaaaugcggucgugaauaggugucagcuugucagucacucgauuggcgauguaggaccugcaggauggcagaauagugaggaaaggagcccaccugucuuccaccuccaucccaucacuacccacucucuuagggcucagggauaggauguccaguauugccuuuuuuuccuuuuucuuugagauggagucucgcucuguugcccaggcuggaguacagugacgcgaucucugcucacugcaacauccaccuccuggguccaagcgauucucuagcccuagccucccaaguagcugggacugcaggcacgcaccgccacgcacggcuaauuuuuguauuuuuuaguagagacgggguuucgccauguuggccaggcuggucucgaacuccugaccucaggugauccacccgccucggccucccaaaguacugggauuacaggcgugagccaccgugccuggccuccaguauugcuuauucucauccaaacugaagcgggcuggagaacagacuuuuguaaggauuccacuaacgagugaggggaacugaaaguaacaaaaguugggacaaaucuuuaucuccagagagagaagaaaccucucuucccacaguggucuguggaggcaggcagggugggcuggcaggcaggaaaggaaaaggaagaugggaagaccuuucacaaaucuguccugagcucacccagugguuguucuggaguccgcccccagaaccacgcccccgucaaacugcacggccaugauaguggucugggaaaagggaaaaaggaguaagucuacauucuccagcagacacaaaccucaaugaucucucuaccuaguuccaaaaauacaaaaucuguccgucgcugaaccauuuucaaaucuuauaggggccucagcaccccgcagaauaccagaaugccaacccucaaaucucaaaagacucaucccguacuuaagcccaagauccucacuagccucgcaggauuucagaauuucaaacuucagcccacccuccaccucccacuacgaagcuaccgcaccacuccaccaucuucgggguaccucuccccauuccuggagcacaacacauuccaccuccucuccaccccugccagaucucucaaccccacucaggcuuuaucuucccaucgcgucaggccuugugcacguccuaugaaccccgauuccuuccucaccccaguggaaacuucucggcuuucccagucuggagugaacgccuccggcccccaagccggugcuggcccggcuccccgagcagcuaguaagguagccgccaucuuucuccuccgguacugccucaaagcaacugucguaaagcgcucugucacgcucuuuggucgcgcuuugaggccuucug

SEQ ID NO: 16675 - RNA, 8294 nt, Homo sapiens
ugagaccccuccuuccugucccacaggacaggaaaugcucagaguugccaggggaccugggcaaagacucaaagcuaacaagugacagaaaugggacuugagccagaccuuuugacuccaaguccagcacucuaucccccucucccaugcaccuccucuccuccugucuuucuccuccuuucugcguauuaugaggugccaagaccugauauaggggauggagguaaaaagagauggggugagaagcugcagccccuccucccaccuccuccuccuucuggcagcccuaguggguggagagggcacucggcucgaccagcugcaguacgacgugaggaaggguucuguggucaacgugaaucccaccaacacccgggcccacagugagaccccugagauccggaaguacaagaagcgauucaacuccgagauccucugugcagcccuuugggguaagccagggcagggacagcugaggaggcucuggcguggcucuugugcuccugguuaggugagggccuggcugagccucugaccugcccaagggcuccuguugcaggggucaaccugcuggugggcacggagaacgggcugauguugcuggaccgaagugggcagggcaagguguauggacucauugggcggcgacgcuuccagcagauggaugugcuggaggggcucaaccugcucaucaccaucucagguacagguguggugagugggggagggaggaggggcucagcuccuuggcgcugucaccaucuucugccugggaggagggcaggcacuggaagguggggccacacuuucucaccccuugugguaugcugacagaggaggccagggcgguggcauucgggccucagaugagaaugggggcggguguguaugucuguccgucccucagggaaaaggaacaaacugcggguguauuaccuguccuggcuccggaacaagauucugcacaaugacccagaaguggagaagaagcagggcuggaccaccgugggggacauggagggcugcgggcacuaccguguuggugaggaugucccaacagaguggccagcgcauacuuguucaugaagagagaaauggaucugggagccagggacuuggggccuggguggggcaguguagugacagaccacggggaggcgcccguggcgcaagaagggaagucucagcaucccucuucucucccgcccccagugaaauacgagcggauuaaguuccuggucaucgcccucaagagcuccguggagguguaugccugggcccccaaacccuaccacaaauucauggccuucaagguaaucccagccucggucccuaacaccaucuggagucccagcgccucuccccgugccccugagcccuccucuccuccgguucucugcaguccuuugccgaccucccccaccgcccucugcuggucgaccugacaguagaggaggggcagcggcucaaggucaucuauggcuccagugcuggcuuccaugcuguggaugucgacucggggaacagcuaugacaucuacaucccugugcacgugagcuuggcggggcugcugggggagugggauggcccagucugggcaccagacacggagacucuagucccccuccuucuccccagauccagagccagaucacgccccaugccaucaucuuccuccccaacaccgacggcauggagaugcugcugugcuacgaggacgagggugucuacgucaacacguacgggcgcaucauuaaggauguggugcugcaguggggggagaugccuacuucugugggugagugagcugccgcccucccagccacaugccccgagguggccccggggugcagccugcucagccccucaccuguuccccacagccuacaucugcuccaaccagauaaugggcuggggugagaaagccauugagauccgcucuguggagacgggccaccucgacggggucuucaugcacaaacgagcucagaggcucaaguuccugugugagcggaaugacaaggugggaggcuccuucccucugaaagcccugcugucccggcugccaugacccuaggccccugggcagaguucuggggagaggaugguggugguggcuuccugaaagcgggccccucugggagcucagagggcagucagccacuaccacugcccugcgcucccuucagauuccgaggacuucccagcuggcccccagggggcgaguggugcacccucuccccuaacaucccagccugccuuuccuccgggugaggggcacugugagucuccuccugcagucucugugucucccucaacucuucugccaccccuucuucccuucuuucccucucccaguugagacacccccccaaccucagcccuuggugacuucuucuccugccccacccagguguuuuuugccucaguccgcucugggggcagcagccaaguuuacuucaugacucugaaccguaacugcaucaugaacuggugacggggcccugggcuggggcugucccacacuggacccagcucucccccugcagccaggcuucccgggccgccccucuuuccccucccugggcuuuugcuuuuacugguuugauuucacuggagccugcugggaacgugaccucugaccccugaugcuuucgugaucacgugaccauccucuuccccaacauguccucuucccaaaacugugccuguccccagcuucuggggagggacacagcuuccccuucccaggaauugagugggccuagccccuccccccuuuucuccauuugagaggagagugcuuggggcuugaaccccuuaccccacugcugcugacugggcagggcccuggaccccuuuauuugcacgucaggggagccggcuccccccuugaauguaccagacccuggggggggucacugggcccuagauuuuuggggggucaccagccacuccaggggcagggaccauuucuucauuuucugaaagcacuuuaaugauuccccuucccccaaacuccagggaauggaggggggaccccgccagccaaaacauuccccccauucccgaccccccucuccucuucuagcccaugcccuuccccgguggagggagggagcagggagcccucacucuccacgccccuugcuugcaucuguauauagugugagcagcaaguaacccuucucccuccccccccaccccuccucaauguaguggccuuggauauccuguuuguuaauaaagacaauucaaccagcucccaccaugcaggccgcauguccuugcuuucugucaguacuguagacuaggcagagagagccuccaggguggggaagaaaggggcagggugggcugggaucugcaaugagugagccucauggggugggaugggcagugcugggccaagaaaaccuagaagaaaugacuguggaagggucagggcagccucagccuuaaaccugugggccugagggccaccagcacugaagguguuugguucccacccgcuccagcagagccagaccagggaagaagaggguuuccuggcuacagccucccugugugcaaguccugcaaaggggucuccuguuuggcuaugaaaugaauauagauagauagcucacaagcuggcagccaccagagucccguggggcugagccuuagaaaggcugggaggucagcaaggcugaaugaagggcaguccuugcuuucuggaagacuggcaccugagagccuaugugaacccuuuccuccugcugaccccuggacugcggccaggccuacacacgccagggaacgggcacacaccauucuugugaaguucacaaacugcagauugaucagcagggggaagggaucauaaugccgugguggcggcagccuacuuuuucaaaaucaauuuccuacuggagaugggugggaaauugaagucggugcgagcuaaggcuggauacacggcgcguaggggagaucaggcacucgguugaaguaggccccgaggaagaugaggcuggagcccacgcugaagagcaccagagcggcccagaagcagauguugucaagggcauuccccaugcgcacccagucggacacuuccuggggaagggucggcacagucaguaaagaggcagcugcaggagccagcggcaugggagacaguggugggccucugccucgcuccacccgccucuggcuccugucccaccucgccgguggccuccugaucucucgugcucucggccacgaaguucacggcauccacacagcagcggaccucgggggcggcggcgcccaggcucuggcagaaggcagcuggcggggaaaacaccggggugggccuuaggagccuccccccuggcaggcaccccgcgcggccccccgggccagggccacugugcucacccguccagguccccugccggugccucugccccucaaacacgagcucgcuccguggcuuuuucaguaucagcuccuccgcgcggagcaauaagcccaccgacgacgcccgccuugggggcgaggcggcccggggggccucgggcggcggcggggagcccaggaggcgcggcagcagcuccaggagaaccuggggcaggggcggggcuuaggggacgagguuaguacgaagccccaccccgacccgggcugcaccgcccccuccgcgcuuacguggcgcagccgcggggacauggcguggguggugggcguccgcugggacacguugagcacgaugacgcaauucaugacaaugagcguggcgaccaccaugacgaaaauaaggaaccugaggagcccggaaggcaugacaucaccguuccuccucccagcuaccgaaggcgccgcgcgcugaccucacaaacacggcuucuccugguacgggcugguuacgcccuccagcugcgcccccuacacgacgacagacgcgucccccagcccuucuccuguccuaccacuuguggcggccaugaaggggacccccagcucccuggacacccugauguggaucuaccacuuccacagcuccaccgaggugaggcuacgcccgccaagggcugcaccucgagaccuucuggguaggucuccuguucgccccugugaccccugcccugcuacucuacugcucugcuccuucuccagguggcccuccagcccccgcuucugucuucccuggaacucuccguggccgcagcccaugaauaucuggagcagagguucagagagcugaagucccuggagccacccgaaccgaagaugcaggggaugcugccugccccgaagcccacccuggggcugguguugagagaagccacagccagccucgugagcuucggcaccaccuuguuagaggugggguacuggggggcuuaggauacgcggcgaucggguagcgggaacaaggaccucugccuccccgcuaaccccugugcccccaaugcagaucucagcccuguggcugcagcaggaggcgcggcgacuagacggcagcgcgggcccagccccagacggcagggauccgggugcagcgcugagccggguagcccaagccgcagggcaggggguucggcaagcuggggcugcggugggcgccagcgcccggcuccuaguccagggagcauggcuaugccuguguggacggggucugcaggggucugccucauuccugcgacagucgcaacagcagcuaggccucggaauccccggagaaccggugagcucaggacacggggugaguuaggggccagaggcggcggggcuagggaggcacugagccggacugucccccaagagagcuacucgggagaccuccaggugacguccagcagcagugaggaggacggcggaccagggacuccauccccguaccagccccacccagcguccgaauaaagcccagggcggggcgagacagccagagcuuuucccggggucucuggguuuuggccacgcccccacccuucacacuggccacacccccgcgggggcuccggcuucaccugcccaggagcggcacgcucagagaagucucugggauuuucugggcaaugaggaacaagaagacggucugggcgagcaggacguugauggagaccgugcauuucuggccgccggcuggagggagagccagugagagcgggccccgccucccgggagcgagcccggguuuggggguagguucggggccacugcuuacccugcgccggcaggaaguaggcgagcagcaccaggcccgagaugagcacacagggcacgaugauguuaaugacguagaagagcggcuuccggcggaugaugagcgaguagaugacgucagucuccccugggccgucgguggcgccaccgugguggcggcggaucacccccgggcagaagucgauggcccacucgccguucucugcgggacgggggcacggucagcuggcugucagagcggggcgcccgccgagcugacagcgggcugaagaggaggcugcggcugucugcaccagggucaugggccgucaggaugggggcaauuacggacagaaaagggcauucucguugaggguauggaaagccagaaggcaggacuagaguaacaaucgagaaugauuucaggacagggguaagcuaaacccaguuguggaagucauccuccagugucguugguccggggcaagcccaccguggaaguccccucucuggaccccgucuagaagcggguuuuucugagcaggcaggggcuucaccaguauaggccucugugucgaugucgaucuuguugauggucuugccgucguugucuacggcaaaagugaacuccaccucuucggcauuguacgucugagagcugcggagccagggccgggagcccaccccagaagcucugaccugggccccggccucaggcccagcccuggaagcugggaucuagcggggccgcgaucccaagcccaccccuucacccaagcccagcccgcacgccucuguucccaucuguaccuccggccgcgcuggagcgucccacccagugccuacgccuggcuccgccuccagcgcgaagccccgccccgagggcggugcuucccgguuggccccgccccauaaggcccccccccaacaauaaucguccgggccucggaguagcucuucccaccggaaaauaagcgaacaguucugccaaucgaaggggaaguaggugaccuccacugcgcagacgcugcgguagauggccggaggcagccacgucacggagccgcccucguagacgagcacguuggcgucguaggccacuccgaacuggccaucaauacugugggcucggggaaaccgagcuuuuugcacaggucugcacccucucagaguacccccuuccccaaccaaguccagcccgcaccccaggccggcuucccuccagccuggcgucuggcccgguucucacuuguuuuccagcacaaucucuggcagccacacgaguucugaagggacucgcaggguuucuauacccccaaagucguccuugcuguaguugagucgguaauccugccaauccuaaggggugggggauggaaggccgcgugcccugcaucucccaccuggcgcugccugggagggguuugggggaaaaggggugcccuggacaagaccucacaccauuccccagauuugacucacgauuccaauccagacgcuaguggugagagucuccucuuuuucauucugcagaugggagauggggaugauugaagugagauuucagggccagaagugagcuuuaggacagagcucagcgguuggggccagaagugggauuuuuggcuuaagaugaggguggggguagcuuaccagugagaugagauucgucagggugaccuugaggcugauggugacaguauccucaggcucccgcacuggccggcuuccugggucauaguuguugaagagauggugauaaagacgcaguuccucguucuuccccacaccccugccugcgauggggucaagaaggaagggucauuggcaaugaagaggcuggagcaccucucuccccucugccuccccuggguccucacaggccucugaggcuguguacuaucaguaucugucuccuaaaccaauuaugcugugccugggaacgaaauacugugucuaagucuccaucuuggucucugucuuugucuucccagucccuucaugucaguaucuguguguguccaauugccccucuagccccuguccguaccgagaagccccaagaggagcaggaccccaagcggagcccuugccauccugcugcgugguucucaggg

SEQ ID NO: 16676 - RNA, 1062 nt, Homo sapiens
ggcuucuccugguacgggcugguuacgcccuccagcugcgcccccuacacgacgacagacgcgucccccagcccuucuccuguccuaccacuuguggcggccaugaaggggacccccagcucccuggacacccugauguggaucuaccacuuccacagcuccaccgaggugaggcuacgcccgccaagggcugcaccucgagaccuucuggguaggucuccuguucgccccugugaccccugcccugcuacucuacugcucugcuccuucuccagguggcccuccagcccccgcuucugucuucccuggaacucuccguggccgcagcccaugaauaucuggagcagagguucagagagcugaagucccuggagccacccgaaccgaagaugcaggggaugcugccugccccgaagcccacccuggggcugguguugagagaagccacagccagccucgugagcuucggcaccaccuuguuagaggugggguacuggggggcuuaggauacgcggcgaucggguagcgggaacaaggaccucugccuccccgcuaaccccugugcccccaaugcagaucucagcccuguggcugcagcaggaggcgcggcgacuagacggcagcgcgggcccagccccagacggcagggauccgggugcagcgcugagccggguagcccaagccgcagggcaggggguucggcaagcuggggcugcggugggcgccagcgcccggcuccuaguccagggagcauggcuaugccuguguggacggggucugcaggggucugccucauuccugcgacagucgcaacagcagcuaggccucggaauccccggagaaccggugagcucaggacacggggugaguuaggggccagaggcggcggggcuagggaggcacugagccggacugucccccaagagagcuacucgggagaccuccaggugacguccagcagcagugaggaggacggcggaccagggacuccauccccguaccagccccacccagcguccgaauaaagcccagggcggggcgagacagccagagcuuuucccg

SEQ ID NO: 16677 - RNA, 1062 nt, Homo sapiens
cgggaaaagcucuggcugucucgccccgcccugggcuuuauucggacgcuggguggggcugguacggggauggagucccugguccgccguccuccucacugcugcuggacgucaccuggaggucucccgaguagcucucuugggggacaguccggcucagugccucccuagccccgccgccucuggccccuaacucaccccguguccugagcucaccgguucuccggggauuccgaggccuagcugcuguugcgacugucgcaggaaugaggcagaccccugcagaccccguccacacaggcauagccaugcucccuggacuaggagccgggcgcuggcgcccaccgcagccccagcuugccgaacccccugcccugcggcuugggcuacccggcucagcgcugcacccggaucccugccgucuggggcugggcccgcgcugccgucuagucgccgcgccuccugcugcagccacagggcugagaucugcauugggggcacagggguuagcggggaggcagagguccuuguucccgcuacccgaucgccgcguauccuaagccccccaguaccccaccucuaacaagguggugccgaagcucacgaggcuggcuguggcuucucucaacaccagccccagggugggcuucggggcaggcagcauccccugcaucuucgguucggguggcuccagggacuucagcucucugaaccucugcuccagauauucaugggcugcggccacggagaguuccagggaagacagaagcgggggcuggagggccaccuggagaaggagcagagcaguagaguagcagggcaggggucacaggggcgaacaggagaccuacccagaaggucucgaggugcagcccuuggcgggcguagccucaccucgguggagcuguggaagugguagauccacaucaggguguccagggagcuggggguccccuucauggccgccacaagugguaggacaggagaagggcugggggacgcgucugucgucguguagggggcgcagcuggagggcguaaccagcccguaccaggagaagcc

SEQ ID NO: 16678 - RNA, 2749 nt, Homo sapiens
ccuaaaauuauuuuuuauuauacagauaauauacaauaauaguggaaaacuagaaaaugcuaaacagggaaaaagaaaauaaaaccacccauauuuguaacauccagacacaacgagugcucacauccugauaaaucacuuuccagauuuucuucugugcauagaugcaugugggaaccaugcuguauucugccaaaaugguucaccgugagaucuggcagcgccccaugcagcaucgggagcuuugucuuguccccccgccaaguccaugucauuaccccuucugcuuuggcugggacugaaauugugugccuguguugugaagacagggcuucugauacagaaaaaggaacuaagaccccucccuaucacccuguguuccuuaccccuccaacccccaacuagauuccaauaggagagcccacaggcucuucucucaagguccccaaaccucccacccucagaggcuguggccagaguaccuaaugcucacugugcucagcagguccugaccacgacccugacucagagcugagggccuccuuccugccacuagaggccccacacggccauuaggccguacccacaggaagaggcuggagcggaaagugggaagcgaaccucgaaggaagagcagccaggcccggggcacugucacuugccguccccucugcagcuccaggugugugguuuguguggcuguggucagagcagcaccuuggccagaguccagggccugugguuucacaugcccaacccagcucagcagcaggaugaggaccacagaggcaaagagcagccagaagagacccaagacauagaagcccagggggaggaggcagcaaaagucgggguggagaaaagggucauuucuggagcucuccaaaugcccuuggagcaccccacggagcuuugguggcugaucaaguucagggaugguuuuuuugguggauucuaagagugauacggguuuugugguaguuaaaaaugugcuuuuuggagugaucaggcuuguggcagacaccaggauggucgggcuuguggcgauggucgggauuggggugggcuccgggguggucgggcugggggcgggcucugaggugggcucugggguggucgggcugggggcgggcucugaggugggcuccgggguggucgggcugggggcgggcucugaggugggcucugggguggucgggcuuggagugggcuccaggguggucauguuuggggcgggcuccgggacgggcucugagguggucgggcuugggguugguucaguaguggauuuuggaguuuuggagaaugugauggauuccaugugaagugugaaauuugggguccaucuaggugggaauguggucugcuccuuaguggauucuuguguuggaugcaaggaggagggcauuuggcugucuagagaagcaguggaccaugaguagaauagaccccaggggguuguaugggcuuugguggggaacuugaccacaguccuuguggcacgcaccuuaucgcccucaguguccucuucuggguaguaaucauauaggucugugucaccuucaucaccaaggguggggcaccccuuuccuggguauuuguagacgggaaacuugucugaauugucacacugcacacuggccacguuagaggucauggccuugacguccacaccuugcuuccauacguagacauuuucagcauuguccugcagccagcgacgaaaauagaggaucucacaguugcauaaccagggguucccguggagaaaagcaaaaggcaggaggugggacccaaaaaagcccuuugguauuguauacagcgaguucucuuggaggagaagggugucgagauucuccagcccauucaggagcccagcggggagcucagucaaguuguuguuagccagacugagcuucuccagcuugggugugggcgucaggagcccugggggcagggucuucagcucauugccuuucagguagagcucuuggaguucgccaagaccacgcagggcaccaagaggcagcgaggucagccgguugaaggagacguccaggacggugagagcaggcagugucugcccuagcaagggcaggcuuugcagcugauugugggauagauccaggguccccagcacuggcagcgucccaucgaccuggagcuuggugagcucgcaccuaucuagguucagcugagugaggcgaguguaaggcaucaggguugccagggagaagguguacaggagguucucacucagguggaggaugguugugucuuucggcaggucuggaggcagcgcugucagauuccucuugucacaguucacuucuagguggcuggccacuuuggagaccucacagaugggguggggguguaaggggcuuggcagcaggagcagcaagaggaggagaggcaugaggaccugugggcaagggagccuugaguggaucccccugcauccccuggaagcauccccccaggccccagcccccuucccccugcagcuucgcuuccagaaacagcauccacaccuccuguccucccuacucccaucucccacccuugccugcagaacuuaaaacuacuagcuccagguccuuggcucuuuccccucccucagaccccucuccugccccagcaccaaccccggcuuacaggcaggcagaaagaccuccgaaggcacagagcgucuucuagggugccacucgacuccguccuucucucuucuagccccauggaggacuaa

SEQ ID NO: 16679 - RNA, 889 nt, Homo sapiens
ggaucacgacggguggcaacgcaaaagcccagggggagaagggaugaguaccugugucggcagcgccgcaggaaucucaugaucuuccgggcugccugguccugcuucuuggugagaaaggagccucuggugaaagaaacaaaagauggaccucacagaaggcaucgcaugccuucggcccccccaggaacccuaggcagggaauggcagugaggcaugaugaucaagaggaugaguaagggggaauggcguggaugcagugggugggcacagagggcuggggcugggcccuacuuguugcgggcaggcaggguggccgaaguccgguggggagggccgggccugcggcgguaggagcgguagugcugcuggaugagcacagccgcucggcggcucugcugaaaucgcuucuguucauaguagcuucggaacuugcucuggaucaggauggccgccugggucaucuucuuauagagugcaaacugcagggguggggaggagggacaggggcugaaauagagggacggagacccaaagcccugaggcucacccaaguuaggcugaugcaagacucucuguaacccacacacucaaggaaagacugaaucaucacagaccucacacucagagcucaugccuaauaccuuaagugcaauccaggucagcuuguggagagagaaggggaguuagggcucuggcaacauucuggaaugguuaggcguggguguggguugguggguugcugguuacacuuuugagggagaagggucucaccugcuuguacuuccgguaacagcgcuggauuacagcugcugcuaccuccugcugcuccuucagccgccggcccugaagggagagaagucucaccaccucaugacccacauaaugg

SEQ ID NO: 16680 - RNA, 12955 nt, Homo sapiens
uuuuuuucuguacaaaucuauuauuucuagauuuuuguauaacaugauagacauaaaauugguuuaucuccuccaaggcaguuugucuuuuucuauuccucccccuucaaccugcgucacaaaagaccaagaacagaugucggaaaaguuuuuuuuucuucaguauuguuuaaaaguuucaauacaaaauaaguuauaaauaaaaggcuuguauguacaaggcuccucagagggaaugaguugucuucaaccccauagaaugaugugaguccaagcuggcucuagaggaucacagcccaaguaucacaggccuagguuuaaacaggaaaauaauuagcuuaaauuguauucuagucaugaaagauaucugauaaaaguuguaaucaaugagaauucuacacauuagaugaggucuccugaguccaguuucaauuaguucaguaguguaguuugucaugaugaccgccccucuuuggcauugcuggaccucuguccugcagccuucaaacaacugcccugggaaccaucagcaucaauagucuucaagcuaagaucaaauccuguagaugaacuaaucaaacauccucaccaucaggaaaccacugaccagaaagauuguauucaaacucuugauagccuggagcuuuuagagcccagcaggaagaugagacuccaaaucuacacaagauugaagcagguauguaucauaggggaggugcaaaccaugcaugaucaguacgggcagaaaacauguaaagacaugaucaguaagcaccugaguguaaaacugccucccgacuccuggguggcucagccucuccacuaugcuaaggaauccagucuguccuuaacccauuuaugccagagguugcaaauuuuuuugugugaaaaaucagaccuuggcgaugaccuugagcaguaggggaucaauaacucccacaggcuuagcguuccaauaauuaaacaguaggcauaaguggguuacucuuguuucuuaccacuuccacagguaauauguuuggcuuucucuaaaagacacuguaacucugcuaauaggcgguuuggcauauuccaucccaggaccaccacuugagcaccgccacauccgaaacauuccucgucuugugauagagugcaaucuucuguaacccaccccuaucuuucaacacauccucagccaucuguccugagcgucccuacguccugaccucacuggauucuaacacaaugguccuugauucccccuuaagugaaaaccaaaggucuaguggaacuagagcauuccaaaugucuaccuuuccaaauguugaacucaagaccuacagaauacaauuuugucuuucccccuccucuuuuuuuuuuuuuuuuaaggcacaaucucgcugucacccagccuggagcgcaauggcgcccucucagcucacugcaaccucugccuccugagcucaagccauccucccacuucagccuuccgaguagcugggaguacaggugcgagccaccacacccagcuaauuucuguauuuuuaguagagacaggguuucaccauguugcccaggcuggucuugaauuccuggccucaagugauccucccaccucagccuuccuaaaugcugggguuacaggugugaaccacagugccuggcuguguuucucauauuugcugugacccccaccuccccucacuuacccaacaauggucuuccugcccaccccagagccggcacugucaacuaugaucuccaagacugcugcacagcacucaccuuccaaaccucaccuccuacuuagcuucacugcugcucugagccacagggcacugacgguuaggugaguggauaacugggguccauaacaauuauaugcugagcugaagcuguacacuuggcaauuaggccaucuuccacuuaccuuuuaauuccccuucucuucccccgaccagcauuuugucuuucacacucaaggggacuuucauacucaaggagcuguagacuccagcucugcuaccauuauaaucuguguggaugacucacuguucaccuuacuaagaagacagaagccaaagccagcugaccugugccucaacucuccucccuccaccuuaacucauuuguacaaacaucuuaagcaccucuuuauuaauauaugccaagcacuggaaauaaaaauaaauaugggccuugcccucaaggacaaagacauaagcagguaacuacaacacuguuacaggugacauggcaugagguacggugaaagcccaaggagagacuggccaguuccccucugccagcccucauuagguuuauugagaaugguaacacagacuccaaaggaauggacuucccaggcuggccaauucuuuuuuuguuuguuuugcuuuuuuugagauggaguuucacucuuguugcccaggcuggagagcaguggcguaaucucugcucaccgcaaccuccgcuuccuggguucaagugauucuccugccucagccucgcgaguagcugggauuacaggugugugccaccaugccugacuaauuuuuuuguauuuuuaguagagacaggguuucaucauauuggccaggcuggucuugaacuccugaccucagaugauccgaccgccucagccucccaaaguguggggauuacaggcgugagccaccgcacucagccaccaauucuguuuuugagacagaaucucacccuguugcccaggcuggaauccagcagcacgaucucagcucacugcaaccuccgccucccggguucaagcgauucuccugccccagccucccgaguagcugagauuacaggcacccaccaccauguccagcuaaguuuuguauuuuuaguaaagaugggguuucaccauguuggccaggcuggucuuaaacuccugaccucaggugaucugcccaccucggccucccaaagugcugggauuacaggcgugagccaccguggccagcugagacuggccaauuccuugugaggaaucaggcugaaugaaguacacggcauauuguagugcuugguaaauauuugugcaaaugauccuuaaauguagugggaggagucaaagucauucagacagaacagccuaaacaacagcacagaggccugaaagcacugcauauuugagcaucugcuaccagugcuggauagcuggaacagaagggaacauaugcuuguagucaacaggaaguagugagggguuuuauuuaaacuuucaccugcuaugucucuuuccauacaagcugauggaaaauggcauccuuccaccaaggccugagccuggagcaggaaacagcaggggcacuggaaccacaaagaccuggggucuaacaccagcucuaucgcuuauuaguaguaaaauuuuggccagauuacaucacuucucugaaucuguuuccuauuccuaacaggaacuauccucucccucaugaaccuaaugcuccagcuaaguagaacaagaugcucuuuguauauacuccaguuuccugcuucucugccuuguucuucuauguggggaucuuccacuuaagcucuacccccacaacucaccagaucuccaugucuguccagaucgauuccaugcuucaaggccaaguuaaaugccuccuccaggaaggugucaccauaaaggagaucacccuccucugaacucccauaagcccuccuuguacagcucuccaggguacugccuguuuauucuguucucuuauuaccaacccaaggcuugagcucugugagagauguguauuucucaauguuaaugaguccucaauucauuuuuuuuuuaaugaaugaguagaauaccuauggaagaaacuugauaaaggugaaauggcuguuaccaggcaaugcugcuuauaauaaaaaugaccucuguagguuaacugcauuuggaaugacagggccaugaaggaauucuaaauucccaguagaaagccauggcuaugaacuuccugaaguacagugugcuccuaaucccaaggcucccccugccugggaucuaaaagcaauaauaauacguaucauauugguuuuauguguguuugugugauauauauacacauguacauacauacauacacauauauggaaaggacauggauuauaagagauauugguuccuauagcacgcuucuaagacaggugguucccuuacccacuuguguuccuggcccucacaccucaguugucacucagguuagcgaauagcccuuggaccucuguaaaaacuccacugacagacaaaccuaaugcugcccugcuaugcuucugcccuguuuccuuccgcaaaaguggugccagcauggccuaucugggucuuaugacuaugaaaugaccagcugaauccaaaaccacuacuacugaucaaagaagagcagguguggagccaggcguccuaacucccagaccaauccucuugccgugaucccaugcugccucuucccuucuuucugacuggccuuugagucuaaaugacuuguuaccuucacuuuucuaugcagguaaauuccucagauaauaaacugcauuaaacauuuaccuguuuauaggucauuauuucuaucaaggugggaauaaaaccaaccacaggucccucuuaccacagagugggucccaggagacgcuuaccagacagcucaugagaagacuggacuuuucuucuguuccuccagugacugaaaauucagguguguggggacaaugugcacugugcucauuuauacuacccucuaaacaggcacgaagcuucugcucugucaacucagaagacuacaaaauaaaaaaguucaaccuccucucagugacuugauagccaacagauggaaaauccucauuccucaugccaaccaauauaaccguggcucacugugauggcuugacuccuuggagccuuaaagacacucgggcccaugacuguaccaagaucucuuaacccaucuccauuuaacugccucuccagauuaaccaacgcccucuacuccugcugucaaacacacugauggccacucauggcaggaagaacgcucagagauuguaggcuacuuuccagccucccucugccucugcccccaccagcugagugcauccuuaccaacaacuagcaguauaugcucccgggucugcuuggguuacuugaacuuccuacuguaacucaguaaugcuaauuacuuauuauguaaauaauaaguuuuauuuuuauagugauaaguagaauguuuaggaaacaaacagaugagcugcuuaaaaaaaaaagaaagaaagaaaaagagcuauagaauuagguaaaagauggggaggaaaaauuccuaaguuguauacucaguuucuugauccacuuuauggaauuaaaaccggaaacucuggacuauguauuauagaaguuguuuauguaaaaaaggugacucagcgaggcacaguggcucacgcuuguaaucccaacacuuugggaggccaaggugggcagaucaccugaagucaggaguucgagaccagcgugaccaacauggugaaaccccgucucuacuaaaaauacaaaaauuagccaggcaugguggcacgugccuguaaucccagcuacucaagaggcugaggcaggagauucgcuugaacucgggagguggagguugcagugagcagagaucacaccacugcacuccagccugggugacagagugagacucugucucaaauaaaauaaaaaauaaaacaggugacucagcucuccaaucagcagggccccacucaaaggcuggcaaauaaauuuauguguuugaaacuuaccauaaaacauuuuauuuuuauaauuugccucuuuaaccaaucgcucaauuaacuggcaaacuugcaguccccaucaugccagauaaaagggcuuuuucuguauuuuaagauuacugaaggccgggcgugguggcucacaccuguaaucccagcacuuuggaaggcugaaguggguggaucacgaagucaggaguucgagaccagccuggccaagauggugaaaacccaucucuacuaaaaauaaaaaaaaaauuagccgggcgugguggcaggcaccuguaaucccagcuacuugggaggcugaggcaggagaaugacuugaacccgcaaggcagagguugcagugagccuaaaucacgccacuguacuccagccugggcaacagagugagacuccgucucaaaaaaaaaaaaaaaaaaauuacugaagcuuaaauucugaauuagguaugucuucauauauagaaaauuuuuaugaaacgucagauacaggcguuaccaaucccaagcugaggucuccauaaaaacguuaagcggugauggcucuccagggcccuaaaggcucugauguguacuguuugccaauuuucaugccauagauauucucaccauggcugauuugaagcuaccaaugugacaccacugaacauaaaacugggaagaaauaugcacaaugggcuccaagucagcacuggaggaucuucaagaaaguagauccaugugggaagaaguaucaugaaaucuguguguggaacacucacaugagaugggauggacaggccacacugacacaccaccacaccgcuugugauucucagguuguaccuagaagcagaauuaggaucccagagcaucauggccaccagaccuggaucuccaaaccuugaauuucaggcaacaaaucuggggggagauuccacucaccuuggaguggggaaugggaacgaauaaugcugaaaagguuuuaaaaacucuuacuuuguacauacaggacagaugaguggguuugccucccacucagccagcaugaugcugagacacuuuucaucaaacugcaagcucuucucauacucgcugaugauggacugcucugcaaggcaaaggcaguuggagggcuucaccaugcuucagcuggcccuguauuuaauucuaaacuucacugucaaaggcuuccuucacacgagggaaagauuugggcaagaccacaauaccaaugacugguuuuuaugcucucucaggcuggcuucaucuugcuggauuccucucccuccucucuguccccuuuuugugagcacaagaggugaaguaggcuaagggccgaggagacaauuuucacacacaucuccagaggccauaggagcacagauacagaaugucagggucccacaggcaacuaaauaaaguugacaaagagaacugauugcuggccgggcacggugacucacaccuguaaucccaacacuuugggaggcugaggcaggcagaucacucgaggucaggaguucgaaaccagccuggccaacauggugaaacccaucucuacuaacaaacacaaaaaauuagccaggcauguggcgcacgucuauaaucccagcuacucgggaggcugaggcagaagaaucacuugaacccaggaggcggagguugcagugauccgagauugcgccacugcacuccagccugagugacagagcgagacucugugucaaaaaaaaaaaaaagagagaacugauuucugaugccaggacgacccugcugauuccacauacuuggaaucuguguuguucagaaucugugugcucauucauucagcaaacauacaacaguaccuaguaucugcuagucacaggggcacaaagaugaaaaagacugucauuguugagcucacagucuagacauuagggaaggggucaaaaaacuacagucacgcuuauuuguuuauguagugucuauaacugcuuuuccacuagaacugcagagcugagaaauugugccagagaccacauggucugugaagucuaaaguauuugcuaucuggcucuucacaaaaagucugccaacuucugcuuuagaauguuccuuauggcugaguacagcacaacacaguaaauccuugucacuucagacuuauuaguuaaguaugccccaaaauaaaacauuuggucaggcuuauguuucaccacuaagauagguuuuguaggugggggaagggaaaaucaauaaaaaaagaugauaacuuaaggaauuuacagucuaaccagagucgacagcaacagucauuaacaacuaacacuugcauggcacuuaugugucaaaugcuauuuuaaauuccuuacauauauuaacuucuucacuauuauuauccuuauuucaaaggugaagaaacugaggcacggggaaauuaagugcuuuggucggugccacacaaauuaaaguaguaaagccaagugaauguuagagguaugacucaagagcuugugcucuugccucaccauaauaauagcuguugauuauugaaagcucucuauaugccagacaaugcacuaagucuucuacacacguuauuuaagccuuacaacaaauuuauaggguauucucuccauuuuauaggucauaaaaaugaagccuaaggcugggggccaugccucaugucuguaaucccaacacuuugggaggcugaaguaggaggaugguuugaguccagcuguuugagaccagccuaggcaacauagugagacccugccucuacaaaaaaauuuaaaaaauuaggcuaggcauuuuggcucaugccuguaaucucaaaacuuuaggaggcugagguggggggaucacuugagaccagggaggaguucgagaccagccugggcaacacagugagacccugucucuacaaaaaaauaaaaaaauuagcucgguaugguggugcacacuugcggucccagcuacucgggaggcugagaugagaggauugguugagccuaggaggaugaagccacagugagccaugauuacaucacugcacuccagccugggcaacagagcaagaaccuaucucaaaaaaaaaaaaaauacauaaauaaaauaauuuuuugucuuguuuuuaucaucuuuagcuaaaaaaaaaaaauuaauaaaaaaaaauuagccaggggugguggcacacgccuaugaucccagcuauucagaaggcugaggugggaagaucgcuuaagcccaggaggucaaggcugcagugggccgugaucacgccacugcauuccagccugggcagagacccugucucaaaaaaaacaaaaacaaaaaccaaacaaggccuaaucaaaucagggcuacauggaauaaaugacuuaacuauauaagguacaaaauuaugcucucuacaccaugcuauggacaccucccucaaggaguggaugcucacaggcccuggggaguuaauagagaauguggcacuuaaaaugaauagggcaagggaucagaccaugcacuaucacuguauccuguaaaauggcagguuuacuuuuuuuuauuuuauuuuuuaaagugacagggucucccucugucagccaggcuggagugaggugguaaaauuauagcucacuguaaccuuaaacucuuggguucaagugauccuccugccuaagccuucuggcugagggaggcuacaaguauuugcuaccacacccagauaauuuuuuuuuuuuuuuuuuuacuucuguagagacaggaucuuguuauguugcccaugcuggucuugaacuggccucaagcaauacuccugccucagccucucaaaaugcugggauuacaggcauaagccaccacccucagugaacuauuaacccauuaauagagaggcaggaugguagaagaaacaugggaacuggauucauacaacugauuuugcuucccaucuccuccacuuacuagcuguaugaccugcacgagaacaccaaccaccuucuguucuaauacuacuaucuuacagggcagucacauggagaaaacagcaucauuaaaugagaaguucuuagcacaaggucuagcacccuggagacccuuauuauugagaagcuagacagccaagaugucagaguacaaaaggagucuuuuggacacuugacugauggagguagacaaaggggacuuauaaacuaauccugauuggaggaaaggucacaguauuccaguagcuaaauacagguaaggaaggacuaccacuagggguuaccuugguugaucagcuccuguugaauuuccuccagcacagccaugucuaucagcuccuccagcuggaagagaaaggagcggcaucagaaguuugaaguauuaaucaccaaccaagccccacagugauucauacuuggaggcuggcuugaagaacccagauuuauuggacaaaaucaguccaguccuccugcagaauaugcugacagugggguaaugcugucaugcugacaagccaucaacaaaugauccaacuauccagugacaaaauaaugguacccaauuuuggagagacgauauaggguagcaguuagguacauauucuuccaaggcuacguaaccacaugaaaaguuccuaaucucugcaaaucucaguuuuggccucuguaaagugggaauaaaaucuaucuaagaggguuacugugaguacuaguuguggugauauaaggcaaacauugguguacugcaggacacacaaaagccacugaauaaugcaucauuauuacacaggguguugaugguuucaaacaguugcccacauuuucuuacacaguccuuacaaugcugaaaacauuaucuucucauuuuauaaaugugaaaacuaaaccucaaagaggcaaacugaaguuaacagucaauagccaaaccaggauuugaauucuggaacuccugacuucgaauccaguguucuuccugauacacuauaaaugguuuucccuuccacacauggcugccaacguuggcugagauuagaaucggaaaguuucuggagaccuuuuuagaaagagauuccugacgugggcagaucacuagaggucaggcguucaagaccagccuggccaacauggugaaaccccaucccugcuaaaacagaaacaaaauuagccgggcaugguggcacacaucuguaaucccagcuacuugggaggcugagacaggagaaucguuugaacccaggagguggagguugcagugagccgagaucuugccacugcacuccagccugggcgacagagcaagacagaaaaaaaaaaagagcgagagagagggagagaaagagauuccuagccuaugccuacugaaucauaauuuccaaggguggaggcaagaaaugaaauuucuuucuuuuuaguuucauaaaugaugauguugcagugaugagcaggucuacggucugguauuucagaccauuucaucuagacaagucuaacauuaaguguagaaaagccuggguuaaaggcuguugaauucuaaaugggguuaggggaaugguggguuuagaggacucaaguaaacaaauaaaagaggacacgagccguucuugguggugcagucccccucccugaaaacacauagcccagccugaccugagccaagucuucuggacaauucuccacugacugcaaagcauuccacucuucuuccaucaccucuugaacuagaaagcuguucugagaauucccuggcccacugcuuccagccuggcgguaccuguuuaggagccugucccggcuguuucucauucucuccaggcaucucugggaaaaaagagcaagauugggggggaaaaaaaaagcauuucuauuuuuaaaaaacacucuuacauuaguugagaaaacauuaaagaaaguuuauagacacaaaauuucaaugauaauacuaacuaguguuacuuuugcauauuccucuguagagauacauaaaauuacaaugcuuuguacacguauuuacaaagaaccauauuuuuuauucuagcuugccaguuuccuuaaugguugugugcauaauaucucagcauccaauguccuauuacagaacauuuauauuccuuccaaauucuugcuacucuagauauggcuggguaacggccuuccugcacagcagcguuucugaacucagggagguuuugucccccaaggaacauuuggcaaugcuuggagacauuucugguugucacaauucuaguuauaggacuauuagcaucuaguggguggaggcccgagacguggcuuaaacaacccuccacaacauauaaauaucucccucaaaauguccauugucaaggcugagaaacucugcuguaucugcuaucuuucuugcgucggguuacuuucuuggacauuacuuacuaauaaccacacuguguucagaagaggccagaacugagguggagcccucuucuaagccucauuuuacuacucucuagaauagaaaucaucucuaucucacaagacgaacguagacaaagugccucucucgguggccaccuccgcagcaacaguagguaguguuauugcagaggugcaaacggugauguccugaccacaauuuaaauucaaaacaaaaucgaauccaaaaacaaggcuuucuaggacuugaccgacccgggcuaaucccacacucuacagucagcaggccuggguuugaccagaccaggcgcgcugcggcaccugcuccacggagcagggcuaaggcgaaggcagggaagacggcggucaccgggacgaucuaggguagaccacugcacaaaccccauacccaccugccggaaagccucuuuccaaggcggcgagcccaccaguuuguacagggagcggcgcggagaccucaacgacuccgccaucuccucuucgcgggagacaaagccacaagacccguucccuggaggcgcgcacagaccccugggagguguacuuuccgggugcagaccgcgaauggaucgcagcguauucugggaaguguuguuuuaucgaccggccccacguggagacagauuuaggcauccaagcgaaaugcgugaggccagcccgaccugcacugagggagguaagucuugagggaaaguucuggaugccuggguuuacccagauggagguguccaauaggcaauuagauacacaagucucaggcucuccccaggugcuagauuuccagca

SEQ ID NO: 16681 - RNA, 8141 nt, Homo sapiens
cggggcuuccggcggcgccucaggucgcggggcgccuaggccuggguuguccuuugcaucugcacguguucgcagucguuuccgcgaugcugccucugcugcgcugcgugccccgugugcugggcuccuccgucgccggccuccgcgcugccgcgcccgccucgccuuuccggcagcuccugcagccggcaccccggcugugcacccggcccuucgggcugcucagcgugcgcgcagguuccgagcggcggccgggccuccugcggccucgcggacccugcgccuguggcuguggcugcggcucgcugcacaccgacggugagguuuagcgggccgggggugugguuugcguucaacagagggaaaacguagaccaggaauagggccugcaaccgaccucugaggucugggacauuuuuccauugauuggcaaccagcgggcuaaacccacguaugaucauauuucccccaccuccccuauccagcaguuucguuuucuuuugguagggggugaauaaaauuaaauacuaggguaccuuuuuccuuagucuuauucuaucgaaaguggaccuuugggaaggcccauggucgugguugaaaauagcauaguuauaucguuuggcaaguggaagaggauuggaaauucuccugguuuauagcggaaagugguaaugcguucauuguuggaaaucacuuuuccagaaucaggcucagcuuccuacuacuauuaugguauuuuuaccgauaaggaaacaggcuucuagaguaaccguaauagcagagagauuagaaacaguccagguuucuggcugcaauaaccuggguaauaguuuuauguuuuagacuaacuggcuuuccuuuuuauguaucuggauuucuuuucuaggagacaaagcuuuuguugauuuccugagugaugaaauuaaggaggaaagaaaaauucagaagcauaaaacccucccuaagaugucuggagguugggagcuggaacugaaugggacagaagcgaaauuagugcggaaaguugccggggaaaaguaaguacuggucuggggaucccagggcagcaacucccuuaaccuugcaggacccauccugggucauccccagaagagccuugaguucagguguggauacuuugauaaauggguuucaagagagugaaggauucauuuggacaacuucguaagccccaggcaguccauucaccgaacacaaauuugcugugggcugguuacuaaggagacaaaaauguagugcaaaaaaguacuggcagaaucaguuugaucucugauuuacagcccugauaaaauaggacacugcucucuaauguuuaguaugggugaaaaugaaaaauauguaacuucuauguaacaggaugggguuacacuguaguaagggcugccaucagagguggggaguuugugaccuaagucagcucccccaucaucuccuaaacuguuaaaguguuuacacuuuucugcauuauagucauccauaaucucauuacacagauaaacauuuggcaucuuccagguuuuuaaauugagccugggcgcgguggcucacacccauaaucccagcacuuugggacgggcagaucaugaggucaggagaaaauccuggcuaacacuaaaacccuggcucuaguaaaaauuaaccggguaugguggcacgugccuguagucccagcuacucgggaggcugaggcaggggaaucgcuugaaccugggagguggagguugcagugagucgagaucgcgccaccgcgcuccagccugggcaacagagcaagacgccaucucaauaauaaauaaauaaauugaauuuccuucauaauugaccuuaugauguguauguaauuuuuuuaaaucacagcuuuuaugagauuuaauugagauggcauacgauuuacccauuuauugaaguuuauuaaauuaagugguucuuaguccucgcagaauuaugcaucaguuaucacuaccuaauucuagaacacuguugucauccccaaacaauaccuauuagcagucacucauuauuccucccuguagccaccccagguaaucacuaagcuacuuucucuaugggauugccucuuuuggacauuucauauaaauggagucauacaauuuguagcuuccccccccaaccccacggagucuugcucugucacccaggauggagugcaguggugcgaucuuggcucacugcaaccucugccucccagguucugacaauucuccugccucagccuccuuagcugggauuacaggcgugcguccgguuaauuuuuguauuuuuaguagagacaggguuucaccguguuggccaggcuggucucaaaguccugaccucgugauccgcccgccuuggccucccaaagugcugggauuucaggugugagccacccugcccacccuauuuaccuuuuuaauuguuggguuguaaaaguuaaguuuuucuggguacaacuaucuuaucaaauuaaugauuuguaaguacuguuucccaucuuguggguuuccuuuucacuuucuugguaauguccucugacacaaaaguuuuuaauuuugaggaaguucaguuuaccuauuuuuuuggucgcuugugcuuuuuuauuuauuuuuuacuuugcuucuaauucaccaagugcaacuugugcuuuuuuagugucacgucuaagaaaccacugccuaacccaagguugugaagauguaugccuuaauuuuuucaaaguuuucuaguuuuagcucuuaguuuaggucugugauucauuuugaauauggugugaaguaggguccugauucucuugccuguugcauaguguguuuuugcccuacacaggucaauugugucuucuguaaucucaccuaaacaccauuugcgcaagguuuucauagcuauuugggggccauuaaaaauaaugcucugaugaacgucauucaauuucugugcccaggagcucagcuuagucagcacaguuggaauuagacagauuuugucaaccucagacugccucuguugccauggaaagguggcuuccuggcagagcagcuaguuagcacaaguggagggcggcacuucauguacucuuuuuuuuuuuuuuuuuuuucugacagagucuugcugugucuccaggcuggagagcaguggcgugaucucggcucacugcaaccuccaccucccagguucaagcaauucuccugccucagccuccugaguagcugggauuacaggcgcguaccaccacgcccagcuaauuuuuuuuuuuuuuuuuuuuuuguauuuuuuaguagagauggaguuucaucguguuggccaggauggucucgaucucuugaccucgugaucugcccaccucggccucccaaagugcugggauuacaggcgugagccacugcgcccagccuucauguacucuuguguggaauggugccugccagaguugcauagcccagcaguuuugguucuaaaccuuaugucccaagaauuuugacucaaacuuuggaacaugauuugucagguguggauucuugcaccuuaaaauugucacuaguuggugugucuggccugcuuugugauuaugaaacuucccacaaguacucuaagggaugagucucuacuacagcccuuguucuuugugaggcauucccuuccccguuccagggcugcucucgguguuuagcagaggcacccuccaucgcuucuuccuuuccuugcagggcaaauuuucugacggggaaagucucuuaaaggggcuucuguuccaucucaccagccucucagguccuuacuuugaccaaggguucccuggaaagaccagggugggcagugucagcuggcuguggccaugagaugcccagucagcacauggcagugagcccugggguacuggcccuguugggaguaacccaugcaugacuuguuuggcugagauaaacugaggccagcuuuggcuuccagcagcugguacaugguaggcacacuucagaccugcugagucacucaggauuggauguaggcacccagccuaguuugaaguucugcauauaauucagccagcuaggacagagacauuguuucaauacgccuuuuuaacuguagcagauuuccauguuuauguguuaaccugcucgguuaaaaccaugccuugucuguuuugccuugucuguuuucccuugccguuuuagaaucacggucacuuucaacauuaacaacagcaucccaccaacauuugauggugaggaggaacccucgcaagggcagaagguugaagaacaggagguaagcuaauacuauaaucagcuuuuaccucaguucugacaggcugugccuggggcuuagaggaggagcguuuuucuuuggucuuucaaaaaaaaaaaauuccucuaaguccagucgcauggcucacgccuauaaucccagcacuuugggaggccgagacgggcagaucacgaggucaagagaucgagaccauccuggccaacauggugaaaccccgucucuacuaaaaauacaaaaauuagcugggcaugguggcaggucccuguaaucccagcuacucgggaggcugaggcaggagaaucgcuugaacccgggaggcagagguugcggugagccaagaucacaccacugcacuccagccuggcgacagagcaagacucugucucaaaaaaaaaaaaaaaaaaaaaagagagagagaauggcaggggcauaagagacuuuaacuggaucaugccuacucuucaaacauuucaggaagugcugugcccagccuaguaaccagccaguaugagggccacagagucccuagacauucugcccaagagccaucaguacaguguugggucaugaccugguguggacggcgcagcucucuggugugcugcuuucccagccaccccaacuagcaucucccugacguuggacccagucugcucccagagcuccgcaucagaggaaaagcugcugcuguuauucagccauaaggauggccagguuccccagccuuugacccuggucccuuaugaagacuccuggaacagucaagcuggaaagagaucuugaaacuuuaggaaagcuuugcaguguacggguggaggaaaaggcuuggaauguuaagggacugauauaaacucaguuaauuggcacauagcugaggcugguauccacauuucuuaacugaaaacccaguguguuauuuaaccaagcagggugccaacagaagugagaucaagcucuucauuugggaauaguauggcauaagacuauucaaauggcuacauaauauccuaauagugguggccaucagacacucugaacagagauccuugauccagccauccaucuccuuccagcagcagcauguauugacuucuuguuuccccagccugaacugacaucaacucccaauuucgugguugaaguuauaaagaaugaugauggcaagaaggcccuuguguuggacugucauuauccagaggaugagguaugcaggauggagugcuagccucuuggcaccccuggggaacagugugucccuugggaacuuccugucccuauuuuagcagaaauuuaaacacuuuucuagcuuagaccagcccagcagggggagagagguggggagugagggaagaggguuaaaaccugaugaguuucaugcugucaguggcccccuuucuuccccugagucuagcuuguccuggagaacccuucaguuucccaauauuguuucuucucagguuggacaagaagacgaggcugagagugacaucuucucuaucagggaaguuagcuuucaguccacuggcgagucugaauggaaggauacuaauuauacacucaacacagauuccuuggacugggugagugcuugauaaggugggggaaccuuuugggccuuggaaggaaggguccuaguucaaggggagaaaaaagcauuuuaauguucauuacagauuuuuuuuuaacuaguaaauauuguucuuugcaggccuuauaugaccaccuaauggauuuccuugccgaccgagggguggacaacacuuuugcagaugagcugguggagcucagcacagcccuggagcaccaggaguacauuacuuuucuugaagaccucaagaguuuugucaagagccaguagagcagacagaugcugaaagccauaguuucauggcaggcuuuggccagugaacaaauccuacucugaagcuagacaugugcuuugaaaugauuaucauccuaauaucaugggggaaaaaauaccaaauuuaaauuauauguuuuguguucucauuuauuaucauuuuuuucuguacaaaucuauuauuucuagauuuuuguauaacaugauagacauaaaauugguuuaucuccuccaaggcaguuugucuuuuucuauuccucccccuucaaccugcgucacaaaagaccaagaacagaugucggaaaaguuuuuuuuucuucaguauuguuuaaaaguuucaauacaaaauaaguuauaaauaaaaggcuuguauguacaaggcuccucagagggaaugaguugucuucaaccccauagaaugaugugaguccaagcuggcucuagaggaucacagcccaaguaucacaggccuagguuuaaacaggaaaauaauuagcuuaaauuguauucuagucaugaaagauaucugauaaaaguuguaaucaaugagaauucuacacauuagaugaggucuccugaguccaguuucaauuaguucaguaguguaguuugucaugaugaccgccccucuuuggcauugcuggaccucuguccugcagccuucaaacaacugcccugggaaccaucagcaucaauagucuucaagcuaagaucaaauccuguagaugaacuaaucaaacauccucaccaucaggaaaccacugaccagaaagauuguauucaaacucuugauagccuggagcuuuuagagcccagcaggaagaugagacuccaaaucuacacaagauugaagcagguauguaucauaggggaggugcaaaccaugcaugaucaguacgggcagaaaacauguaaagacaugaucaguaagcaccugaguguaaaacugccucccgacuccuggguggcucagccucuccacuaugcuaaggaauccagucuguccuuaacccauuuaugccagagguugcaaauuuuuuugugugaaaaaucagaccuuggcgaugaccuugagcaguaggggaucaauaacucccacaggcuuagcguuccaauaauuaaacaguaggcauaaguggguuacucuuguuucuuaccacuuccacagguaauauguuuggcuuucucuaaaagacacuguaacucugcuaauaggcgguuuggcauauuccaucccaggaccaccacuugagcaccgccacauccgaaacauuccucgucuugugauagagugcaaucuucuguaacccaccccuaucuuucaacacauccucagccaucuguccugagcgucccuacguccugaccucacuggauucuaacacaaugguccuugauucccccuuaagugaaaaccaaaggucuaguggaacuagagcauuccaaaugucuaccuuuccaaauguugaacucaagaccuacagaauacaauuuugucuuucccccuccucuuuuuuuuuuuuuuuuaaggcacaaucucgcugucacccagccuggagcgcaauggcgcccucucagcucacugcaaccucugccuccugagcucaagccauccucccacuucagccuuccgaguagcugggaguacaggugcgagccaccacacccagcuaauuucuguauuuuuaguagagacaggguuucaccauguugcccaggcuggucuugaauuccuggccucaagugauccucccaccucagccuuccuaaaugcugggguuacaggugugaaccacagugccuggcuguguuucucauauuugcugugacccccaccuccccucacuuacccaacaauggucuuccugcccaccccagagccggcacugucaacuaugaucuccaagacugcugcacagcacucaccuuccaaaccucaccuccuacuuagcuucacugcugcucugagccacagggcacugacgguuaggug

SEQ ID NO: 16682 - RNA, 28122 nt, Homo sapiens
cggcgaggaaggggcggugugcuccuguugucugcaccugagagggggcaggagcucucggcgcuugcgccucccgccgcggugcccucccgacaugccggaggaggcgggcuucccgccggccaagagauuccggccaggcucuggaccuccgagccgcgcuggguccuucccucccgggaggcaaguggugaugcugcugacugcgggcagcggcggcagaggaggaggaggaggccggaggcagcagccgccccuggcccagcccucggccagucccuacccugaagcuguggagcugcagcgccggagucugcccaucuuccaagcgcgggggcaacuguuggcccagcuccgaaaccuggacaacgcgguccucaucggugaguggccgcgccggcgggcucuuccuugcacuucguccguggcuuagcuagagcaguuuuucuuacaugccucucaaucccuuucguucguggcuucaacaaaccugaauaccuuuucugggccagaccuggagaggggccucgaagaagaguccggcagcccugcccuggaggcgcuggacagcccggugagagugaccaacguguguaggcaaagacucaccuuccgcguaaaaggguagagaaacguaccgggggcuugcggaucuuagaagaguggaucugacccgguuugugaggaggcggcuggggaggucgugugggagggagggcauucuaggcaggggggaaagcccguuugagagaugggaaccugaacacauuccggucgaaagggaagguguaguuucuggugcaugaaaagaggcagaguuguggggcagggacugauuucauggggcuuaugauccccaacguguuagaggagauacugaaggacggaaaggaugagcagccaaagagaggaaggagacccaugagugcugcuagucaaaggaauagagagugagcagaugcagcagucaaguccgguuauacuggacuuggaugugaugcccacuggauuuggaugugagcuauuuguaagaguuaaagaaaaaggaaagaaacacgaaacgcggcuggcaguuaaagacagcuuuucuuuaguuaaaaccugagaggcgcuccuggccgauuucggucaggagcccuuucucuuacagacuaagaguauauauugguguuagggugagggggcuuaucacaagcuuggaauguuuauauguguggagaaguuuuuggcaggguuggacucuuugggagcaggggauguuaucuuggggcagacauuuuuccggcccgaggggguuuaucucccggcuggcauauucccggcuggcauauucccggccagagugggguuaucccuuaacaugucucuggucggggaggaguuuggaauguuucuggcuggagauguuauuugugguuuauggucgugcugaccuuagccauuaggcugauaccuuuuggauuuaggcgguuuuuuauuaaggugaacuuuugaaugaggggcuuguccaagauggugauguuccugcuuugucaauccagacccuauaguuauaaaaaggaggagggacggcauguucuuucuggcuacuuccugcaacgaggggauggagaguuuccuggucucggguugacuaggagcaaugccgucuguagauguuuuuggguaguuguuugugaaauugccaugauccugucaguuaaaaaucuuugaaaaagauuaauuaggcaggguaagaacauuaguuccaggcauauuauuaggagagggcccaggaaugggaugacccaugcuaugauuuuguuuucaaaccaagaguccauuuggugguuuugguacucccuuagcuuuuuagccuuuucuuuacguuuuuuagcagcgcuuuuuacuaggcccgauugguugauauagaaagaggcgugagccaccgcaccuggcccccucaaaacaauuauuuaaccuuuuaacguagguaaaaaugugcauucuuaucccuccugauaaucuuuuuaccgaaaguguacuuuacuuuccuuacacaccuugcacauaaagugucucuucaauaguuuuaaauacauguuacacuguuaacuuuuagcaaccuuuaccuuuguugaaaaccuugguaaguucgggauuuuaauuaugugcuagguguacagccuaggacuuagacagaagugcaguuaaggucuggcuuauuucagcauuuagcuccauguguccuagguuuuaccuagcugcaaagcaggcaaguucuacagcuaagaguuauggugacauuuuauaaagcauucaggaggccuaaucacuuuuaaauuguaaaacauuucuugcauacauuuccucucauaaaauuuuucaugacuuucacagacuaucucugacacuauugaucguggauccaucccaucgagagcuauuucaacaaagcuguguggguaacagcugauuugucauugagcugagggcugaaagcagggggaagaggcuucuguuuugaggaaaaaggagggaagcugagagaaacuuuauggaugcugcucgauuuaggaugggguuauguguggaugaauccacccauccucauaaguugaaaauauccuaaguuggaaaugcauuuaauaugcccagccuacuuucagugugcucggaacauguacauuagccuaugguugggugauauuaucuaacaugaaaccuauuuuauaauaaagucuugaauauuucaugcaauuuauugaauaccauacugaaagugacaguuguguggguacucaaaaguacaguuucuacuguacgauuuugacuuuugcuccauccugaagucaaacaguucuaagacagggaccaucuguauucagagguugaggggaagaacucaguagggagggaggcagaagauagaaucgagcuaacagagcaaagaucaggaggcaugggggacgggggaacuuggccacaagggcuagaugcagggcuggucuggaagaggaggaaggcuaagaggcugcagggcuagagaacggauguaaggauggugcacugcagaagggcuucuaggggcaguuagggagagaccacauuuuagaaccccacuucugugagacagguucaggagcccugcucagaaugggagucacugggcuucaagugggcccuuggggaggauggagacgagacaggcugcaaaaacaagaaaaaagaucgauggcaguaguggugccuaggugcauuucggcuacacuauaaacucagguuugcuucugcacagccagauuauagguggaacaucccaaauuugaaaauccgaagucaagaaugggcuccaaggagcauuuccuuugagugucauaucagaugcucaaaaaguuuuggauuugggagcauuuaggacuucagauuuucacauuuaaaaugcucagccaguaaguauaaugcaaauauuacaaaacuugaaagaauccaaaguucaaaacacuucugguuccaagcauuuuguauuuuacuuuagcaacgcucuguugcccugguauaggagcaugaaagauagagacauggaucaaaguuugggguuuugccuaguggauucagcaggaagauugcagaauaaucaaauccuuugucugauucuuaucugggucaggaaggaugagcagucagagggggcugacagacugacagggaaaaaaacccacaaaucaugggacuggaggacuuuuugaagucagagaggccuggugguagcuagagggaggggaaggaagcgcagguuuacugaguucuuugcucuaaucaggcacuguuaaaggaauucacacaggguaggaaguaacauuuacugcgugcuuauuguaugcaaaauacucaaguacacgagagggacauucagagcacugcccucugggagcuucccuucugguguuggaggaggacggacacauuuaaacgcuucuguacaacacaggauggucagugcuggaagagagaugaacaaggcacuacggagcccagaggagggccacugugcagccaggggagcguguuugaggccuaacucaucuuagaguuugcgaggcaggcagugugagggcagguguucugcccauagugugggcagaggcagaggguuugaagggaggcagcaggcuggggaguggccaggaguugaaggcagcagugcaugaauggaugucucuucaugucagucaguaugcagaaaucuauguaacgguuguauuuuauuuuauauuuuaacuauguaaauuaccuuuugaacauuuauauuguuuccaauuuuuuucugucaggagcaaaauugaauaaaaucucuuugaagcuguaucuuuauacacauguuuacuuauuuuguuagaaucaauuucugcaaguagaauugugggucaagggauauaaacauuuuaaagauuuaaaaaacauaauuugaccaccugagaaacaauaccaauuaaccagcuaauuucaccagcaguauacauaccugaaugcccauucuccugaggcuuuaccaacacaggguauuuuaucuuuuacuucugacuuugagcuguuuguuuggugaaauuuaugucaauuugcuuuuuguuguuguuguuuuucuaagacagggugucauuccguugcccaugcuggaguguaguggugugaucauggcucacugcagccucaaccucucaggcucaagcaauaugcccaccucagccuucagaguagcugggaccacaggcgugcaccaccacguccaacuaauguuuguauuuuuuguagagacggcaucucccuauguugcccaggagcaacuccugggcucaagugauccuccucccuuggccuccccacgugcuaggauuacaggcaugagccacugugcccagccgauuugcauuucuuuuuuuauuuuuauuauuuuuuuugagacagugucucacacuaucucccaggcuggcaugcaguggcacaaucauggcuuacuguaaccuugaacuccugggccucaugauccuucugucucagccucccuaguagcugggacuacaggcacaugcaaccacaccaggcuaauuguuguuguuguugagacggggucuugcuauguugcccaggcugauuuugaacuccugggcucaagagagccuccuaccucggccucccaaagugcugagauuauaggugccagcccuggugccgagccccaguuugcauuucagugagccuuuuuuuuuuuucccccucucuccuaggggaaacuggcucugggaagacaacucagaucccucaguaccuguaugaaggagggaucagccgccagggcaucauugcugugacccagccucgucgaguagcugccaucucucuugcuacuagagucucagaugagaagagaacugaacuugggaagcugguaccugguuccuucuugacuauuaguacuucuugacucaacagcucucuccccaugcccacugccuuuuauuuuucuaaacaagacuccuuuuacauagugagcugcuuucuugccuauucuuccgagaguucuuuaccagcuccugagagaucaggggcucuauuggucccaugugcuuugcuuucaaaaucugucgucagguuggauaaauuaguugcuuuccuugaacaucuuaagccuucaguaaccucucuuaacucucuuaucuauauaucauucuagaaaaauuguaagcauuaugccaguguauaugugaguauugagaaugagucucagaacuguauauaagacagauuuauuuguguguguguguacucauuucacuuaaaaauaccuuagacgucuuuucauaucuguacauagcuucacaugaaacuuuuuuuuuuuuggagauagucucgcucggucgcccaggcugaggugcaguggcgcaaucuuggcucacugcaacuuccgccuccaaccaagcaauucuccugccucagccucccgaguagcugggauuacagacacgugccaccacacccaguggcuaauuuuuguauuuuuuaguagagacgggauuucagcauguuggucaggcuggucucaaacuccugaccucgugaucugccugccccaaccucccaaagugcugggauuacaggugugagccaccacacccggcccacaugaaacuauuaaauagcuugagguagaagguuaauuuuaaauauuccuuguaauaguuacauuaauugcgguuaaaguaaacuugaccauugucucucucagcagcuagacugcaugcuucccaagggagugggaagcguugguguuggucuuguucacugugguagugcaagugcccaacuuagugccggacacagugggcgcucaagaaauguuuggugacugaauaaauuguuucccugcacagguuggcuauacagugcgcuuugaugaugucaccucagaagacaccaggaucaaguuucugacagauggcaugcuucugcgugaagcaauuucagacucuuugcuucggaaauacagcugugucauuuuggaugaagcucacgaacggacuauccacacagaugugcucuuuggaguggugaaagcugcacagaagaggagaaaggaacucgggaaacuuccucugaaaguaugagggaaacuuccccugaaaguaugagggaaacuuccccugaaaguaugcguaacacacagaaggaaacaggccuggcugggcgcgguggcucacgccuguaaucccagcacuuugggaggccaaggccgguggaucaccugaggucaggaguucgagaccagccuggccaacguggugaaaccccgucucuacuaaaaauauaaaaauuagcugggugugguggcacacaucuguaaucccagcuacuuggguggcugaggcaugagaaucgccugaacccaggaggcggagguugcggugagcugagaucacaccacugcacuccagccugggugacagagcgagacucugucucaaaaaaaaaaaaaaaaaaaaagugaaaguucauuaaauagcauaacuuuauagacaacuuguauuucagggaguuggcagaaauaugaucugaaaguauccagauaauuggcccggcacgguggcucacgccuguaaucccagcacuuugggaggccgaggccgguggaucaccugaggucaggagaucgagaccagccuggccaacguggugaaaccccgucucuacuaaaaauacaaaaaaugauccaggcaugguggcacaugccugucguuccagcuacuagggaggcugaggcaggagagucacuugaacaagacugaaauuccgucuugauuuuuuuuuuuuuuugcacucuguuacccaggcugcagcguggugacgcgaucucagcucacugcaagcuccgccucccagguucacgccauugcuuaccucagccucccaaguagcugggacuacaggcgcccaccaccgcaccuggcuaauuuuuuguauuuuuaguagagacgggguuucaccguguuagccaggauggccucgaucuccugaccucgugauccgccugccucggccucccaaagugcuggggcugggauuacagacgugagccaccgugcccggugaaacuccaucucaaaaaaaaaaaaagaaggaaaggaaaggaaacagaccugugugcucuagcaggguguuuuccucugccuguucugcucagagccuuggaagaaaguaaacugugauggggguggcacaggccucaaucaucugcuuuuggggcucgagagggacacggaaaggccuucccacuauuuguuucugguccuccucuucguucucuuaugcaggugauugugaugucagcuacgauggauguggaccuguucucucaguauuucaauggcgcccccguccucuaccuagagggucggcagcauccgauccagguguuuuacaccaaacagccucagaaugauuaccugcacgccgcgcuugucuccgucuuccagauccaccagguauggugcugggggcaaauuccugaaaaguucucuuuuaucuugcaguugguagugagaacauugagccuugaaaagaaaagcuacugaauaaaacaacuuugugaguugugucaucaagaugaauaaggaggccaggugcgguggcucacgccuguaaucccugcacuuugggaggccgaggcagguggaucaccugaggucaggaguucaagaccagccuggccaacauggugaaaccccaucucuacuaaaaauacaaaaauuagccaggcaugauggcgggugccuguaaucccagcuacucgggaugcugaggugggagaaucgccugaauccgggagguggaaguugcaaugaggcgagauugcaccacugcacuccagccuaggugacagagggagacuccgucugaaaaaaaaaacaaaaaaaaaacaaugaauaaggaguucauuugcugugucuggauuuuuauccuuuauuuaugauaucucuaauuuucauugaaaagaaaaauaauucaguucugaccagcagcuuucuuacacugagccagaaaauuuucauguuaaagcaguagcuuaccaacuuuccuugauuauaaccgccauuaagaaguacuuuuggcugggcacaguggcucacgccuguaaucccagcacuuugggaggccgaggcggguggaucaugaagucaggagaucgagacccuccugacuaacauggugaaaccucgucuguacuaaaaauacaaaaaauuagccgggugugguagcgggcgccuguagucccagcuacucgggagacugaggcaagagaauggcgcgaacccagguggcagagcuugcagugagccgagaucgcgccacugcacuccagccugggugacagggcgagggucugucucaaaaaaaaaaaaaaaaagguacuuuuucuuuugcaaccccguacgcuauacauauaacugaaauaggucuaugaaacacugcuucuggccaggcaugguggcucacaccuguaaucccaacgcuuugggaggcuaaggcaggaggaucacuugaguccaggaguucaagaccagucugacaacauagcaaaacccugucucuauaaaaaaaauuauaaaaauuauuuuuuaaagaagaaguacugugucuuuuacuacauguaggguacucugauauuuugugccucauuuaaagaaaauguuggcugggcacaguagcucacaccuguaauccuagcacuuugggaagcagagguggguaggauugcuugagcucaggaguuugagaccagcccgggcaacauagcaagacuugucucuacuaaaaaucaaacaaucagccaggugugguggugcaugccuauagucccagcuacuugggaugcugagguaggaggaucacuuaagccuggaagauuaaggcugcagugaacuaugaucaccgcacuccagcccgggaaacagagcaagauccuaucucaaaaaaagaaaaaguugacauuagcccaauaauggguugcaacuuagaguuucuuuuuuuuuuaaacuauauuaggagaauauuuaaaaauauuuucucauuuuauuaaacauuuacuucaaaaauuugaaucauuaagucacuuuuguuuaauuuguauaaaauuuaauguuuuuaccuuccuauuagcuuucugagaaaauccagaggcaaacuuuuaaaauaacuuuuuauuuaauuaauuuacuuauuuagagacggggucucauucugucacccaggcuggagugcaguggcauaaucacagcuacuacagccucgaucuccugggcucaagccguccuccuaccuuugccuccugaguagcuggaacuacaggcacacaccaguacaccuggcuaauuuuuuuuuauguuuuguagagacagggucuugcuacguugcccggacuggucucaaacuccugaccucaagugauuuucccgacucagccucccaaagcacugggauugcagaugugagaaaccgugcccagucaauuuuuauuuuaaaauaagugaugcauaugggauuuaaaguuuuaaaaagucaaguaguuuauaguaaaagguuuauaauaaaagaauagcaguuguuuuuacuucaacaucccagauuucugcuguuuagggcaccuacuuucaaucucuacauauugcuuucauguuucuaaacuaccuugcuuugaccacuauuuuuugaguuauggguaucaggcaucauaugcuaauuucuuaccauggugacaaaaguuuagaaugccccuccccaacccccuuuaucuccaaccucuugacaguucuaucauguuuuuguuuagguuuuuguuuuugaggcaggaucuugcuguguugcccaggcuggucgugaacucccgggcucaaucaguccucccaccucagcauugggaguagcuaggacuacaugcuugcacaccugugucuggccuauuaugauguuuucugaguccaguaucaauacuaagaauauuaugaccacacauugcuaguagcacaccaucaucccuguaccuuguuucuugaacaacacaguugugcaagcuuucuggguagcucuggcucauuuucucccaaauauuccaacaucucauaugccagucguguauaguucuguguucaagcacagucugucuuuucagaguccuuuaugcugcuguuccaguuggggcagguggcucuccugggccuuugugcagcugucaucuugacucuucacuuugucaccauuuucccguggugagacccauggcuucccagucuccuggccguccuggguaggagagggaacugaaggcuuuaacuacucuauacucagacuuugaaccaaucccugaguuuucacucucccacaacauaauuuguaguuuccucccucuagccaagucauccagccccuuuccccucucuuccaaaaugaguugagacuccucaucucucauugccuuuucuuucuaagacaguggccuuuacugucguuuucauaguguuuggggaagaagucugccuuguucagcugcagaaagcaaacgagaauuuuucaugaaugauggcugcuggugcauuagguuaccacuggcuuugaugaauucucccacucaugagguuuugacuguuuuagauuuuauccugucuguguaucccucugcacauuuguucuguuaauacugggcugaaaaaaaauacauauuaaaaaauacguauuuuuacauauauacauaaauauacauauaauuauuaaaauuuuuuucuauuuauuuugccauuaggcacuuuuuuuuuuuuuuuuugagauggagucucacugugucgcccaggcuggagugcagugacacgagcucggcucacugcaaccucuaccucccagguccaagugauucuugugccucagccuccugaguaucugggaucacaccuagcuaacuuuuguauuuuuaauagagaugggauuucacuguguuggacaggcuggucucaaacugcugaccucaacccauuugccugccucagccucccaaagugcugggguuacaggcaugagccacugcgcccaguccaucaagcacuucauuuuauuuauuuauuuuuugagauggagucuugcucugucgcccagguuggagugcagugaugcaaucucggcucacugcaaccuccgccucccauguucaagugauucuccugccucagccuccugaguagcugggauuacaggcgugcgccaccacgccuggcuaauuuuuuguauuuuuaguagagacaggguuucaccauguuggucaagcuggucucgaacuccugaccucaggugaucuggccgccucggccucccaaaguguuaagcacuuuacaucaaacaaauuaauguaucugaucagaaaucaaagaaaaaucagggcauuagguaugucauucacacuuggguguuguuccauuugaaagugaggaaccccauuaaccucaguaucucaagcaguuguccgaguauaguguguguuuuggggcgugugaaagcgcuuucgacggcgucauucauuaaaggcuccuucuccagcauggcugcgccuguucauuuccauagauuaggauuuccccaaguuuccuucuguuuugucaacuucauuuuucaagaugcuuauaaaagaaaggaagcuucaugcagauuuuauuugcuugccugauuaugcuuuucaugguauuguucuuguuagaaaaaucaaucugaugauuucccuucaaaauuucaucacuuggccuauaaacauagcuggcuaacuccuauauauuacaguuuuguuuuuuguguuuuugagucagguucucguucugucgcccaggcuggaguggaguggcaagcagcuggaacuauaggcaugugucaccaccccugaccaauuuaaaaaaaaguguuuuguagagaugggaucuugcugcguugcccaggcuggucacaaacuccuggcugcaaacgauccucccgccucagccucccaaagugcuggguuuacaggcgugagccaucacacccagccuguuaccauuuacacacugcugguaaggguucucuccaagcuagacaucaacuuuuaggcucauuuacauuucuauaguuaagagaaauaacucugggaaacaucaucaaucaccauugucuuuuucugugcaagcugcaauucuaucaaugccuaguaaacccacucuacuuuuuuuacaggaagccccuucuucacaggacauccugguguuccucacugggcaggaggagaucgaagccaugagcaagacgugccgagacauugcaaagcaccucccagacggcugcccugcgaugcugguccuuccucuguacgccucccugcccuaugcacagcagcuccgagucuuccaaggggccccaaaggugagugcaccaccucuucuguccagcccuauucugggcacccagacggauccaccagcgaggucuguaccuguuaccaggcuccagauaagguguaugggaugggauacccaggugccagaucagcgcacugaggaggugcaggaauaaaaugcgcggugacacacgcagcgcuccugugacaggagcagggagacaguuguugggaugagggagaguauaaaccaaagcugcaagguaaacgagugacuucuaaggaccagcauaaauugcauuuguccauagugccauuucuugugugccuuugccgugccaggcacugugcuagcauuuauauccacugucugucauccucgugggaaccggcaaggcagguuaugaucccauggggauccugaggccccaagaagggaaguaacaauugcucaagggggcgcauaguaagucacuggcagggccacgauuccaacccacaucuacuugcuucugauuccugugcuuguuccacugcaucucauugccucaaauugaccuuuaagacugcagcguccccuuccccugcccgguuuaaugaccaaccauuaauauuaaugacugccauuaauaauggagucaucuucuguuggucaagagugaauuguggaaguuaauggugagaauauguuugaagacuucugaaucauccgugugucaaugcggcuuuuugguuuucuuccuccuuuuagggcuaucgcaaagugaucauuucaaccaacaucgcugaaaccuccauaaccauuacaggaauaaaauauguaguugacacgggcaugguuaaagcaaagaaguauaacccuggugagaauuuguaguucaugaaugucucuccugugucuagugagcagccacugaaacuguagucccacaguuuuccccugaguguuucauguuuguaacuaacaaauucagguggcaggcgccaugagugagaucaccuacacuccagguccgcgaaggaguccugaggcggguaugugagacaggaaguagaggcaggaaagaagagcccagguugagcaaacuugggcacacagggucagggaccugggcagagggucugguaccccaucagaagucggcucuaaggccagggacagcugggugucaaucaaagggugucaucagaaacuauauauauauggcugguuugagcucccagguuucucaggaaggaaccagaucuccuggcugaggugaggcauggaaggagcacuggcuucuccuaagaaggugcagugagaagcuaacuuaaggucaucuugacucaugucuguuuuauacuuugcuuuauuccacagaggauuugagaccacugaaauuauugcucccaauuauugaacugaaaugcucuaguaaacauuugaggguccuggcuuccacagguguaucuuuuugugaugacguaggugaaagagcuugggucuccagugccaggcuaaugauacaccuuuaucaagaaaaugaaccucauuuacugcuagaaaacagacaucacauuauuucugucuuacagcagaacugggagggaggauaaagcacacaagugauuugaggcauuuaauuucguagucauugauugauaguaugacccccauccuaguuugcugaaacucccaguuuuagcacccaaaauccgacaucccaggaaacccucugucccaagcaaacuggagggguuggccauccuaccaucuaaggcaagaccucggaaacuacucuucucgccccuugcugcaugcgugagguuuuucugauguuuuuguaacagauuucacagugggcuuauggcaaagccuuguuucacuagggccaaaccgcugcggagcagucugguuuugugcuguccauugugcuagccuugaggcuuucuggacccccguguugcugaaagaaccacuggugugcuucuuuuuaucgacacuguagaaagaguuuguucaugugaugaagcacuaauggggcucacucuccauccagacaguggucuugagguguuagcagugcagcggguaucgaagacgcaggcuuggcagcgcacagggagggcuggcagagaggacaguggcaucugcuaccggcucuacacggaggacgaguuugagaaguuugauaagaugaccgugccagagauccagagguaggcaccaguugcuccugcacugcugcuguuugucaccaugucucuccugcuugcccagagcugcaguuuuuacucacacuccaccaugagggguucugacucaauggcagagggaucaggucaugacccuggucucaugcucuucacagguguaaccuggccagugugaugcuucagcuucuagcaaugaaagucccaaaugugcucaccuuugacuucaugucgaagccaucuccagguaagugaaauccacaguuuugcagaaggugggugaggagacaaacaacaacaaauggacacuuccaaaaaaauaaaguauauuggucaucuccuuuuguuuauuuaauuuuguggaugacaacauuaguuauuagagaagcaucugaaaaucaugaaaugauagauagauacauugauugacuuuuaaagagacagggucucacuguguggcccagguggaggugcagugacuauucacaggcuccaucacagccuccaacuccugggcuccagcgauccccccgccucagccucccaaguagcugggaccacaggcaugcgccaguguuccuagcuaugaaacgauagauucuguacuaucagcaccaucaauaaaguuccuugaccucuggaaccagugaaggucaucaugcgaguccuugggauacuacagaaauguaaugaaauuguacuuuuaucagcacagggacugcaaagaucacauuucuuugccuuuaacuggaauuugauccaucucuccuguucauuaguaauuucucuacagaagaagaaaauaauuggaaauauuuaugauauuggcuuuggcaccuggccucucaucaacgcaccauuuuccuuuucuuuuuauugcccccccuuuucuuaagaaaugcaauugguuuaaaaaagaaggaaagaaaacacaaagucaccaguugauggguauacaaggguccugcccugauccucagguucacaguuuccuuccccuagaacaaccacuggaaccauuuucuaguagacuucuagagcaaauguaugcauauaugaguauauguaguguguuugauuuuauuuauguauuuauuuauuuauuuuugagacagggucucacucugguuguccaggcuggagugcaguggcacauucucagcacacugcagccucaaccucccgggcucaggugauucucccacaucagcuucccaaguagcugggacuacaggugugagccaccaagccccugcuguaguauguuuuuguuuuuguuuuuguuuugagacagggucucacucuguugcccaggcuggagugcaguggugcgaucccagcucacugcaaccuccaccugccggguucaggugauucuccugccucagccucccgaguagcuaggacuacaggugugcaccaccaugcccggcuaauuuuuguauuuuuuaguauagauggaguuucacuauguugaccaggcuggucuugaacuccugaccuaggugguccgcccaccucggucucccaaagugcugggauuacaggcgugagccaccacgcccagccuguaguauguuuuaaaacacaaauagcaacacacauugaguauuguucugugcuugauuuuuuuucuuucauugcuaaauucuuacauacaaaugaagaagauacauaagguguaaggaaugguuaaaaucuaacaccuguguacccaauugaagcccccaggagucccccccacccacuugcccucgccuccuuccacucuuuugggguacccacucuuccauauuuuguuuguaauugccuugcuuuucuucacuguuuuacuauaugcguauguaucccuaaaccaccuguuguuuguaaguuuauguuaguuauucuugaguaagcgguuuucauucagcuuguuccguauaguauauuugugcugaugcuuuuucacacuaagugcuauuccauucugugaauaaaccaaaaugcauuuauccauccuucaguugauaaauauugcuuuaaaaaagcaaugagaaacacacugcuuuuuuucauuuaauacauuuuacagaucacuccuuauugggauguauauauuuacuacauccuuagaaaugcuuuuuuauucuuuaauagguacuauauuuacaugguucaaaguuuaaaauauauaaaauaguaaauaguaauaauguccuucucauccccuugucucccagccuccccagcuggccccugagacaacugcuauuuccacuguuauguguuugguucuggcgauauggucucugugcgauguguaucugcaggugaaauucguaaguguaacauugcugggucagauguuacacuuuuaauguguauauucaaaaucuacauacauauugccaaauuacaggucauuuaaaaagaaaauugaggcugggcaugguggcucacaccuguaauccuagcacuuugggaggucaaggugggcagaucaccugaggucaagaguuugagaccagccuggcuaacauggugaaaccccgucucacuaaaaauacaaaaauuagcugggcgcgguggugggcgccuguggucccagcuauaggggaggcugaggcaggagaaucgcuggaacccaggaggcagaggcugcaaugagccgagaucacgccauugcacuucagugugggcaacagagcaagacucugucucaaaaaagaaaagggaauugaacuaaagacagugaugucguucuuugacaagugugucaagggggcaguggcgguuaugauuuuugcuguuguuugauguagaauuaucagaagcucccagaaauacugaacuagcugcaacuucauuuuuuuggacuuuuggcuccuuuuuaugucucuguuucuuuagaucacauucaggcggccauugcccaacuggaccuguuaggugcucuugaacauaaggaugaccagcuuacccugacuccaaugggaagaaagauggcagcauuuccuuuagaacccaaauuugccaaaguaaaugauacccucuccucaguccucuuucuguacauuacaguuaaccgucccaaaguaguaccaucuacccagugcuucuagauuaaucucacuuuuucucuuacauaauuaccaaccccuaguuugcaaauagcccugauucauguucagugugggauucaaagagaugaaguuaagagccccuacccacaagaaauuuggaacucuguagggaaggcagucaccuguuuuauugaauauuaaagagugaaauaacacuaauguacaucgccaugguuuuagaaauaccugcccuuuaacuccuuagaagggaaacugcaaaagcaauguacagaaauagugcauucuaaagcuaggagaaagcuggguuuacacaauuuuaaauuuugcuuugcagaccauccucaugucccccaaauuccacuguacagaggagauccugaccauugucucccugcugucuguggacagcguccuccacaacccuccuucccggcgagaggaagugcaagggguccgcaagaaguucauauccagcgagggggaucacaugacccugcucaauaucuaucggaccuucaaaaaccuaggcggaaauaaggugagccuugucuugcaccuguucuccagcgauagcugcuugucucugcuaugugcuucccuuuuucuacugaagccgugcaaaaaguacgcuuucccuuuuuggcuaaauuaucuaaagaaucacaaaaagaaagccagacagcauuucagaaaugcuucaguaccgaagcagugucauucuggucucuguuccgaauguguuuaagucaacaagacuuaagugacucccaacccaucaaaacuuaauuggaacuugauuaaguaauaugucuaauaaugauagugcguaccaaugaaugaguacuuacucugugccaagccccaugcuaagcacuucuuaauguaagaucucauuuauucaguaaaguaauccuaagaaaugagcacuauaauuauuauuuuuuauauucaugaaacauguagucauggaaacgaagcuucgugcaguugaaaaacuugcccagggccaggcacagugucucaagcuuguaaucccagcacuuugggaagccagggcagguggaucacuugagcccaggacuuccagaccagccuggccaacauggcaaaaccccgucucuacuaaaaauacaagaauuagccgggcgugguugugcauaccuguaaucccagcuacucgggaggcugaggcaugagaaucauuugaaccugggaggcagagguugcagugagccgagaucgugccacugcacuccagccuaggugacagagcgagacucuaucuaucuccaaaaaaagaaaaaagaaagaagucuuacauaaauugacugggcauuucuguuuuguuuucugugucuguucauauccuuuguccauuuuucuacugggucguuggucuuuuucuuaaugacuuguagaacuuuuaaaaucaauucuagagauucuaaucauuuauuggguaugaugagacaaauaucccaaucugggaaacuucaaguuuuucuuuaguuuaaauuauuaacacuuuucuuauaguucauguuuuuugauauaaagauauuuuccuacguuucuuuuuggcaccugaaguuuuuucucugaauucaacuguguucuaaaaauguuguuauauuuucucuauagagaugagaggauuguuagcugggcaugguggcaugugcagauaguucaagcuaucugggaggcugaggugggaggauugguuugcagugagcuaugauuguaucacugcacuccagccuagggaacagagcaagaccccgucucugugaacauauaaauggugaaugaguggauugugauaucacucuuucuccuauucaggauuggugcaaagagaauuuugucaacagcaagaauaugacgcugguagcagaagucagagcacagcugagggacaucugcuuaaagguaucgucugguccuaguguucugugggugacaaagcugucacuuuguucaagguagaaauuuugaaguugcuuauugcuagugauuauaaaaggauuucucauuguagcaaauuucacaaauaagaaaaaaggaaguuacccacaauuccacaauucaguaguuuagccuauuuccuaauagccuaguuuuuauuguauuuuuuuacauaguaaauuauauguauaauuuauauuugguuuuauaaucuuuauaagcauuuuccaguguuagaauucuucauaagauuuuuuuuaaguaugaauaucugcauuauuuccuuuuagauuaccaaaguuguguauaguauuugacacaaugcagaaaauagugauuuauaauguagaaaguuuaaaagucucccauaauccugccccuccagagauaacuacuguuaacaguuugggguagcuccuucuagaauuuguuucuguguauguauguuuuugugcaugucucugugccugugugugagcacacacauaacggauacgugcauaugagguacauguuccacaacuuccuuucuuccacauggcauauuucuuucuuucuuucuuucuuguuuauuauuugagacagagucuugcucugucacccaggcuggagugcagugguaccaucuuggcucaccacagccuccgcucacugcaaccucugccucccgaguucaggugauucuccugccucagccucccgaguagcugggauuacaggcgugcgucaccacgccuggcuaauuuuuguauuuuuaguagagacgggguuucaccacguuggccagacuggucucgaacuccugaccucaggugauuugcccgccucggccucccgaagugcugggauuccaggugugagccacugugccuggccucacaugcguauuucucaaauccuuccuguggcugggcuuucagugcugcaugugucuagcucauucauuuuagugauuucauagcauuucauuguauucagugcaguuuauuuaagccucuaauaauggucauuuagauucuguuguagugaccauccuccguaugugcuguggugcacacagaaugaauuucuagaugggggaauuuggauuuuguuagauauugccaaaguguccaccgcaaaguguuuuuuuuccuuucuuuuuuuuugagacggaguuuugcucuuguugcccaggcuggagugcaguggcgcgaucuuggcucaccacaaccucugccucccguguucaagcaauucuccugccucagccucccgaguagcugggacuacaggcaugacccaccacacccggcuaauauuuuguauuuuuaguagagacgagguuucaccauguuagccaggaugguuuuggccucccaaagugcugggauuacaggcgugagccaccacgcccggccuaauuuuuuguauuuuuaguagagacgggguuucacuauguuggccaggcuggucucgaacuccugaccucaggcgauccacuggccuuggccucccaaagugcugggguuccaggugugagccacugugcccggcccacaaaguuuuauauuagcuuuuuauucccucuuagaguacaugguguuuuaaagagcugucaugguauauuuaaugcucgcaugacacuccacauuuuaugucagagauagaggguagcggaaguguucuuuugcuguugaucacugagacaguguccguguguuugcugcuguccugaguacucuguggugaaugucuugugcccccucagugcggacgcugcugggagacagucacagccuguacccaggccugugucugaugccaacggccuacgguuggcacuagagcuguuucuucucauaguagccuauuguauucugucuuucacacauuuuuuuaaacugcuuuuguauuugaacaguuuccugccagucugucucuuggcuucauaaguuuucucaauuuaucauugacaguagaaacggugcuucucuauuaguugugaauuuaggacccuguaguggccagggauaccucucauuauaugucaggcacugguaagguccugagacuuuacagacaugccuacucaguaacuaaguaauaaucuagauggugaccugacguacauacacucaugccaggaggccaucaaauuaaaauaaucacuaucauucaugaaguguuuguucagcacuguucugaguacuuuuuauguggcugccuuauuuaaacuccucauuucuuuuuuuuucuuuuucaacucagaccuuaacccaaaggauaaaauccucauuucaaccuauaagauugauucuuuuguuauucccauuuuacaaaugaugaaacuaagccuaaucagguuaaauaauuugccccaaaucacucagccagugagugguaaagcugauagucuggaaggagagaccaccaguuagccucuggggcuucuuggagguggugacaacugagcuagaucuugacagauaaggagauaaaagaguaucuuccaggccaggugugguggcuggcuuaugccucuagucccagcacuuugggaggcccaagcagguggauugcuugaggccaagaguucgaaaucagccugaccaacauggugaaaccccaucucugcuaaaaauacaaaacuaagcugagcgugguggugcaugccuauaaccccagcuacucaggaggcugaggcacaaaaaucgcuugaacccaggaggcagagguugccagcgagcugggauugugccacugcacuccagccugggcaacagagugagacccugucucuuaaaaaaaaguaucuucuucaggcauagaucagcugauugucaacaacagaaacccuagagccaucauaaaggacaaaauaaagauucuuccaaggauggaaagguaucucugagaaccgauaggcaggaaauagagucacaggaaccagaaaaagccugcaggagccaggcccgccacuuucucuggaccugcugcuucucuugcuuugagugcccucugcgugccuccuucccuuuucucaccuuuaccuccgcauggaagugauuucucugcauggccccuccacucaagagcccagcagagauugacaaguuuuccaguuucaaaccuaaaagaugccuggaagagaaaagcuggccagcuuagguccagcguguguguaccacugguuuguucaucugugcccaggggcguagguuacaugccccacucaucaagagcaguagaacaaggacauugacuggugacugacauuuccucugaugagacaggcagcauuucuacuaagaguagcaaaugugaaggcacagauaggaaucaugaaacggggcgaggaaagagaaggcagccagcuaugggggaccauggagugucuaaagaagaguggugaggccgggcgcgguggcucacgccuguaaucccagcacuuugggaggccaaggcgggcagaucacuugaggucaggaguucaagaccagccugaccaaaauggugaaaccccguuucuacuaaaaauacaaaaauuagccaggcgugguggcaggcgccuguaaucccagcuacuugggaggcuagggcaggagaauagcuugaaccugggagguggagguugcaaugagcugagauugcgccauugcacuccagccugggugacagagggagacucagccucaaaaaaaaaaaaagaaagaaagaaaaagagcggugagaggaaagacaggcgagcagcucaggguggcuccuucguggcuucaccacgggaaguuugcauuguuuugcaaggagcaguagagacauuguugaagguauuugaguggaugaagagugauucgaguugugcuuuagguagauuagcuuggcagcagcaggugggugaaucggagugaggagauggugagauggucaaagcgagagggaagggccuuuccuuuccgggccguccugauggaauuuaggugaggggugggucacccaaccugccuguggucugguggcuaaugugagcaccucccucccagcccuaccuucacaggcgguaguuucccuguuucugguccgugcuccuccagcugggccuucuuccccugaccuugcugauccuuggugaccaccuccgaaugucagaauccacaucguuaggcucacaaugugggcugcuuuugccccaguggguccaguugccccaacacgcuguguagugcugaccaguguuuacguguggggucggcuccauuccucgcuuucucccgaaacagaugucaaugccaaucgcaucaucccgaggagacguggagaguguccgccgcugccuggcucacagccucuucaugagcaccgccgagcuucagccagauggcaccuaugccaccacggacacccaccagccaguggccauccacccgucgucuguccucuuccacugcaagccggccugcgucguguacacugagcugcucuacaccaacaagugcuacaugcgggaccucugcgucauagaugcacaguggcuguacgaggcugccccugaguacuuuaggaggaagcugagaaccgccagaaacugagccgccccaggaugccgccagaaucacuggucccugggagcuuggacuacaguuguccuuacagcaggcuuccagguuggcgcuuagagaagccuuggaaucagcugaaggugccugacuuccaggagcgugaaagcaucuuugcucaacuccugggacugaaccauauagacauggacauaucauuuguaccuggaaaccucaaaauuaugcuuuugguucuuacugggugacuuugacuuaauuuaacaccugagccucaguuuucucaucugccaaaugggaguaauaauaauaauccuuauaaaauuggguucauaaaguuuagagaaaaggaauggaaaguacccagaacuaugccuggagcacgcacgacacacguacagugaguugggagccguuaggcugaauguuacugcuugccauaugaugugaaguacagcaauaucccaaguucuugugacugagggagauuuucuggaagggccacaggagguugcggagcuuggauguugcccuuaguucuuguuuaaugucucucugaaugcaguuuuaaaauagaaaacaaaacugacuucuguagaaguuuccagagggaggugcuguuaucucguaccuccugggauggcgaucccuacugaacgcuugugucucaggguggaccacucugugucugucuccaagcagagaccaguaaaggagccuccugguccucagugcgugacccugucagugcuuucaggagacauguaagcuuccugggugaagguugauuuguaccuucugaauccugucacguguagacaugggaaacugaccuaucaguguuuuguguguguaggugacucccacauacacaguugccauuuuucucucuaacugggcaccagugaacaugcgggcaugaggagugacuguguaccauuucagcuguuucuuuucgggcaguccccuggucagagggggugggggugggggaggggagagggguaccuagaacccagagaacauuggcuuaugccagauaccacaccacaucugggcuuacauucuuguaucuuuuuuggugugugggcgggggggguggggggcaguucagugaagucuagaagaccugcuggacaaauucuaaaagagcuagagcuguaacacuuauucuugcaucuuauuaauuuucuaugauauuuuuuccuucuucguagggacuugggacaaucuggcuuugcugcuuucuaacugcuaggcaccucucucuaacccucauugucagagggaauuggaggauauccacagucuguuccuguucugauauucugagcagagaaaaggcacuaacgguuccucuuagcuauuuaauuaucagaagcaaguaaucuuuccccagauaauauuuugcccuagaagaagccgugauuuagcucuuuuauugugcuuacuugguccaaauacaucugugggguguuuugucauuucuuaaugaaugaaucauaguuauaaccaggggccaagcugcccaagaggcucuucagagaucauggaugcucucuuucuggaagcuguggccugauggagcagccccauuccagggucccaucuguccggaguuguguaugucaaguccggcucagucuuuauuuccaacacuagccgugguccugugcagucaagcucucagcuaguguuuagggcugucugucagaaaugguuauacgugggcaaaagaagaucugacagcuccuauauaccuuaucuuacugaauucuuaaacuuugaaccaguucuuccacuuacugacuuguuaccacugcugacuuucugaaaaguuuuccaguuuuuguuuuuuguuuuuuguuuuccaguaggggauuagaauguuuaguccuacuuaguaagaaaaauauuguauuuuuaaucauucauagugcugguaaaaaaaaaaaaaaaaaaaaaaaaauugggggguggccgggcgcaguggcucacaccuguaaucccagcacuuugggaggccaaggcgggcggaucaccucaugccuguaaucccagcauugggaugggaggcugagguggguggauugcuugagaaguucaagaccagccuggccaacauggcaaaaccccgucucuacuaaaaauagaaaacuuagcugggcaugguggcacacgccuguaaucccagcuaccggggaggcugaggcacaagaauugcuugaacuugggaggcagaguuuguagugagccaagaucacgccacugcauuccagccuggccgacagugugagacggucucagaaaaaaaaagaaagaaagaaagaaaaagaaaaaacuugggguaauuuauguccagcuuaaguaccugaacaguuuccggaaauguauauuuuuuuucugagaggcaaaggauguaaacagcuucuaaguagcuuuaauguuucuguacagaaauaaguuuaucccuguaacauugugguagaguuuuaauacaguauuuaguuuuuuauugggcuuuuuuaaaaaguuaacuuuuaacauagcugcucagggauuaaaucagauuggaaaacccauucugacuccacauacugcuacaaagaaauacaucguuguuuauauugagcugcaggagauaguacacuuuaaacuuaagaaaguuaaauguuucacaauaacauugcaauauaaucuucagcuacucucuuuccauugguaaaaucucugauggugugauaacucuuugccaaccuacgaaacccauaucuggaagaaucaccagcucccgugagcagcuucauguaaauagaugcacuccaagcagauugcaugccucagguguuugucuucuaguaaucauggagugugcaacacccagaguaacacuacaaggggcaggacugcaaacagcagguccuggcuaaaaacccuuaaugcugcauugcugccaguuguaaagagaugccugaauggaggcaaguucugcccugugggugaaacugaugauguacuguacugucauauauaaauccacuaaauccagcuaccaggaacugccuggaacuguggccaugcauuuuuuuuuuucuuuaaagaccagugugauaguaggccaugcaucugagauacgauauuccuugguaacuagagggagaaaaaaaaaucaaguagguucaggcuuauguuguauuuugagagucugguuuuauuugaacagaaauaacucuacagaaagcucuuguaaauaaugcucaaauuugcacccgacgaucaaauccauuaaaaaugaaucuuguauaugauguguguggcuuguuucuugcaucucuuuuccauuauucauagaaaauuauuuagaaaauauuaaguguuagucuuacca

SEQ ID NO: 16683 - RNA, 16063 nt, Homo sapiens
caggucggaggccggggugaggccgacccacaggccgccuugcucccucgcgaagacgcuuaugccagucucgcccguccccgcuccuccucagagaaaaugcugccccgcagcacuuaccggagcgaccaugagggugacgauuugaagcacacacaggcuucccgccaccuccuuuaaaccgccgcuggcuugccagggacagacggcgcgguuggcuccccaaaauuccgacugauacgcgccucggcgagcgaaagcaaacgcgggauacucucgcguuccugauuggcugguuguggacaccucaauuaugacagaaaggggccgggcgggaaaguuagcuguggccggcggggauuggcagaaggaaccuguacuuacucguuuuucccggacguuggcugguggagaagagaggguggggagauggggcgcugggggggggcgguggcgacgcaacucgugauuggcggaugugcguuccuuaggucucuacggauugcgguugcuuggcguugauugggcagucgcgggaaaacuaaagugggcggggggccuuugggcccgccccgccgccggggccugcuggcggaaggggaaauggggugggugggggguggggcaggcgacgguggggaagauggcguaccagagcuugcggcuggaguaccugcagaucccaccggucagccgcgccuacaccacugccugcguccucaccaccgccgccguggugagcagcugcagugccaccuucucauuaucugggcuggauaugacugggucuucaggaaacugggguuugggccucggggaggcccagaggggcuggucccggggauggguggaggcguacagggauuacucugggguucgaguuggcgccaagaaugcuuauccagugacgcgagaagggagugcugcuucauggggggucaggucaguuucuaagagaugagcgccggaccuauagcggguuaggguugcgggagccucccacccaagaaauguguccgagagcucugccaauggccaggugguaccauggugacuagugagaggaagguccguuuagugaagaaacaggaauggggaaagcaagcuggaaacugucgagaggggaauggcuuauaauaaaaagggucucuggaucuaaauaaggggcuagcuggagguacccagcccuaacgguggcagggucuccagucuccguuauuucaagugaguuuuguuguuucauacagcuguuucagguggugcccaugugguggguagauucauagcagcuguuuuuauuuguccugugucuaaaauaucaccaccugucugccucauuucuucaugucagccucaacuauugcaacauaaaacagacuuuuuuguguuagguauugaggauacaaagaauucuaccaauccuagagaauucuuuaccaaccucuuccucuggccuaagaagaaaggcuuaaaggaaaucacgucuaagugaccgagaguuggaaauugcuagaccuacuaauucuuuguuguaaaugaugaaauuuuguuucuugauuugcuuuaagaagcucuuuuucuauuucagcaguuggaauugaucacaccuuuucaguuguacuucaauccugaauuaaucuuuaaacacuuucaaguaagugguucaucacaauagugauuaaugcuucaguuucuucuuuuucuuacuguuuaguagcaaauccuguuauacacuauccuaaaaaagaacccaguggggaccuuugauuauaaguugccuugucaggauauaaagcagugauucugcagccugguuggacuugagaaucccuuagggaacuuugaagagauucucaagcuccucaacaaguaccaaaucagaauuugcaaggguaggaauuaaaaucuguguuuuauuuuuaaaguucccugcaucguuuugauguguccaguuccuguauuuggaaaucacugguuuagacuuaacguuguccuaugagaggaggcugacuagcuagcugcuuagggguugucucacagggauggccuuauuuuguccauucagcaccuaggcacacccaccaccuugguguuaucaccaugguccagaaacucaauucuguuagugcuuuuaaauugugaucugucuuccagggaucagaucauacuaaccaaauuccaaacaucuaaagcuauauggugguuuauuagauuacaaugggagaugguccuuuccagugauuaaaaugccaaaagaggcugggcacaguggcucacgccuguaaucccagcacuuugggaggcugaggcaggcagaucaccugaggucaggaguucaagaccagccuggccaacaugguaaagcccugucucuuacuaaaaauacaaaaauuagccaggcgugauggcacaugccuguaauccuagcuacuggcgaggcugaggcaggagaaucacuugaacccgggaggcggagguugcagugagccgagauugugccauugcacuccagccugggagacaagagcgaaacccugucucaaaauaaaaugcuaaaagagagauggauuuuucuguuccaggaugaucuuaccauaguuggaguaggggagagacccaaaagccaauaacugugccucuacacaugcuguucugucugucucaaauguguuucauucacuuuauauccauugaacucuagcuugccuuucaaaacgcagcuuuuguguaaccuuuauguacucauccuccuuuguuuuagaacaucucucacuuuuacuuugcaguuaugcguaugcuugucuccucacuaggaugaggacucuaaaaucuggauaauuaauauguagaacugaauuguuucaacuuuaauaguuaacaauucucaagaauuuaguggucuguaaagcaguccugucaucucuugucacuguguucgcacaauacucacauggcgcuguaguuccauccaaguaagucuugcuuccuacuuggcuuuacucugccugggguuaaacucuugaugacacugugcauuuggaguuaggaguucuagauuugccaucagaguuuccaucuacuccugcggguccuuggucaggacauuuaaaaguucaacuuuuagcugaauaacuaguauucagcuagucagucaacuuuuagucuccuaucugugaauuggggguagcuugcuugucuguggaucacaagagauaguagacauuuuaaaacguuaagcacucuacaauugagagugguuacuguggguguggagauguuggguagggaagggucuaucaggguuuccaacaagaaaauaaguguuuggcagggugcaguggcucacgccuguaaucccagcacuuugggaggcugagguggaugauccccugaggccaggaguuugagucagccuggacaacauagugagaaccuaucucuuuuuuuuuuuuuuuaaguuuuaguuuaaaaaaaaagaauuuuccuuucuuuuagauguuucugacugccuaauguaaacauuucucagcaauuuauauuagacccugaaguuuuucucugauaugucaguucuauuuauuauaugaugauacuacauaugaaagcacuguuuucuguucugccgauuaaccuagucuuuccagcaaacuuucuccauacgacgaucacaauuuaaaauuuucuuuccuauuauuauaaaugucacagucccaaugaugucuuucagacuuugaacuaaaagcagcaaaaaaaaucuaacaucagauuauaugcccccguuuuuguuucagaacagaguaucacucuguccaaggcuucucaaccaccgcagucauaggauguuucuuuuguauuaauauggaacuguuuccugguaauuuauuuuacuuaauacaucuuucucuugauuuuuuuuuaacagauauggagauuaaucaccaacuucuuauuuuuugggccaguuggauucaauuuuuuauuuaacaugauuuuucuguauccuuuauuaaauggggucagcaucaaaacuuuuucuuaggaaguaaaaaauuaaguugaaacuuuucauccuguuacuuguuuuugguaccaucuuagcuaugauuucugggucagugguacauaaaguaguugcuuagguaguaauguuuugaaaaugucuguaggucacuuuguucaaaugggagguuuuaaccauaaaaagauagcacuucugcucuuuuguuacuuacaaaucugaucaagggaggggagaauugauuuaacugaggcauaccuccacaguaaccaacagguucgaagccguaaaacaaccugaaugcaaugguaauucagcagaauuugggcauaaguuuuggaauggguucaugaggagugggaaccugagaucuccuuggguccugguugcuggaacuacuggcugaaagacagugguugugucugcugggcuugucaaguuccgguuuguugaaaggaaaaccccagcucugauccaaugguaauuggggccacagagcagggcauuccucuuccaccccugcccucuguauuaagagggaguuacaguucaacucaucugcagcugcauuccuuccugaggauggcaggaauccauuuuauauccuauguaggauaucauucugauaaguuuccauuaaaguuuuuucucaucguaauucaucuuuauugacugaggugcucaaccugccaggcuggaaaaguaguugagcacacaaggcuucuugcugcggauuucuuccaaguuaggaugugggaaagcaaagauggugcauauuaagguguggcugagcacaggaaagacaauacaaauuuuuaaagguuuaauaggggacuggagggccgggugugguggcucacaccuguaaucccagcacuuggggaggccaaggcaguggaucacgaggucaggaguuugagaccagccuggccaacauggugaaaccugcucucuacuaaaaauacaaaaaauagccuggcaugguggcacacaacuguaaucccagcuacucaggagaaugaggcaggagaaucgcuugaaucugagaggcggagcuugcagugagccgauauggcaccauugcacuccauccuaggugacagagcgagacucugucucaaaagaaaaaaaaaaaagaauaggggacugaaagcaugucugugugucaucuggauuaguucccagccagggacaguuuguaaaaaaugaugcuggucuugaccuuuucucaaaugcuugguaaaaaaguaaucacauuaccacucaaacauucuuauacaaaugaagacuugacuaauuacaaauaauauggaauccaaguguacuuacaagauaacauuaaauuuuuacuuuguucauauucgugugcuuaauauuuucuuaacuuggaacuuaagauaucguuacugucgaaugcuagaagaaggcucuuuccgaggucggacagcagacuuuguauuuauguuccuuuuugguggauucuuaaugaccguauccuucaacaaacaacacgggaaaauguugaagaacacccuggcucuuccuaaagcuugucaucugucucccacaguucucuagaucuuagcuucagggcacuaucauuuauuuuacagcacauuuucugugacaaguuuccaaaccuagcagucggacaggaugagcaagucaaaggaacuuuuaacccagguggguuacuguuaagcaacucaguuauaucauuacugcuuggcguacuucacuuuuaaacuaaguugguaagacauuuacuugguggcuaccaaaaccaauaaauuauuuuuucagaaaaagaauuuucaucuauacaauagacuuagauaugguacggucugacaagaugguuuuguuccagcuagcuuuauucaucucuguaaaggugcuaaucgugagcaagcuuuaauauaauuauugacugaagaauuaacacauuuuccaaagaggcaagaacuucacgaaagcagaguauuuguuugaaguagcuguaaaucucgauaauuuagccuaagcagauuuuugccugauugcucuggguaauuauuuucuggguguuucuccuucuauucuaaagauguaacaacuugacuuuuccaauucaaacuucuguuagaacacaaucuuuaguucuccugcucagucuuuccuauuaaacuuuuaauguugauauuuuccuuaaugccaucugcuagcuuuuuggucuguuugugagcuuaguuuucuugggccaggccuuuacaauaaugcucgucuauguguggagccgaaggaaccccuauguccgcaugaacuucuucggccuucucaacuuccaggcccccuuucugcccugggugcucaugggauuuuccuuguuguuggggaacucaaucauuguggaccuuuuggguaaggcucuucucacuauuuuuuaaauuauuuuaccuguaaaaguauuuuguuacuauuuuucauguuuauucuguuuggccuucacguauuaccuauuguaaaauaccacaauauuaguucauuaauuuuuaauaauuauguugacauucauccuaaauauaggcaauuuguguugguaggucuaccugcaaucuaaauuuuaauucucucccucauccuuuauuucugcuugacucuagguauugcaguuggacacauauauuuuuucuuggaagauguauuucccaaucaaccugguggaauaagaauucugaaaacaccaucuauuuugugaguauuuaacaccagguuacauacucuuacaggcaaaccaggacaggggcaugaucuguguuuucuuuggcuccccuagcuccuaguacacauagcucaggucaguaaccauuugcagauugagcauucuggcuacaguugaagagcacuuggacuggguaggagcagacagugccaggguuguggcaagaccaacgucaacaggcucaagauaucuugggaguaaccugguaauuguuagagaugaccacuagaacuucuauucugguaggagccugcugguuuuaugaaagcugcuguccacguuuagugaaguaagguagcaaaaugggcaaaacugaugaaaguuucugaugguggacuuuguggccugccaagcaggugguugagauaagcagugaagcagaguggaaauagcuuuggacuggaaaccagguguagcugucccacugaccagccauagagcaaguccuuucuuuuuugcacuucaguuuccugagauagaacuuugauuucuuucuuucuuuuuuuuuuuuuuuuuuuuuuuuuuuuuuacauggagucucacucuguuaccuaggcuggagugcaguagaacuuugauuuaugagaccucuuucuacucuggaauuugguauccuugggagaugccauauuaaaaagggcucaauugagaaguaaaaugugaguuuuuguuauaaaauguuuguuguagaauaguaagcaaaaaagaagaaagugaaauuguccacuaucccgacacuuggguauagcaguggccaccauuguuaacuuuucaauguguauucuucagucuuuguguacuuuuuaaaaaacgcugagccaggcaaggcugcauacacuaugauugcgccugugaacagccacugcucuucuugggcuaggccuuuaacauagccacugcauuccagccuggacaacauaacacauuccuguaaucccagcacuuugagaggugaaggcagacggaucacuugaacucaggaguuugacaccagccugggcaacauggcaaaaccccaucucuacaaaaaaucccaaaaucagcugcauaugguggcauguacuuguaaucccagcuacucgagagguugagguggaaggauugcuugagcccagaggguugagacugcagugagccgagaucgcaccacugcacuucgggcugggggacagaguggcacccugucucaaaaaacaauuuuuguaaccuuguaaacuuaguaugccauaauuguuuuuuccacccugaaguguuauaaaauuauaacaggugauauuccaugguauggauaugguguaauuauacuaaucccuuguugauggacauugacguuagugcuugguuuucucuucuguaauuggaguggugaauguccuuguagcuaaaucucugcacacauccaugauuauuuucaaaagauaauuccuagaaguagaauuccuauuuuguugccaaacgccuuccagaauggauguucagguuuacauuucaacuagcauuuauaacuguucauuuccccacauccuaaucaaacaaggaaggcauuuuauuuacccuuuccuaguugaauaguuguaggaugaugucucauuguuuaugauuuuuaaaaaauguuuugaaacaauuucaguccuacaagaaauuacauaugcaguacaggucucacuccauugcccaggcuggagugcagugguaugaucauagcacacuguuaacucaagccccugggcucaagugauccucccaccucagccuccugaguagcugggacuacaggugcacaccaccaagcucugcuuauuuucuuucuuaaauguuuuuuuuuguggagacaaggucucucuauguugcccaggcuagucucgaacuccaguccucaggugauccucuugucucuuggccucccaaagcacugagauuacaggugugagccacuacaccccacuuuuuauuuuuuuauuuuuuugcaauuguuuucuggcacaacaagauauaccaggcucauccugugcucuccuugauccaguccuagaaucagcuguuucuucaaggagcccugguuccuuuaaaguggagaaugguauuuagaagccaagaucugggugcuagaugugcucauugcuauuggaguguugcuauucccagauccucucagugaacagagcaauggaauuauauguauguauguaugauaauguauacauguguauauuuuuagaucuauguauuuuuuaaaacauggguuuauacuauacucccauuucuaguacuaccucaugguucauucuagcuuuuuuccuauugguuuccuccaauauuuuauuaugaaaauuaacaaacuuauaggaaaucagaaaaaaauuggagugagcuucauguagccaccacauagauucuguaauuaauaguucccuauucuuauugcacaccuaucccuacaucuagcuuuccaauccaaaauguaugugccauuauauguauacuuaauuccuuguauacuugagugugcauaucaguaacuagaguuuaguauuuaugugcaacaaaauacacaaaucuugagugugucaacugaguuuuuauaaaugcacacaucuguguaucuaucaagacagaaaauuaccaucaaccagaaaguucccugauguccuucccugucaaucauuguaccugucccccaagaagcaauugcuauucugguuuuguuccucuguagauuaguuuuucauguucuacaacuucaugaguagaauuguacaguaugcauguacucuuugguauaaggcuucuuucauucaacauaauguuuuugagacucaucuguguucuuguauuuauugguaauuuguuccuuuuuauugcugaauauuauuugguuguaugaauguaccacuccuuuccaucugcccuuuccaucuguccuaaccugauucuuauuaugauuaauguuuuaccuaccuaauuaccccucauauguaaccagucuuucgggauagucuccaccucucccauauggaugccuugcuuaucucacucacccucagauuccccagaccaggcugcccucuuacagggaugccuccccauccuacucgggcuaacaucucgucaggccaccuccaugugugcauggucugauggggcucuugacucccuauaccaggcugugcccccacccccauccugcuaauguuugggcaguagaagggaucucaguuuuguuuuuguugucguugcuguuuuuugaaacggauucuugcucugucacccaggcuugagugcaguggcucaaucucggcucacugcaaccuccgccuccuggguucaagcgauucuccugcgucagccucccuaguagcugggaucauaggcaugcgccaccacacccggcuaauuuuguauuuuuaguagagauaggguuuugccauguuggucaggcuggucuugaacuccugaccucaggugauccacccuccucggccucccaaagugcugggauuacaggcaugagccaccacaccugccgggaucucaguuucuaauauacuuuccuuugauuauugugagagcaaacauucucacguuuauugaccacauggauuuccuuuuugaauugcauauucagcccuuugcccauuuuuucuguugguauguuuguuuuuauuguuaauuuguaagaauuuuaaaaacucauuuugaauuauacuauuuucugacuccaguauaaaucagaaguuuucagauacauuucuaauuuuaucaacuguggaggauuacaaguagaaauauaagugcaaauugaggaugcugcuuuaaugguuccuucuuuagugagguuuugaauuacuacaucauaguacuuagggagucuuuuggacauuuacuauccccuccuauguucugcaguaauuuuucuugggauaccuuguuaauuuuuuaaaaauuuugugguaaaauaauaccuaacauaaaauucaccaucuuaacucauuuuaaauguucaguggcauuaaguauauucauacuguuuugcugccaucaccaccauccauagaacucucuucauccuacagaacuacaacucuguacucauuaaacaacuccccaccccagccaucaccauucuauuuucuuucucugaauuugacuacucuguaccuaaguggaaucauacaauauuuguccuuuuuugucuggcuuauuucuuauuucauuuagcguaaaguccucaagguucauccauguuguaccaugugccugaauuuccuuccuuuuuuuugagacagucuugcucugucgcccaggcuggagugcaauggagcagucucagcucacuguaaccugugccucccagguucaagugauucuucugccucagccgccugaguaguagcugggauuacaggcaugcgccaccacgccaggcuaauuuuuguauuuuugguggagacaggguuucaccauguugacuaggugcaguggcucaugccuguaaucccagcauuuugggaagccgaggcaggcagaucaccugaguucaggaguucgagaccagucuggccaacaugaugaaaaccuucccuccuaaaaauacaaaaaucagccgggcgugguggcgggcgccuguaaucccagcuacucgggaggcugaggcaggagaauugcuugaauccgggaggcggagguugcagugagccgagaucgcaccauggcacuccagccugggcgacagagugagacucccgucucaaaaaaaaaaaaaaaaaauucuauuauauguguguaccguauuuuguuuauucaccuguugaugcacacuugggugauaccuugguuauggggaaacauuaaugauaaauaugugaaagucagguuacaaaacauguagugugaucuaacuuuuguaaaaugacauaauguaaaaauucccaaagaauaacuaaaacauugacaauaguuaccucuggaaauugaggauauuuugcucaucucuauuuccuccuucucuguaauuauuaugauuuggauugcuuuuguaguaaaaaucaguaaaagauaaaagcuaauguaaauguuaauaauuauagaugcucuuacaauauguuaacuguuuaauuggcaggcagguguaaugcuuaccuauugguggaaacccuauggggccugaacugaccuuguaguacuuuggaccugagaugacucugggaccaaauuauaucuguugcuugucuuuuaggaaagcuauuuuugauacaccagaugaggauccaaauuacaauccacuaccugaggaacggccaggaggcuucgccuggggugagggccagcggcuuggagguuaaagcagcagugccaauaaugagacccagcugggaaggacucggugauacccacugggaucuuuuauccuuuguugcaaaaguguggacacuuuugacagcuuggcagauuuuaacuccagaagcacuuuaugaaaugguacacugacuaauccagaagacauuuccaacaguuugccagugguuccucacuacacugguacugaaaguguaauuucuuagagccaaaaaacuggagaaacaaauauccugccaccucuaacaaguacaugaguacuugauuuuuaugguauaaggcagagccuuuucuuccucuucuugauagaugaggccaugguguaaauggaaguuucagagaggacaaaauaaaacggaauuccauuuuucucucacuguauuaaagcuuuugugugugaucuuuuaaauucugauaauguauuguagcccuccugcguagaucugagcucagaacaguuuacacagcuguucuuccugugucuucacaacuuuuaacuggauuucauuucaggauuggaaauacguggcugucaugcugugguuguguacaucuuacuaacucagaaugcaagauucagcaggaagaugauuuauuucugucaucuggauagguuguuuugcaucuggguuuugccaaacuuugucagacaacaugaaaaaaaaggagggaggaugguucuuguagcaguaggaauucagcuauaggaaagucagcuguaagcuaauguggcaucuuauuugcuuuacuuacauuucuccauuaagaaguauccagggaaagauugguaagggccacauuuuuguaaaacuaggaagauuuucauuagacuuuuuuuuucuuuuauuuuuaaaaaaguuuuaauuaaaaauuuuuuuuuaaauacagauggggucucacuguguugcccaggcuggucuugaacuccuggacucaagcaauccucccaccucagccucccaaagugcuaggaugacaggcaugagccaccaugcccagccauuuuuuuuuuuuuugccuuuuuuguuuuguuuuguuuuuuguuuuuuuaauuaaaaaaaaaaaauagagacagggucucagauuuucauuagauuuggaaaccaaguuagaauguugacuuuggagccagacgaacagauaccaguuagcuaggcauauguucuuccagggucuuuggcuaguuaacauuagucauuugcuucgugaaaauucaagaaccuuuucagagccaaguaccuggauuaccuucccaaucagguagaaauuagacaggguccacagaaguagacacuuaaugcugugguucaauaaauacuuccccuaaauauuaagucuucccugagucucagcagguuugcauucacacugcuuaaguaacuuccagaaccuggaagagucgaaagagcaccccuaggaaagagaugauuccaaacagcuuucauuaacggcauguaggcacaggucccuuucccaaaaguggauuguuaguaguaguucauucaaccuuuguuaagggguagcuuuccagaaugugacauuguccucagaaagauagacauaggcuuaaacauaauggacauccuaaauaggaauuuucagauuguuuuugaagugaaaaguguuuuaaugucuuuaaauggaauugcauaacuaaugguauuuaaguauuuuacauguugcuaauaacuuugaauaugauuguugcaauuuuauggaaccugggucuaugggacugcuuuuuaagcaguuuaaaaaagguuuucaaaguuuaaaagccaaucuuagcauguauaauccuuaugggauucuuaaguuuuauccuaucuuguuuuugcucaagaacgcuuuaucagugacguuuguuagaauuuuguuuuuuguuuuuuuuuuuuaaauuguuuuugggcuagaaaugaguuucucuaguuuuauuuguucucccugaguuggaguuaugcaaugaauggcauuuuugugguaaaauacuaauccuaaaaucuguuaacucacuguucauuuaaguagggaauaucuguauacauuaaugacuagguaaaacaggaaauacauuuugaauauacagccuaaaggcaggcaguuacaggguuuuugauuucuccgauuuuauagggugcaaguucccaguggcaggaugcccugcugugugacugacuacacuguguccugagcagugguaauuucaaucaccucucaucaguuuggccagcccuacaaccaccauuccuagcccuguguugcuugacaggauaccugugcuugaauggacauaaggaaaaguccuuacuuucuccccaauuuaccucucaaucuuaguucuuccagaacacacuucccuuucacaaugcaaauaaacugaaagugagauuugauacauggaauuuugagaccaaccaacuaaccuuacacauaauuugagggauuccuggauucuucuagugauacugaaaagcacacuugacuaaagcauaguguuuuuuguuuguuauggaaauacgguauacguucauuuaaaaauaaauggacauacaaauugcaucuccuuaggagauacauuuuauauacauuucggugcguuuuuuuccaguauggauuucuauuuguuucucucuuccucuuguuuuuucugugucacucuuguauguccucauaucuuucauaccucuuguguagucucuagaagcagaacaccuaaguccugggucuggauaaugaaacccucagucucuggggccucugaaaauaaggaagcauuggagcuauugccauguugaguaaugggcuuccuagaacuauugucaucuauccugccaguguuuuauguuguagcuguuuuucuuugacaggugaguuccagcuauguuguuagucaugauccugccauuauuuucuguguucuguaggaugucuccaggcuacuuaaacauauuuuaugaguuugcaauaaaauuguugaaucuuguaugaucaagucacuccucugcucagaaauccacagugacuucuuaguaagccccuacauuauaugcauacuuguuuuuuucuuaacuuuacucccacuucuaccuaacagggaccucaacuuaagucucuucaguucuucaaggccuggccuuguuccugauuccucaaaaaaucuugacucuaaggccuauuuuauugucugucucugaaucccuauaaagcuucaagucuguaugacauucuuaacgccaaauuauauauugucuuguacuguuccuagcugguacauguauauuagucuugucucccucaugagaauguaagcuccuuaagggcagggaccaugucuuaauuuuuguauccaccacagugccuagcacagugcuuggcacaugggugcugaauaaauaccuuuguuuauugaucagcaaaguauuaucugguauuuuuaauuauagagggauuaaaguguaugcaugcaagcuugagccuaguugcugaagcuugugguugucucugaaagugggauagagggaaacugaacaugaucaagggcaguaauuugguggucggaaaagcaaaggugaccaccagcuguuauggucgugaucagaccaguuaaguccacagaccaucccagacaaguuaaaaaugaaaugugucugacacuucgucguuugaaggaagaaccaggauauucucugaauaguuauuagcuugucaguaucuacauaugaaagcuggugaaccccaagagacuucuucaggagaaacagcagauuucagucuaccaaugggagaaaugugagcagcauggcuugaugcauauauaggacuuaauuuuuccacucuuugguccucuuagcuuugaggcuauagaauagcuggaucauuaggccagagauuauggaugaguuaccuacagauuuguuaccuaccuaugu

SEQ ID NO: 16684 - RNA, 7111 nt, Homo sapiens
agggcucugcacugccagucccuggcuccuucugacaaaaccacugagcaagaaggaaaagccagaccccuuggcaggaugagaggggucucugcccgcugccgggccuggggccuggggccugagccaggaggccuaggucccaggaccuccgccuccaccccaugggucagagcagccugaacccugugcgcgcuccagggaggggacccggugugcgaugcgcgggggcugggcuagcaagggcaguggcgcgagcgggacgcaggauacaaagcccggagccacgaggcuggcggcggggcgggggccggagcgaugaaugggcacggccgggccaauccaagcgcagcauuugcagccgcgagagagggagccaaucggauccccggggcgguggcgguggcgggggcggggacggaaccaaucagcugugaggacggggccgggggcggagccgcgcagaguuucaaaucggcugcggugggcgaggagcagcugugcugcggcugugcucggccuuaguggugucgggugagugcgggcugggcacaaguuucgcccuuguugcccaggcuggagugcaauggcgcgaucuggacucaaaacaauuuuuuuguucggaggggagggcaucagguucuguucacaggggagggcaucagguucggacacgcacggccuguggggucgucuggguaccacaagaagucggaucgaaaucggggcgucuggugggaaggccggggucugggcgggugcgcguuuggucugggcgagcuggugaagaagauggugaucguguccugggcccagcgcugaagcucggcuacggcgugucuugacccugccuccccuccucgccugagccagagagaggaaggagguugggaugaaaagacagcuguuuuggaaacuugaagggcgggacaucagaaaugcugcugacccgaggccccucuuccaggaagcauccuccuuccugcacccacacuuaccaacucgcccgcccccgccaccccgcugcaucccgucucuuccccuguguccagggucucuguggggccugggaauggguauggggaaugccuugcugaucugccuuucgcccuccuccccagggucuaguggacagagaagacucuuggccaggcagauggcuucucgguggcagaacauggggaccuccgugcgccggagaucucuccagcaccaggagcagcuggaggacagcaaggagcugcagccuguggucagccaucaggagaccucuguaggggcccuggggucccugugcagacaguuccaaaggaggcugccccugagagccgucaaccucaaccuccgcgcagggcccuccuggaaacgccuggaaaccccagagccaggucagcagggccuccaggcugcagcucgcucagcuaagagugcuuugggugccgugucccagguaauacugacaacacuaaucaucuuuuuuauggaguguuuccuuggugccaggcaguuccugcccucaaagagccucaagaauauagacuucaugaaaacagggacguugguuaguucacugcuguuuccccaccaccccagauaguuccuggcacauauaggugcucaacaaauaguugaaugagugaaugaaagcaugucuuggaggaaacagaugcucacaauaccaggugauaagagcuguacgugauaggaaauugcaaagcaagugaccaauagugaggcucaccaaaugcaagcuuagucggugaaggcuucccagaggaggugauuccagaguucacccagggaagcaaaggucaagggguauuuaggguaggggaaauagugcaaguccaggccuagagcugagggaaagcaagguguacugcccacucagcuguguaucccugaggagagccagaauuguagucuggguaugaacagaugacagagagcaagguagagcagggggaaaggauaugaaggagcuuagaacucucccaggaaugaucaggaguccggaagauucuaaacaguggaaagucuggucuaauuagcauauuagaauuugcccuuuagcuacaugauggagaagggaauagaggcagagaugcuccugauggagacuaaggguuuggacuugcaggggauaaacuucaggagcugccgagaagguccaguuagaggggauuugcugucaaaugagagcugcugucaggaagacguccuuauauuggauguaagugucuguggacccuucaagggaugcaucuuuaaacccagagcuggagguguagacgugucacuuagaaaggacagaagccauuaggaugaacagaccuccagggagaggauugggggcugcagaggcuucuccucggugucucauugggaauucugaagaugaaagaauucuccagaaaguggguggcucuuucuggacccucugcagagagcucucugagccaaauguuaguccuuauuuggaagcacuuuuugauuguuuucaccacccucagggaucagagaaaugaaaugaauuuguccaaggucacauaacucaucaaauuuaacuugggcuucgcuccaaacacugggcucuggcuugucaaggcaaagacagucuagcugaugaagaagagccuucacggcugucacccggcuggugugaaaggcccaagaguuggggcuugguccuaugggcaacaagaagccacagaagaguuuugagcaguugagugucacggucagaacugcccuuuagaaggaucacuauggaccacuguggaggguggauagagugagugagacccgaggcaagaagacaggugcucucuugguguacagggggugcugggcgggguggccuguucuuuuggggcccucuccuucaguccuggggucaccgucugucuggaaagagaguuuggacuuagacaaacaggcuccaggcaccagggggguccuccugcggcugacugcugcugucauauccaagagcucugagcugggucccagccguggacucauuccaugaggagucauucacauccuucacccuggagacuaacaauagccuguauuuacaggacacuugcugaguguagggguugcuuguauggucuggagaccaagguagcucacccuugguuuuuuuuuuuguuguuguuuguuuguuuucgagacagggucucacucugucgcccaggcuggagugccauggugcgaucucggcucacugcaaccuccgccucccggguucaagcgacucucaugccucagccacccaaguagcugggauuacaggcacccgccaccgcgccuggcuaauuuuuuuuugcauuuuuaguagaaaugggguuacaccauguuggccaggcuggucucaaaauccugaccucaggugaucugccugccucggccucccaaaguacugggauuauaggcgugagccaccgcgcccggccuaacuuuugguuuugucugugcuaaccuuuccauuugccuguuccagagaauccaggaguccugccaaaguggcaccaaguggcugguggagacccaggugaaggccaggaggcggaagagaggagcacagaagggcaguggauccccaacucacagccugagccagaagagcacccggcugucuggagccgccccugcccacucagccgcagaccccugggagaaggagcaucaccgccucucuguccggaugggcucacaugcccacccauuacggcgaucaaggcgggaggcugccuuccggagccccuacuccucaacagagccccucugcucucccaggcaagugggauagugcuucaccccggggcugguggccuuuuaaccugggcacaaucccugcugucugaccucccagacaccaacugggcccuagggguuucuuggcacccccuguggcuaccuggagccaggggcacccugagcagcgucauauuguauuauuauuauucuuacuguuaaauguguguccugcuuuagcagauauccagugcauguauuugcucaucagaaaaugagaaaacaggcugggcgcaguggcucacaccuguaaucccagcacuuugggaggccgaggcggguggaucaccugaggucaggaguuggagaccagucuggccaacauggugaaaccucaucucuacuaaaaauacaaaauuggcugggcgugguggugcacgccuguaaucccagcuccuugggagguugaggcaggagaaucgcuugaacucgggagguggaaguugcauugagcugagaucgcgccacugcacuccagccagggccacagagccagacccugucucaaaaaaaaaaaaaaaaaaaagagagagagaaagaaaacaaaacaacaacuagauuccuaaggauuguauuucaacuuuccggcugaguucuagggggaaauggaguguguuaguuaaggcugcauaguagcuuagggcuguugaauuuuuccccagauuucuuugagggcuagcaucuuucuuuagccuaauaggaacuuugagcuguaauuaaggcaggcucuguuugucccauuugacagguaaggaaacggagguccggagggguuuggugauuagccugagggucauccuguaagaaauagaggaguaaaggcugggguccagaucaucuggauguucugccccaccgaucaagcuggccugccuugcagaaucuucuaguucucagacaggcccagaaaguggccuggcucagggcagggggugaagcucaucccaaucggcagucccuggcaguuuccuggucccaucucggagcucucagggaaggcugccuagccgcugcaccuguguuguggcagguagucaccaggaugcauguaagugaccagguggcucuuugcaaaccuguaagcuaaaauaaggcuuguguacacuucaaaaauacucuccacaucuguauucugacccgguuccgcguccagagccagcaggggaccugagaaaauccuuuaggaccuuaguuucucuguccguaaaggaagagcugaguuuaguucugacacaaucacacucacccaagccuccuagugagcccagaagcaaguuuugaagccaccuggagagcugaggcucaguuuccaaguggggaagcugcaaaaucacuugcccgugaccuuggccucguggaucuugaucuucucucuguuugucgcucugaggucaccuccuggagugagggucuggagugaagcccagcccgccagggucaucugggcccacagaccacaccccgguaccggguugcaagggucuccugccgggaguuuccaacuagucacugguguggcuuuuucuuucaugcagcgagucugacagugaccuagagccugugggggcgggaauucagcaucuccagaagcugucccaagagcuagaugaagccauuauggcggaagagaggugaguuggcaucccaugcuucaaagugaaggggccgggagggccccuccagccaucuuuguaggcaggcguugguucugcucugaccugcugugugacccuggccagucucugccccucucugggccucagucucccucaucucaaacaugagaaaggacaaaauccuggacuggggugaugguaaaggauguagccugaauguguguggucuucugggccuugggaccccauguuuguccaucacuuggaaccucacguguggcugguuccugaaaaaccugcccuuccuccagaacucuccguggcucgucugugcccugccugccuauggaauugggaaaagcaaccugacugcuauggaguuccuggucugucugcucauggccccauccugggggcagggccucgguuguggaccuccccuaacuuggggcuguuuccccauuccacuuguauaauggccaugaugggcucuaaggcugggcccugccagcucuauguguugaggggccauauuccuaccacauuuccgggucugaucuuguguagcucaggcugggagggcccucucagagcccaccacacccaguggcaucaaucccuccccuucucucuaguggugacaucgucucucucauucaugacugaggaagugccugcagguaaugcccaccucccaagagucuuucucacuguccuucuccuccaucucaugcaugagcaaguuaaagaaaaagcccacagagcugaugggcacagcagaguagguaguaccuacuugccgcuugaagccagagcugcuaaccucacugaccccgucauuaacagcacgcugggggccccaaguagcuacagccaccuuccagcaccccccaccccgcagugagcagggaaaggcaucccuacuucuccuaccuugagcacagugaaaaaggcagcucugucuugaaggaaacaagcccugucugaccgccaaggcuucauacucaaggaugucuaugcuuccccgugagcuuccuggaaaaaacccccgggagucgucaguaccccugggccacugcuaacaagcaccuaacaaggggcccagagcccccugcuccagccacaucuggacccaucagugacugccugccauagccugagagugucuuggggagaccuugcagagggggagaauuguuccuucugcuuuccuaggggacucuugagcuuagaaacucaucguacacuugaccuugagccuucuauuugccucaucuauaacaugaagugcuagcaucagauauuugagagcucuuagcucuguacccgggugccugguuuuuggggagucauccgcagagucacucacccacuguguuucuggugccaaggcucuugagggccccacucucaucccuccuuucccuaccagggacucggaggaaggcauaggagauauuuccaggcuuacgacccugggcucacggguaccuauuuauaugcucagugcagagcacuguggaugugccaggagggguagcccuguucaagagcaauuucugcccuuuguaaauuauuuaagaaaccugcuuugucauuuuauuagaaagaaaccagcgugugacuuuccuagauaacacugcuuucucauaauaaagacuauuugcauuuga

SEQ ID NO: 16685 - RNA, 2609 nt, Homo sapiens
uagcggcgcuggcuuccgcaggcuccgcccucucuugcccacccggaaacagccucgccccgccuacgcgggacccaaccgcggcgaccggacgugcacuccuccaguagcggcugcacgucgugccaauggcccgcuaugaggaggugagcguguccggcuucgaggaguuccaccgggccguggaacagcacaauggcaagaccauuuucgccuacuuuacggguucuaaggacgccggggggaaaagcuggugccccgacugcgugcagggugaggccgggauucgggggcugcuguccaauggaaauggcaggaaggucgagccuacggccagaaggggggcuuagcggaggcagagucuugguuccagacauccgcggagcaaucugagcuguccccaagucuccuucuauuaaauccuaccccgcccugccaagagcgcucuuccuuuuaccaccuuacccggaugaucuuggaaucuaguuccuuaaaacuucucacucccccaguaccauuagugucuuacaggauacgugaguuggucagcaaauacaugugcuuuccauuguuacgggcgcgguggugcaggggcaaaucgggacugggauuugguccuuacccuuaacguggcucuaagaccagaagggaacaccugacuuguguugaccucuucaguuagcugcagguuaaagucugagugcuuaccaagacugggggaagggggaaagaacacaguuuauacgugccugauuguagaguugacgugcgauuauuuuaucucaacuuuuuuuaaagcugaaccagucguacgagaggggcugaagcacauuagugaaggauguguguucaucuacugccaaguaggagaaaagccuuaguaaguggcaauguauaaucuaccucgcagacgugcacaaauugcauacuuaggcgggaagggccucagggacuuacuuacccaguuugucuuacaagguaaugucugacaaguuaaacaauuagaagcuauuaaauacaaauuuaaaaugcccaccugaauuaaguaaggguaauucaacgaauuuggucugguguaagcccagaacuuagcuggcuuuacuuuuauaucuuagucacacuuugaaacuuugcacaggguaauuaguagauuaagccauaguccgcaagguuuuuuaaguguuugcaagaacagugauuacuaaaaaauuaaauguaggacuaugucaaauauuaagcaaacuguaauaaaccaaguaaauuuuuuucaugaucacuuuuucuuuucgaauaguuggaaagauccaaauaaugacuucagaaaaaacuugaaaguaacagcagugccuacacuacuuaaguauggaacaguaaguaucuuuaaauaugcugggccuguaauucacugucagaacucuuuuaacuugcuguggauccagauuugaaaagaucuugacauuucaucucaauuccauuguuguucagagugcugcugaaaguccauuccuauggccaaucccaauaaacugauaauguaaauaucuagcuauuaggucuuuuucauguuaagucacucuuaaaaaaccagaaaguagguugacucauaauuccuuaaaacauuugcaucaacaguuguuuucuguuuaauucauaauucugguuaaaaaguaagggcaucucuucuaguucagucaugccccugggauccuaaauuaaagaguugaggggaagaagagggcacugggcuugcugucuccuguuuuagucuguggagcuuccugguauuugggguuuaagucucuugagccaaguauguuagugauucaucuuacagcaaauauauugauucuuucauaaaacuuguuauaacuagaugauaguuucugaauugcguaauuucuguguucaaagaugagugucauucaaggcagaacucauuccacuccuaauaacguuuuauagaaguagugaagauuugacuguuuuucucuuacagccucaaaaacugguagaaucugagugucuucaggccaaccugguggaaauguuguucucugaagauuaagauuuuaggauggcaaucaugucuugauguccugauuuguucuaguaucaauaaacuguauacuugcuuugaauucauguuagcaauaaaugauguuaaaaaaacuggcaugugucuaaacaauagagugcuauuaaaaugcccaugaaccuuuaguuugccuguaauacauggauauuuuuaagauauaaagaagucuucagaaauagcaguaaaggcucaaaggaacguauucuugaaggugacggaaauaccuaaaaacuccuaaaggugcagagcacaccuuccaaaucucucaaaagaucaguaucuuuuauuuuaaguuaucuccaucugcaaagcaacugaugauauuccugaaaccccuucuuugauuuuggaauguagaaccuaaccucaccacugaaggaaagcacaugaccucuaaucuagccucugcuuaauucaggcaguuuuguuuuguuuaauaaaaaacagacuccugagcacuagaagcaguuuguuuugcagcugucucaaugugcuuuacuugggaugaggcagg

SEQ ID NO: 16686 - RNA, 2953 nt, Homo sapiens
uaagcccaggaacucuagccucagaguccaugcucuggugaaucccuuuggaagcaguuguauuaagaacagaaguuguacuuuuacauuguuggugggaguguaaauuaguucaaccauuguggaagacacuguggcgauuccucaaggaucuagaaccagaaauaucauuugacccagcaauuuuauuacuggguauauacccaaaggauuauaaaucaugcugcuauaaagacacaugcacacuauuuacaauagcaaagacuuaaaaccaacccaaauguccaucaaugauagacuggauaaagaaaauguggcacauacauaccauggaauacuaugcagccauuaaaaauaaugaggucauguccuuugcagggacauggaugaagcuggaagccaucauucucagcaaacuaacacaggaacagaaaaccaaacaccacauguucucagucauaagugggaguugaacagugagaacgcauugacacagggaggggaacaucacacacgggggccugucaggggguuggagggcaaggggagggagagcauuaggacaaauaccuaaugcaugugggucuuaaaaccuaaauguccgguugauagcugcagcaaaccaccauggcacauguauaccuauguaacaaaccugcacauucugcacauguaucccagaacuuaaaguaaaauuaaaaaaaaagaaaagaaaaaagaacugaaguuguuuacuugcucucauucaugcaucccggagaaaaagguuugagugcacauccuggauuaggcacugagaaaggcacuagcuggacagguggugaugaauaaaacagacaguaaauagaaauuacaucauaauaaugugucauauauuuuaaaauagcuacaagauauuuuaaauguucucaccacaaagaaaugacaaauauuugggccagacgcgguggcucacgccuguaaucccagcacuuugggagaccgaggugggcggaucaccugaggucaggaguucgagaccagccuggcuaacauggugaaaccccauuucuacuaaaaaugcaaaaaauuagccgggcgugguggugcacaccuguaaucccagcuacuugggaggcugaagcaggagauuugcuugaaccuagguggcagagguugcagugagccgagaucgugccacugcacuccagccugggugacaggagcacaacucugucucaaacaaacaaacaaaaaacaaaaacaagagaaaugauaaauauucgagugauaaauaugcucauuagccugauuugaacacaccacaauuauacacacauugaaaaaucacaugguaccccguaaauauagacaaugauuugucaauuaaaaaugaaauaacacuuaaaaaauaaaaaaguaaaaaguaaaaauuacaccaauaaauauaagagguacaaauugugcuaagugcccuggggacacaggaaaggcgggaaaacccagggcuauaugcaugagaguuacaaagggaaaaggacaggagggaggcaauugcaggaggggcuugggagaaugcauguccuugggugcaggucacaggaaggaacucaugagcuugauucaggauguguugaauuuucgggccgagacacguccagucugcggaaggcuggacaucugggacucuggcaucauggcuggguugaaggcagaggaugguaaucacuaaggagccggcugugguuaggccaccagcauggaugagacuccccaaaaggaagcugcagaaugagaggcaggcagaggagaggaaagaagaaaaucacagagguggggaugucuuugcauccgugugucuccagugcccaaaacagggccucgcggagaagaggugcucggcaccugucuguugccuggcgggcugaaugaauacaugggcgacugucucagugucgccuuaguugugucccuuccucucuagagcuccguuucccucugaccugggucgggcgggcagcugcggcugcugaggcucgguggggccccuccaagacgcguguccgcaucugcccgccgggcgucugcggggugcagcguccacuggagcgcgacagccccugggacagaggaggacaguggccucgcuucccugugcgaucgcccaggagcuccgggccggagagugcgagcggggaaaagggguccugcaccuagaguggggcggacguggcgaggaagccaggggggaccgggaagcgaggcccgcggugcggagggcgcggggcguggggggacaccucucggagagacaccggaggggcggaaguaaggagauggaaaggagagggagaucggggagauagaccugagagacccagaggccugcagagaguuucauccgggacccuucagagcccaggaaagagcagaugcggacgcgggagggcgccuuacgccaaagcgggcagcaccagugaccaaaacacgccccgcuuggcagccccgggacgcaccucugccucggcagcgcaggagaggcuuggacagcgcgagaugcuagggcccaggcugccccuagagggcuggcccgaagcguuggaguccaaagacgccucccaccgccgccggguggcagaauugggggcaggcgcgucccacagaccccgagggguggccccgccccagggccgcggggaggcgcccccgugcggggcggaguugucaccgcccccuccccaauccccggggacuguggccccuucuuaagcccgcggcgccucuagcugccccucacucgucucgcccgccagucucccucccgcgcgauggccucggcgcugagcuaugucuccaaguucaaguccuucgugaucuuguucgucaccccgcuccugcugcugccacucgucauucugaugcccgccaaggucaguugcaucuccaggcagcccuucggacacccggcguccug

SEQ ID NO: 16687 - RNA, 17124 nt, Homo sapiens
cacuuguuuuccuuuugaugaagcuaaccaccggcauuucuccuaagaaauggauauaaaaaaaguuugauaugguuaaaguaagaagugcuagcuccuagaauaucucuggauauugcugucccuuguuacagagcaugagcccugcccaaagacuggaguguaauggcauagaaaaggucaggagcccacugagccagaaguauaggaggcuugcgacaaaguuuaacaggggccuguugcuaucacuggguggagggacagaugggagaacacucacaccauggaaucuuaggcagccauuaauaaaaauaagccacacuguuuuguuuguagggauuuccuuggguauugcugaauuuacauuaggauguaaagaaauguugcugggcgugguggcucaugcccuauaauuccagcacuuugggagucugaagcggguggaucaccugaggucaggauuucaagaccagcauggacaacauggugaaaccccaucuguacuaaaaugcaaaaauuagcugggugugguggcgggugccuguacucccagcuacucaggaggcugaggcaggagaaucgcuugaacccgggaggcagagaucgcagugagccgagaucccaccacugcauuccagccugggugacagagcgagacucugucucaaaaaaaaaaaaaaaaaaaaaaagauggcagcuuuacugguucaaaaaaaaaaaagugaaaaaauguauauaacaggacuccaaauguguauguuuguauggugguuauauaagaaauugcuaaauaaaauacaggguguccugguuaaauuuuaauuuuagcaaaacaaucauugcauggaauauaccuacacuaaaaacaauucuuuguuucucugaaauucaaauuugacugaauguccuguauuuuuauuugcuaaaucuggcgacucuguuauauaaggauggagaaaacugugaaaggaaauauaccaaauugugggaggcaaggaaaaauggcacuaguaacacccccagcaaauaugaaaugaacccauuuuuguaaaauuauaugcuuaugugcauacauagaugcacaaggaaguuagaaaaaaagguuuuggcauacuaagucuuuuguaagaagcaugcaucauauacuaagugaaaaaggcauguggcagaguaaaaaguauaguaagauaauauguguggaaaaagaaacaaguaaaacccaguauaugcuuguuuaggcuuguauaugcaaagguagagcuuugaaaagaugcccauaagacuguccaaagugguaucucaggguaugggguuggggaauuaggguuagcuuugcuuuuauacuucuuuauaugauauuauaucaacuagcuccaacaaaaucuaguacuuauguauuuugaaaaaaaauaaauuuuuuaaguaaggcauuuaaucuggagcuuaagagcauaaacuuuggagcuauauacauguggacucaggcuggauccugccaccuucuaauuguauacuccuuggaaagcuacuucaccuuaucuguaaaauggagauaaaaugcaugccuauuguuuaugaugaagauuauaaagagcucuguauuguaacuggcacacaaugguuaacaaccucuaaugccaguuauuauuauuacuagaaaauaaccuaggacauaaaaaucaugauauucagggagaugccuacaaacccugaucuucuugaagcaaaccuugaucugcuggagguaagccaccaccaacuggcuuaggaucuugaccaagacaucucaucucugggccucagugccauaucuacaccaugagagagauagacuggguauccucugauucauucauuuacucaacaguuuugaagcaguugcuccaaaucaaucccuggccuagaagcuggagacacagagaagagggaccuggcucuaccuucaaagaccuggcuugagucaaaggugacucagucucucggaggugaugcaaauaaaccaggugguaagugcuacgagauagugcauuugggcacccagagaagugggagucagagaaaacggccuuuucagccacaacauuugugaacaucuuucaggucuuggauuuuuuuaagacacugugcggaugguucccagaaagguaagcagagaacagaggcugaguaccugauguugauuuaggaucggcaggggaagcaggaugccacacugagaacaucuccucagaaugucauaggcugcuuuaucuccucuaggggagcugguccugggcuugggcucugacaucaaaaguggauccaagguuuuguuuuugcuucuuggugcuuucuuugaugaacuuucagaaugaagaggaaaucuguuuauacuucuugucuuuggacgaacaucuuucuccaucguggaaguuugauuuucagcagcuugacuuggaagagaugaaggaagaauuucuggauuuccaacaggaaaguguuucuuaaacucugagucuggacaacauuuacccugcaauugugaauaauauaucaaauuuuaaaaugacuucagcuuuaauggucagaaaauacaguagacuagauaacacaagaaauucccacuguaaacacuuuuauaugguguauaaaaugugacagacauucaauuuaauagcuggcuuugcaggaaagaaagaaaauuuugcauuccaggaaugaaggucugacugguugcuaugguuugaaugugucuccuccaaaauucaggugcugccaaugugaugguauuaagagguggggccuucgggggugauuagaucaugaaagguccucccuuuuuaaugagauuaggguccuuauaaaagaggauucaugaaguauuuggcuacagccuucuacucuuuugcuuucuaccaugcuaggaggcagcaagaaggcccucaccagacaccaaaugguggugccuugaucuugaacuucccagucuucagaacuguucgaaauaaauuuguguucuuuauuauuacucugucuguggcauccuguuauagcagcacaaauggacugguuaagcacaggaguugacacugcuuaugggagauguagggucaacuuuguaacuaggggcuuggaugacaggaaagucccauccacacagguggggauuuggaaguaagacucuauugauccugcauaaagcuggaaacuuuaaaggauaaauuaugguggguaagaggaaaaguaucagcuaaugagaaaaggaaaguggcaaggaagcuuuucuuucuugggucgguauuugaguguggagaugaaaacuuaugccccugaaaacucaaaaucacagguccaugccauuccugugugugggauuaggauuuacuuuggccucauggucugggaaucccugagcagaagaauuaacauaaacauugagaugucuggcagaagcaaucacaaaauuccucuggagggacaacagccucaaaauaggucauagaggauccucauagguagagucccaccagauagaaacucacaauccaaaauuacaaacacacaaggaagcaauccaccuugaguaagagucacagacacaaaaguagucagauuagccuccaagaaguucagguaaugcaacuauaggauagagacuguaaaauaaauuaauuaaaaaugauuaaaucugggaaaagaauaacaucucaugaaaaacagaacagguaaauuugaaauuuucuaauuuguaauuaacaaauaauaacuuuauauauuuaugggguacaaugugauauuuuaauauauauauacauugugggaugauuaaaucaaguuaauuaacauaucaaucacuucacauaccuaucuuuuuuuuguagugagaacaaaaauaggcaaauuugaaagaaagauaaauugaacuucuagacaugaaaaaugcagguauugaaccuaaauggaugggcuaaaaacagaaaauuagauuuggccaagaaagaaugaaugaacuuggagauaauuucaggaaauuacccagaauauaagagauagaaauagagaaaauaugaaagguuaagagacauaaggcgauuaaaagagagaaaugaaaaaaaaggagagucaugaaaaaaaagagagucaugaagcuagaaugagaaugcuuaauauacauguguuauguuccagaaggagaguugagagaaugugggagaguuggggaauguugggaauucaaagagauaauagaugagaauuuucaggccugauuagugacauaaaucuuuauauuaaggaaagagaaauccugagcaggagaaaagcaaacacauuugaguacauuguucugaacagaaugaauaaaaauaaaacuacucuuaaacacguuacagguaaaaggcaaagaggaucuugaaaucaaccaaauauaaagauuacguacaaaggaauggcaauuaggcuggaagaaaauacaucaacagcaauaacagaagugggauggcaguggaauaaucuucaaaaugauaagagaaaauagcuguuaaucuagauuuugauauccagcuaaacuaucauucauggaugcaaaaaacaaaaagcuuauuuucaggcaacuaaagauuuacuacucaagguucuuggugaagaagcuacugagauguauuucaggaagagagaaaucauacccagaaggaaagcuuaggauccaaggaagaaugugaguaaagagaaggguaaacuugugaguauauccagccgggcacaguagcucaugccuguaauccuagcacuuugggaggccgaggugggcagauuaugugaggucaggaguucaagaccagcuuggccaacauggaaaagcccaucucuacuaaaaauacaaaaauuagccagacgugguggcacacaccuguaguaccagcuacuugagaggcugaggcaggagaacugcuugaacccaggaggcgaaggcugcagugagccaagaucgugccacugcacucaagcccaggcaacagagugagacuuuugucucaaaaaaaaaaagaaagaaagaaagaaaaaaagcaaaaacaaaaacaugugaguauaucuaaacaggcaugaguuacauaaauaacaacaauaaucaguaaagagggguaguaugaaagcaaaaugaaacaaaauucuggcagcauuuucauguaagauaguuacaguguuaacauguucucaaaucuauauacuauuuguaaggaaaguagagauaaugacuaacuuuagacuuuauuaagucaaguauuuauauuaaaauguuaaggguaacuauugaaaugauagaaauaaauguaaaauugacgaaucaguaggaaagaagaaagagaauaaagaaaucuugcucaauccaauagaauacaagggagaagcaagcagcagcagcagcagcagcagcagcaguaguaaugaacaagagugguaaaugcaaggccccaaaacgaugggggaaaauuauuguuaacaucauugagagugauaaaggcauugugauuaagaaaaugacuguauuuuugagauauuaaagaaugauggugaaauaacaggauaucuuggauuugcuuuaacauacuuuagaaaaaagaaaacaaacaaaguauaguucaagccuggaaaacuuuugauuuccacguguuaacagcuauuuucucuuagcacuuugaagauuauuccacugcauacccacuucuauuauugcugucgauauauuugcuuucagccuaacugccauuccuuugcuuguaaucuucuucggcugauuucaaagaaaucaaccuuugccuuuuaccuguaauguaucuaagaguagauuuauuuuuauucaccuuguuuagaacaacaacuguuguaucuggggaguaaauacaugaauguuuauuguauuaacuuucuacugucauauuuauuugaaaguuuuuguaaucaauuuuauuucuuuuauuuuuaguggacaaguaauaaugauacauacuuauagaauacagaaugauuuucuaauacauguauacaguguguaguggccaaaucagaauuguaauaagauuuuuaauaaacagauuaagauggucaauagauucuauagccacccaagcuuucauuuucagacauauaaggccuaaaaaauuugccucucaugcuuucuuucucaagaaacuauuuggggauauguucuaucaaacaaggaguaaccuaagaaagagaaagaugagaccugagauuugggaaucagaacuccaaccguggagagaguggaagaaauuccagaccaacagcuaaucaucaagccuggggcauaacaugcucccaaaaugaaauggacagacuaucugauguguguaguuguacucaggggaauuuucagaucugguagagaauuuuagggaugauuuagugauagguaccuagaaagugaagcaaaugaaaaaccgaagcaauuauuaaguccagguaaaacaaaaaguuguaggagaaagaacacauaaucacaauucauguggaaaaccauuuauaauguuuacaugguuauacuaauguaauacugaauauuuauuuaaccagaaugagugaaaucaauacauuggaaggaugaaaugaagaacuuuggaggugugugugugggaugggugguauaaaaaagugaaaucuauauuccuaaauccuuaugagucaauaaguaauaucuaaaacuggaaaaaauauaagaaggugcuuuagacauaugaaggugauuaccagaagaaacagcuaaaagcaaaaguagaguauuugugucuggggaguaguuagcaugaaggggaccaguggggcuuauaguuuuucugaggucgugggagacaauuaacaagggccauaauaaguaaguaaauuagauaauauguuagaaguuggcaaaugcuauggaaaaaauaauagaagaagguaagggguugguaaauaugugauggagagggaguugcaauuuuaaauagguuguugugguacaucuccuugagaaggugccaucugggcaaagacuugagagaagugagagaguuagcuccuggaguaggguggggaaggugaggagguagcuuccagccagaggcaguagccagugaaaaggcccuaaggcaugguaugcucaagaaacaaucaggaggccagugagcugaacaggaguaguacaugagaucaaagaggugaugagauaagaagggaggcaaagaugacauagaucucuaaagccacuguaguuuugaguuugcauaaaauggggcaagaaucaguacagagaucugaacagaggagccaaacaaucugacuuguauuuuuaagggaucacguugaccucugugaugagaauagacuguagggggcaaggugagaaguaggaagaccguuuaggagacugcugcagcaucugggcuagagaagaugaugguucauaccaggguagcaaugcggagggaaagagaagucgagagugaaccugagauuuuggccugaacaacuggaaagauagaguugccaucaacugagaugggccaagcuguggcagagaggauuccauuucagauguguuacauuuaagaugucuaucaagcauucaagugaagaugcaguaaauaguaauauacaaaucuagaguuuggggagaaaaacccagacugagauauaaauuuggaagugucugacuacauauggcuuuuuaaaaaauuuuuaaauuuuuauuuauuuaucuauuuuuugagauggagucucgcucugucgcccaggcugcaguguaguggcgugaucucggcucacugcaagcuccgccuccuggguucacgccauucuccugccucagccucccgaguagcugggacuauagucacccaccaccacacccggcuaaguuuuuguauuuuuaguagagacgagaguucacuguguuagccagguuggucucgaucuccugaccuugugauccucccaccucggccucccaaagugcugggauuacaggcaugagccaccauacccggccuuacauauggcauuuuuaaaaaucaggagguaggaugaaauaaugaaggcagugaauauagguagagaagagaccagagacuaagcccuggggccccccaaaauuaagaggcuggggagguagagaaugagagaccaccaauguccuugaaaaccaggaaagugugguacccuggaagccgagaaaguccacugaggaagagggagugaugagcaguaaaugcuucccauaaauugagaacugagaacugagcauuggauuuagcaaugcagaggucauugauuuugacaagagcagauuugguuaaaauggagagccagacuggagugggaauaagaaugagagaagaaaagauggaggcaguuacuuauagacaacuagcucaaauguuuuucuacggaggggaacaaagaaacaagaugguagcuuauaggaaaugggaucagaaguauuucauguuuuucuggcuuugggucauauuaauaaaaaguuaaagacugaaaaccacaaaaccaccuaguauacaugauuucaauccuuaauuuucaaaauuaaaaaaaaauucuuuucgugcaaggccauugauauauaaauauucaauagugguaccccuuuaaaaaguuauuguaagaaauguuaggacaaccuagagaugugagacuuuguuguuaccugcguguacagcucauuuaaccucucucuguugcaggacagagaggggagaauugcuggagcaguguagcaaaaaacuugugugaccuuguguaggcaaaaagagaggguauauuauaccaguaggaggggauaggcuuuagagaggcacauaggaagcuccucuaugguuaagaggugggaaggcaaaguaagugaguguggaugcugccaaggagauagaucugguguuggcugguuguggaugucuucuuuuccugaacaaggagauaaaccauuauccccauuuuccucaaaagaagaaagaagcucagagagguuacacagccaguaaggggcacagcagaacuaaaauucagaguuucugagcacaaauccaguuccauguguauuggagcuccccacuucccuguagccuucaaauaaguguguaggugcccugguugccaggcuggacauuugaagggaaguagucagcuuuacucuuguuuuggugcucaccaaguauuuucucauucaaacagaacacauggaccacuuauaggaucgaauaaacaucaguacuaaggaaaacaagucaguaggugauuuccacguacagccaaggcugagaaucccguggcuggggcagcgcaucucagacuugaaaugccugggaaaucaugugacccugcauauucugauuuagcauuucuagggggagggccugagauucugcauuucuaacaggauuccaggugaugcucaugcagcugguccacagacugcacuucaaaaagcaaagagcugaaagguggaaacaauccgaauguuuaccaacaaguagagaaacaaaaugugggaugaccguaaaaaggccauuaacuuugggaggccgaggaaggcggauaaccugcggucaggaguuugagacuggccuggccaacaugguaaaaccccgucucuacuaaaaaaaaauacaaaaauuagccgggcgugguggcaggcaccuguagccccagcuacuccggaggcugaggcaggagaaucgcuugaacccgggaggcagagguugcagugagccgagaucacgccacugcacuccagccugggcaacagagugagacccugucucaaaaaaauaaaagaaaagaaaaggccauuaaaaggaaugaaaugcugacacaugccacaacuacaacacgggcaaaccuugaaaauguuacgguaagugaaagaagaugguuacauaagaccacauauuauaugagucuacugaugugaaguguccagaauagacaaauccauagagauagaaagcagauuagugguugccaggaacugggaagaugagggaauguacaguaccugcuaauggguauaggauuucuuuuuggaaugaugaaaauauucuagaaccagauugcacaacauugugaauguaccaaaugucucuauagugauggcaaauuuuacauuauacgugguuuaccacaauaguaaaaagaaaaagaaaagagcgaaaagcuggaucgucucuaugguuucuuuaguuuugauauucuguaguuuuaagcacugaaguguuaagaaagguaaacaacuuucugcccaaggagaaggagaagaguucuuuggagagaagccuugguaaguuucccaaaggggaaaugcuccauucugugcaaaagaagggagcaacuuggcacagcaaugcacuaaacggcgcuuaggggcuauggagggaagaaccugugaguguucccaggcaaaaucagucagucagucaaucacguaacugcgccucuacagaguccucuuuuugcaccaagcucugaugucaggaaaauggaaaaagucaugcaguuuugcaggaagcucacagucuaauagagaagacucccacaugggaccgaaaacaguaagacaggcccuacugaggaccaaauugcaauguccaggccaugaaguuuggagauggucagaggugaucggggguguugggaguggcaagggaagccccuuugaagggcugggcacaaaugaagaccaauuuuugugugcuugauuagccuaagcaagucacuaaacuaucuuuuggaacaaagcaaaaaauaaauaugggacccuuuaauauccaugcuauguaaaauugggcccagaaucugccuuuccuaucacacuuuucagaauguggaugaacuauuggcaccauuagaaaauuacuaagugcuacucaccauaugguggaaauacuuauuuucuggaaucauuugguugcaauaaugacaguagauuucccuuucaggagcugaaauucuuuccccugaauaagcagagaaacaacaccacaaaugauuguccuugucaacggcuagcccagcucucccacaacugcauacauggccugugcucaugagcacgaacugccccccggaccugccuggucuugacuuuccugcgcugccggcauccuugaccacacaggcaacucuuggccgaaucacccacaucauuuccuuuauggccacagaugugcacucagggcagcagcaaccguaauggagagacauuuuccuggaucaggacugguuucuaaggagaugaauggagcuguagccacggaugccaacccccuccauucugacugugcucuuucauugcaccaguuuucagacucugugaucagaccagguguugguugaacacauuuuuguugacaguguugaagcuguguuguguuguguuguguuguguugcacugaaguuguguugaagacuguguuugauucuguugacguccagccaugcugggaugaaggaaauauacaugacucucacaauuuccagguuuccauuggccaguuuugcccuuggguggauuguuuaucaggagaagguuacugucuggggaguuuuaggcucucucccauguuaccauguuaccaaaacaacuagcaaagacaccaaaggaucugucacacugaugguugugugacaguaaauacacccucauaaagaggugagugauucaagugaacauaaaaugguaccagggagccaauacauaggcccccaggccaggagccauugcuaacucccuucuggccauuguugauaauggaaaaagcccuagauucagugccaggaagugcgggaguccagucuuauuuuugccucuagcaagucccugcuuuauucuguguguagguuucucaucuguaaaaggaugcaauggaucucugccaggcuaggacugugcuagaggugcucaaagaaagccuccuguuuccuaggacuccccauggucccccccuuuuuuuuuugagacagaguuuugcucuuguugcccaggcuggagugcaauggcacgaucucgacucacugcaaccuccgccuaccggguucaagugauucuccugccucagucucccaaguagcugggacuacaggcguccgccaccacgcccggcuaauuuuguauuuuuaguagagacgggguuucuccauguuggucaagguggucucgaacucccaaccucaggugaucugcccgccucagccucccaaagugcugggauuacaggcauuagccaccccgcccagccuucuccauggccucuuuacucaacuuugugguagcuaggcucuagccccggccuccuagucucccuggaccagucauuugaaggccacagcagacacacaggaaggccacucugaggcaugguuuagaauuagaauagccagaugaauugagaucuauacagcaaauacacuugucauccguccuguugagagcuucccuuccuugcaucccauccaggaaaggcucuggcccuuggaacgucucucuuccaccccaguuugugugcuuaccuuucccgagcugggccuguucacugcgacagacaucucugugcugggcgagcaugcggugcaugaugaacuggccacagccuuggcagagcucuguccggcugccacaguaggacucguggagcuccagcuugcugagcugcauguccaguuugcagaacuuacacucaacagggcgcuccuggcacucauuggccugugggaggcagcaggaagggcaugaucacuggcccuuuuuuuuuuuuuuuuuuuuugagacagagucucauuguguugcccaggcuggagugcaguggcuugaucuuggcucacugcaaccuccgccucccggguucaagcaauucuccugccucagccucccaaguggcugggaccacaggcgugugccaccacgcccagcuaauuuuuguacuuuuaguagagacgggguuucaccauguuggucaggcuggucucgaacuccugaccucgugauccacccgccuuggccucccaaagugcugggauuacaggcgugugccacugcgccuggccgaucacuggccucuuugacuguaggcagaucaaggacuugugcccaucucccuagggaauuagggccaauacgagaaagcagaugagaagggccagagugcgggacugccuucgggggaucugagcucugauggacucauggaccauggaaaacccuucugaucaguaucugggggacaggagaaccuguguuaugcggugggcuaguucuccacugcucuccaagccuaauggggugaaaagaguggucagguggaaaucucuauuacuggccucccguuuccccuuccucuccuuuucucagguuggucuauuuggcuguaaaggagaaaucacauggggcucuuaccuuaugaaacuccagcgaggacuucugcaugcucugcugacacaucguacacccaaccuaaacacacacacacacacacacacacacaccagauguggguccacccagcacccagggccugccccacauccacuuuggcucacaguguuccggguuugggucugugaacucccagagggcagggauccgauguggcuaccucagugucucucuagcaccccgcccaguguucaagaaguguuugucagaccagucugaguuggcaacggcugccugagcuugaguaucuccagagagacagaucaggggccccaggaggaauggacauggaaaggcgggaaacagggcuccaucugacugccuuccaggaccuuccuuuuucacauccucucuuuacagaucucaagagaacagccagucuuuccugaaaccagaaccucuugccuaugccagauccauaagccuguagggaaaggauuggaaauaggaaaacuggagguagacucagauuagcaugaaaaaggcaggauuaacauuuccuuuccaugggcuuuguguggaggggcuaaaugacuucccauggcccucaagugagucucugccugggggacuggacccuugccuuaaguccccagcccucaccccaacucccggaccccaucucuccugcagggaggacuggagccauucccugacucccagaccccuucuuucuugcagggaggauggaacacuugccccucccagaccccaucucaccugcagggaggacuggacccucgucccccaacucucagaccccaucucuccugcagggaggacuggacccacucugugacucccagaucccaucucuccugcagggaagauggaacacuugccccucccagaccccaucucaccugcagggaggacugaacacucuccuugacucccagaccccaucucaccugcagggaggacuagacccucgucccccaacucucagaccccaucucuccugcagggaggacuggacccacucugugacucccagaccccaucucuccugcagggaagauggaacacuugccccucccagaccccaucucaccugcagggaggacugaacacucgccuugacucccagaccccaucucaccugcagagaggacugaacacucgccuugacucucagaccccaucuguccugcagagaggacugaacacucgccuugacucccagaccccaucucaccugcagagaggacugaacacuugccuugacucucagaccccaucucaccugcagagaggacugaacacucgccuugacucucagaccccaucucuccugcagagaggacugaacacuugccuugacucccagaccccaucucaccugcagggaggacuagacccucgucccccaacucucagaccccaucucaccugcagggaggacugaacacucaccuugacucucagaccccauccucccugccgccuccucaccugcuggugcucaagcuugcagugcuccuccaugguuuccuuggggacaggcuccucacacuccggacacaggaccaggaaccgcaggcaguaagccucauggagggugaaguuggcagagacuacaugucuuuuacuacagggucaagguguggggauagaaaaauagacuuauuuucauauuauaaaacauggagcuguauuucauacccagggcuagaucuccagaggccuuaagcacugaacaugugaugaugaugacaccaccugccccacacucccuguguggguccaaaagucagaacagugaggcagcaucuaauaagaauaaggaugaucuacagagcucuuacauugcuggggcagggcaugggaaggagcaggagggaggaauuacaaaggggcauggggagcuuuuggggugacaggaagcuucauuaucucaauuacggggaugguguuucauggauguauauaacuuaggccaaaacuuaucaauugcuacccuuuaaaaugugagguuuauuguaggucaauuauaccucuauaaggcuguuuuuaaaaugaaacauuucauuuuaaauaauguaaauaauuaaauuauuucaauuuaaauaauuugagagaagugccaaauucucuugaaucuuuuuucuuguuuucuggugccccuguuugguccacaguguuaggaacgcagcccugcuaggcucacgcuuccugccagggccaugccaacuuccaaaaucuccaaagcgagagcuucccaagucuccccugccuucagguucaccugcgcuaacucacagagacuccgagguucuuccuggagaccacagugaaggaaggguucugagccucccacuuccugggcagggcauuuuucucuaaccguccuuuuugccaagaagugcccccuuuuggcugggugugguggcucaugccuguaaucccagcacuuugggaggccgaggcggguggaucaccugaggucaggaguuagagaucagccuggccaacauggugaaaccucaucucuacuaaaacaauacaaaauuagccgggcauggcggugcacgccuguaaucccaacuacucgggaggcugaggcaggagaaucacuugaacccgagagaugaagguugcagugagcugaaaucgcgccauugcacuccaggcacuccagccugggcaaaaagaagcgaaacuccaucuuaaaaaaaaaaaaaaaagaagaagaaagaaagaaaugacuccuuucauuuccaucagcucuugcuuguggcagcuugggagaagggaaaugggguggcuguagccguaaaggcccaggggacgagaagaguuacaugcccauguuccuggcacaggggacgugcuccgagagggacugucaaagccucacuccucuucugcccaggcagcgggcacacaggcagcaucaucuucccuuccucugcucucucuccucugccugaccuggccccuucucccccugcucuuccugggcugguugagaaaccagaguacuugaagggucuggcuggagcaaagcucucuggggaggguccacucaggucccugucacagguagggagcuuugagaauggggcuuuuugaucggucagauuccgcgcccccccucccguuagagguguggucccagcccccugcucuguccccccugccccgccccacggcucccuuuccaaggagggugagaguaguccuggagaaucuccgugggacacuuucuuucacagaugggugugaaggucauaguaucagaaccccaaauuaggacccaaggucucacaaguaugaguagcccaguugggaccacuggccgggcuauuuggcuucagaacugucccagaaagccuaacauuugggggaaaggggcugcagugaaguggagguaaugcugcccacccccacccagagauuaccaaguuuaaacccuccuacccuuggggcccacggucuccagcugcuuguccuccuaaguguucuuaugcaggaaccacuuucugcucccuucagaaacagcccuaugucgucuacgucucucccucgccagcccgggucugccgcuggagaaagcacuuucuuaccaguuccugcacaccgagaagucuccuuccauguucugcucucugcaggcuuucgguugaguuucguuucuugcaggcaa

SEQ ID NO: 16688 - RNA, 3701 nt, Homo sapiens
guuuccgggagacuugaucuuuauuuuguacccagucugguugaggcagauagguaagggguguccugaagggaaggacagagaugccaacaguacccugggcucugccuguccugcuucguggggcccagggccuaggcagaggcucugcacucuuuccacuguccuccugaaagcuggaucugaacucagugcuagccccaggcccuacugcuuuuucguuauuacccugauuuucuuagcugauaaaauagcuagagauuccauccggugugggugaucugaagaaugauuguuagcucuggaugccagaacucaagucuagguaacuuaaaaggccagagguuggggccugagccagcagugagcacauaauaaauccuuuuuuuuuuuuuuuuuuuuagacaggguuucccucuuguugcccaggugggguugcaauggugcgaucuugguucacugcaaccuccaccucucggguucaagugauucuccugccucagccucccaaguagcugggauuacaggugcccgccaccaugcccagcuaauuuuuuguauuuuuaguagagacgggguuucgccauguugcccaagcuggucucgaacuccuagccucaggugauccaccugccuuggccucccaaagugcugggauuacaggcaugagccaccgcacccagcuauuuuuuuauuauuauuauuauuauuuuaaagacagguucucacucuguuguccaggcuggagugcaguggugugauccuagcucucugcagccuugaacuccugagcucaagcgagcuuccugccucagccucccaagcagcugggacaacaggcaugugccaccgccccuggcaaauuuuuaaauuuuuaguacagaugagaucuugcuuuguugucuaggcuaguuucaaacuccuggccucgagguaucuuccugccuugaccacccaaagugcugagauuacaggugugaggcaccacacccugcgggugcacacuccauugcugcugugucugcucugcuccugcccccaugcuucagauaacucugccuucugccagacccacccccauccuguuagaaccccuggaaggggcagcaggcaugggggacacuggagacaugggcgugcucugugugggcugccaccuggagcagggucccuuggccacaagugcugggaugcucuguugguucuugcugacccugaugcuggugcugggccuggguagggggccuugcugccagaugccugaguagggugugagucauggcccuggccacaucaggggucccugaagccacaagccccaacacaucagccucugugucauccaggcugccacggaggaugagggggcaggcccaggcacuagugguagacuuggccaccagguugcugagcagaaccccagugcuuggggacaggugugcagagccaaaggagcaguugagcgaggaggugagaaggagcacagagccgcugcuguccacggcggccagggcacugcucucggggcucacagcagucugcaggaacggugggcaggggucagggaugggcgccccggagcgcagggcugccuccaacagugccagcaguucugggccagcugagggacuggggguggugaacaggaugcccuggggcacagguagcugcucugcugguuccaaagugggccugggcacagccgagggcaccuccacccccaggucucccgccaguagacucaguagagcauccccagcaaggucugaggugggagcgagggcugcgcugcgaagcacagcugccaguuguggguugguggcucgggccccagcgcccaggggugucccaucagcauggcaaaguaguggacagaggccuucugugccccgagccaccagagcccuugccagggguguguccaccaggaagcccuccugagccagcgugguggggcccacuagcaggcguggccagggcaggcggccgaagcgugcaugcagcaggugcagggugggcagagccgcgggcagccccaggccgggggccagggucugugcugggccugaugucagggccguggaauugccugaggagcuaucguggaagaggccccaaaacauggcaccugcaggagacagaggggucccucagcagccgcaggucaagggucacugacuuguuucagucaagaucccuugacugagccugggaucaggaguuacugaccaggccugaggucaaaguuccacagacccgggcucaagggucauagccugggguuggacugcugcccaaacccuaaguccugcucacuuagcagucuugaggucagugcuacugacucccuaaguuccaggucacugaucaggcuguggguugggguugcagucuggggucaggggucacugaccuagccccguggcaugaggaugcaccacugccaggcacaaugcagcuccaacuccagcauccacgacguugcccccggcaacaagcagcucucggccuaggugggagcauguggcugcagcaaggaaggcacugucaugcagcaaggaggggggcuaggcugggcuggugaccccugacccuccccuccccaagccgcccccagcacugacugaccugcagggcugaugauggcaccguggugguauacgccagggccgugggaguguccgccggguggaggggccacagagcccaagcuuccugucgaccugcccugauucuggagcugccucacagccagggagcagccaacagccagcagcagcagggcugccacuacacgggcccagguuccgggcagcccgccagccuuguuccugcagaggggggguguccugagccacggcugggacagagggaugcccaaggaccccaagagaccccagggaauauuucccaaaagguuugauuuagcaagaggagcacaagucagccaaggagaaagggcuucuuggcagcgggugcaucuugggcagacauggggaugggaaagcaucuggggaaacugagccuagcuagggagggagccucuggaggggagauugguggggcagaguccacucaggugggagggaggcccagugggguguggcaggcaggagagaaggggcuggggagcaggcccagccaggcguagucaggccccaaccugcccagcaggugccuccugcaccaggacuugggggcuggggaccuuugacaaagcagcagaugggacagaggcuggcuugguacaaaugucccuccagaugcacagacuuuugauugggucaggccaagucucgggcuacagccuggguuuucccccaaauugaccguacagugccuggagcuaaacccagcggggagucgccuggucccccugaggggcuccagagagagggacuugccaaccucaagccuggggagccuggugcccagaccccucccuuacuuaccuggaagaguccuggugccuccggggguuuagaaccagcgccucugaugucuccuccuccuccacuuccuccuccgacuccaagcuuggcucccagggcagcagcuucugauagaccacgggcucuucugcccgcuccauggccccccagugcucgccccagcccuccugccugccagccuuuccggcugugucucagaggcccugcccaagccuggcaggugggagguggcagcgaccuuggggaagg

SEQ ID NO: 16689 - RNA, 18252 nt, Homo sapiens
agcuccccuuuccuuccuuucaagggcuggguggggccucgcauagaucagggccaggacuggccaggaacuccucacucuguccggacuucuguucucccaaauccuccuggauguaccagggccugacuccuuggcccuucccucugggaguuauagcuucccagcagcacgagacccagggucacagcugcagguccaggagaaggcuugcgucuccaaacagcaagaaaagggaaggagggagggcagccuuggcacaggccccacuaagccccacugcugaccugacaccccuuuccccaggugccauugggacaaugaagaacccacacucccaccucgucugggagguguccuacagcguccgggaccggcugggcugccccaaagcuuucugugugauccacggcuaggcacccacccucucuggcccaggccugcugaguggcccuggcaucaagaagaggcuguguccucaguuacccuggaaggauguguguguuggagccacacgguuggacagguucccagcccuagguuugggccgcagggccccuggggccaaggaagaagacagccccaaguggguguccggggagagccuggccugccaccagcuuaugugaucuugggcaagucccugcccucccuggaacgaagggccagggggcuggacuuucccacacaacuugcugggcaaagcacgaucugcagcuuugaagacucaacagacccuggaccauacggagagcagguggcccaggccucagggcggcagucccggcuuugaggcucacgcgagggccugguaugcagggaccacugcucagcugggccucggaccuuggggauauuggacgcaaccuggcaaaugaagcugggcgcccaagucucuggguacucccuggaggacacugucucacugucucggguuggcucccagccuggaggucccagauggggacuguucugacaagcuggcaucaccaggggugaaggcccuggcugcagcuguacaccaccugugcccccaggcucaaggucucuggcaggugcacaccagcccaacucugcagggcuucucucccugccaccaccccccaagccaggaccccacuccuuccccgaggcugagcugagccuuuuccaggggcagggcccaggagaccauucccagaauccauggggcaguagccagggcuccggcugcuggaggaagcagcuauccacaaagcuuccugccccagagcugaggcugaggccccgggagaggcggccccuacccaaacacuggcugcuggcauuccaccaagugaccccaggggggggccaggccuucgaucacccaccucccauccaugcacacaccaggaugcagcugccaacuucacaccagccccaacccgcuuugggggagcuuagcccccugcgucacccacucccugcacuucugcugcaaucaaggugguucuggugcgggggugggguggggggugaggccuuguggccaaugggggaccccccaagagccagcuuggacaaugcucuucuugccccuuaguuacuggcuggcuguggcuucagugguguguaagcagguggaauacucacccaccaagcucugggguaccccgagggccugacaagaggaugggguggggguggcauccuccaaagaccagccuccacccccacuccagccucagcggggccccagcgauguuuucuuguuguacaagaaccagguccgaguguugccuccucuuccuuccggaagccaaacugcuccuuuauuuuuuagagcugcugauugugaaucucagagucuuaagagagaagccaaauauauuccucuuguaaaugaagaaauaaaccuauuuaaaucacccccugguggcucccucacagcaaaaaagccugggggcaaagagguggcaggcacgagagauggucacaccugccugcagccagcacaucaaccugcaccaacccaggcaaacaccagagcccuggacauggcccuggagccagggucccagcccagaaccggggguggggaggucucugcacccugggaccccugcaggaauggcucaggcugugcuugccagagcaggaugcccgggcaggcggcaacagccacccuccccaguggcagcgccuuagaaacagcuugcguauuaaaaucaugguuuaaaaaaaaaaaaaaaaaauaggcgucucaggcagauggaggcaggggcugaggggggcccguaccugugcucagggcuucccugccuuccucaccugugcuuucuucuuggccccacucugaagcaggcugggacuccugaugaccaaagacagccuugccuuuuuccgugccagcgcggacaguggugauuugcccaagacccccuuuuugggaagagccuucugaugcugcuuuuggccugcagguuccgugggggacccgggagcuccauucaccugggacggcuucugguuuuucuucugcaguuuuggggauuuggcaggggugcuggggcuccgggugggggcgccaggggcuggacucuuggugguuggcgucccguuugccugggcugggaccuuagccuuuguccuguuccucuucuuccugcccaugcuggggggcuggcucccgccgguggcugcaggugugccauccuccgcuggcgugccauccucugacuugcguuucuugcgcuucuucgucucuggcaagaaucccuuuuucuuccgcuucuuacugauggggcucuggguggcacuggggaucuccuuggcauccuucuucuccaacuuggggcgccugaagggaagugagcaagguuagaaggugcccaucgagggcagcagccaccgccaccgcgacugcuaccuccaccuggauucugaggguccucugaggccccuagguucugugaggccccuaugagggucccgugaggguccuaugaggguccugcgaggccccuggguccugcgaggguccugcgaggcuccugcgaggguccugugaggguccuacagcucccacaucugagaaugcgcuugagugcaugugugugcagcagcaugcgugugcagugugcgugugcagcagcgugugugcagcgugugugugugugcagcagcgugaggguguucccagccccuacccaaggugugugucccccucccagaaccuacuggacucccaggguuuucauggccugccaguagaggucgugcaggcggcuggagccgguggagugugcccccugcuguaggcucugcuguugccccugcagcacacccaggagcaccgucagguccaaggucagcuucugcagagggugggaaggcagagcuguggggccacagagggcggggccucucgcgggcucccagucuucccaccucugcccuguugcugccucaccagugaccccugccccuuccugggccucagccucuccuucugccuguuaagucauccgugucucuuaccgagggaggaaacacgcgccccagguguugguucuccuccuucccauagccaaaggccuggucucagagucucgguguccuccccuccagcaguggcccgggcccacccaccuccaagagggccacuccccagcacuccaucaccgcggggcugccaaagcgcuuccccacccaacccugccaccuuccugcacauccugaauggguuauuguuggaauccgccagcuuccgggagcccugcucuccuggcuuccucacuaucagccaguuuuguaaggccccgucccgggccccgccucugccugccagcacccccuuggcaagcucucccuccacaagggcugacuagcaccuaugcugaagauucccaaaccccgcccucugggccagaccgggggacccagauggccaccuccagcugccucccagcccugcccugauggcugcccacacuccuguaccaggccuggaaaccuggcugcucacccugaaucuucuccaacccuuccacagucuccagcccugccagccccuucucggcuuucucacgggauguggcagugccaccccacccccucucaccccgcccugcaggaggaggacaggguggcacagucccuucccaagucacucacccauccaugguuugguaacugcccaaauggcagcccagagcccuggcccaggcacugagaaguuuccccacaugacccccaucccugcaguccagcccgggcauggcacugcuggccgggaggccccaaggcccccaagaggaacccgaacacgaccgcggacugggcccccgccucaccucauguuugcagguccugaagagaacguugagcagcuccagggaggacagugccugcugaugcugcgccuuggucugcgccucccccagcacgcgcaaguucuagggaaggguggccaggcugaggcacuccggagagcugcucaaagccuuucuguuucccagccggaaguaaagcccagaggcagggaccgucuccugggacaaccccaguucucccgacucuggacucaggcuccaauccucacuucuuucccagagaucggucucccggagaacugauucugaggggguggggaaagggcgccccccggcuguuaccucggugaccuuugcuaggaccuggcccaucagcugcuuccacucgggguccucaaagcacgaccucaccucccgcauggacagggucuucuggagcagcaggcaggccugugggugggcaaagguggguggcaggagccuuggcacguugggugcucacggcucagggaugcaugagggcucgggggcccgcugggcacugcugugggcagcgugugaggcugccugcugcucugggcucugugacuaccugcuccugugccuuugugugcagguggggacaccaaggccucccagcuggauagaggugggaccucagguugggacaauuccugcccauuauuggcuuagugccaucuuccuccagccugcccccaacagcccuggcaccagagcagacacuaccaggggcauccuguguguggccagaugggcagcaguggcugcgggagugaggcuggcccugcccccucagcuccuguguguucacuguguggcaggggccagggcacggccacccccuucagagaccauguacccacagccaagccaguggggcagggacagcugugcccgugcucaccaggacagcgcucuggggccucacaauauccagucagaagaggguuaagcggguuaauucagacaggcccugggcugggagcugggaagucucucaccugaugacggggccgcaccgggcccgugauaugcuggaccaggauggggagcaggcucugacagagcaccugguggggagugacaagggcugugaggugcaggcugggcugagcagggaccaugaggaagcagggcaggccccaacacucaccgggugccgggagaagaggcugaggaacaugggaacugugagggggcuguugcgcuuggucaggaaggagcucagugcugucgaguacacccgggucaccagguucaaguccaagcagcuggcagccuaggccaggggagagcgagcugggugaggccaggagaggggucccugggaugggagcagagccuggccuaccuucaucagaaggcugaggguugggcccuggggaagucccggccuccacucccuggcugugaaaugccuggggcugcuccugggccaggcccugcucaccugcgggcccgugggcauguggcuggggucagugccagcuuucugcuucuccugugucucaugcacgcagcccucagcaguguugcccuucaagacccggagcagguagagagaggcguugaagugguagagggcggugggggagucgggcuggcggccagccugcugcaccaaccgcuccaccugggcgugcagggccccugcgcgcucacccaagucguggcaguagcgccgggcacggcacagguggugccuguggguggugaggacgagagcuggucagaacauucucgguccacccugcuccgccaagcagagccaacccaagucccacuuuauaaguggggaaacagaccuagaagacgacagaggcgacccaggccacagaggagggcccagggccgccugcaggcugccuggaagcugugugggcucagagugcuggggugacaggggcgcuccaggggagaacagaacagcucccugaguggaggcugcaccaagggccaacugccugccuggggcaccccuccugucuacacuugucucucauggggcaguggccuucaggccuuuuguaaagcgagacaaggguucaugugcuuagaacccucuguggcccugcagggccggggauauaaugggggcaagaggcaggaugcucaacaaacgacacuguccacgcacgcuggcagaacuaucugagaaggcguggcccgggcgggccuggguuugugaagaaugcacugccagucacacuccccaccccuccugacuauccacgcagcgccccagcucccaggccuucaccuccccagcaccugagcucugaaggcaggucuaccaggugccugccugucucucccacgccugccaccgccucccuccugggcccucugccuccagcacagccccucccaaacccuucuccacgcugccagccguuucugaaaaggcaaaccagacucagacccuuccccacgccacugcucuugcugauaaugccucuguggccuccagcaccgcuagggucagggccugcgagggugcgggggucuguggccucgcugcuugccugaccuuccagcugcgugucugaccagcucccgucaggaugcucuuccucccuuucugcccugcccaaggccucccagccugacaaacucccaugcacacuacaccuccgaggacuggguuggguguccccugccacaggugcacccacugucccccuccaccccagcacagccccacuugagacugucaagggcagggauggaccccagcuccagggcacuguuggcacagccccacuugagacugucaagggcagggauggaccccagcuccagggcacuguuggcacugugucgggagaacgcggggaugaagcaaggacugugggaaucacuaagugacgugugccucuagggcugagcagugagccugcgagcuaggggcccaggcuggaagcuuggcucucuccuuccugugcagacagcaagccuagagcucuggcucuccugcgccugggggcugccggccacaccugcccgcccugcacccccgugcucacgugaagaugcgcgccgucuugugcagaagguccugcuccuguuuggagcugcugcugcgcaggcugcgccggaugaugcucagcagcggcuccagcagcuccaggaccagggcauucucgggcugcuuggucacuagcaccuccaccagguccagcaccugcagccaggagggcaggucagcaacacgggggugggcgcacagggaggcgggggugggcgcacagggaggcgggggugggugcggcccgcccccaggcucacccggaucuggaagucgcgccgcagagccuucuccuucugcagcuuguucuucucgucucgccgggccuggauacgcagcuucugcucggcaaagaggcuggcgaggcucugguccagggccaucauggccucaucccccagcuccuccucguucucacuguccucuccacccugagggacagaggcccagcggucagccaggccucgggcaggcacacaacauggggacacccgagcccuccccggccgccccccccuccaccucccccacucaccagcgccuucccagccugcagcacggucaucagcuguucccggaagcccugauccacguccccgucgcgcuccuccuccucgcucuccucccccucgcucuccucuucacucucugagcuucuguuguccucaccuuccucgcucuuguccugugugguagaggcaggcgcgucacacaccuccccgaucgucccacuccccaccgcccccgcccggcccaugcuggcaacaccucugcacccuucagccgccgcucaucagaaucguccgucaccaccacacggucauucucauccucacuggucucgggguucagcaccuggggaggggugccagccacugacccauuugcagcccccgcccuccucuccaggccccacucagccuugaccaaagaccuccauuucccagaagaaaacggagccuaggagaggcggccaggccaggccaaggccucguugagaccccucccaccggccgcaggcucccggcagggaggcuggaggcugaagcggcaccccuggugcagcucgcugcucagugagccccagcccacauuccacucccaaaggucccaacucacauccagaauuagcugcagggcacgcggggucaggugggagcagauguggccaaacacgcuccgggccaccuggcgcaugagguggcugggcugggccaacagggccagcaagaucuccaccagcaccucuacccacggggguuccugggggucugcaagagggagggguugagcccggauaggggaccgcuggccccaccccaccacucuagucccucucgugaccaaggacccaccgauggucuuggugcggcuccggcggggcuucucucccagacuuuuccugaugcaggucuggaugucacccagcaggucacagcucucugcaggggacugcgggcaggguaggacacacacuggggccaggcccuguccccagcccuucuaaaccaggcaaggggcuggccaaauggcagcaguggcaucaagaagccuccaacacccagccacuggcccgcccuggccagucacccccacaauccagaacagaagaccccagcuggacaccccaagagcugagggcuuuugagauggagucucgcucuauugcccaggcuggaguacaguggucugaucucggcucaccacaacuucugccucccagguucaagccauucuccugccucagccucccaaguagcugggauugcaggcguguaccaccaugcccggcuaauuuuuguauuuugaguagagacgggguuucaccauguuggccaggcuggucuugaacuccugaccucgugauccacccccuugccccccuuggccucccaaagugcugggauugcaggugugagcccccgcgcccagcuagcugacggcuuuuucacaccuaauacgcaguuacaggauccaaaagccugaaggggacaaggaguccaacucccccuuggacacucaagaaaggcagaaccugacaaggauggucagggucccagagaagccagcaagccccagcccccaauucauaauucuagauuauucccuccaugcuuggcuuggcaugagagacagaauugaaagucauuaguuuuaacuaauuuaauuacauugaacucaucugacuggggauaaccccagacucgagugagguggcguggugugcgcaugugcgugugcaggagcucuugaaaacugugugaucuuugguaccuaaaaagcagacuuuccccucauaaugcagucggcagcuugaacguuuaggccagggugggacaaagcagcccaaagcccuugucauugcucuccggcucccaggcugugugcccaagcagguccccguccuccucugggcugcaccuuuuuuuuuuuuuuucuaagacagaaucuuguucuguugcccaggcuggaguacaguggugucaucucaacucacugcaaccuccgccucccagguuuaagcaauucuccugcuucacccuccugaguagcugggauuacaggcaccugccaccacaccuggcuaauuuuuguauuuuaguagagaagggguuucacucuguuggccaggcuggucuugaacuccugaccucgugaucaccugccuuggucuccggaaguacugggauuacaggugcgagccccgagccuggccagggcugcaccuuuuaucuaaggcucugacacagcaaacugcagccuccucuguccaagucaaguucggagaucccaaggcugggggcaggcuccacauguguccuggaaucaccaggacucugcugcuaucaaaggccugacgucaagaauuggaaggggcaucguggccaaccuuuccccaaacagcucauccacaugcugggcucagaauaaccaaagcuggcaaguaaggcaaccacagucaaguggccagacgggagcaagcaagagacccaccuacucaggcuacagaagaccuaaagcagccccaauaagagcagcuuaugucaugagaagaaaacucaaaagaaaucaggguacugagccucgaauguggucagggcuucuugaugggaagaaccgagcgggagagcccguugccagaagguguucccacagcaggggguacagugcaagcuccuuugccucugagucuuaguuucuccaugucaaacauggagagggggugucugccucaaagcuguggggauuacgagauccugcauggaaagccuaggacaccagcuggugccgcuaaguggccggagggauguuuccaccugugacaaaguuggcuucaaaaaccucccaacuuaacucccccagaaccuuuccuggaaacccgcacagcccucaaaagccucucgguagggggcccauugugccauagaaccccaggcucacagccccucccucccaggccccaguaccuugaggagguggaugcccacgaggagcagaaggugcuggaaggcagcagcccuggccucugcggagugggccuccagcuccuucagagucugcagcauccugcggggagacaggcgauucccaggccccugcaccagucagacugcagcguccugcccacccccuggaaaucccacgugcucaccggucccaggccuggcgcugcugcgcagugaagggugucacgguggucacguuguggcugugauucaacaggaggucugcgaacugcaccaggugguagguccagggcugcccacccugggucuggcccggugccugcuugaacugcgugcugagggucugcaacagacugggcaagggauggggcuuggggucagcagaccagaugagucaauguagccgccucccuccgcccuccccagggcucggucucccgccucuccaggaccuacuagaacuccgggggccucugccguuguucccagcuuaggggaccuggagggagcaggcgcccucaaggccuucccaccuucggaccucuccugggcugcccaagacucaccugaagaaggcacugcugacagccucucgggccugguuuuccaaagggaaggagaacgggugcuuugucucagggaucugggaugugggcuucuuugugacaaagaacgaguggaacaaacaaaaccuggggagggugggagaguggccauagccauucacugccauugguuuuuacaggcuccccuccuuggaugguaccaccgaggguacaaggccaggaggaggaggagccgcccuucugcccuggguacaguccucgggggccugacgggcaaggcuggagggggcugggcugggcuaggaugggaaggggccguuucucugcucuggauccccagcugaacgcggguuaacccgagcuagagagagucagugccccucucaaggaaccaacagaugggaggcuguguggucauggccaagucaggucacugcuccugcgaacaugggacagcccccucuugcaaccgugcauguugagggugacgugagcacccagcucugcacuggcacagacgaggcagguguggggcagaaggcuucccugacaccucccacgugcaaaagcugccugcagggcgcgcagagcacaccugaaccuuuuaggccccugcagcuggggugccuccugggccccuucccuucacggguuccugaggaauucccaaguccccuugugccugccccccacugaugacucaacccaaaggcuucuggcuccaggggaugcaaacuaggacgaguuaaggggccccauuccuuggccacacgcccaugggaagcugggaauccagcacagcucgcaccuggccaccugcucagucaaggccuccuccaucuccaggugcaggcuguccacaaugcucaccaaucgaaagaugauccauuuccucagccggaacacagcucgcucaggccuagcggggcaggaggcgaggucaugugagccacuuauaacuggcagaaacaggcugggcccaguggcucacaccuguaaucccagcacuuugggaggccaaggcuggccaaucacucgaggucaggaguucgagaccagccugaccaacacggugaaaccccaucuccauuaaaaauacaaaaauuagcugggugugguggcgggugccuguagucccagcuacuggagaggcugaggcagagaaucacuugauugcuugaacccgggaggcagaaguugcaaugagcugagaucacacgccacugcacuccagcuuaggccacagagagugagacucugucaaaaaaaaaaaaaaaaaaaaaaaagaaccagcaaaaacaggacauuccuuugccugaucucagagacaacacuccaagaucuccccaucccgaucgccaguguggggacacacaaguaaacugaggccucauaugagagcuaaggcucuucccccucgcuccucucaugguuuagagccaggacgcuguggagggcgggcuugggucgcggggcucugcaggccuaggaaguuaacuccuaaauuagguguccucccccaagguccacucacauguggagcgaugaauccugggcuuucuucugguuguuggugcugaagucaaccaaggaguccaggucuggcuggagaaacauggcccgcagccaggccacauagcccugcagggccggagggcucaggaaccgcacgacccgccagaaaguaggcgugacagggaggccuugguuggugacagaugagaaggccacuagcacggccagcugccgcucagggucauccuggcaccccucuaggaaggugcccacguaaucguccaucucuggggcaaacuugaacugcuuugggagcugcaagaguuaggcauggcgcugagcccaccagcccaggggggcaggcgguuaacaacccaacagccaagggggcaggcgggcaacagcccaacagcccaacagcccgggggcaggcgggcaacagcccaccaggcuugugcccacuacagguuaaaucgagccccggcaaucuccuguuguacacagcuaggcugugccugaacuugcaacaguccagucaccccagugcuuuugucuggcgucaaggccucugugggucugacugccccagcuucagcaccuccggccccagaaggccccucuuuccgccuugcuggauggggauggccuguuuuccuggcucaacgcagggcagagugguaguuaggaggcgagacugaccuggguucaaagcccacgcugccaauuccuagccgugucaucuucgggaccaaaaacaaccaccucucacgcgcuuacucagugccagcacccgcgcuccgccuuuuugggcggcagcuuagcauuuuuagcaacucuuugcgguuggccaauauugucauugcacaggugaguacagugagacacaaaaacaccuagagguaacuucucagggucagaggcucccagugggauaguguccggcuucacagcccaagcuguuuuccuuucaauuuuuuagacuugugccccuggcauguagugccaugaucauggcucacugcagccucaaaauucuggguucaagggauccucccaccucagccucccgaguaacugggacuacaggugugcaccaccauccaacccaagcucuuaaccacugccugauacuucaagucucccccucacccagaaugacagcucucugaaacucacugcaaagauaaaaugagcuggugagaacagucaacccagcagcacuuacugggcaccaggcucacuggugcccaaacauggucaugacgacuguucucaucacugccacaugggcgggggcggagagaggucugaacagcccgcuggcuauccaugcccacaagggggccugcuggcagaagggccugacuuuaucaaaacugucagagggaagccagguacaguggcucacgucuguaaucccagcacucugggaggccaaggcggguggaucaccuaaggucaggaguucgagaccagccuggccaacauggcaaaaucccgucucuaccaaaaauacaaaaauuagcugggcgugguauugggcgccuguaaucccagcuacucaggaggcugaggcaggagaaucgcuugaaccugggaggcggagguugcagugagccaagaucucaccacugcgcuccagccugggcgacaagagcaaaacuucaucucaaaaaaaaaaaauuuguccgagggaaagggguucaggcagcucacuacccagacggaggggacacccauagcucuagccaagcccccgaggugcccugcuccccuuuuuggcagggagagcuccacgucuagccuuucuggcagugucgagcugcacgggcauuacccaccuuagcagugcacacgugcuccccguaauggcggaucacgucucccugcaucaccaggugcagcugcuccuuggucagcaggggcagggccgcgcccagcaggcggaaacacagguagcuaaagggggugcaggacagagccuggucagagcccuuggugccccuggugggaaccucaggacuaguggccuagcccacuucacggacagggaagggggccgagagaggacacgcgucgcccgcaccuggcuggccagaacugcaucuucagcagcccuuguuccaccaccuccuuccagaaccgugggaacuugucuuccuugagugccaggcggagcagguccagagcaauggcgggcagcuugcgguccuucuucacagaggaggcggccaucuucagcacauucaccagccugcggagggcaagggacucagggaacacuugccucacaggcaagggccagggugacaagagcagccgggacacccccaggccaaacgacaaaucugggccuggccagaugcagucccuuggccccagggagggcaaauccgcccaccuccaucacaccuggggacauucucaucugagaauagguucacggaucccaccagcuucuugagcuuggagggcaccuucugcugggccaggaggaagagcucuagcuguucaggggagcugaguauuauauucaagucggcuuugaggaccuccggcaggaucuccugcaauguggccuucgagaccuaaggauggagggagaagaaaucgugacuuccucugcggggugagccugguggauccuguucuaccugcuccugacacggggccaccuggugagguaucagagucaucagaggccaguugcuaacaaaacucaaauucccaggcagcgggguuuuugacaagcaucccacugacgcuaacuggccccuggagguaccugccccccaccccuuauuuuuuuuuuuuaagacagagucucacuuugccacccaggcugaguauaguggugugaucuuggcucacugcaaccuccgccucccagguugaagcaauucuccugccucaggugggauuaaaggugugcgccaucacacccagcuaauuuuuguauuuuuaguagagaugggguuucaccauguuggccaggcuggucuugaacuccugaccucaagugaucugcccaccucggccucccaaaguucugggauuacaggcgugagccaccaugcccggucaaagcuacccuuuuaauuauuccuuuuuuugguauuucagaguacuagcucauuucauacacgaggagcccuagguggagagcugggauucgaauucagguccuucuggcucugaggucaagacugcacaguaagcccuggccuggagaccugcuaccccugccuuucucuucggugacaaaagggccuagggugcuaccuucccaaguagggcaguggaggcccacaaggggccagccuugaccaggauaacaauggcaaacguuuuauauacuugccacgugccaggcacaguuccagagcugcacugcccaauacgguagccacagccacacagggcugcugagcgccugaaagguggcuaaucugaacaggggugugccuaaguguaacauacacacuggauuuuggagacaccugacaaaaagaguguaagauaucucaacacuuuuuuauaccaaugcacacugaaauaauauuuuagauauaccagauaaagucaaaugucacuaaauguuacuaaaugacaccuguuucuuuuuaccuuuucaacaaagucacugaaacgcuucaaauuauacaucuuuguauuucuauggaacagugcuguuccagauucucauccgagcccccuugaugucucuguaacaaaguguugccugggcccgcacagcuggggagcucauaccucggagaggauguccaccagggccuuccggggcugcuccugcaagugguuuugguacugggccagggccugcagcagcuucaccgacuucaucagugccuccugguccugguccccacagagggacagaggguaugagcagggcacacgacugucccccacccaucccaagccagccuacauucccccagucccuccaaagcucuuaccuucaccagccgaccugacugaaagagggcgagcacuccaaacagguuugcaaagagagcaggucucagcauugccuagaaaaggauuccaggcacaggcaugaggggcccuggaacuccccauuccccaagccucccaccccuggggcugcugaccucccuggccccacucucaccuucuucaccugaugcaggucauauuuuucuuguaucugcugcaggaugcugcacaaggggaggucuucaaaagacuguaacagcugccaggaguuguguggcaggaggaagaggguucaggagaguggcccaacuacgucuucacaaaccuuaaccucccuucccccuucaacuucucccaagaagccucaggucccuagucccaccuucuauguaccuucuauggccccuagauuacuagucugaaaugcucagccacugggucuucucuccgcacguggucugagcuccccucaggcugauccugcaggccugggucuuuauugcucugccccuugucaaggcgccucagagaguggucuacuccaaucagcugaaugccucugcaggccuaagggagcccacccagcgcucacugcucccagaaaguguaccuaagaggccgggcaacccaagcaccaaauagaaaaccuggccaggccuugcucacaccuucuccacuuucaugaagaggccucccucagguuggccuccagucugcucugccacucccgaccucucucucgggcugccccuccgccacagcugagacaccacacccgcccuccucauaccccaccauuuugaccuggauggcugggacccugccaggagcaccaccucaccugugccagggccaaacuguagcagggccgggcuguuucucgcccgaccccgagucccgugauuagacgcuucagggcauauuucaucucggaccccugcggaaccaagcacacccucguguucaauggugacaacaaggugcacgcccccgcgcacccuggcauccagguucgcgaccacgugcccccagucucaacucccugggcccgccgccgcuuccuugccgggauaugcgcagccucugccccagaccccgccacuccaccuucggccugccacgcagauacuccagcagcuucuccguggccgcaagucgcgucuccugcucaggcuucgcaaugucccagaagaaguccaagaacucgcgacugugcuucaauaggccauagcggucggcaggccgggcgccacucugcgucgcuucuccaggcgacaucggcugggcgggaucccggcucuccaucuccgccacacucaccgaaacacgaaacacgugugcuccggccccagccgcuuccaggucagggcacggcgcau

SEQ ID NO: 16690 - RNA, 947 nt, Homo sapiens
caugaugggacaaaaucaaaccagcaucucagacuuccugcuccugggccugcccauccaaccagagcagcaaaaccugugcuaugcccuguucuuggccauguaucuuaccacccuccuggggaaccuccucaucauuguccucauucgacuggacucccaucuccacacgccuauguauuuguuucucagcaacuuguccuucucugaccucugcuucucuuccgugaccauucccaaguuguuacagaacaugcagaaccaggacccauccauccccuaugcggacugccugacccaaauguacuucuuccuguuauuuggagaccuggagagcuuccuccuuguggccauggccuaugaccgcuauguggccaucugcuucccccugcacuacaccgccaucaugagccccaugcucugucucgcccugguggcgcuguccugggugcugaccaccuuccaugccauguuacacacuuuacucauggccagguuguguuuuugugcagacaaugugaucccccacuuuuucugugauaugucugcucugcugaagcuggccuucucugacacucgaguuaaugaaugggugauauuuaucaugggagggcucauucuugucaucccauuccuacucauccuuggguccuaugcaagaauugucuccuccauccucaaggucccuucuucuaaggguaucugcaaggccuucucuacuuguggcucccaccugucuguggugucacuguucuauggaaccguuauuggucucuacuuaugcucaucagcuaauaguucuacucuaaaggacacugucauggcuaugauguacacuguggugacccccaugcugaaccccuucaucuacagccugaggaacagagacaugaagggagcccugagcagagucauucaucagaagaaaacuuucuucucucucugau

SEQ ID NO: 16691 - RNA, 999 nt, Homo sapiens
ggagggaccccauuaccucucaggucagugaucuccuccccaaaaauauuugccacagagcacccugaacaucaggguuucugaggcuguagauaagaggguucagcauaggguugauaacaguguugaaaacuccaaccccuuuauccuugucugaagccuccucugaacccagucucauguaguugaagauaccucuuccaaagaaaagacaaaccacggugaggugggagccacacguggagaaggccuucuuucggcccuccacugaacggauucguagaacugcagcugccacguggcuguaggcagugaugaugagaaccaaaggugugccugccaugaugaaacccacagcaaagagcagcagcucauugaguugggugcuggagcaggagagcuggaagagcugugggaggucacaguagaagugauugaccucauuggggccacagaaguugagcguggacauggccacagugugggucagugcguuggugaaggcacaagccaaggacgcagccaccaacauccucuggacugucugacucaugcgggugcuguaggugaggggcuggcagauggccaggagucggucauaggccauggcggucagcaggaagcaguccaucccagccagaagguggaagaagaagagcugggagaggcaggcgucauaggaaauuguggacuugugggacaagagacgacccaacauugcaggaacagugacagugauacauccgacauccagcacugacagguuccccaggaagaaguacaugggggcguggaguuugggcuccaccaagacggcugccaggaugcugagguugcccccaguugugaccagauaggcaaagaggaggagcacaaagacaacuggcugcaucucuucuguuugcacuaggcccaguagaaugaacucagcaacagcgguccuauuggucccagcuucuggcuccaugaguuucuguaaggacaugucccagcagggga

SEQ ID NO: 16692 - RNA, 15340 nt, Homo sapiens
cguuccacagcaguuucucuuugacugcguccucugcgcugcccaugguguggcaggaggcggcgccgagcgguccucagagcccccgcgcccucgccgccuccgcgccucucggcucagcgccccacgcgcaaggcggagcccccgcccgccgcgcucccggcccgccgccgccgccgccgccgcagccacugcccggugcucggcuccgcagccaucuuccgagccccgcacagacgucaggcggcaggcccggccccuucccacagccggagggggguugcgcacagcgacgggggaucggggcggggagaggccgugcgcgccuaggggcggcagacccgggcgcgcgccacgggggucgcugucauggcaacgcacccgcucccgcauggagggcgcgaagccgcauugugagcgcuggcccuggagcccgcggccccgcggcugagagcgagccucggucccgcugaagcuccccugacuucugccugcucccucucccgacgggacggaaagggccggggcucgggcaugggguccccugcgguccgagccugcccacggcgaagccggugcagccuggccccgugaccccucugaauccccguccggccgucgccgugcaguugucaaguuucugggaagauuagugggagcgcagccgcccgagcccgacggccggagggucgcggccagucccccuugccgggucgccacgucccacaagguccuucccggccgcuccgugggaggcggggcgcagguuggaguaacagggacgggcuugagcugguacggaaccgggcaaggugagagaagugucuuccacgcgauucccaagccucgcuagggaaucgagggagaagaaagguugcucagagugauaaagaacaugccguugcaaacggaagagcaacgugcccgaaucuaggugacaggaagggcuuaggccuuuucggcacgaauggagccuuccagucaacaugcuucuacgugaugcagcuuuauagcgcaaaaaaaugacaaugcaagggguacaaacagcccugcuagaccaacagcccgagccucgacagucuacauccggcgccuucaagcccccaaccacacacugcgaagugggaaaaguucccagcgcggcuuggcgaacccgcuaacacggcgcucucacgagcugcuggaaaagaccuucgcgagagggcgcagggagucccgcucccuggagggcccgcccccuuggaggggaccggaagcgcuuguccuggcccggaagcagugcugacuccguacacgcgcgcugcggcauggcggcccaccgccccggcccgcucaagcagcagaauaaagcucauaaaggcggacggcaucggggucggggaucugcacagcgggacggcaaggguaaggagauaacguagaaggaauaagggcuauuuggccguuauuaacucuuuuuccucaugcccagacugagcuucugucucccgucugggcuccacgcgaaaggcccuuucuaaggugggcggagaggagucccuuuucuugaccuuguggggccgaucacaccagccccuucuaaucugccauucaggccgucuggcacugaaaacccuaagcaagaaggugagaaaagaacucagcagagucgaccagaggcaucgcgccagccagcuccgaaagcagaagaaggaggcggugagaggagcgggauuugggagaaugcggcuucucugguguucuagguggcuaaugccucgaaguggaaaaugagaccgggaggaggguccagggacagagcauagcccuagagcacgugucgagcgugcaggucuagcauucuuugcuuuggucagaauuccugccaccccgcuggcauaccuguggucuuuuacuagagagaugcugguuuuggguagggggagcaucugugggaguggaaaugcaaugcuggagugaaguacugagacacugagauguucucggauaucuuucuauuuucagguucuggcagagaagagacagcuggguggcaaggauggcccuccucaucagguacugguggugccccugcacagcagaauuucccugccagaggccaugcagcugcuucaagauagggacacuggaacaguacacuugaaugaauugggaaacacccagaacuuuaugcugcugugcccccgcuugaaacaucggugguuuuucaccucagcaaggccagguuagaguauacaccaauauuuuguauuauguuugaguagugguauuuuuuuuuuuuuuuuuuagaauaaugugcuggugccaaccaccucuucuuacugugucuucuaucugcaggggaucugcacguuguguuagacauggcuaaaguagcugauaccauccuguuccuccuugauccacuagaaggcugggacagcaccggugauuacugucuuuccugccucuuugcucagggccuuccgaccuauaguaagugaguuagcauuuauugugcaccuuuaauuugucaggcacuaugccugguauuugauacaggaauacaacugauggaucauauucagcugguggugggauguacacauauggauuaaacuugauccauuguuuacagauuaucacucagggugucuuuuuguuuuuggcuguccuuugcccagagaaacaaggauaugaaguuugauuucacugugaaauuccuucaggguaguucaguguugggcuucccagugaucucugggcuugcaacugagcuauuagguuguuugugaacugcagagggauuuuuauguaaugaagcaguaggucaugaagcguuuucucuuucgcuuacagcacuagcuguccaggggauuucuggccucccacugaagaaacaaauagauaccaggaagaagcuaaguaaagcaguggagaagcgcuuuccgcaugacaaacuccucuuguuagacacucaacaggaggcagggaugcugcuuaggcaguuggcuaaccagaagcaacagcaucuugcuuuucgagaucggcgggccuaccuauuugcccaugcuguugauuuuguuccuagugaagagaauaacuuggugggcaccuugaaaauuucaggcuauguucgagggcagacucugaaugucaauagguugcugcauaucguuggauauggugauuuccagaugaaacagauagaugcccccggagacccuuucccuuuaaauccuagaggaauuaaaccccaaaaggacccagacauggcaauggagguaagacugauauucuuaauucauguucauaugaaaguuggcacaggaaggaaacuuaaauucagagaagauagucuguacacuuaggugaaugaggagacugcuagucugaaguaaggcaauagucaguuauaaauagguugauaaaucacauauuuauccagcacuuucuagguagucugcacugugauuggcucugaguuuauagaacacacucaagaugugguugcuuuccucaagggacuuaauugggcuggaacaaaauggcaugugugaaauaaagauugagauagcauaugguuagagugcggaccagcaguggaaguugagaaaguagacuagcaagcuucacauaagagaucagacuugagcuagguguugagaaggauaaaugugauuuaugaguugaagagggauaaaagaauauccuagaagauaagagacagaaugaaccuaggcacagugguggaucaaaggguuuaugugaaccuugaagaaaucagcuugaugggagugagguacguaauaaauggauaggagugggagcagauuaagaaagaccucaagagccaagcagagacuuaaaauacccuggaaauuagaaaacagccauuggaaaaguuuugacaaguuuuagcauucugucgcacucaucuuauacaugaggacugauauuucugggucuuucugguuacuguguuagauuuaggagauuuuugguucaugguugacuaucaccugcuuuugguuuucagauuugugcuacggaugcuguagaugauauggaagaaggucuuaaaguccuaaugaaggcagacccugguagacaggaauccuugcaagcagagguuaucccagauccaauggagggagagcaaaccuggcccacugaggaggagcugagcgaggcaaagggucaguauugguaaacuugucuguaauucaucugaccuggaauuguggauuuucuguagcuguuccaagugagggcccuauaggauagagugggguggggguauaguugaaagucucuccucacccucaaaugcuguauguuuucaauaaacaaacauuauacacagucuuguuccauuucucaaaauuacuuguguuaauguuuuaucaugaacagauaaacaacuuuggauucauugcagggcuuauuuagcuguguaaguauugcuaguugugaggcagcugaauuaaauuuggaaguaguucuauuuacagugucugccagaauuucccauguuggcagcaguaucuggugccuugccuaggugagaauaaccagagggauagggaaaagaagucuguaauuuacuuaauuuguuugggcuuuuacagauuucuugaaggaaaguucuaaggugguaaagaagguccccaaaggaacauccaguuaccaagcugaauggauuuuggaugguggcagccaaagugguggggaaggagaugaauaugaauaugaugauauggaacaugaggauuuuauggaggaggaaucucagguaaggaaaugaggccuuaggccaauucugugucuagcuccaaauguaaggcaaagugcaggugugaucuugaugggugugugugguuaguuucuuuuuuuuauuuuuuuuauuuuuuuuuuaugagacggagucuugcucuguugcucaggcuggagugcaguggugcgaucugggcucacugcaagcucucccuccuggguucacgccauucuccugccucagccuccugaguagcugggacuacaggcgcccaccaccaugccuggcuaauuuuuuuguauuuuuaguagagacgggguuucacuguguuagccaggauggucucaaucuccugaccucaugauccgccugccuuggccucccaaagugcugggauuacaggcgugagccaccgcacccggccguguaugguuaguuucuuaggaaugacucuguaguugccaggaaugaggcuuuuguuuuauacuuuagacuguauuagaauuuauguugguugggaauagggaucuaguacaauuauuuuacucuuagcuuauuggccuuugggguagagacagguguggauuucuucugaaaaaacuguaauccuauucuacaggaugagaguagugaagaagaggaagaauaugaaacuaugacuauuggggagucugugcaugaugaucuguaugauaagaaaguagaugaagaagcugaggcaaaaauguuggagaaauauaaacaagaaagacuggaagagauguuuccagaugaaguggacacgccccgugauguggcugcucgaauucgguuagucaacaagucuaucaacaaaucuaaauucagucaauacguuuuuaaaaacuuggcucagagcugugucacugugaugcaaaagaagaaaaacacauuuuuucugcuccugaagagcuaacauuuaauaugggaaggcaggacauacauacgggaaauggucauauguaauuaaguucuagacuguggugcagacucacguuacaggacuugaaugaaggggaaauacuaagguuaauuagcaaauacuucuucccaaaggagccaguacucaauugaaguauauaauguuuggaaauuuuaggggguuuggguagaauagcagaaguagaagagugaagaaguagaugauuauaucuguucuggaggugagugacuaaagccagugaauuaauuuuggauauuaggagguaaggcuauguauuaggccauucucgcauggcuauaaagaaguaccagagacugcauaauuuauaaagaaaagagauuuaauugggucaugguccugcagacuguacaggaagcaugguguuggcaucugcucagcuucuggggguguccucaagaaacuuacaaucauggcagaagguggagggggagcaagucaugucacacggccagcgcaguaacgagagcaaggcaggaggugcuacacacuuuaaacaacuagaucucaugagaacucacucaacaaggaggguggugcuaacccacucaugagaaaaccucuccccuaaugcagucaccucccaccaggcuccaccuccaacacuggggauuguauuucaguaugagauuggggcagggagacacaucugaacuguaucaggccauuaccaagcaucuuuuuugucagugagaagcuuggguuugguuccgauagaacuuguuauaagcuguucggagugucgucuugguuuaagcuguuggguuguuuggagagaggaugauuggaguucuuuucagcuagcuccuuagccauuuuagcagugacuugagucuauauagcaccauauaaaucugacuuaaugucuuuaaaaaucuucaauauucuagauuucagaaauacagaggccuuaagagcuuccggacaucuccaugggauccuaaggaaaaccuuccucaagauuaugcucgaauauuucaguuucagaacuuuacuaacacuaggaaaagcaucuuuaaagagguugaagaaaaagagguugaaggagcugagguaucuauccuccuuguucaucuuguauguugcuuucauuugucaacaugcucccuacuuuauuccuucucuuggcaugaaaauaugcugcauuuggggauuaggggagccccugagucauugauuagaaugauacugggaacaaagagguaucagcuauguuaaaugaaaaagugugaucuggguaaaugaagcaucuugaaggaugaggguuggcuuuaaaaauuuuaucugagagacucaacauauuuggagaaagcuuccucgcuauugggacuuugaaagguaacuccaugauugcuuucugcuuucuuguggcagguuggcugguaugucacacuucaugucucugaaguccccgucucaguggucgagugcuucaggcaaggaacacccuugauugcauuuucuuuacuaccucaugaacagaagguaaauugcugucuugugggaaaaugggggguugugaaacuuuccagcugcuucugacagucuaaaauucuguuuaugugugacuaaaauuuugcucauugggaugcaaaaagucugccuuuaugauuaggaauuggagaauaauagagaagucaaugaugguuuuauucauaucgucugaaccugucugaagcaucucagugaugcaaucucugugugguucugagacuucuccaaguauguuuuucagaccagauuuugaauaaggguuggcagccuuaaaaauaaagguuuggcugggcgcggcggcucacgccuguaaucccagcacuuuuugggaggccaagguggguggaucaccugaggucgggaguucgagaccagccugaccaacauggaggaacccugucucuaccaaaaauacaaaauuagccaggcgugguggcacaugccuguaaucccagcuacuugggaggcugaggcagaagaauugcuugaacccaguaggcggagguuguggugagccaagauugcaccauugcacuccagccugggcaacaagagcgaaacucuuaugucaaaaaaaaaaaaaguuuaugccaaagugcagaucucuuuucucuugguggccaguaguuguguauguugugggguaugugauaguucuuugaucgguuuugguaagggcucaagaagaaggggcuugaaugagugugguuuugagauuguggugagugaaugccuugaaggccacugauuuuuguguggcagauguugagcucuuuucuguuaggugcaggaagguagguuagcauugaagggugcaugaaagcucugaucagccuguguuuggcuuaaaugccagucauugguggagguaaaggaugaacccguguuucagcaucuacacuccaccauuaauuagcauugucaguucuuagaaugagucugaaucugcuaguuugguuugccuucuuucaguuuaggcaauuguauuccuagacuaugaagauuuuuguuuuucuuacuugguccccagaugucaguauugaauaugguggugaggcgugacccuggcaacacugaaccugugaaagccaaggaagagcucauauuucacuguggauucaggcgcuuccgagccucaccuuuauucucucagcacacugcagguuagcaauggggaagcuggguucuuguccaucuugucuuuugggaaagugacuugugguggaggggugccaaaauauaugguuucaaaaucuuacaucucuggguuagagguauuuucaguacucuggcuuaagagccaaugauguuuuuauucaaaaugucugaaccugucugaagcaucccagugaugcaacuucugugugauacugaggcuuuuuugccaugaguauuuguuccauagcagguuuugaauagaaguuggcagcuuuauaaaaaggguauuagggugggugcaguggugcagugguucacaccuguaaucccaacacuuguggcauuagaacggggaauugaagaccaaaaaagguaagauuuaaucuuguuuuuguuucuguuuuuuuuuuuuuuuuuuuuuuuuuuuugagacggagucucacucugucgcccaggcuggagugcaguggcgcgaucuaggcucacugcaagcuccgccucucagguuuacuuacaccauuuuccugccucagccucccaaguagcugggacuacaggcgcccgccaccaugcccagcuaauuuuuuguauuuuuaguagagacgggguuucaccguguuagccaggauggucucuaucuccugaccucgugagccgcccgccucagccucccaaagugcugggauuacaggugugagccaccgcgcccccucuuguuuuuuuuguuuuuuuuuguuuguuuguuuguuuguuuuuuuggagacggagucuuacuccguugcccaggcuggagugcaauagcgugaucucggcucacugcaaccuccgccucccggguucaagcaauucuccugccucagccucccgaguagaguaguugggacuacaggcaugcacgaccaugcccagcuaauuuuuguauuuuuaguagagaugggguuucaccauguugggguuuaguagagaugggguuucaccaagaccaggaguucaggcugguuuugaacuccuggucucaggugauccgcccaccucggucucccaaagugcugggauuacagacaugagccaaugugccuggccucuuuuuuuuuuuuuuuuuuuuugagaccgagucucacucugaugcucaacuggagugcaauggugcaauccaggcucacugcaaccucugccuuccagguucaaucaguuuuccugccucagcuucccgaguagcugagauuacaggcacccgccaccacgccuagcuaauuuuuguauuuuuaguagagacgggguuucaccaugcuggccaggcuggucucgaccuuaggcgauccuccugccuuggccuuccaaagugcugggauuacaggcgugagccacugcgccuggccagucauucuuuuauuguuucaaaaugguuuugauuuuuuuuuuuaggaugaacuauuuucauauuuuauacaguugggaaaauaaggaauaauguaaaaguaaaauuaccuuauauuagagaaaauucauuuuuauuuuauacauuuucauccagaucucauuuuuuuucuuuacacaauuuggauuguaauuguaaauaugguguuaaacauugcauuuaucacuuaauugauuuugaucaauuuuccauaagauuaauuaguuaaugagacuuuuaaugcuuuauugucauuuggauauauuccaguguaugugauguacugauacuuauuugagcuucuacgggugagcacuuaggcuauuucuaauguuuugcucuaaacuagaucuguaugcauaaaacuuuauuuacuucuuugcuuauuuuguaaaggcagauccuuagaacuggaacuaaauaaaagucucaguugcagagacugaggcaggaggaucgcuugaggucaggagugugagacuccggucucuacaauuuuuuuuuuuuuuuuuuugauauagaguccaacucugucaccaaggcuggagugcaguaacaugaucucagcucauugcagccuccccgucccagguucaagugauucuggcgccucagccucccaaguagcucggaccauaggugucugccaccacgcccagcuacuuuuuguauuuuuaguagagaugggguuucaccaaguuggccagucuguucucaaacucuugaccucaggugauccacgugccuuggccucccaaagugcugggauuuauagggaugagccaacaugcccggccucuacgaaaaaaaaauuuuuuuuuuugggagauggaguuucacucuuguugcccaggcuggagugcaguggcaggaucuuggcucacugcaaccucugccuccuagguucaagugauucuccugccucagccucccaagcagcugggauuacaggcguguaccaccaugccuagcuaauuuuucuauuauuaguagagauagaguuucaccaucuuggccaggcuggucucaaacucccgaccucaggugauccacccgcauuggccucccaaagugcugggauuacaggcaugagccacugcgcccggccaaaaauuuuucuuuuuaauuagccaggugugguggcaugugcuuugcagucccagcuacuugggaggcugaggcaagagggauugccugagccagugggcccaggaguuugaggcuccagugagcuguguucacaccacagcccuuaaaauauuuuauuuuccuauaaguuuaguauuuuuaaaaggggggugagggcuacauugaagguagaacaccaaauacagucuagccuagauagcagagugagacacugucucucagaauuuaaaagggugugauaaaguguggaaacuuugaugucuagugugccaagggcagugugggugaaggaauggaggcuggguauggcucauaguuggguaaagcagagguagggguccugagauacugagagacuacuggacgggacuugcagcagaaaugauugucuccuacacaguaggagcaggaagauauguugcccacuaacuugggggcuucugaacaucguccuaguucacucacucucagcaguggcaggaggaauaugaagaaagcaguauuaaugguguuuuggauaauuuuuauucucaccaauugugagaaucacaaucucuaagugagauuaauuuuucuuugccuuaaaauauuuuauuuuccuuuaaguuuaguauuuuaaaaaggaggugagggcuaccuugaagguagaacaucaaauacagucuaggcuccaagauucugacuccagauaaaaaaguuacugaucaggcaccugcaauuccagcuauucgggagccugaggcagaagaaucacuugaaccugggagguggagguugcagugagcagagauggcaccauuguacuccagccugggcaacaagagcgagacaccaucucaaaauaaauaaauaaauaaaaaguuacugauacagccuggcgcgguggcucacgccuguaaucccagcacuuugggagauugagguggguggaucacaaggugaggaguucgagaccagccuggccaacauggugaaacccggucucuacuaaaaauacaaaaauuagccgggcgugguggcaugugccuguaaucccagcuacucaggaggcugaggcaggagaacugcuugaacccgggaggcagagguugcagucagcugagaucacaccauugcauuccagccugggugacaggaacgauacucaaacucaaaaaaaaagaaaaaaaaaaaguuacugauaggacuagaucguaucuuuuaggugcauugaggcagcgaaaauuuuugagaacuggugguuuagagaaguagaagcugccauagguuuaagaguugcacuaauacagcuuuucacaggccucuaucaccucugguuucucaaaaugguuuugcuuuucauuuuuuaacccuuauggcagcggacaaacauaaauugcagagauuccugacugcugacauggcccugguggcgacagucuaugcgccaaucacuuuuccuccugcaucugugcugcuuuucaagcaaaaaagcaaugguaaguugagccacagagaugaacagacccugcagguccuuaauagaugaacaccguuuucucuuguuuauuuaaauuugggagccaaaugguauggagaagguaaugaugguuuucaaaauacaguaagucuucauuuaacauuguuaauagaacaaugaaaacuccaacuuuuacgugaaacaguguauagccaguccucaaauaacugccuuuuguucaacauccuuuccuuguaacaacugaugagaaaaaguaugguuuuguuauacaucauuucucuugaaguacaaguuuucaagaaccuauugacaagguuaagugugggcuuacaguuuaccaaucuuagccucagauugggcuagggcagggaugacaaaccaggcucuugcaugggucuuuaaauggacugggcaauaaaugaagacuuuggccuguaaauuccuaaauagcuucuuugcuuuuguccuuuaggaaugcacagccucauugcuacaggccaucuuaugucaguagauccagacagaauggucaucaagagaguuguucugaguggucauccuuucaaaauuuuuacuaagauggcaguaguacguuacauguucuucaacagagguggguaugaaggaggaggaugggaucugauugccuuugugguauaaagguuggguuuacauuuuguggguaaauguuucaucuuggucuuuaauguguuugauucuaagaggaugugcugugguuuaaaccaguggaacugagaacgaaguggggccggagaggacauaucaaggaaccuuuagguaaggaaacacgggauuugagaccaugucugcauuucugcaguguugcuaaaugacuguuggguuggaagucauugcuuuaaaauuuucuacuuuuaauuugaccgacuuguucugaugucuuucuagguacccauggccacaugaaaugcagcuuugaugggaagcuaaaaucucaagacacaguacugaugaaccuguauaaacgagucuuccccaaauggacuuaugauccauauguaccagaaccaguacccuggcugaaaagugagauuucuucaacagugccucaagggggcauggaguaauggauucaaagagauucugucuuaccggugccagucaguacuccagggaugggaggcacaaguugugauugggcaaaguuuauuuucuaugucagccugucaguccacugccccauuuugcaagacuuuuuuuuagccuugacaaaaugucucaguuaaguauaaaaguuuuuccacuacuuaguccaaaaaaaacuauuaaaucuuaaugaaauagccacucuccauuaagaaucugauaacuaagaguugacaauacuaggaaacaaaaugucuucaguaucuaaagacacugaauucccaccauuuccuuuucuguaaauuaaacagaaacagacugauaagaagcuggccuuucagccugcuucacccaaguuauggaggagguuaagucuacauuuccaccacugagcacaauacaaauguucuuuacuucuggggaaacaguuugaaaauguugagacagcacagcagccacuccaacaccagcuguagguucaaugaguaguuucauccucucccacaccagcuggguugcacacuguugauauggaagggaguaggaauuagugaaaggggagucuaguugguuuaccuauaaaguucagaugagaauacguguccaguuugaauuuucuuaucacuguguacacacgcuucccaaagcuuuucuuuaauucugacucugcuucugucaagaggguugucauuaauacaucuaggguacccucccaugucaugaaguuaccuagucagguucccgugggucacuugcuacuccuaagggaaguuucuucugccuaagaaguuacaccaugcuuugcuauuucuuuucuugcuggagccucaccuuaauuucauccucugugacagugaagauaucauccacaaggucccugauaauaggccagguguucaagccaaugcuggauuugacaccaucugcuaugguuucuggaggauaaagauugggcaucaguuuccccuucagcuuggacugguagcagucaucugcauuugaggguucagcagcauauaccuucacacuagguuucagagccugggaagaggaauauuaagacaucuuaacaacaaaccacaacauugccugcaugucuaaaagaaaauaugggccuggugugguggcucacaccuguaaucccaacacuuugggagcccgaggcggguggaucagcugaggucaggaguucaagaccagccuggccaaccuggugaaaugcagugucaacuaaaaauaggaaaaucagccaggcgugguggcagaccccuguaaucccagcuacucaagaggcugagguaggagaaucacuugaacuugggagggguagguugcagugagcugagaucacaccaaaaugggguggggcgcaguggcucacgccuguaaucccagcacuuugggaggccgaggugggcggaucacgagguagggagaucaagaccauccuggcuaacacggugaaaccccgucucuacuaaaaauacaaaaaaaaaaaacaaaaaaaaacuagccaggcaugguggcaggcaccuguagucccagcuacucgggaggcagaggcaggagaauggcgugaaccugggagguggagcuugcagugagccaagaucgugccacugcacuccagccugggugacagagugagacuccgucucaaaaaaaaaaagaaaauaggcacaauaaguaauacauuucugcccaaguaagagccuucccuuuuguggauguaaugaaaauaucuucaagcacuuuauaaauaaauuauaugucugauacuag

SEQ ID NO: 16693 - RNA, 998 nt, Homo sapiens
gcuccuggugcugcuugugugcucguuuggugcggaccugguaccucuuuugugaaacggcagcugaggagauuccggcgcuugccauggccgacgaaaaacccaaggaaggagucaagacugagaacaacgaucauauuaauuugaagguggcggggcaggaugguucuguggugcaguuuaagauuaagaggcauacaccacuuaguaaacuaaugaaagccuauugugaacgacagggauugucagugaggcagaucagauuccgauucgacgggcaaccaaucaaugaaacagacacaccugcacaguuggaaauggaggaugaagauacaauugauguguuccaacagcagacgggaggugucuacugaaaagggaaccugcuucuuuacuccagaacucuguucuuuaaagaccaagauuacauucucaauuagaaaacugcaauuugguuccaccacauccugacuacuaccguauaguuuucucuauucuuucauuucccccuucccuauuccuuuauuguacauaaaguaacugguauauguacacaagcauauugcauuuuuuuuaacuaaacagccaaugauauguuuugauugacaucaaguggagaugggauggggaaaaauacugauucugugaaaauacccccuuucuccauuaguggcaugcucauucagcucuuaucuuuauauuccaguaaguuauuuugcucucacuguuuuaacaaaaacaacaacaacaacaacauaaaaauccuugcauaccuuuuucaauuggagaauuuuaaugauuuucauuuaucauuguaaaaccaaggacaauuuuauaacuuuuucguacauagcugcuacauguagggcaaucugucuuuaaguagggauaaauuacucuaaaacaaaaaagaauccuagauacuuuucccuucaagucaagcgucuuguuuaaauaaacugcuuguuuaaaaugaaaaaaaaaaaguuaaauauagg

SEQ ID NO: 16694 - RNA, 726 nt, Homo sapiens
uggacagaggccuaggaugaaagcugauugcugaggcugauaccuuguggggcucuaucucaucagugaucaaugagcuggacggccuggccaaggggcaggagacagaccaccgggcugggggcuacgcccgugugguacaagagaaggcccgcaaguccaucgaguuccucgagcagcgauucgagagucgggacucuugccugcgagcccugaccagccguggcaaugaacucgaauccaucgccuuccgcagugaggacaucacuggccagcuggugagacccuguggcaggaagggaaagcccacagccagcuuccagaacaaggucuccaggaaggaagggcugaaggaggcccaucagccugggcagcugagggccagccaccauggaggcccaggugggggaguuccuucuccccuaagucacucguagcacagucagaucaggccaggcagggccagcgcaugcaugggagggaucggggagguggcccugcccagggcccccgaggcagaggaucccuccuccuccuccacauggcgcccccuucugcccaguggugcuucucacacacgucuuccuccaggguaacaacgaugaucucauccuguccugcugccuccacuacugcaaagacaaggcuaaggacuucaugcccgccagcaaagguacagcuuugccuccgccuugggaucuuccauccccacugcccuaccucauc

SEQ ID NO: 16695 - RNA, 726 nt, Homo sapiens
gaugagguagggcaguggggauggaagaucccaaggcggaggcaaagcuguaccuuugcuggcgggcaugaaguccuuagccuugucuuugcaguaguggaggcagcaggacaggaugagaucaucguuguuacccuggaggaagacgugugugagaagcaccacugggcagaagggggcgccauguggaggaggaggagggauccucugccucgggggcccugggcagggccaccuccccgaucccucccaugcaugcgcuggcccugccuggccugaucugacugugcuacgagugacuuaggggagaaggaacucccccaccugggccuccaugguggcuggcccucagcugcccaggcugaugggccuccuucagcccuuccuuccuggagaccuuguucuggaagcuggcugugggcuuucccuuccugccacagggucucaccagcuggccagugauguccucacugcggaaggcgauggauucgaguucauugccacggcuggucagggcucgcaggcaagagucccgacucucgaaucgcugcucgaggaacucgauggacuugcgggccuucucuuguaccacacgggcguagcccccagcccgguggucugucuccugccccuuggccaggccguccagcucauugaucacugaugagauagagccccacaagguaucagccucagcaaucagcuuucauccuaggccucugucca

SEQ ID NO: 16696 - RNA, 3716 nt, Homo sapiens
ucaccccaaacagccuacaggaacccauugccauccgggggaccgccccuaucagaaugacaucagcaauggcugguguaaucaaagcccauuugucagugugaauucuuagcagauuaacuugucagauucacagagaaaccgucacuaaauguuuauguguaaacgauguugaauuuuaaaaucauguggauuauggcggauggggccugacaagaugacagucucugguuucuaacaaagugaaguuaccagugucaaaacagaggauguuuauugugaaaaaugucaaaguauccacagaaaccccugcagaccccugccagcaaugucgggccuugguuagcugaccuaaggccugggacgcuccugguuugaggcccagggcaggaauaguggggcugcuacagacgcagccagucagcugggagccccacacagcccugcauaccaccaccccagccacacuuaucugcagaggggccuggcccaggcagcugaguagucucugaguauccccucacccgaggccaccuuccuuuccccucugcccacagccccuugccucccuucacacucuccuuccuccuguccucuucucucgccaccaccaaccccacaaaccucucccucccgaauccuccaaacuccuccccaggcugaaagccaguucucagccucccugccuggagcuggcaagccugagacugcucagguccgacauggauauuugcagccccccacccccgccagcccacgcagucagugagcacagcaggacacuuccugugccuugcugucugccggaccuggaccucugucaggaaaugcccagccugggacugacgaguagaccugccacccaagcaggccugucaggguagggaugucacuugugugagugcuugucccuggcuuaaauucucuccaauguguuaaagauuagggaguuagggaaagagagguaguggagagacugugcuuaaaaaaaaaaaaagucaucuaaaaagaaugaaagauaucugugccacuauagcaagaccuuuuaaguauauacucugaaaguguggcuaauaugaucaugaugcuguaggaaaaaaagguuauauguccaaguguauguacuuguaaaugugccuaaagaaaccuggaaggauacacaggucuucccugggguacaagacggagaacugggaucaucaucuuaacucuacucuuccuuuuuacucuucuguccucuuagagacuuucgccuguauacauggauuacuguuacuuagcaggggcgaccgguuggccaaagccuuggugugcccuuggcacaauucugccaagacccuuacccucuccucuccucagggcucccuuaaccccucuccccacaucuggaaaacccuggauacauuuucuguuccaucuuuaguuuucugccucuggaugcguaaagcuucaaccugcuggcuuuuagagggagaggacuuguuaaaaaaaaaaaagugggguguggggagagcgguguugugaucugggggccagccaugugguaaaaaggaguagaggucaaggggcugcuucuauucccucaguuuaggguccugggaggcugacggguuugggcagcuuuugggaacuaggcagaagagaguccuguaugggaggccggagucaaggcagaagcccagugcagcccucucuaggccagcaggggaggguccccggggcugagagcccggacggaggaaaggacugguagaagagccaagacacggcuagcguggcacccccuccccaggaccacauucuccagggugagaagagcagccagcccucugccuccuguccucagugacagccuucugcucucucaugcccacagaggagccaauccggcuacugcgggagguggugcuguugacggaugaccggaaccugcgugugaaggcgcucacaaggaauguuccuguacgggacaucccagccuuccucacgugggcccaggugggcugagggagccacacuggggccccccccccguggaaccguuccugaaaggccaccaggcgcccaguguagcacggaagaugcccacgugccugagccaccaauccacccagacaauaaaccauccucuuccaacccacgccacggccaugcugugggggaccugcuccucacagagccccucccaaggaucgggcggaagcugcugggacccuccugggcugccaggauuuagcagggagguggcuggcuacagcaacagcagcugggcaagccagauaggccgcccaugcucucagccuuucucccucccccgucucauuccaaggcugagggagggccuucucgccuggggacgcagccacuuucuccaguggagacagggcagggguucugaguuuccgucagaugcagugaaaucacaguucccuuucaucuucagaaccucugucgugaauguguucaagaggcuuugguuaagucaggaagaagugcccaggguguguguccccagucucccugaggccuggacucgcccaugaacccaagucggcuucuagacagcaugucccuaacagcagcccugggcccccaccucuucuaccauccaccccagacuuaccacacacccuuccugcugcuccucuuccugcccuuaucaaccugggucccucacacuucgccaguugcguccccguggacagucaugagucuagaggaaaggggcaucuggucucaggcccgugcucucggguggccuccaccugcucccucucuccucacuggccuuucuuuccgucuagcuuccucuucaggaaauguccugacuccccucagcucccccuucaccccuccuugcccgccuacccucccuccagaauagccccucacccuucuuccccuucuaguugauccuuuucaccucccugauccccuucauuucuucaccgcgguuccucgucauagggguucucacucugaacuuucccucucuacuacccauggcaggaaccuaguacaggucucccacccagggccuuccacccucggcuccugugcugggagaaacuuccaggcguggacagcccagccugaggcauuccagugcuggggcaccgucgccuaaccugguuucuagcuuugcccucacuccccggaaaaacugacacugacacaggggcccuuuccuugccccuuuagcugguaccucaguggggaggcuuccuuaccaagaaugaguuccugaaacccagggccagagacaaggacaacuuaggggaagacgggguuuucgguggagccaggggcaaaucuuaaugggaccagugggggauaccccagagcccauggccugacugcacagccugccuggaggaugggugcgcagcucugcccucccugaggcccaggacuaugccagaagcgaugggguaccguguaggggagccaaggccaguaguuuggggguaggaguccccuagagucucagaagacugggcucuuuggaguacaggguccccggccucuccuuuaagauucucuccccagcuggaaggccgaugacuggguggucgggagggagacccagcucuccuuucugucccguuugcagcacugguuuuguuuccuuaauaaauuuuuaguuaugaaacauaccugaccucuugcugaucuguuucugggacuggggagggaggcagguccaagccucugca

SEQ ID NO: 16697 - RNA, 7781 nt, Homo sapiens
caguguguaggagccgcggccgcaugaaugagccgccgcacgaguacuacgcgcgccuauaaaagccgccgcgccggccaggcugcgggaggcgaccgggcaguggcgacgcggcccgccagguaagcgggacggaccagccgcggagggacagaugugcggacacggacgggaggacgaggaggggacgggcaggcggcggguggggcggccccuccgggguggggaugggggcggacggggggcaccgggguccccucgcggcugcggagccggggccagagacgacacgagcccgcgcagcaccugccggcgcccgauggacacgcagcuacuucggaggagcaucgaguggaggaccgaccucggagacccccccccggcuuucuuggggcuccugcgccauucucccaggaaagugaggcgaaggugcuggcgccccaggagacgcgcccccuccucucccucccugcggcgcggugacucagccucgcugcccgggccggcugagcgggggugcaggcgagagacggacgcccacccccgcuuccccggcccuccugggacccccgccccgcauggcgucgggcgccccuucccggcaggucccguccagcgggucccgcggcgcccacggcuucccgccucugcgagcggagcuguccucucaggaccgggggggcggggccucccaggucccgccccgcccccacgcccccgccggaagugcccccucugggacaucuuugacgucacggcccucugacgucaggggccgcgugccuggucgcgagcgccgggcggggcagggcgggagacgcaggggaggcggagcagcagagcccccagccggggcagccggggcgaccggggcaccccgcccggacagcgcgccggcaccuuggcucuagacugcuuacugcccgggccgcccucaguaacagucuccagucacggccaccgacgccuggccccgccccaggaccgcggccccggccgccgccgccgcgcccggggacccccaguccccgucccucagggccccgcccccggcccgcugccugcgccgccgcuguccgcggugcugaucaacgcaggcgccgccaucgggccgccccguccgggucccuaggggcugcgaggggcgguggcccacgcgcgcuccucagcccccgccgccccgcccgcccccccgcggcccugacgucagcccgccccgcgccggcgccguccgcgcgccccgcccccgcgucuccagggcaaccguggcuuucgauuguuacugugggaacuggagguaacagucuacagccauggucgccccgcagcacgcccacgcgccgcgccacgccgcgccccgagccgcgggcuggggacgcggagcagaaggaggcgggggcggcgagucaagaucccacgugcccgcgcggguggcaggaggugcugcgcagggaggcggccucccggggccggcggcugaguccaccgaggcucgagcgcgcgcguccugcggagugcgucuggcggccagccugaggccguccuguccucccggccaagguaucccagccagggcucggcgagagaaggggucgggcugggacucggguucuuucgauuucggugagagggaagccacugggaccaggaggcuuggaaggagguuugucuccuggggccugaagacaguagagggaggaaaguuuucugagauacuccacagccccguucuuccaggaaccccuagcugaagugggcauugggcgaagaguaaacucuugaaucuuucccucugagcuaggaggauaagaaggguccccaacccucuggaagccaaugagcuuguaaaguuaaccugguccgcgaagcgucugaacagaucagccugcucaccucagccuaucucuaggugcuggauuccaaucugagacaguuucucaaauuagcccuaaagaggagugaauaccacaggggcugaaguccucuggugcggaugaagugugaacaaggaucucuaaaaauauuauuguauaugucgccugccucugccaacaucacccacuacaggggaugucuauugaauaucaggugugagacuuccccagagauaguguugggaaugguuaaugcaacccagcccacgacacguuaauccaauuuuucuuaacgucucacgccccacccccuccuucacuccccacccggcuccuuugugaaguacuucuaagacacucgugccgguuucccaguuaaucaacacccacaugcuagccaucccaccuccccagggccccgaggucuugcagauuaaaacgcacuugcuucuggguuccaggggaugucaguggguggacugcaguggacugcuggguguagugcucugggaagccagagguccaaccuggcauuaucagcaacuggugguuaaggggccauauucuguuucugagcuuucuguaaaacgggauaauaaucucuucuccucggcaggugcacugugaggauuaaauaggaucauguaaguaaaaauccaaaaacagcagaauguuauuuugaucuuaaguauucuguuaggcuacuacauguuugugaaggggugguguugggaggggaccccagcucugugcacuuaggcagaaugaacgggaugugggggguacaccuugagcuuuaggcuauauauauuuauugucuaauauauauauaaucuauauuauauauauguuauacauacauauacuuuuauuuuuuuucuucugagacagucucgcucugucgcccaggcuggagugcaguggcacuaucucggcucacugcaaccuccgccucccggguucacucugggccuggggcuguugagagguuccuugcuaaggggguucucucuccuaagagcucuaggaauccaagguggaaucagagguggaaaacagaaaugguugggauauucugagaagaggucagaauguggucagaggggaaagaaccagaggauugaccguacgucaggguuguuuagcaucuuagaaaucauuuagggcagggcacaguggcucacgccuguaaucccagcacuuugggaggcauaggugggaggaucucuugagcccaggaguucgagaccagccugggcaauacaaugcgacucccaucucuacaaaaaagaaagaaaggaaagaagaaaggaaagaaaagaaagaaaauuaguugugcacaccuguagucccagcuacuugggaaguugaggugggaggauugcuugaggcugggagguugaggcugcagugagcugugauugcaccacuguacuccagccuggaugacagagugagacccugucucaaaaaaaaaaaaucauuauuuagggcugggagacauggcucaugccuguaaucacaccauuuugcggggcggggcagaggcuggaggacugcuugagcccagaaauucgagaccagccugggcaacauagugagaccccaugucuuaaaaaaaaaaaagccagugugauagguggcaccuguagucucagcuaagcuacucaggaggcugaagcgggagggucacuugagccgaagaggucgaggcugcagugagccaugauccugcaccuggugacagagguagacccugucuuaauaauaauccagccuggccaauauggucagacuccgucucuacuaauaacacaaaaaauuagccagccaugguggugcuugccaguaauuccagcugcuugggaggcugaggcacuagaaucacuugaacccaggagacggaggugcagugagccgugaucgugccacugaacuccagccuggguggcugagugacacuccgucucaaauaauaauaauaauaaugguaccuaccucaugaaguugugagauuaaacaugaaguuguaagguuuaagcuauauauauuuauugccuaauauauauaaaauauauauguguuauauauauauaauuuuauuuguuuuuuucuucugagauggagucuugcucuguugcccaggcugaagugcaguagcaugaucucggcucacugcaacguccgccucccagguucaagcaauucuccugucucagccuccugaguaguuaggacuacaggugugugccaccacccccagccaauuuuuguaguuuguuuuuuuuucuuuuuuuuuggagacagggucuagcucugucucccaggcuggaauacaguggcacaaucacagcuuacugcagccucaaaacuccugggcucaagugauccucccaccugagccucccgaguagcugggaccacaggugcaugccaccacacccagcuaacuuuuaaauuauuuguagagagggggucucacuauguuucccaggcugguucugaacuccugggcucaauugauccucaugccuuagccucccaaagugcugggauuauaggcaugagcaaucgcaccuggcccuaaauuaggccgcauuaaagcucuugcuuauuacaaugucugguauacaguuauuacucaauaaaugcucuucuggccgggugcaguggcucacaccuguaaucccaacacuuugggaggcugaggugggcgaaucacuugagaucaggaguucaagaccagccuggccaacauggcgaaacccugucucuacugaaaaugcaaaaauuagcugggaguggugaugcacaccuguaaucccagcuacucuggaggcugaggcaggcggaucgcucgaacucaggaggcggaggucgcagagagcggagacuguaccacugcacuccagccugggugacagagcgagacuccgucucaaauaaguaaguaaauaaauaaaugcuauuccuauuucuauccuucagaccuaauuuuccuuugcuauaaauugaaaauguuuaagcagugauuguucuggggagcuugcuccccucccugguggguugcaagagagucacacuagggguuuuucagauaacacacccucacccgaggcuuucauucaaccccuaaggcaguggcuuuucaaaucccugcuugggaaugaugggggcaauuugccaaaaugcagauuccugggucccagugauucugacucaguacaucuggaguuggccccagaauucaaguugguuuuuugagauggagucucacucugucacccaggcuggagugcaguggcacaauuucggcucacugcaaccuccgccuccuggguucaagcaauucuccugccucagccuaccaaguagcuaggauuacaggugcaugccaccacgcccagcuacuuuuuuuuuuuuuuuuuuuugagacaguuucgcucucguugcccagguuggagugcaauagcgugaucucggcuuaccgcaaccuuugccucccagguucaagcaauucuccugcuucagccuuccaaguagcugggauuacaggcaugcgccaccaugguuggcuaauuuuguauuuuuaguagagacagaguuucucucuguuggucuggcuggccucaaauucccaaccucaggugaucugcccgccuccgccucccaaagugcugggauuacaggcaugagccaccacgcagggccagaauucagguuuuaaccaauguucuggauguaaaugguacacagaaucugcguauuggggguggggaggggcacaacccccuaagagucucucuugcuccuggacggcaugaugggaagugaccuguuccacuugucgagaacuaguggaccccauguuucccucuagcuuggacacuaugguucucaggaggaauccucacccccggccaggagcccuucuccuccaccuacuacugcugggcucuaccucccccacuuuuaauuuuaagccuuggcucaaaauucacuccccaauauuucuccccuucucucuacuuucguccucaauaaucccaagcagcugggguguacaagucguuuucaccucuugggaccgugcuaaagggggcagccuaugauuaccaugaggguaugggagcccugaacugcaaaucuaucauuuccagagaagccagaaaucugaaauuuucugugcaauuucugaaacuuuaaaucagaauuuuuucuaaaauucaaugggucagauaccacagucuguguaaucaauccauuccaaagucuccuccuuuugcuaaaggagaagauuccuuaaaacaaggcagaagccaacugaagcaagggagaaccaccucccaccccuccccacacacacuuuccacacccaguaacuaggucucugggcggauaauucuguuuuguuuuguuuuuuuuaauuuuggacagcuaaucucuguagugaggaacccagaacuuucgguaauguaagggauauuagucugguugucagaaaaaugggcuggaguauuugugcugugucccugaccauaauuccugcucaguugcuuagcucccuggcaacuaugucugagggcuaaacaggaguuggugugaucuuccagaaaaagaacaggcuucuugucuugcagaggcaggaagucagaaaacaagagugugugugugugugucaggggguggggggugucagguggcacuggaaaugggagggaacucauuaagagugggcaauuggccaggugagguggcucacgccuguuaauuccagcacuuugggaggccaggacagguggauugcuugagcucgcaaguuggagaccauccgcacaacauggugagaccccuucucuacaacaaauacaaaaauuagccaggcauggugauuugcgccugcagccccagcugcuugggaggcugaggugggaggauggauggcuugagcccgggagguggaggcugucaagauugugccacugcacuccagccugggugauagagucagaccuugucuuuaaaaguaaagaaaacaaaaaaagagugggcaauccuagguaggugcaguggcucaggccuauaauccuagcacuuugggaggcugaggcagguggauuguuugagcuaaagaguuuugagaccagccugggcaacguggcaaaacccuaucucuacaaaaaaauauagaaauuagccaggcgugguggcgcaugccuguaacgccaccuacucaggaggcugagacagaacugcuugaacccaggaggcugagguugcagugagccaggaucuuggccacugcucuccagccugggugacagagugagccugucucaaaaaaaaaaaaaaaaagagugagcaauccucaaaguauccaagaacaacuacacgccccaaggggaaaaccagcuggauugcuuaggccuuggcuguagucacuaaagaauggcaucaaucucagaaacccucaagauggggucaauuuaggaagaagcuguuuauucuguacugucuuuggccuccaccuaaggucuggcaucgacccacccuucaggcucauaguucagcgagguuagagcacuuagggagaagcagguaacacauccaggguuugagagaagaccagcacacaacucucagugaucuggauagaggaagacuaaauuacugugguucaggcagccuugccaggugaugucuucccaaaacuucucagauguauauuccucccugauugugccaccuaggccuccuucccuucaguuugggacuuaaaacuuccaccaauaacgugaguaugugcacccaugcagcagccuguccgaggacucacaacuggagacaccucccugcuuggcgcugcccagaaaacuauguagauggccaagaaaccgacuuccauua

SEQ ID NO: 16698 - RNA, 15813 nt, Homo sapiens
aacggugacuuccugcaguguuuagauaaaaccaggcuagaaguagaggaccaccaaauuccucaagagcuguuucucuucauaugauauuucgcauagcucaaaauaggaggaggaacgaaguaacagaaguuagggauaaagcucuuuuauuguaugcauugaaaccuuacaggggcagccuucguguccuguggaaucugcugucccucggguuuucuucuaggguauuggaauauuaaacugggauauuaggggccccugggguccagaaucuugccaaugaagagaagggccccugugucugugucccucaguacgaagaugaaaggcugguuaaggugauaguccagcgggaaggugaggugggcaggcugcagcccugggcugggggugguucccgccccauccucguuccacucaaagccagcccgguguuccaccugagucagcuugauggguuugccugugaucuugcuaaagucuggugaaucaaacaaggauugcagcucuguagagauggagagagauuuccguuaaaacccugccuuccccaacaccccaaccaagggaucccuuugcaagcaagcugggauggcgcagcacuguugacuuucucugaggccugaagaggucugagcugaccgaggguggagugacuugcccaggagcauuuagcaaguuaggucaagaugagaaaacaggucagacagacucgucuugagaggcaguguugugagcgccugucagggaggucugcucgugaggcugaggaaugagucugaugagagaaggcaguucagccuucccuucuggcacgaugaggauuaaggacucauccacggccccccuacaagccuguggagcccuugcguucugcuuagcacaguggaaggcccaaagacccugccccaccccauccacccaccaagagcgaaagggucuucagacauacucaucuccugcagggacuuggugacuucgccuucauaacucagcuucagcuuggggacagugaggaccgccugcacggucuucaguucucggucuaugucaugaaugaacucggaggugaggcucuccucuaucaaggucaaauucugggucacuuucaggggcaggaagaagaugauacucaugcuuccggucaagggcagcugggcaaucugagacaagugagaaagcaugugguuaguccuucagagcccaaaagccggggacagacacagccaggagcugccuucccucucccgugacggggcccuggucucguccuucauccagccccucaucuauuuaacaauuccccuuccagguuauagcuuucuggcagugagccaucuccugagguuucuucagaaaggaugcuguuggccuuucuuaccuuggccuaauaccaacugaaguugucugcugaaagaauguucuccugugguuuaaggagcuagaauugaauuucaggucuuuauuuucucccaaaguccaucggccaacauuuacugcucauuuguuaaauagagagcacuggacuaagacagggagaaccggggauaggaauaccgaaggggccguaagagggcuuggagacuucaccccauccacccaccaagagcaaaagccuccuuugaacagaggcucuuaaccuaagguccauggaacagauggugucagggaucccaagagucuccgaaaucguugacagaaacgugugugcacaccuggcggugcucccucggguuugaggcacugucgucagauucccagagagauccgugugauagccguggcccaagaaagguuaacaguuacagacuuagaacuaaaagaagucagguacacugaaagccuuagaaugccaacgauuggccaagcgugguggcucaugccuggaaucccuguguuuugggagaccgaggcaggcggaucaccugaguuugggaguuugagaccagccugaccaacauggagaaaccccgucuguauaaaauuagccaggcaugguggcacacgccuguaaucccagcuacucaggaggcugaggcaagagaaucgcuuuaacccagcggggcggagguuguggugagccgagaucgugccacugcacuccagccuggccgacagagcgagacugucucaaaaaaaaaaaaaaagaugccaacgauuuggaguuugucauuauuuuucaaaguuuggcuuuaaauucuagaaauaggagucucaagagaacaaacaugugggugcccagucugagggcccauuuccuauuaccuuauucguccuuacaacaaacccugggaggguaaguguugguaacgauccccugccccaucuuaagaggaggaaagcucagacauguuauuaaccugcucaaagucacacagcaggcgacauguagacagcugucggaucucaaaggucauuuuauucccacuacccuguuuugcuucucuauccucucccuccauccaccccccacccugccccuaucccuacagaccuugcagcugagaucugaauccaagccauagcguaaaacagccuuaggguccgacaucauggggacccucacgguccucucuucauccaaguagaaauccucgagggaagucuuucuggagucaaacuuuguuacccacugcccuggaaagaaguguaugacauagucugagccccaggagaccagaaagacaguggcgccaugcuguguccccagagcacguuguugaaaauugccccacucaagggagcuuagcugucaggggcucugaggccucagggaauaggccuaucucaguguguguggcuuggagccuacaguuauuuccaggaccccaagugcccuucaccagcaaacuccgauggcaagacguugauuugguugauuagagucuagauuguacacguucugugauagccugcaggaaaaguaaagugguagccgggcaugguaacucacaccuggaaucccagcauauugggaggccgggguggguggaucacuugaggucaggaguuugagaccagccuggccaacaugaaaaaacgcuguccuaaaaauacaaaaauggccgggcacggugacucacgccuguagucccagcccuucaggaggccaaggugggcagaucacuugaggucaggaguuugagaccagcguggccaacauggcaaaaccccgucucuacuaaaaauacaaaaauggccggguguggugccucacaucuguaaucucagcacuuugggaggccaaggcggauggaucaucugaggucaggaguuuucgagaacagccuggccagcauggcgaaaccccaucucuacugaaaauacaaaaacuagccgggugcaguggugggugucuguaaucccagcuacucgggaggcagagacaggagaaucacuugaaccugggagccagagguugcagugagcugagaucacaccacagcacuccagccuaggcaaaaagagcgaaacuccaucucaaaaacaaaagaaagaaaaguaaacuggugugcacuccuacagcagugucucugggagacagucaaagaaggucugagcugggaaggaccucugagguccucuggauuaaguccucuuguagcugaaaacaggccaaagccaaagaggugaaguaacuggcugacgcucuggaagccagcugauggccaagccccuuuaguuuaaugugaccuauaauauccuggacccagagcuguuccuucacucacuagacaucagugcuugaaguaggaagccguuuggauuuuguccaggcucgggggccgcucuugcuggugccucagaugguuacaaagcguuuuaagggagaguuugcccaaccccucccccuaccccaggccaccccacaaggccuuaucugaacagggcuggccccacacaagacccguggaacaagcuccaaacacaucaccacagccuagaaggaugucguuggccaccugccaugucuuggguacagaacuagagcuguuagaaaacuuggagacaacauaaaaaggugucuaugaaguagauauauuauccucacguuaaaggugagaacguaggcccagaaagguuaugaaaugugugcagaguuccucagcuaguacaggcagagcugggauuuaaaccuugucugauuuggccagcgcaguggcucacgccuguaaucccagcacugugggaggccgaggcggguggaucaucugaggucaggaguuuucgagaacagccuggccagcauggcgaaaccccaucucuacugaaaauacaaaaauuagcugggugugguggcgggcgccuguaaucccaacuacucgggaggcugaggcaggagaagcacuugaaccugggagguggggaggcuguagugagccaagauggcaccacugcacuccagccugggcaacagaaugagacuccaucuuaaauaaauaaauaaaucuugucugacucaaaagcugggaaagccccaaacagacccaguguucauucuuccucccucucugcucuucugucuccacaagucucucacucuauagacauucacgccuugccuuggauuugaugacaagcagguaagcuucaggcaagcacaguucccagauccucccccagcugugacccagacuccaugcugggcaaggucuuugacaccucccuuuccaagccccuucugaugucugccauccauccuuggucaaacaagaaguggaaaguuggacaugguaaucccagcauuuugggaggccgaggugggaggaucacuucagcucaggaguucgagaccagccucggcaucauagugacacccugucucuuaauuuaaaaauaaauguaaaagggccgggcgcaguggcucacgccuguaaucccagcacuuugggaggcugaggcggguggaucacgaggucaggagaucgagaccacggugaaaccccgucucuacuaaaaauacaaaaaauuaguagggcgcaguggcgggcgccuguagucccagcuacucgggaggucgaggcaggagaauggugugaaccuggaaggcagagcuugcagugagccgagaucgcgccacugcacuccagccugggugacagagcaagacucugucucaaaaaauaaauaaauaaauguaaaagggccgggcgcgguggcucaugccuguaaucccagcacuuugggaggccaaggugggaggauuacuugagcccaggaguucgagaccagccugggcaucauggcaacaccuugucucuuaauuuaaaaauaaaaagggcugggcgugguggcucaagcuuguaauccuagcacuuugggaggcugaggcgggcagaccaccugagcucaggaguucgagaccagccuggccaacauggugaaaccccaugucuauuaaauacaaaaaauuagccgggaguggugguacaucccuguaaucccagcuacucgggaggcugaggcacaagaauugcuugaaccugggaggcggagguugcauugagcugagaucgcaccacugcacuccaguuaggacuacagaguaagacuccaucgaauuaauuaauuaguuaaaauacaguaaaauaaaugaaaaagaauuggagacgcgcucacccuugaagugcgccacaccgagaaggagaaugcugaucucaucgggaauuuccuuuguggaccuggcgagcuucccuuucaucugcgccugcacccaguuguugaucucuugcagguccaagcgaggguugcccgucaggacucugggccuggucccauaugacuuuuccagaggugccacaaagcuggauuuuaugcgcagcucugagaagaggcggagcagagguuagcguaugagacucgacgacaagcaucccgucuuugagagccugccaggcucggguucugguuuagcgcucagcaggcccugacuucccagccagcaucuuccugugacuugccaggacuucugcuggcauccccaggcacuggccaggggggcagcagauuuccccacaucgcgccacugcccucccugccccucccaccgucuccugcagcccacuuccucuuucugagccucuuugggcucacgggcccuuccuccacaccagugccaggccaggccugggcacacaugaucuauuguuuagaaacgggccgagcgcgguggcucacaccuguaaucccagcacuuugggaggucgaggcgggcagaacaccaggucaggagaucgagacuauccuggcaaacacggugaaaccccgucucugcuaaaaauacaaaaaagauuagcugggcaccugcagucccagcuacucgggaggcugaggcaggaggauggugugaacccgggagguggagguugcagugagccgagaucacgccacugcacuccagccugggcaacagagcgagacuccgucucaaaaaaaaaaaaaaaagacccccccagccugcagcauggagcccacaugccucaggcaacuugggcugcaaaggcgacucacucuucucaaagacgauccgggaggcacucuugagguucuucuggggggcagugaccgugucaaggagcuccuuauagguaccauggaugucugggcugcugaucaagucauaguagagagcccggugaaugauggauucuguucgcugcuccgcuccugccagagacaaggauguggacguugauaacugcacaccagggccccaaaucaagcccccucccagaacacagacacuauacucaucuuuuuugucugcugagagcccaaguaggcugaucuucaagacaaucuagguggccaaggaauuuucauccuuagagauuuuccugaaguagguuaaaggcaucaggccuggaaggugggagugagggagugagagguaccagucccuguacuucucccaucauagcccuuaagauuauucuggccaggcgcgguggcucacgccuguaaucccagcacuuugggaggccaaggcggguggaucgcuugagcccgggaguuugagaccagccuaggcaacauggugaaaccccgucucuacuaaaaauacaaaaauuagcugggcaugauggcaggugccuguaaucccagcuacucuggaggcugaggcaggagaauuccuugaaccagggaggcagagguugcagugagcugagaucacaccacugcacuccagccuuggcgacaaagcgagacuccgucucagaaagaaaaaaaaaaaaaaaaaaagacuauucuguagugagcugguauuaguuccccugugaacccagcuguguccucggugagggcaagcccacaccugcuuguuugcaguuacaucccaggaaccuaggcuagcaccagcuugguuaaggaaugcaagaaugugccuugaagucacugugucaauaagcgaacccugaggccaagcgccaugucaguggugcccagccccuuucggggagcuggggaaucgugugugugcagccccugagcuccugcuuacacagcugggacccccaggccaggccccuggugcuacuucaccccucgcugaacugaaaugucaauaaacucagccacguuuacgcagaggccacagggggccucuccaggucugccuggggcuuccugcaucugagcacucacccagcgagagggccgagagggccguggccacacugagaggagacaggagcacguuggucguggggcucgugcuggaucgcacccgguacaggucauagccgaaguuggagacagccgcugccagcuuguucacggggacuuugaagaaaggauccuccuccuccaccagcgccccugugcugucggggucuggggagcccuggcaggagacaggaagucuuggguuugaguucagggacucgcagagaugcacagggacugucuccucacggcuuuguguaggguggugguucuggccccuuggggcuguccuuccuaauuuuucuguguuuggccuaaaacgggaaugaguuuuacucccugaucacgcaugagcucucuguggagagacagcgcagaagagagaucagcuguuuuuuuuuuauuugagacagagucuuacugugucacccaggcuagaguucaguggcgcgaucucagcucacugcaaccuccaccuccccgguucaagcgauuuuccugccuuagccucccaaauggcugggauuacaggcaugcgccacugcgccuggccucauggccagguuuaaacacuugugaccuauaagccgaaaccuaugacccacuuuuuuuuuuuuuuuugagacggagucucgcucugucgcucaggcuggaguacgguggcgugaucucggcucacugcaagcuccgccucccggguucacgccauucuccugccucagccucccgaguagcugggacuacaggcgcccaccaccaugccuggguaauuuuuuguauuuuuaguagagacgggguuucaccguguuaggcaggauggucucgaucuccugaccuugugauccacccgccucggucuaccaaagugcugggauuacaggcaugagccaccgcgcccagccccaugacccacuuuuuaaaaaccaucagccgaguggcucacaccuauaaucccagcacuuugggaggcugaggugggugaaucacuugaggucaggaguucgagaccauccugggcaacacggugaaacccgucucuacuaaaaauacaaaaaaauuaacggggcaugguggugcaugccuguaaucccagcuacucaggaggcugaggcacgagauucgcuugaacccaggaggcagagguugcaaugagcugagauagugccacuguacuccagccugggugacagagugagacccugucucaaaaaauaaauaaguaaauaaaaauaaauauaaauauaaaaauugggagccaggugcaguggcuuaugccuauaaucccagcacuuuggcaggccgaggaagauggaucacuugagcucaggaguuucagaccaaccugagcaacauggugaggccccaucucuacuaaaaauacccaaaaaauuagcugggcgugguggaacgugccuguggucccagcuauuugggaggcugaggcaugagaauugguugaacucaggaggccaagauugcagugagccaagaucgcaccacuguacuccagcaugggugauggagugagacucugucucuaaaaaaagaaaguuaaaaaaaagaacucaguuuuucuuucuuucuuuuuuuuuuuuuuuugagacggagucucacucugucgcccaggcuggagugcaguggugcgagcucagcucacugcaaccuccaccucccggguucacgccauucuccugccucagccucccgaguagcugggacuacaggcgccccccaccacacccagcuaauuuuuuguauuuuuaguagagacgggguuucaccauguuagccaggauggucucgaucuccugaccucgugauccacccaccuccgccucccaaagugcugggauuacaggcgugagccaccgcgcccggccccucacugcagucuuaaucuccugggcucaagugauccucccaccucagcuucccaaguagguaguaccacaagcacuugccaccacgccugguaauuuuugcuuuuuuguagagacaggggucucacuauguugccuaugcuggucucaaacuccuggauucaagggaucauccugcuccgccucccacacugcugggauuacaggugugagccaccgcacccggcagaacugaguuuuuauuuccgcccauugccagccccugucgaguagguguuugguagaugagaaauaaaugaguggccacauggcccuguagaauggguguuuuuaucccauuucauaggcaaggaagcaaagacugagguaaggguugucuagggucacaaagcuaggaagagggagacgcagaauucauacucugaccucacgaaaguccagggcucucgccaagaugcccagcugcucuugucccucaagggugggccuccgccaacacucaccccauaacacucauauggcccaggcuucccuccaugugccuguaucugccuugggaacccagcugcgcccuuucugggcaggagagaggucacuccauacccucacucccugccacagccuggucaguauccgaacaaauguccgggaacaugaccugcucaguggagcccccacuaggaagacaagguaaugagaaaagauccuggccaggugcgguggcucacaccugucaucccggcacuuugggaggccgaggcaggagaaucacuugaggucgggaguucgagaccagccugaccaacauggagaaaccccgucucuacuaaaaauacaaaaugagccgggcuugguggugcaugccuguaaucccagcugcuugggaagcugaggcaggagaauugcccuggacuuguuaaaagugcuucagauuuuuacucuuuugggaucuuauucaugucccuacuccauccccugaaaggcaaggcaagacauuuucucucuguuuugcugcuggagaaacuccagcccuagagaaauaaaggcccaagccuggccuggaaccuggguccggguucccuguccuguuucccgugcugccugccaaggaggggcggggaaugcugaccacgcccuccccgccugccuacugaccuccuccggggggcuggcaggguucuggcagcugcugugcccgaggagggcuccaaugcagaggaguagcaccagggccugcauccuggggccugcaagaaaagaacgaggcagcaagccgcucucccccgacacugcacugccccgcuaccccuuccuggccaccccagccaggacccagggguugggcagggcuagucacuuucccccacccccugcagcgaccaccccucaccccuccaggcccccagaaguggacccucagcuugauggcccaucccucccagcaagguucucccgccccucccccugccucagggcccacagucauaccauaagcuugugcuuuuguuccacugucugcgucaggggacccuccuuuaagccuaaagcuuuuauuuauuuauuuauuuauuuauuuauuuauauuuuauuuuuugaaacagagucuggcucugucgcccaggcuggaguacaguggagcgaucuuggcucacugcaaccuccgccuccuggguucaagcgauucucccgccucagccucccaaguagcuggaauuacaggcaccugccaccaugcccggcuaauuuuuuguauuuuaauagcgaugggguuucaccacguucaucaggcuugucucaaacuccugaccucaggcuauccaccugcuucagccucccaaagugcuaggguuauaggugugagccauuacaccuggccccugaaccaauagcuuuuaaagauccagagcaguggggccccagccccagcagggcuucuccacguggaguauggcccagcacaaguguaugcuaaagcuuuguccuggaggcagcugacccacuccggugauaagacuuugggcaaccccucccaggagaauggggcagaacccaggucuccuccauggaaucaccggauaccaagcauagaggcacccaguccggcacgugcugucccuccaaauucucaagcugucuuuggacuucuguggccucacaaggcagcucauucccuucucccacaguucccuuucaagagcucuuccucccaugguuaggagugcagggccuagggucagagauccuggguucacauuugaaauuuuuuuuuuuuuuuuuuuuugggagacaagaucuugcugugcugcccaggcuggaguguaguggcuauucacuacacaaccauagcacuccacagccuggaacuccugaccucaugugauccuccugccucagccucgugaguagcugggacugcaggcgcaugccaucacacauggucucagugcugugucuuaguagcucuuuaaaucaccauuuuuucucuuguaaaauggaaauaaaauaaccuacuauuaaaauaaaacaacuaccgagcacaguggcucaugccuguaaucccagcacuuugggaggcugaggcaggcggauagccugaggucaggaguucgagaccagccuggccaacauggugaaaccccaucuauacuaaaaauacaaaaaguagccaggcgugguggcaggccccuguaaucccaguuacucaggaggcugaggcaggagaaucacuugaaccugggaggcagagguugcagugagccgauuaugccacugcacuccagccugggcaacagagcaagacuuagucucaaaaauaaauaaauaaaauaaaauaaaauaaaauagccaggcaugguggcacacaccuguagucccagcuacuuggagggcuaaggcuggagaaucacuugaacuugggagguggagguugcagugagccaagaucgcaccacugcacuccagccugggcaacaagagugaaaacuccaucucaaaaaaaaaaaaaaaggccaggcgcaguggcucaaaccuguaaucccagcacuuugagaggccgaggcggguagaucaccugaggucaggaguuugagaccauccuggccaacauggagaaaccccaucucuacuaaaaauacaaaaauuagccgggugugguggcgcaugccuguaaucccagcuacuugggaggcuaaggcaggagaaucacuugaauccaggaaguggagguugcagugagcugagaucgcgccacugcacuccaggcugggcaacagagcaagacuccaucucaaaaaaaaaaaaaaaaggaaaaaaaaauguagaaucugaacagcguugucuccccugcccuggcccccaacacaucauccuucauuauccauuuauauacacaaacauccacccacacagcacacacacuuuuugacuucccagaacaaaguggaucagaaaauuugggaggacguugugugauuguuggcucucguccuucaaauuaaaucagauaauccacuggacaauaucgugaggcaugaaagaagauugccuuugaguuuacucagcuuaaggcaggacgggcagcaggaagcagccugguuuucuuucuaaaccccgccucgagccgcagaccucugcguucccagccagcugcucuugcacguggcugcccugacaugcagggagaaaacuuucguguagacaacaggaaaagcuuucugcagcgcaagacagaggccucaccaccauccaggccuacagcuggucuccacccggcuggggccagccccacccagcugccaggagccugccuccccugagccucugcagacugguuuauuagagaccaaaaauucagugagguacacaggaggcaaggcuagaagagaaguuguuaguucuaguuccucuggcccaaguaagaaauuaagggaggagacaggcucaucccggcauaguuuuuuuuguuuuugagacagaguuucacucuugucgcccaggcuaaagugcaguggcgcgaucucagcucagugcaacuuccaccucccggguucaagcaauucuccugccucagucuccugaguagcugggauuacaggugcccgccaccacaccugguuaauuuuuauguuuuaguagagaugggguuucaccguguuggccaggcuggccuggaauccugaucucaggugauccaccagcaucccaaagugccaggaguacaggcgugagccaccaucccuggccauuauccuggcauaguauuuaaggaaacuaaagucacaauucaaauggacuugaaggagcgacuuuagucuuggugccuacagaaucuaagcccaaaccccagaucaggugguagaugauugucacaauguggguaggcugaggugaggugagggagccuggcagggaagggacauggguccaaagguggccccgagcuagacacagggacccagaguauuaacggcaagucugaauccuccacuucaagccaucuggauaagggaagaggagagaugauugaaaacccuacaagggcagugagagggcaagcgugggggucugcauggacgccccucagcacacacgcaauacccuguccacagugguugcucaugggcugagcaggcgaccgcuggcuggcugcagccacagacaaugaugccauccuguccaaagggcaguauccaagccccgcucucguccuagcaggcgggggagggcucagggagagguagauacccucccugcugggccaaggucaggccuuauuuucugacaauugcccacaucaagaaacacagaagcuuuugugaucuugccuccacgugaggcggaucaacucaagccaauacauguguuucagauuaagcccaguuaggagacaaacagccuccaccgccaccucccccucuucccagaaccgcacagccuucagccacauggcagugggccucggagauagcauggggaagggcaccucccccuccccuggcucuccggaggggauugagggguccucucuggcccacccauggugacccagccccaaacaauguuuccugaagcuuuagaagcugaaugagucagcccagggugccguggaguugcacuuccccacaccccagaagcagcagccccaagaauaggacucccugcccuccaaccccacggaaccugggggcuaacguuggguuagcuaacaccggguggggggccuaggcuggacaggggcgggguuucugggaauccugcugagaccuaccccucccaguggcuuggcaggcagcagaaaggguucaucucggacggcccuugucuccagcacuggcagcugggcccccaugcccuauacaccugccggccuaaauaguggucauuguuugccggaggccacaaccucauuggucgcccagccuugacucacguagccaaagagagugggugggggcuggcuagaaggacccagcuguccuccaucccagcccucagccagggcgccgaggccagcgguuugguggugcugggaaauugccuuaacagucagcaccagcugauuuugaaaaaguagcagggagccgagggagcaggggccagggcugggcugcagggcggccgccuuccugacugcccuugguggaagcagcucccgugagccuccuugccucgggcuccagucuuggggugcugcucagacccgacccagcagcuuagcuccccuuuccuccccaugaccgccccuccgcuguuucccacucacuucauucaaaagccuuuccagccucuuccgucggugcagugggauuuggggaucacuggguccuggccuucggccuuguccccccagcucccucugcccucucucauccacucacccuuuugcccaaauugcaggggcugcugucuccgcauuuccucucccuugcaccccucuuuucugcucccuggagugccccugccucuccccuguccccccagcccaggggagccucucccgccgucccuggcaucagagcagccagggagcugcuuuaccuguggauacgcugcagcuccacacccagccuagucccucuaagccugcacacugagggggcuccagccagcacagagcuuuuuuugcugccuucuaauccagcguccagcaggcuucagauuacagcuacuccuuucuuaaagcgaccugcacucaauuuggauucugugauugcaucacugucucguguuaacuuuaacccacugcugcaccaccauccauuacgcc

SEQ ID NO: 16699 - RNA, 15813 nt, Homo sapiens
ggcguaauggaugguggugcagcaguggguuaaaguuaacacgagacagugaugcaaucacagaauccaaauugagugcaggucgcuuuaagaaaggaguagcuguaaucugaagccugcuggacgcuggauuagaaggcagcaaaaaaagcucugugcuggcuggagcccccucagugugcaggcuuagagggacuaggcuggguguggagcugcagcguauccacagguaaagcagcucccuggcugcucugaugccagggacggcgggagaggcuccccugggcuggggggacaggggagaggcaggggcacuccagggagcagaaaagaggggugcaagggagaggaaaugcggagacagcagccccugcaauuugggcaaaagggugaguggaugagagagggcagagggagcuggggggacaaggccgaaggccaggacccagugauccccaaaucccacugcaccgacggaagaggcuggaaaggcuuuugaaugaagugagugggaaacagcggaggggcggucauggggaggaaaggggagcuaagcugcugggucgggucugagcagcaccccaagacuggagcccgaggcaaggaggcucacgggagcugcuuccaccaagggcagucaggaaggcggccgcccugcagcccagcccuggccccugcucccucggcucccugcuacuuuuucaaaaucagcuggugcugacuguuaaggcaauuucccagcaccaccaaaccgcuggccucggcgcccuggcugagggcugggauggaggacagcuggguccuucuagccagcccccacccacucucuuuggcuacgugagucaaggcugggcgaccaaugagguuguggccuccggcaaacaaugaccacuauuuaggccggcagguguauagggcaugggggcccagcugccagugcuggagacaagggccguccgagaugaacccuuucugcugccugccaagccacugggagggguaggucucagcaggauucccagaaaccccgccccuguccagccuaggccccccacccgguguuagcuaacccaacguuagcccccagguuccgugggguuggagggcagggaguccuauucuuggggcugcugcuucugggguguggggaagugcaacuccacggcacccugggcugacucauucagcuucuaaagcuucaggaaacauuguuuggggcugggucaccaugggugggccagagaggaccccucaauccccuccggagagccaggggagggggaggugcccuuccccaugcuaucuccgaggcccacugccauguggcugaaggcugugcgguucugggaagagggggagguggcgguggaggcuguuugucuccuaacugggcuuaaucugaaacacauguauuggcuugaguugauccgccucacguggaggcaagaucacaaaagcuucuguguuucuugaugugggcaauugucagaaaauaaggccugaccuuggcccagcagggaggguaucuaccucucccugagcccucccccgccugcuaggacgagagcggggcuuggauacugcccuuuggacaggauggcaucauugucuguggcugcagccagccagcggucgccugcucagcccaugagcaaccacuguggacaggguauugcgugugugcugaggggcguccaugcagacccccacgcuugcccucucacugcccuuguaggguuuucaaucaucucuccucuucccuuauccagauggcuugaaguggaggauucagacuugccguuaauacucugggucccugugucuagcucggggccaccuuuggacccaugucccuucccugccaggcucccucaccucaccucagccuacccacauugugacaaucaucuaccaccugaucugggguuugggcuuagauucuguaggcaccaagacuaaagucgcuccuucaaguccauuugaauugugacuuuaguuuccuuaaauacuaugccaggauaauggccagggaugguggcucacgccuguacuccuggcacuuugggaugcugguggaucaccugagaucaggauuccaggccagccuggccaacacggugaaaccccaucucuacuaaaacauaaaaauuaaccaggugugguggcgggcaccuguaaucccagcuacucaggagacugaggcaggagaauugcuugaacccgggagguggaaguugcacugagcugagaucgcgccacugcacuuuagccugggcgacaagagugaaacucugucucaaaaacaaaaaaaacuaugccgggaugagccugucuccucccuuaauuucuuacuugggccagaggaacuagaacuaacaacuucucuucuagccuugccuccuguguaccucacugaauuuuuggucucuaauaaaccagucugcagaggcucaggggaggcaggcuccuggcagcuggguggggcuggccccagccggguggagaccagcuguaggccuggaugguggugaggccucugucuugcgcugcagaaagcuuuuccuguugucuacacgaaaguuuucucccugcaugucagggcagccacgugcaagagcagcuggcugggaacgcagaggucugcggcucgaggcgggguuuagaaagaaaaccaggcugcuuccugcugcccguccugccuuaagcugaguaaacucaaaggcaaucuucuuucaugccucacgauauuguccaguggauuaucugauuuaauuugaaggacgagagccaacaaucacacaacguccucccaaauuuucugauccacuuuguucugggaagucaaaaagugugugugcuguguggguggauguuuguguauauaaauggauaaugaaggaugauguguugggggccagggcaggggagacaacgcuguucagauucuacauuuuuuuuuccuuuuuuuuuuuuuuuugagauggagucuugcucuguugcccagccuggagugcaguggcgcgaucucagcucacugcaaccuccacuuccuggauucaagugauucuccugccuuagccucccaaguagcugggauuacaggcaugcgccaccacacccggcuaauuuuuguauuuuuaguagagaugggguuucuccauguuggccaggauggucucaaacuccugaccucaggugaucuacccgccucggccucucaaagugcugggauuacagguuugagccacugcgccuggccuuuuuuuuuuuuuuugagauggaguuuucacucuuguugcccaggcuggagugcaguggugcgaucuuggcucacugcaaccuccaccucccaaguucaagugauucuccagccuuagcccuccaaguagcugggacuacaggugugugccaccaugccuggcuauuuuauuuuauuuuauuuuauuuauuuauuuuugagacuaagucuugcucuguugcccaggcuggagugcaguggcauaaucggcucacugcaaccucugccucccagguucaagugauucuccugccucagccuccugaguaacugggauuacaggggccugccaccacgccuggcuacuuuuuguauuuuuaguauagaugggguuucaccauguuggccaggcuggucucgaacuccugaccucaggcuauccgccugccucagccucccaaagugcugggauuacaggcaugagccacugugcucgguaguuguuuuauuuuaauaguagguuauuuuauuuccauuuuacaagagaaaaaauggugauuuaaagagcuacuaagacacagcacugagaccaugugugauggcaugcgccugcagucccagcuacucacgaggcugaggcaggaggaucacaugaggucaggaguuccaggcuguggagugcuaugguuguguagugaauagccacuacacuccagccugggcagcacagcaagaucuugucucccaaaaaaaaaaaaaaaaaaaaauuucaaaugugaacccaggaucucugacccuaggcccugcacuccuaaccaugggaggaagagcucuugaaagggaacugugggagaagggaaugagcugccuugugaggccacagaaguccaaagacagcuugagaauuuggagggacagcacgugccggacugggugccucuaugcuugguauccggugauuccauggaggagaccuggguucugccccauucuccugggagggguugcccaaagucuuaucaccggagugggucagcugccuccaggacaaagcuuuagcauacacuugugcugggccauacuccacguggagaagcccugcuggggcuggggccccacugcucuggaucuuuaaaagcuauugguucaggggccagguguaauggcucacaccuauaacccuagcacuuugggaggcugaagcagguggauagccugaggucaggaguuugagacaagccugaugaacguggugaaaccccaucgcuauuaaaauacaaaaaauuagccgggcaugguggcaggugccuguaauuccagcuacuugggaggcugaggcgggagaaucgcuugaacccaggaggcggagguugcagugagccaagaucgcuccacuguacuccagccugggcgacagagccagacucuguuucaaaaaauaaaauauaaauaaauaaauaaauaaauaaauaaauaaaagcuuuaggcuuaaaggaggguccccugacgcagacaguggaacaaaagcacaagcuuaugguaugacugugggcccugaggcagggggaggggcgggagaaccuugcugggagggaugggccaucaagcugaggguccacuucugggggccuggaggggugagggguggucgcugcagggggugggggaaagugacuagcccugcccaaccccuggguccuggcugggguggccaggaagggguagcggggcagugcagugucgggggagagcggcuugcugccucguucuuuucuugcaggccccaggaugcaggcccuggugcuacuccucugcauuggagcccuccucgggcacagcagcugccagaacccugccagccccccggaggaggucaguaggcaggcggggagggcguggucagcauuccccgccccuccuuggcaggcagcacgggaaacaggacagggaacccggacccagguuccaggccaggcuugggccuuuauuucucuagggcuggaguuucuccagcagcaaaacagagagaaaaugucuugccuugccuuucaggggauggaguagggacaugaauaagaucccaaaagaguaaaaaucugaagcacuuuuaacaaguccagggcaauucuccugccucagcuucccaagcagcugggauuacaggcaugcaccaccaagcccggcucauuuuguauuuuuaguagagacgggguuucuccauguuggucaggcuggucucgaacucccgaccucaagugauucuccugccucggccucccaaagugccgggaugacaggugugagccaccgcaccuggccaggaucuuuucucauuaccuugucuuccuagugggggcuccacugagcaggucauguucccggacauuuguucggauacugaccaggcuguggcagggagugaggguauggagugaccucucuccugcccagaaagggcgcagcuggguucccaaggcagauacaggcacauggagggaagccugggccauaugaguguuauggggugaguguuggcggaggcccacccuugagggacaagagcagcugggcaucuuggcgagagcccuggacuuucgugaggucagaguaugaauucugcgucucccucuuccuagcuuugugacccuagacaacccuuaccucagucuuugcuuccuugccuaugaaaugggauaaaaacacccauucuacagggccauguggccacucauuuauuucucaucuaccaaacaccuacucgacaggggcuggcaaugggcggaaauaaaaacucaguucugccgggugcgguggcucacaccuguaaucccagcagugugggaggcggagcaggaugaucccuugaauccaggaguuugagaccagcauaggcaacauagugagaccccugucucuacaaaaaagcaaaaauuaccaggcgugguggcaagugcuugugguacuaccuacuugggaagcugaggugggaggaucacuugagcccaggagauuaagacugcagugaggggccgggcgcgguggcucacgccuguaaucccagcacuuugggaggcggagguggguggaucacgaggucaggagaucgagaccauccuggcuaacauggugaaaccccgucucuacuaaaaauacaaaaaauuagcugggugugguggggggcgccuguagucccagcuacucgggaggcugaggcaggagaauggcgugaacccgggagguggagguugcagugagcugagcucgcaccacugcacuccagccugggcgacagagugagacuccgucucaaaaaaaaaaaaaaaagaaagaaagaaaaacugaguucuuuuuuuuaacuuucuuuuuuuagagacagagucucacuccaucacccaugcuggaguacaguggugcgaucuuggcucacugcaaucuuggccuccugaguucaaccaauucucaugccucagccucccaaauagcugggaccacaggcacguuccaccacgcccagcuaauuuuuuggguauuuuuaguagagauggggccucaccauguugcucagguuggucugaaacuccugagcucaagugauccaucuuccucggccugccaaagugcugggauuauaggcauaagccacugcaccuggcucccaauuuuuauauuuauauuuauuuuuauuuacuuauuuauuuuuugagacagggucucacucugucacccaggcuggaguacaguggcacuaucucagcucauugcaaccucugccuccuggguucaagcgaaucucgugccucagccuccugaguagcugggauuacaggcaugcaccaccaugccccguuaauuuuuuuguauuuuuaguagagacggguuucaccguguugcccaggauggucucgaacuccugaccucaagugauucacccaccucagccucccaaagugcugggauuauaggugugagccacucggcugaugguuuuuaaaaagugggucauggggcugggcgcgguggcucaugccuguaaucccagcacuuugguagaccgaggcggguggaucacaaggucaggagaucgagaccauccugccuaacacggugaaaccccgucucuacuaaaaauacaaaaaauuacccaggcaugguggugggcgccuguagucccagcuacucgggaggcugaggcaggagaauggcgugaacccgggaggcggagcuugcagugagccgagaucacgccaccguacuccagccugagcgacagagcgagacuccgucucaaaaaaaaaaaaaaaagugggucauagguuucggcuuauaggucacaaguguuuaaaccuggccaugaggccaggcgcaguggcgcaugccuguaaucccagccauuugggaggcuaaggcaggaaaaucgcuugaaccggggagguggagguugcagugagcugagaucgcgccacugaacucuagccugggugacacaguaagacucugucucaaauaaaaaaaaaacagcugaucucucuucugcgcugucucuccacagagagcucaugcgugaucagggaguaaaacucauucccguuuuaggccaaacacagaaaaauuaggaaggacagccccaaggggccagaaccaccacccuacacaaagccgugaggagacagucccugugcaucucugcgagucccugaacucaaacccaagacuuccugucuccugccagggcuccccagaccccgacagcacaggggcgcugguggaggaggaggauccuuucuucaaaguccccgugaacaagcuggcagcggcugucuccaacuucggcuaugaccuguaccgggugcgauccagcacgagccccacgaccaacgugcuccugucuccucucaguguggccacggcccucucggcccucucgcugggugagugcucagaugcaggaagccccaggcagaccuggagaggcccccuguggccucugcguaaacguggcugaguuuauugacauuucaguucagcgaggggugaaguagcaccaggggccuggccugggggucccagcuguguaagcaggagcucaggggcugcacacacacgauuccccagcuccccgaaaggggcugggcaccacugacauggcgcuuggccucaggguucgcuuauugacacagugacuucaaggcacauucuugcauuccuuaaccaagcuggugcuagccuagguuccugggauguaacugcaaacaagcaggugugggcuugcccucaccgaggacacagcuggguucacaggggaacuaauaccagcucacuacagaauagucuuuuuuuuuuuuuuuuuuucuuucugagacggagucucgcuuugucgccaaggcuggagugcaguggugugaucucagcucacugcaaccucugccucccugguucaaggaauucuccugccucagccuccagaguagcugggauuacaggcaccugccaucaugcccagcuaauuuuuguauuuuuaguagagacgggguuucaccauguugccuaggcuggucucaaacucccgggcucaagcgauccacccgccuuggccucccaaagugcugggauuacaggcgugagccaccgcgccuggccagaauaaucuuaagggcuaugaugggagaaguacagggacugguaccucucacucccucacucccaccuuccaggccugaugccuuuaaccuacuucaggaaaaucucuaaggaugaaaauuccuuggccaccuagauugucuugaagaucagccuacuugggcucucagcagacaaaaaagaugaguauagugucuguguucugggagggggcuugauuuggggcccuggugugcaguuaucaacguccacauccuugucucuggcaggagcggagcagcgaacagaauccaucauucaccgggcucucuacuaugacuugaucagcagcccagacauccaugguaccuauaaggagcuccuugacacggucacugccccccagaagaaccucaagagugccucccggaucgucuuugagaagagugagucgccuuugcagcccaaguugccugaggcaugugggcuccaugcugcaggcugggggggucuuuuuuuuuuuuuuuugagacggagucucgcucuguugcccaggcuggagugcaguggcgugaucucggcucacugcaaccuccaccucccggguucacaccauccuccugccucagccucccgaguagcugggacugcaggugcccagcuaaucuuuuuuguauuuuuagcagagacgggguuucaccguguuugccaggauagucucgaucuccugaccugguguucugcccgccucgaccucccaaagugcugggauuacaggugugagccaccgcgcucggcccguuucuaaacaauagaucaugugugcccaggccuggccuggcacugguguggaggaagggcccgugagcccaaagaggcucagaaagaggaagugggcugcaggagacggugggaggggcagggagggcaguggcgcgauguggggaaaucugcugccccccuggccagugccuggggaugccagcagaaguccuggcaagucacaggaagaugcuggcugggaagucagggccugcugagcgcuaaaccagaacccgagccuggcaggcucucaaagacgggaugcuugucgucgagucucauacgcuaaccucugcuccgccucuucucagagcugcgcauaaaauccagcuuuguggcaccucuggaaaagucauaugggaccaggcccagaguccugacgggcaacccucgcuuggaccugcaagagaucaacaacugggugcaggcgcagaugaaagggaagcucgccagguccacaaaggaaauucccgaugagaucagcauucuccuucucgguguggcgcacuucaagggugagcgcgucuccaauucuuuuucauuuauuuuacuguauuuuaacuaauuaauuaauucgauggagucuuacucuguaguccuaacuggagugcaguggugcgaucucagcucaaugcaaccuccgccucccagguucaagcaauucuugugccucagccucccgaguagcugggauuacagggauguaccaccacucccggcuaauuuuuuguauuuaauagacaugggguuucaccauguuggccaggcuggucucgaacuccugagcucagguggucugcccgccucagccucccaaagugcuaggauuacaagcuugagccaccacgcccagcccuuuuuauuuuuaaauuaagagacaagguguugccaugaugcccaggcuggucucgaacuccugggcucaaguaauccucccaccuuggccucccaaagugcugggauuacaggcaugagccaccgcgcccggcccuuuuacauuuauuuauuuauuuuuugagacagagucuugcucugucacccaggcuggagugcaguggcgcgaucucggcucacugcaagcucugccuuccagguucacaccauucuccugccucgaccucccgaguagcugggacuacaggcgcccgccacugcgcccuacuaauuuuuuguauuuuuaguagagacgggguuucaccguggucucgaucuccugaccucgugauccacccgccucagccucccaaagugcugggauuacaggcgugagccacugcgcccggcccuuuuacauuuauuuuuaaauuaagagacagggugucacuaugaugccgaggcuggucucgaacuccugagcugaagugauccucccaccucggccucccaaaaugcugggauuaccauguccaacuuuccacuucuuguuugaccaaggauggauggcagacaucagaaggggcuuggaaagggaggugucaaagaccuugcccagcauggagucugggucacagcugggggaggaucugggaacugugcuugccugaagcuuaccugcuugucaucaaauccaaggcaaggcgugaaugucuauagagugagagacuuguggagacagaagagcagagagggaggaagaaugaacacugggucuguuuggggcuuucccagcuuuugagucagacaagauuuauuuauuuauuuaagauggagucucauucuguugcccaggcuggagugcaguggugccaucuuggcucacuacagccuccccaccucccagguucaagugcuucuccugccucagccucccgaguaguugggauuacaggcgcccgccaccacacccagcuaauuuuuguauuuucaguagagaugggguuucgccaugcuggccaggcuguucucgaaaacuccugaccucagaugauccacccgccucggccucccacagugcugggauuacaggcgugagccacugcgcuggccaaaucagacaagguuuaaaucccagcucugccuguacuagcugaggaacucugcacacauuucauaaccuuucugggccuacguucucaccuuuaacgugaggauaauauaucuacuucauagacaccuuuuuauguugucuccaaguuuucuaacagcucuaguucuguacccaagacauggcagguggccaacgacauccuucuaggcuguggugauguguuuggagcuuguuccacgggucuuguguggggccagcccuguucagauaaggccuugugggguggccugggguagggggagggguugggcaaacucucccuuaaaacgcuuuguaaccaucugaggcaccagcaagagcggcccccgagccuggacaaaauccaaacggcuuccuacuucaagcacugaugucuagugagugaaggaacagcucuggguccaggauauuauaggucacauuaaacuaaaggggcuuggccaucagcuggcuuccagagcgucagccaguuacuucaccucuuuggcuuuggccuguuuucagcuacaagaggacuuaauccagaggaccucagagguccuucccagcucagaccuucuuugacugucucccagagacacugcuguaggagugcacaccaguuuacuuuucuuucuuuuguuuuugagauggaguuucgcucuuuuugccuaggcuggagugcuguggugugaucucagcucacugcaaccucuggcucccagguucaagugauucuccugucucugccucccgaguagcugggauuacagacacccaccacugcacccggcuaguuuuuguauuuucaguagagaugggguuucgccaugcuggccaggcuguucucgaaaacuccugaccucagaugauccauccgccuuggccucccaaagugcugagauuacagaugugaggcaccacacccggccauuuuuguauuuuuaguagagacgggguuuugccauguuggccacgcuggucucaaacuccugaccucaagugaucugcccaccuuggccuccugaagggcugggacuacaggcgugagucaccgugcccggccauuuuuguauuuuuaggacagcguuuuuucauguuggccaggcuggucucaaacuccugaccucaagugauccacccaccccggccucccaauaugcugggauuccaggugugaguuaccaugcccggcuaccacuuuacuuuuccugcaggcuaucacagaacguguacaaucuagacucuaaucaaccaaaucaacgucuugccaucggaguuugcuggugaagggcacuugggguccuggaaauaacuguaggcuccaagccacacacacugagauaggccuauucccugaggccucagagccccugacagcuaagcucccuugaguggggcaauuuucaacaacgugcucuggggacacagcauggcgccacugucuuucuggucuccuggggcucagacuaugucauacacuucuuuccagggcaguggguaacaaaguuugacuccagaaagacuucccucgaggauuucuacuuggaugaagagaggaccgugaggguccccaugaugucggacccuaaggcuguuuuacgcuauggcuuggauucagaucucagcugcaaggucuguagggauaggggcagggugggggguggauggagggagaggauagagaagcaaaacaggguagugggaauaaaaugaccuuugagauccgacagcugucuacaugucgccugcugugugacuuugagcagguuaauaacaugucugagcuuuccuccucuuaagauggggcaggggaucguuaccaacacuuacccucccaggguuuguuguaaggacgaauaagguaauaggaaaugggcccucagacugggcacccacauguuuguucucuugagacuccuauuucuagaauuuaaagccaaacuuugaaaaauaaugacaaacuccaaaucguuggcaucuuuuuuuuuuuuuuugagacagucucgcucugucggccaggcuggagugcaguggcacgaucucggcucaccacaaccuccgccccgcuggguuaaagcgauucucuugccucagccuccugaguagcugggauuacaggcgugugccaccaugccuggcuaauuuuauacagacgggguuucuccauguuggucaggcuggucucaaacucccaaacucaggugauccgccugccucggucucccaaaacacagggauuccaggcaugagccaccacgcuuggccaaucguuggcauucuaaggcuuucaguguaccugacuucuuuuaguucuaagucuguaacuguuaaccuuucuugggccacggcuaucacacggaucucucugggaaucugacgacagugccucaaacccgagggagcaccgccaggugugcacacacguuucugucaacgauuucggagacucuugggaucccugacaccaucuguuccauggaccuuagguuaagagccucuguucaaaggaggcuuuugcucuugguggguggauggggugaagucuccaagcccucuuacggccccuucgguauuccuauccccgguucucccugucuuaguccagugcucucuauuuaacaaaugagcaguaaauguuggccgauggacuuugggagaaaauaaagaccugaaauucaauucuagcuccuuaaaccacaggagaacauucuuucagcagacaacuucaguugguauuaggccaagguaagaaaggccaacagcauccuuucugaagaaaccucaggagauggcucacugccagaaagcuauaaccuggaaggggaauuguuaaauagaugaggggcuggaugaaggacgagaccagggccccgucacgggagagggaaggcagcuccuggcugugucuguccccggcuuuugggcucugaaggacuaaccacaugcuuucucacuugucucagauugcccagcugcccuugaccggaagcaugaguaucaucuucuuccugccccugaaagugacccagaauuugaccuugauagaggagagccucaccuccgaguucauucaugacauagaccgagaacugaagaccgugcaggcgguccucacuguccccaagcugaagcugaguuaugaaggcgaagucaccaagucccugcaggagaugaguaugucugaagacccuuucgcucuugguggguggaugggguggggcagggucuuugggccuuccacugugcuaagcagaacgcaagggcuccacaggcuuguaggggggccguggaugaguccuuaauccucaucgugccagaagggaaggcugaacugccuucucucaucagacucauuccucagccucacgagcagaccucccugacaggcgcucacaacacugccucucaagacgagucugucugaccuguuuucucaucuugaccuaacuugcuaaaugcuccugggcaagucacuccacccucggucagcucagaccucuucaggccucagagaaagucaacagugcugcgccaucccagcuugcuugcaaagggaucccuugguugggguguuggggaaggcaggguuuuaacggaaaucucucuccaucucuacagagcugcaauccuuguuugauucaccagacuuuagcaagaucacaggcaaacccaucaagcugacucagguggaacaccgggcuggcuuugaguggaacgaggauggggcgggaaccacccccagcccagggcugcagccugcccaccucaccuucccgcuggacuaucaccuuaaccagccuuucaucuucguacugagggacacagacacaggggcccuucucuucauuggcaagauucuggaccccaggggccccuaauaucccaguuuaauauuccaauacccuagaagaaaacccgagggacagcagauuccacaggacacgaaggcugccccuguaagguuucaaugcauacaauaaaagagcuuuaucccuaacuucuguuacuucguuccuccuccuauuuugagcuaugcgaaauaucauaugaagagaaacagcucuugaggaauuuggugguccucuacuucuagccugguuuuaucuaaacacugcaggaagucaccguu

SEQ ID NO: 16700 - RNA, 3039 nt, Homo sapiens
aggagagcaguccagcacuguucguagcggguggaaggaacacccuggacagcaggugggguucuggguggauggcaggcccaggcucugcggccuugcgcaagacagaucgcucugagccucgaugucuucguccacaaaacaggggcaaugacaaguacccggcagggcugggugaggaucagaugggccuucugauacccuagaggcacugggcaaugcggugcuguggcucgcuaggucuucgcccccaucccgcccccucccaaagccccagcuccaggagccccccgcaaccccaggcgcuugucucaccuggcucgguacacagguaggaguaaaagcccucugacuugagcaugaugagcagcgagccccagcccaggaggacugccgagaagaggagguucuccagcacggccgugcaggccauccaccagcggcgccgaugggcaguggccagggugggcgccauggugcggcgcggcgcggcuccggcuccggcuccggcucugcaccaccugcgcacagaacucggcgucagcggccggcccuugcccagccccugcggccgcccccagcagccccgaccgcugccgcagggcucgggauugccaccccuccccggccgcggcggccggugcgcgcagcagaggaagcgaaccccagcccugcccggaccugggacaccccgagcccgcggccggcucguaccgcugcccuccgcuacgacagagccgccccggccaggcagggagacgucucccgcagcucacuccgagguaaacugaggcauggaggcaagaaggggcuaacgcaugcucagggccguggaacuaguccuggccugcagcaggacugacaucgccuggggccagcauggaacgcagcgugaggugggcaggggcagauccgagggcugccucucccagggacccugacaggugcccucccgcccgcgcccgagacccuuccccagagcugguuucuucaaccacaagaucagcgcccagaccuacggaacggcccgccccggcgcgcucauuggccggacggcgcaggaacugccgcgccauuggccgccgucuaggucgcuaggcgcugcggccacgcgaacccagcgugggagacgaggagccgguucaaaccgguggcgcgagccagccgcgcgacccccaucucgggcguucccccggcaacucgcccguuuccauggccucggacccccgcgccuccauuccccagcccgcaucuguucgucaucucuucccuggcggccccucaucgcuccaucucucuccucguucccacguuuucucccuacgccccuucggcggccgcuucugcccccgcgcccucgccccggccgcgauccccucccugcugcagcucacccggcuccuccggcgugugucgggcccgcccggcgccuuuucugcccucuuuuauuccagcccuuuuauuccgaccccaagaagaaaacacugccgcccgcugauuggcugagcggggcuggaaacaggcgucgaccaaucagcagccagccccccgcccgccccgccgcgagcagaagccgguuccggccggacucggagacaaacaagagagaugggggacgggaggggccugggcgcugcgggccgggccucggcuuugcagccuucaacccgagucacagcgcggccgggaauccccggcgacaucgccccgcggccucuccagcggccugacccugcgaggcuggggcuccggcuccgcgucccggcccccagcggacuccccccagaagccgccgggccaccagcgcccccagccgggcucucccgcggccgccccgccguccccagcugcccccugcgcgcgggucaccacgcccagaugcgccggcuccgcacggugguuccacucucgaauccccaccccgccuccuccccacgcagcgccgccguccccgccgccucgggcuuuggguccugguuccucgcucccccgccccggugguucccgucccggcguauucggggccugggaucccggacccgguccagccguggcgccccccgcugaugcaccgaccccuuccccucuccccgguggcgucugcccggucccuggaaguuggcccuuggaaaucugcaaggggauuuggggcuggucugucccguccuaggauggggucuccugagcuccccccaucagacugaccuuucuccgcccguguucacgcacugcucgguccuccggggacccuccacccuugaucgucaucugggugcucccugcccgcgcuggccaccuucaccccguuccccgucccuuucagggaagguccccucugcagggcgaugcuacgggccacguccgccagcugguacaagcuagggaggguucgagggggcuccggguccccgucugauaagcccgggcuccgaaagcucagcuccccgucuucgucccccggauucgaggcacuaacccgacccgggaagacccucugacugccccagaaucgccuuggucacccuggcucgcuccggggggcuggcuuagcaccccagggcugccgcgcgguguccacgucuggaaucccagcgguuugggaggcuaaggucggagggccacuuggggacaggaguuugagaccagccugggcagcauggcgagaaccaucucuaccaaaauaaaaaccaaaaauaaaaccccaccaccaccccagggcugugggagccccaaacgccucuugcuccaccugccccaguccgagugugcccccuacugucuagaauccgcccgggccaccuggcgagggcaaccucccccagacaacgcuuggagcugucagccugcuggggggcggcuccagcugguagccuacccgguuccucacccuguggaacccuucccacucccaagguuucaacugccaucugaaaaaucucuuucuucacccuucccuccucuuugagcagccugacggcgcugcagggcucaaacaugccucaaauaucccccagaacuguccuccacauuuucucucag

SEQ ID NO: 16701 - RNA, 1150 nt, Homo sapiens
uccuuuuugauacuaguuagauguguacuugacucucucccuuacuauauggugucaccuugaggauuuggaccagauccuguuuuuuccucccacaacgcacagcagcuuauauacucagugcucagcgaacguugauucagcugaguugauaucuguuugagagcuagcguggguuguucugugucuguaucuugcgucuuuaguguuuuucuagacuuuuaaacuuauucuuuccuugcagagccaugaccaggcgaagacaauacggagaaguugcuaaucuccuucagggugugaugaauguccuggagcacuuccacaaguauauggggauuccgcagauccggcagcuuuccgaaagguaaacugucaccagagggaaaguauauggggauuccgcagauccggcagcuuuccgaaagguaaacugucaccagagggaaaguauauggggauuccgcagauccggcagcuuuccaaaagguaaacugucaccggagggaaaguauauggggauuccacagauccggcagcuuuccgaaagguaaacugucacuggagggaaaguauauggggauuccgcagauccggcagcuaaacuuuccaaaagguaaacugucaccggaagaagugaucuugcuuucagaaaaggaccuggugcuaggaagugcuuaagcacuuagcucagcguguucacugcagagucuuagugugugaaggaauaucagaugcuaccugaucuaacugucuggugcagacguucccccacuuuaccccuucccaugucuuccaaagcugccugugguagauaguuacaguuguauauauggacaacucucaguuguccccauuugugagagaaacuguucuagguaucuauuucuuuguaacaaaccagcacaaaacuuaguagcuuaaaacaauaauuguuuugcacguauaauuuggccuggcucggggaccagcucaucccugcuccgugcagcauuagccgaggcagcucaggaggggacuggagaaugcauuggcucacucucauggcuggcuccuuggugcuugcugucagcugggagcuuggccaggccguugcugggauucuuuguugucuuccacgggcugcuuggacuuccucacgguaagguggcug

SEQ ID NO: 16702 - RNA, 2891 nt, Homo sapiens
guuucaucuucaaaauaaaaauuuauucaaucuguaacaagaacauugaaucugcacauuugcgcacaaguucacauuuaaaaacaguggagcauaucuguaauaaaaaaaucuaugauacaaguggaacaucccaaccaccaggaagauuaaggaaggagaugagaccacucuauauucugcuucaaaugccucaaaaaugucccagagauuccagggagcaccugcuuuaauaaaacaugagcauaaaaguuugggguggcuuggggcaaagguaacagucagaggagagucuucuggacuuguuuuccauguuagaacaaguccuacaaaacaaagcagaaagaaaaaaaaaaaaaaagaaaaguaaaggcaccuuuagauaugccaagcaaaccaaaauccaacagaacauaaaaaucaaacauuucccugugggcuuacugauugggaagcacuucagggccaguuacccaguuuuuaguuuggguauuagcucugcauguguacacaggacgcugccaccagcauugcuuugaggacacagacggcagcaccagucaaaugccucuuaagggaucuucaaggugauuaaggaugauuccaguuuagaaauccuauccuagaccucuggggcacugagaaaaugaggcugguuaucuucucauagcaggagccagggccagucacccuccauuuccaggcuggaaaaguacagaagcaccuugcaauagcucuucaugacgucaagggaccccacacccugggagaaggguuaggagugugcagcuuccugcuuugguggcaggccuuuuccuaauaugggugucagaggaguugaggcagcaaauaugcuugugucuaauacaugccuugaucuuuuaguuuggaagggaaaacaaaguccaagaugcuuuuaaguuggauugaugcugaaacagcuaaaauuucaucuuauccaccaucaaaaagcaaaacaaaauuaaacaaaaugacacuagccauucaccauuacaaccaucacuauaagacacaccaucacugaggaaaugacaacuauuuccauagagagugcuggaugggagggcaggacacagacggaagucagcuucagcguauacccacuuacucacaagggcugaccaugauggcccugcucugcaugaggacucacaggacagccagggcacugaugccugcaggacugcauggccgacaagaugaugcacauuuuaauauucaaaauguaaacaaaguauccacaaauaguccaaaaaagccaaagaauggcuuuacuuaaaaauuuuuaaaugcccuuaaaagugacuuuuugcauaaugcuuucuuaaaaaaagaacucucacaaaaacauuuuuaccaaacaugccuagaucacuucagaacugaaauccucagaugaaacaggugaacacuucugugaccugcuacaucucagaagcuucucauaggaagcuuugaguuuacccaacagcaucugucuggggccugugagcagaguaccucagagccugaggcacugagaucuucaggcuguccuuggagcucuggguaguuugcaaaaugagaaagaggaacuaucaguagggauaaagacacagaacaaggaaauccauaacccugucucaagccuccucagaaccaggaaaauacuaaagauccugaagagacuaagaugauaggaaugaucccaaacauuuagaaucugaaaggcaacuaaaaugaggagagaugaauauuacgguacuauaguacuacaugucuacuacaguauccauuaguccugggugucuccaaaaaucaagaaaggguugggguuucccuuucuacugaccagguucagcucaaguucuguaugcuccuggggcuuuuaccccauacaccaaaacaucaacuguuuuuauauauguacauauguguacacaugcacauacacuccuccaaaauaagugagagucuauggugguuuaaaaagagagagagagagaggagagagagagaggcaggcaggcacugggcaagagucaaaguuuuuccuauucaucuuugccagucuaucaaaucugcugcuucaggucaggucaugaacaaaagaaaagggaaagaugccacuggagauuauaaaagucugaagagaagacagucuggaaaguccuugacaguucacugcgcaccuccccuggacacugcucagcuauguaaauaacccaggaacacccaauucugggagucugaaaaggcuggcacaaacuccuuggcaugguugaaugacagauauucuguagaagauguuuauuuaggcagguaaauuaaaugauaaaaaaaguaauuauaaaaaggcagaaagacuuuccucugcucuugaaaauuuuuuuuccccacaguauuaguggguuuugucccaucuuuguuguuauuuaaugcagugagugaacauuaaacacaguggaggggagaagagggaacaguccaaaacuuugguccugcuuguaccucuuagugugugggaugucaucaucguaagggguuaccacaaguggaugccacucucuuaacuuccaggcaaacccucuccccacccugccauaaguuccugcccuuccccaucauauuggugguggaacugcuucaagaaggcaggguauucuacauggaagagcucuggaaauccauaacccugucucaagccuccucacauugguucauaccaccuaacaaaacacuuuacaacacacaaauauccaggaaucacaaaacugaguggaugagauacuugaacauucaaggagacuacugagcaacagcacaggguacacauaaucacugcaccauagagacgcuuuuagcaagugguuucuguccaaccugcuucc

SEQ ID NO: 16703 - RNA, 7602 nt, Homo sapiens
uccugcucuaggucugcgaacccgagccuccccagccuacccgggagucauggagggagggaagcagcgugcgcaccuagcacacagcugcacauuuauuuucgaugguucuccgaggccggcggaagcugggaggggagucggggucgcucgacuuucccgccgcuggagggggcggggcaacuugggcucuggccccgccccuaugcuagccccgcccucuuagguugauggcagcggcagcuggggcugcagcggcgccgggcucuagagagccgcaggaucggccagagugcggagcuggacacccgggucccagauacuacagacacccggagagguggcuccuucgcccugaagccuuccucggcccccuacgcacucgggccccuuccgcagaggauucgcagcgugagcgccccgcagcccgcucaggaccagguacccagccccccacacccggccgucaccgcagccagcggagcgggcggggucccugaggggcagaggucugcgccuccuccccccgcgccgccaaauucgguuucgggcggggaggacguggugucuauauuuggccggacagcagccagcgcucccggagggcgcagacaccucgucucgcaagaacgcagugucagggcagcaggcugaagaagggugcagggaggccgggccucaggcucggggccgcagacgcgccuugaagggcacacggaugcuggggcugggguggggcaggagccacuggcuggggcuuugggagugcucaguguguccucuagggagacccuagcuggagaaaaggcaccucacccuccccaccccugcaaaucuggcuuggccguggcgggggcagggguggaggaugggguugaagaccccaccccuagaagaguucacuaggaagaaggcccaaccagggcagaggacccagaggagaaaccggacaagccuaugguaggcaaaagccagaagaccaugaucagggcuuccuggagaagccagugcagaaaggagugggagaagagggauccaccucacucugugcugccacccguccccccacaaggcaugggaugaaaacaguagcagaaaggacucagauugguggacaggaggaacuucccccuuggcaaaauuuuaggaaaaggcaaaaccccaucugccugaacuauuccagagaugcgaguucgguauccugugguggcugcagucuuggccccauaccuggcuuuaagccaagauccaauggucaagucuucugcuucuggacagggugccucugggagcuacaaccacguccgugaagagaugcucaucaaggcuggcgguggugggggcggggggugcaggcaguguggcauugaggcuccucccaaaaacauuccaacguccagaaagcuuucagucuguuaggcuccacaauccccucagccugggucucuguggagaauucaggccccaaauccuagccacuuacauuaaacagcauuuuacacagcaaaauaacuuucccauacuuugaccaccuugaagaaagcucccugcuucuaggaccagacacuauauggauuuauaccugacuccugaccacauaacccuucucaucagccaccccuccacuccuccucccucccgcagcucacaggacuaaggaccaaaggcauuucugggcacugagauccuaccucucugccugcagcuaugagcagacgugugguucggcaaagcaaguuccgccauguguuugggcaggcagcaaaggccgaccaggccuacgaggacauccguguguccaaggucacaugggacagcuccuucugugccgucaaccccaaauuccuggccauuauuguggaggcuggaggcgggggugccuucaucguccugccucuggccaaggugagggaucagggaaaggaagcaagugggaggacacuagcuggggccccugggaacuccugagccuuuguucucaccuaguuccauuccauagucaggagaagcaucuguguggauuggcuccucccuauuccccaagcccucaaggaccagaggggaggccaccccaccccacccuaacaucaggguggcuuacucccacucccuagcccucccaccucuccaugcaccaccccauucccagcagggaccaggaggggagccgggugauggagaugguugggacacagcacagccaagccuggccagauuccaucacugccucuccuaaugccgcauccccucauguuuuggguguggagaaccuccucccuagcccaagaugaccauuugauuaagucacaucccagagcagcaaacugaggacagggucaggcucuauccaaagagucccugguuaccuccaaggacacuugcagugaaguagaaagaaagggaacggaaaggaagggggacaugacacauaaagccagagcccucccuacccucaggauggggaccaggcaaugacuaccacguuagcuucauaaccuuaagccccuugaccauccacaucccaaggaugacucucccccaacccccaagguaugaccuugaccuggauucuggccccuacaccuuguuaggguaggcuccacagguggcggggucaggaagaggccugaaaaagccagugacucaccccagacaaugcagacaucauccugggacacagccccagggcucaaauuucagccggagcugccuccucccccaauaugucugcucuuucaguaccacauagccacccucucccccgcugccuggucuggaccagugucugccccugcagaggucucagaacccccacaagcagccugugaagaccaaaaaauagaugggcccccagcucccauuuggggauaguaggcaccaggacugcuugcugcuugugguuccaagguaaaagugguucacaaggaagagaucugccaagggaggccaggaaagggcuguccagcacuacacuauuaucucaccuugaccucuuccaccaggagauucccacagacacuucaauaggagaacaggcugaagaacagccuccuccaaguaggugucuuuggaagagcacugggcuggaaaguucaaaucucagcucuacaaguaucuuguuguguguccuugaugaggccaucuuaccucucugugucacagucccuaauauuaaauuauuucaacucugccuucaguaaagugcaggaaguggacuggaugggguuagaagugcagagagggaucugcaaagagaaaauagguaauaaggaaucgagauguaagcagaucugcuacccacuccccaaaaaacacacaggagaguagccccacaucuucuucuccaaccccucagacagggcgaguggauaagaacuacccacuggucacugggcacacugccccugugcuggauauugacugguguccacacaaugacaacguuaucgccagugccucagacgacaccaccaucaugguaggagccagguggcuacugcugggcaguugagcaggggagcagggaaggcugccucaccugugcuggggaaggugcuaagggugguaauaagggaggugcugggucccagggcccugcccugcccagcuccuggacuauuuuuagcuacaugcccacccccucccaggaugcacugcuuaggacuaauuauagccauggccaacuuggugccuggagagcagcagggcagugcucugaagucucccugcuggagugaaugggaggucucuggagagcuggcagugcccccuccuggcucccagcugcuucuguucuaggcaugcaccaccacaucuugcccuguauuugacccuuaccacucaagagagccaguaggguuaaaaaaaaagguagggaaggaguggagggacaggguggcuccucauuccacccaccauauaccuuuucuuccuacccagguguggcagauuccagacuauacccccaugcgcaacauuacggaaccuaucaucacacuugagggccacuccaagcgugugggcauccucuccuggcacccuacugccaggaauguccugcucagugcaggucugggggcuaaggaggggucccccauagaugggugggugguggcaaaggugggacccaggugaccaugccuggccacucugggcagguggugacaaugugaucaucaucuggaaugugggcaccggggaggugcugcugagccuggaugauaugcacccagacgucauccacagugugugcuggaacagcaacgguagccugcuagccaccaccugcaaggacaagaccuugcgcaucauugaccccagaaaaggccaagugguggcggugagugccuggccuggccacuccccagaaccccuugaccaguggccagcugucagcacccuuguacccaccauuaucagagccccuggucccggcuuucaccugucgcaucccugcuccagagacuagcccccuucccccgucucugcaaccacaggucucugcccuaaguaagcccccagccugcaauucucugcccggcuccuguucccuccccucccuugcaucucagaagcucagagaagggcuccucgcuuugggauugaggaggggagaagcuggaaacuccauccucccaccagaaccugcaugaaaccugagcuccuggaccccucuccucucagccggcacccagacgcaucuuccagggucuggggccugacacuggcucgagggcuggcccuuucuccuuguggacccgcugggcgggggauggggcaacccucgcgcguugcuuaucccagccggaugcccugggagggcggcggcccuggccucgccagccucaagucuaaccuggggugcgggugcgugggccgcgugcaugucugcguggagcaagcgcgccgagagcggucggggcuggcgccggggcgcucuaacccacuaacccggcgagcaggagcaagcccggccucacgagggcgcccgcccgcugcgggcugucuucaccgcagacgggaagcugcucagcaccggcuucagcaggaugagugagcggcaacucgcgcucugggacccgguaggccaggccgcgccgggcgcgcuagcucgcuccuucucugggucugccgggagcgccuucccgggcuguggcuggcgcccaagaggccagagcggagcggggagcucccauucgggaaaagccucgcugcgacuccggggagccagcagacaccccugcucuagggaucggccuuugagcgcgcuuaaggguucgggaucggcugagagccgcgugccuccugcucucuccaggcccggaugcucuccaggucaggggccagacguggccccgcaggaagcugagugcuuaggccccauuugucucuuccccgcauccgcuccuccaccccggacacccaagucagcaagcugguugcucaucccuccaugcuccucagggcaggcagcugggugaugucccucccugucucccccuccccccaggagagguuugcggcccacgaggggaugaggcccaugcgggccgucuucacgcgccagggccauaucuucaccacgggcuucacccgcaugagccagcgagagcugggccugugggacccgguaacgcagcuggaggcuuggggugugugccucggggacuggcaucacgggagaguggccaggcgccccccacccgcagggcaugcccaccuggacaggacugaaggcugcugccaccucugcagcgccugccauucucacacccaccccucugcccaguuuugcugcgucgcgugaaggauccugcgcuggcgcccccaccuggugaugccgagucccugggggugguuugcugugacugcaugcggcgcgcagcggguauaugugcaggggaggaggagcuaugugcgcaggggaggaggagagaugugcccaggggaggggccugcaacucuggucacuagagguuuggggcauaggguuugggaaggccaggaagcguaaaggggcuucugggggucccgaaguagcacgggaggguggggcagggcuggucacgccuccugugcucgggcagaacaacuucgaggagccaguggcacugcaggagauggacacaagcaacgggguccuauugcccuuuuacgaucccgacuccagcaucgucuaccuguguggcaaggugcucacggccgggcagggagaacagggcacuggauggagauguggagggccuuguccgggcgcgccccugaaccgacugauuuugcagggcgacagcagcauucgguacuuugagauuaccgacgagccgccuuucgugcacuaccugaacacguucagcagcaaagagccgcagcggggcauggguuucaugcccaaaaggggacuggaugucagcaagugugagaucgcccggucagcagccuuggccccuccugaacaccuacccgccucugucccccacucaugucggguccuagccacggggcuuccccaguaaugcagugcuuuggaaaagcggggcggggggauaagacagcucuguuucagugccagacccaccgcucacuagccuuacauucucaacuucaguuuccucaucuauaagaugauggugaacacaccaucaggguguuuuauugcagaaccaauaauguguguaaugugcaauaugcaugguaggcgcugagcaaguguuggccuccaacccccuuggucuuagacaggagaaguuaaggacguggaagucugcgagggugcugaacccugcucccuuauagguucuacaagcuacacgaaagaaagugugaaccuaucaucaugacugugccccgcaaggugaggggccgggagaaggguugggcagggcuacgaggcggaagggagcggagcaagccccgcacccucucacgcaaguccuccuguccacccacccccgcagucagaccucuuccaggacgaucuguacccggauacgccaggcccggagccggcccuagaagcggacgaauggcuauccggccaggacgccgaacccgugcucauuucgcugagggacggcuaugugccccccaagcaccgcgagcuccgggucacgaagcgcaacauccuggacgugcgcccgcccuccggcccccgccgcagccagucggccagcgacgcccccuugucgguaagaucggcccugcugcacucuggcccaaucuacaucucccccaaccgccccuauacgacacggccucucuguccuccgccccagcagcagcacacccuggagacgcugcuggaagagaucaaggcccuccgcgagcgggugcaggcccaggagcagcgcaucacggcucuggagaacaugcugugcgagcugguggacggcacggacuagccccgcgcgccaggcaggcggagcggggcggggcgcacaagcucggccccgccccggcuuuuagucccgaacuccggaccccgccuucuugggcugggcccgggggcgggacuggggagggaacuccgccccucgcgggagaccagaacucuuggagcuuaggggagacccacgucgcuccagcggaggcuggacugcgagccuc

SEQ ID NO: 16704 - RNA, 21681 nt, Homo sapiens
uuaggcccuggcucuggccuuugcucugcggagcuggcggcccccuggcacagaggugacaucucaagggcccaggcagcccucuucuaguggugccaagaggcggaggcugcgggcugcccuugguccccagcccacucgcucagcccugagguuucccucugcuuccccagggagcuugaaggccaagcaguccauggcgggaaucccugguagggagaguaaugccccaucugugcccacugucucccugcugccgggggcgccuggaggcaaugccagcuccaggacagaggcucaggugcccaacgggcaaggcagcccagggggcugugucuguucaagucaggcuuccccggccccucgcgcagcagcgccuccacgggcagcccggggccccaccccacgcacugaagaggccgccugggcugccauggcccugaccuuccugcuggugcugcucacccuggccacgcucugcacacggcugcacagaaacuuccgacgcggggagagcaucuacugggggcccacagcggacagccaggacacaguggcuggugaggaguucccucccuacccuacccgaggcccccgccccaccucgcgucgcccgccgccccccguagcuucccugcccucccgcccuugacugcucggcgcccggcccacagcugugcugaagcggaggcugcugcagcccucgcgccgggucaagcgcucgcgccggagaccccuccucccgcccacgccggacagcggcccggaaggcgagagcucggagugacggccugggaccugccacuguggcgugcggcuccuccccgcgccgcgaggccgcgaccucugccacguggaccgcgcgcggggcgcucccugguggcgauggcgcggcacuggccgagcacugcgggggcuuuccuccuuguugguugcugagugggcggccaaggggagaaaaggagccgcuucugccucccuugccaaaacuccguuucuaauuaaauuauuuuuaguagacucuggaguugagcuugugcaucugccgcacagagacucccacccggacccucguccuaggccauggaggugguguuugaggcagcccgcccccgcuggccaaccugucccuggacauggggcuuuaggaaugugcucgugggaggguggcguuaucgucauacauguuagcuuuguuauucgcaaacuaacucuuccacuagacagacguucccagcacaggggcuucccuagggcggggguccuggggcacuugcagucacccuucaugucugccaccucccuccagcccccauucucuaagcaucagaaacagcucauggucacuucuuuauuuuugauacaaauguacaugacacgucuugacagcccacccaccaccacacagguagggccuggcccccagggaagaagcgggauggggagagagcuggugggucccaccgucugccucuccagccuucccaggcugcagccagguucccaggccuccagagggugggaccacagcaggugcagguagugauggugggugcuggccuugcagagguuacggggaggggacucagcuccacagccaccagcugagucggggaccccggggagccagccccaggcucaggugcucaguccuccacccuagccagcacacauucccccuccacgcaggagcaggaggagauggagggaagugguuuuugauuuaaguucauagagaaggggcgagaguggggagggaucagggaggcagcuggcaggaccaaaacuggcuacccggacagucccuggcuccagguggggaagggaagcugauccccaugcuggucccacugcucugguccccucaccccucaaaacuccagauggaccaggccuccggaacggcacugccgcccacacacucaacacgcaggcacgcgggggcacucaguuaccacaaaguuaaaauuaagggguggggaagaagaaagaaaaaaaaaaaacagacuuuccaguguuugcugcuggggaccccagcacacagguuggggccugugcccuaggcaggggccauauggcauuaaagggagagcagcaaggggcugguggcuacagggcagggacauccauggagacuauguacaaaggaggggaugcccccgcucagcccccaguagggcugaacuggcucauggggguggggcgcauguacggagagcugccccacuuggaguguccccaccugccccuuugcugagggugcccuagaaggcgaggggcugggagugaugccuugcaggccccugcucacuaggaggggggagaugcuauauacagaggggaggugcauggaaugugggggacagaagcuccugcccccccaccuccccauccuuaggggcucgacaggggugggcaccagggcaccuggcugccagggaguguggcagcacuaagggcacuugugccaguggcucuguugggguggggauuaaugucuggaguggcccagcuccuauggccagugagguccuagggugcaggugaggguguggggagagaggucacugcuucuucucucggguggugauggugaccagcugcuuggcagccuuggcgaugucauaggcgcacuggaucaccugcugagucagcagcuggaaguccacuggggcgccgggcucugggggcacugucuuccggcacucacucugcagccgguaggcgcuggcguugagcagccgcagugagcuccgcacuggcuccagggcuggccucuggagggggcaggagugaggcuggaccuuggacuuuaagccaccagcugagaucagggcccaguuugucugugucuccacccagguagcgaucagaugggauucuccacgccugccccagcucgaggcccucccacuccugguccucucuuuggccccuguaccuuugggaagagggaggccaucucggucacagccaaauggaucuucucugagcagggcacgaagcugcggggagaagggaggcuauaaagcagggggcucucaagggagguucccagggacagcagaacccagggccccucaugcucucugcaacacccuagaagccaacaggaacugcaucccccucaccucccccuccacucaguaccugucaugcuugaacuccugggcugcccgcaacaguuccugaauguucuuggugaccugcucugucuucaagaugacauccucugugcugggaagcccaggaucuaggucuccauccaggcuuuccagcucuggguggaagucuuccucuuugcccagcucuagaaaccucuucccuuccagccugaggcccagguccagaaaacagagacaaagauacauauagagaaagacacguuccagccucggagccgcccgccuugguccucacacacugggggcccucucaaccuccccgccucggcaugugagcaggcuggacuggagacccagggagccucaccccagcaguggguccccacuuugcguguucucauagucacugucggcuccacugccguggcgggaaagcuugcucuggagggcggagggaaggggcugugagcgccguguuccuggacccacacugccccuagcccacacggcccccagccacccugugggcacugggcauggaaacauuaccguguggcggcuucccuccugggagcaggacagcagcggggaggagggagugaagggcacagcugaggcagacaccccuuuccggaucugaaacccagggcagcgcuggauggagucagugugccccacugccccccugcucaccagcagugcagcagggaccaggucagucuaaucaucuuaagccccgaauucagcacagagcccagaacccccuggggcucagaaccuacuggcuaagauggacacgccuuccccaggcuuacccgguaaaggccagcagggacgugcacugaauagauggcgucguccucuagcuccuggggauguuagcacagcgagcgucaugguggacccugcggcagccccacccaucuccccacaccuugagacccauaggugacucacagugcuguggaaaggcugcagccgcguagugagcucguccccaggggggcccccaaagggcuucagggcagagccagguucauacauggaaaaggccuggcgaucccugcggugugugcucccgccuggcgccauggguguguguuccgcccguucacuggggaguggaggugugggcaccggcccuggaggcugccggagcugcagguucuccgccugcagcuuguggaucuaugggugcaaagugcugucaacccccuggaguccuggggcucccccucccaccgaggcugcacccucaccucucgcugcagccuccggagcucgucgcucaggcuacuguugaccuucaugagcugcugcaccuuugccuccgauguagccagggccuucuucagcuccagguacuccugcagcgucacagccccgucagacaaguccgaggaguccaugcucugcagagagagaccuaagcuggucagcaccugggggcagggaggccaacacccgcagggggcaguuauugaggcuaggagcagcccaccugucccucaggccccugggcuacaagaggacagagcugggccucagcgaaggccugggucagggcacaggggagugggaaggagggugggacucagacccgggcccgguugcuccgaguggcgccggugcugcgcaggggcuccuggucuguguccucgucagaggccacgcugucguagucguguuggucgucgaggucacucuggcuccgcagagacagcucgagguugucugaggacacaggagugucacucaggccacacuccaccacacaacccaucucucaggucaccacuggcagggagagccaugcaggaaagaccccuggagccccgccugcuucccacacccucccacacaacccucccaccuguggggcugcucaggcucuugcccugcugucuccgcuuggccucacugagaaugucgaugaucaagguggcaaacucucgggcauuaaagcgggccagcuuuugucgccccugcaaggcagaaagggccaggcuggcuucaggggaccccuuaugacugacgcaggacggcagggaccaaguagcaaggcauggcucugccauuuaauuuaaccccagcuaaagcgucccagccuagcuucaccuggcuagucagcagccaaggccacccguggcaggguaugauagaguagggugccugagcagaggccggaacacccaccggagcugcuccccaagugcucaaaacaacagccuccugaccuucccaaaucccagugccagcugugcccugagggaggcccuggcaaaugcuggagagcuggcucaggccccagcccacugccggaugaggagggaccgcggggaugaaguagaccaccccaggcccccaauccagcccccucaccugauuccgcguggcugaguauuccggguuaacaggcaggaagggcacggcacugcgcucugucaccagagugcugugguuuuggguagccagccacacuguaggggacggacaggagcagaucagccacgguggccaggcccccaagguggggguggggaagcacugagcccagccuuccuagcugcccccacgccuacugagcacugguguucagaacagggguggucuuugggcacgcagagcuaggccgggccagggcaaggcugggcguggccggcuggggacagacaaauggaacaaggccagugccacucauccaaacccagaguuugggcuggaauccggcuguggccaggaaggagugaugcagggggguggagcgguaccagggagacagccaaagugggaggcugccagagcaagaggagccccagucugaggcugggggaggagcacgcuagccgccucccccucagcacucuacccagccugggaugcugcccaggcaggcucacagccagcaggggcucaucugcaggccucugagcagccccaaccccaggcaccccuucuuagcccaguaaaggaccagagacccaugccugggccgcucggguccuccacgccagacacuccugcucccugacucaccugcaucauuuucucuucgauccaccucgucauacacguccauggcgaguuccucaaaaagccgguugcugagcuggaggaagagaggggcccagauguugucagaugcaucggcucccagugccaaggccagcuccccagcauguugugagccuuggggaaccgguggccuuccuugugcugcccagccccuacagucucagaaugggaaaguggaaagggaucauguuccaaacuccaaggugggagagaagggaccaguccauccccuuguagggaggucagggagaggggacugcugaggccagugaggggacaggucaaagacuuggaaaaggucaucgagucagaggcagaggaagcaagagcagagggugggggaucagagaggggccagcuucaagugucagggcacuguuggagcagacuuaccgccugcagcuucuucuuagcagcuuuggccaauucggauaagucaaggcugagggcagagggagaugggaauugggaggagaggagagaccugagagguggccaggcccaugccagcaaccuccccaacaugcagggaucccggggagauggcaccccagaugcugcacaccaaaugccuccccgcccuaccccaccuucaggccugcugccccggcaggcaccauauaccucugagacaugcacuuuugccgagaucuaaguccagaggaaggcagcagagggaagaacaggacagaggcggcaguuacccaggagcagggcagcacacgccuuuucacaucaggcccagacccaucuccacgcacacccggcccagaagggacaaagcugaauucaucucaccgcgucccccaccccuccuccucuggcuugcucuuccucucagugaccuguuuguccaccaccagugucagccaccuggcagucaccugaagccucccucacccuccaguccuagugaagcuccccagguuccucaaucaccuguugccugggcuuuguaaguuucuuaaucucccuccuucuaguuuugucccuacaauccuguuccacccagcagccagggugauuuuuuggauacaccuggcugcacuaccccuugccuuaaggcacugcagugauaacaggugcauauggcacacuccaaacauacuucaucagaauacccuagggacgggcacaguggcucacaccuguaauccuagcacuuugggaggccaaggugggagguucgcuugaggccaggagguggagaccagccugggcaacacagagauacaaaagcaauuuaaaaauuagcugagcacgguggcaugugccuguagucccagcuacucaagaggcuaugguaggaggaucguuugaggcugugguaagcuaugaucaagccaccgcacuccagccugggcaacagagcgagaccccaacucuuaaaaaaaaaaaaaggcuaaacauuuugcauacauucuuaucuaauccucuccucccugaaaaauagaugcugucaucuccauuuccaggagagauaaccaaggcucagagaggucaagcagccugcaagucacacagccaguaagcagcagagaugacuucacacuucugugccuggaacucuccgcucucgggauggucacugcuccugcugaugcucucggggcugcucauucuccagcucgucucuaucccagucuugcuuguaggguucccugccucccaugcugugcuccagcccgggggcugccuccauucccaugcagcauuucuacccuccaugccucugccucucuugcugcacucccccaugaggacuagaaucaccuggcuaggcugccuccccagcuagauugugagcuccuuaagggcagggauugugucucagcugccucugugcucccagugccaagagcaguagcuggcuccgggaaggugcucaguuaaugugcuguugaauggagcccauauuuggguguauuuaccauacacaugcacgcaugcacacacaacccagguagaaucagaccauagaaguaggagccuuggggucuggaagaggucuggguuuaggaucugagucgcccaggccugguuaugcccaucugcccacacaggcccuuggggaggagagcaccuccucucuccagauccaggccagcaggcacagccuggcaugaggacauggccaucagagguggccaccagguggcaccagcauccaucuuaugugcugggugaguggcagggggugucccacacugccucucagacggaagcagaaacaccucauucaaccagccucagcgcacgugccuaauucugagcacgcuagaggccuagccagcagucacaaaguuagucacaucccugaagcccacccaucuuuucagcgaagagcagaggcuucucuaaagacaguggggucggugccacugggacagaacccaguggcccacccucccagccggagguagcuucuguuucuuuuucuuuuuuuuuuuuuugagacggaguuuggaguuuugcucuuguugcucaggcuggagugcaauggcgugcucucggcucaccgcaaccucuaccuccuguguucaagcgauucuccugucucagccucccgaguagcugagauacaggcaugcgccaccacgccuggcuaauuuuguauuuuugguagagacgggguuucuccauguuggccaggcuagucuugaacucccgaccucaggugauccgcccgccucggccucccaaagugcugggauuacaggcgugagccaccgcgcccggcccacagguagcuucucacacccaagcccuccauguacuugacagucacggggcucaggcuaugcgggccacauauggagcugacauuuuuuaccugccuuggggcccagcauuagggacugaggacuaagcugugccucuagucucuggggggagggagcaggguccuaggccucugaaaccugggcugggagcucugggggucagccacccacauggcauccaacagccucuggaaaggggcaucaggugggcacucaccugucagccaucugugggaugauguaaugcccauucuugugaucugaacaaaaauaaaaaugccaagucacucacuagugcuggguggccucagcagcugggagcccaccucacugccaugagcagggcuggcacccagaagugucaggggaaaguggggagggcaggccacccccaagaaugcugggagcucgugggaggaugcaggaugcccacccccacucccuagccccagcgaugcuauggcccagagccugcaguaauuucacaggagccaguugccuagcaacauugcuccccagccgcucugucaccauggcaccugcugccgggugcguccaggucccaccugcccagccccagccaggccugucacagccaggcgccccccaagcucugcucacccggcuugcguccacagagguagaaggccagccggucagugagcucauauuggcacucaaccagccuuuccgccagcucauggugccccgccugccugugaggaggggguauggcucagaccugcagcagcagcccucacccacacccccacccacccacacugcacccuucagccgacccucaccuggcauagucaaugggugugcggccauuaacaucaggggagccagggucagccccauacacuacaagcagcucggccugcagugucuguccugccuuggcagccacgugcagagguguggugcccuucucuggguggaagaaguuggccugggcacccagggagagcaggcgcagacaugucuccagguugccuguccgcacgcucgaguguaguugcuaagaggagcagagugugcagugaauacgcaugugcgugaggcgcaccuccccacccacaagcugcacccuggcugccccugggacaccuagcagcuccaaggaggccugcccaaaccagacuaugucgggaggacagaggcuucccgcuagggguuaaugccaauuaauaaacgcugccgucagucaccaucuaccacgugugcugugugcccugcuuagauacuauuuaugaaguagaugcuguuauuucuuucccauuuuacagaugaguaaacugaggcuaugaguggcuaagcaacuacccccagguuuucccagcuucugaguggcagcugugggcuucuagccuugugugucuacuugguugcuggggagccucagccacacacggccugacccaacaaucugcucucuccacccugucuacuguuacccugaccuggcugccuuuggggcccagggcucaguggggacaaaggagaggccuucagagagucguggaugggaagaagaggagggggccacccaucuguuguagggccccucaaaccuugcugaggucuuuggcggugacuccaucaucgucccggcagggaagcuugugcacaaaugccagcaucugguacuuggcccugaugaacucugacuugauggggcugcauggggcacacaggaggaauggggagcauggugggagaggguggucaccuugccaccucccagggcccugucccggacugcgcagucucugcccaccaccccuccagccccacucacuggacuuugucuuggggguuggcuuuacgccggccgcucugcacuugugcgggguccagcagggagugcucccagauggaguuggccccguugcuggcaagcgugugcaccaucugcagggaagagaugccaagugagagagugcccacugcgugcuaagcaaugggggaaacacuuccugagcgccugcuguggcuggcguagcuggaaacgguaccaagggggccuacugugugcccgcaccaccacaccuccaucuaguccagcugcccaaagacacagaucccaugagugugccaaggcucagagaggugaagcaacuugcucaaugcuacacgaccacguugauaaguggcagagcaggggugugagcuacucuucugcaugaagugaguagaugggaggaaagggucaggauuagccucugcccuaggggggugcugccccuuggaagcugcagauuccagauggggguguaugugggugagggggaaacgcccucaugcucagcacacucugccugaggggaaggaagaaccacccgacugagcccuguaccugcagcagcgugggaggccaggcgcuguggcgaaggugcuugacaauggagauguggcgucccaggcuccggugcacgcugcagcacucgucacacaccagcacaccccugcugauggaugcccagccagggucugccagggugagggcaagggucagccggagccagaugaugggccagaccuccugagcaccugcucuggcccgugccaagccuaguacucuccacacauucacucacucagucuccaacagccuaggagcugggaccaucacuacggccagguuaccagugagggaucuccccaagagcucacagcugggggcugacagagccaugcccuuuccuacauccuuaccccucugggauaugcaguccccagggcccauucagcaggcacaguuuccugcccugcagccacugcuaccagucucucagccuuuucccaggaaacgaggucucugccccagcccgucccgaagggaggaagggauccccaaggggaugcaacccagaugcugcugcaugccagaugcuguugaaacaugccugacagaucacacccguccacagguccugccucuggccuccugccagcaggugagguccuuucaugcuggagccuccugccaucaucacugaggguguaagcuggagcccucuuaaggaagauggacagagcaaaggagcugggcuugacugggcacccacuagguaccagcuggguacauuaugugugaugcugcuugcaacugucaggcaagguaggacaugcuaccucugugaugaagaaacaguggcucagagagguuaaagggcuuauucaaggaugcgaggcuaaugaguagaauugccaggauguggcacuuucaugccugagaccaugccauguccacacuugcugcugucccucugccucuauagccugcucuccacucuuuugggaaaagugaacuugggagaagaagcagggccaggacugggugggaguuccgggguucuucucaaggguggaggagaugccacccauccuaggccccuugggagacagcugcauacgacucaggcugcggaaaggucacgggggagaaagcagccauugugugccgccugagagugggggcagggcgccucucucccaggacacuuugcucugcccagcggcccccacccugucucaggaaacccuguccuggggugggggugggggacuggcucucugccuugcccuguagcgcucaggguguucagaaguauccccaucaggggagggacaggcuuagggggauaagaaucucucccaacuagaaggcaauucucaggccuuuccccucuaaggacuuccaccaaaguucccaggaaaauugaggagacucugagucaggggcccagccugagcucugcccacagcaagugacccccacugaggcaugaaaacaggaaguaaaggagagaggccugucuuuggguuuaggcuuuuuuuuuuuuuuuuuuuuugagacggagucccgcucugucgcccaggcuggagugcagcggguuuaggcuuuuuaagggacccccucccaaucagggcaacagagggaugcccaaggugaccgccaacaccuuccuggggggcugacuccagggcucaggaggaagggaccagccuucuucgccaagagggggagcccuagcaugcacuucugggcuggcuuuacccaaauagugaggcaccccagguguggagaccucccucuccccacuccaaacaccacugggucagggggcugccagccagccaccuccagcagcccaggcaggaagccggaaaugaugcagcccaaauuccucuuggugggguuuccuguaaguggggagccgcccagggcaggaucauaaaugggcugaucugaggucugugguccuaccggagaagccaggcauggaaggcugacuauauauccacggccaauggcuccagagcccuaagccaugggcagaccagauguggugagugacccuggcuauggcaguaaccaagaccaggaugcaggagugugguccaaggguuugccuggcacuuucccccagccugggggagggguucuccuucuccuccaggugaccugagaagaaugguaggcaaaggacacuguccuggucugggcagccgcuauuggugucagcucauuucuggaugacacagaugggacgcccacccuaaccauucugucuccucccucugugcaagugcccuugggacuacccagauuguaguuuaaggugaagggauccuugcgucaagaagcuccuuggaccaaaccugggacggaaaggacaggaacuguaagggaacucgucagcccucccccugcgcuucuggcuccaccggcaggguaugggucuguauguguggagagguagcaggcgugauccugggaucacguuaaccagugccaaccccauggaggccucuacuacggugaauuccugccaccaccugaagccaucaguggccuccagggccaguagguuugcacauacaggcuagccucaggccucccuccccugagcuaagggccagaucuccacuagacuaagggaaaagcccacaucaugaaggcaggcgagaguaguccuugggguagagucagaauggugguuaccucuggggugcacggacugggaggggguacuuggaagcccccuaaggugauggaaauguucuauaacaugcuugucuaaccugcaguccauaugcggcccaggcagcuuugaauguggcccaacacaaauucauaaacuuucuuaaaacauuaugagacuuuuuugugacuuuauuuuuuauuuuuauuuuugcuuguuuuauuuagcucaccagcuaucauuaguguuagcguauuuuagguguggcccaagaaaauucuucuuccaauguggcccagggaagcaaaaagauuggauacccuuauucuauaacaugaucagagcaguaguuacauggguauacacacauguaaaagcccaucaggaugaacacucaggugcaggcauugacacacacaaauucuaccuccauaagggaggaagaggagcccaacauuugucccacucugcaaucuacacuaugaagagacaaaucagccuguagcuugucccguaacauguccccggccuugcucaccagagauaccuacaggacaggcaucuugaggccuucacucucacccccaggguugccaaaguggaaaaggcugagauagaagcccauggggugaggagaggcccuugacugagaucguguggcgaggugggccaagccuaaggaaaggggaagaugcacauucuccagggcucccugcccccuuccucucuuggacuccccaggcaggcaggaacacauacggugccugacgagguggcacaagcugccagagcagccaugucauguccagcugccuagcaacacacucacacuuguccugugugcccaugcccgggagcagagggaggauggggcucucuggggacaggcugcaucucaccucugaccuccaugaccccccaaauuaaccaagcacaaaaagucccuggccccacuccugugguuaggacugcagggcuccuaucauaauaaaagaagccugugacccugggguggagcgauacaccauggggcuggcacuggaucuggacuccggacugcuggguacccucaugccucucugccugagaugccacaggacccagaccaaacaugccgcugcaugccagggccagcauccuaggguccaggugugggauagucccaagcagccagccaggguccuaacaagcagccaaacacucagggagugccugccaugugcuggacaccucgcugggugcuaggugggcugaugaguaagacuguccacauccuccccaccccaccauccucaccuucucaccaccuuccugaccucuauugugaaucaggggaaaggaggcaucuggggcacaaauuccucugacagaugaggaccugggaggaggagcugggcaauccaacacaucugaugcccaccauuccucccugagcccacugggcauccagaggcuguggucggacauucaacgcaacauacaaaggacaacugccuugcuggugcugcccuucaccccuccaccccagaaucagaccacagauucggagauggcagccccccaaaaaccauuucuacuccaacuucuuugccucugaauugaggaagcugaggaccccacagugaggaaagucuuguugggauuacagaguaagcugggaacaaaggcaacacuaagccccagacucccccgauugggcgccugcuaagacucuccuccacauuccaugccaugcuuaccccacggaguuguggaacaguggggagacauuuauaaggcaaggugcauccucagcccugccauccccagaccugccugcagcucggggaacggagucacaguuucuuagggguauggacccucaaccccagggcccucuaaaccaugauaagccccuaggaggccuuggucauaaccaccuauggaguauuuugugcccaagcccugcuaagucauaguucccaaauacucuagcuuggcacccccagaaccaccagagcaucugugaggcucaaccggugggguccugggccugcucaagggguggcugaaaguuaugggcccacaaaccagcaccccauacucucacucuuaaucaugcccacagccccgcuagaguucacggaccuccgcagccugcccaggggccuaccagggagauagcuccuuugcuaaagaaagaauggaugugggcuagagcuuccuucccaggccagcugcagagccccgucacuggcuguccucccucaucagaagggagcagccucuuggaucauuaccccugacuuccucagcaggccugggggguuucacuccagcccaguccuaacucuguuaggaaaaggaagggaaccaccauguaaauacagccaggagacaggccaggaagccagcaggauacggggaaucucggcacggccucccacccauuucuggccagacugggcuaggggacagggaggggcccgcacccaggauagcuugaugccaagcucacuuucccaagcaggccuuaccggugaacaggaacagcaggguccagccgagcuguucccagucaccaccagcaggccuggggaugccucccgagaagacacccgggucuagacuggcccugaacgccaggcccggcaaggagcgcuagccuuaggaacccgaggcagggaguccugggaguagccaccgcucaucugcuccugaggagacgguauucaggccccacuggcgcaucugcccggcccucugcuccuugcccuccaccaccccggcaggcguaccgaccacgcgagcagcaggugcaagacgcggggguggcacugagaugacauaaaaccacacucgcccccaccucccaagcccugacggccuccgccacggcccuccugccaccccaggcuggcgcuuccgucggauacagagauggagguggaggagcagccagcugcccgccucccucagaccgaggagcgggaggcggcgccgggaacguccuuccucgcuaguccacggccuccagggagcaugggcaccccaggccggcccucccgccaagggcgcagcuccgcaguggccgaggcgggggcccagccuggaggccgcagccccccgccccgcccagcccuccggccccgcacagcgcucuugccaggccccggcgcccgcccggcggcggccuggcugugcggucccgcccccggccccgccgcgcuuacccggggcgcugcaguccgcacacaccuccgcucgcggccccuuucgggacauccucagcggcgacgcggccgcagcccucugggccagcguggggggcgcgggcggcgggcccgggcggcggcggcggccccugcugcccggcccggcuccggcgaggccccggcgaggcuccgcgcgcccggccaaccguccgccccggggcuggcccggaacccgccgugcccgccugcccgcucgcccucgggcgcccuccgccccgcgccgccccgccgccgcucgcggcuccucucuccgcccccugcgcggcucccggccgcuucugcaggaagcggcgcaggcccugcccacagggggaggggccgcacccccgccccgccgcgcgcugccggccgcgcccccuagagaaaggaagcccgggcgcgggcaggagggggcgggggcgcuuaaaggggccgcggcagaugcccggccccggcgggcagcguggccugcggcccuggccuccgcugcagcgcucgccuggcccggaggcaaugugagucacccucacagcccccuccccuucacuuuccgcgugggguggaccgggggacgcugggcccacggacggcgaggguggggauuagggaagaaggacuuggaggcccaagucccgcuccaggucaaaggggcugugccuugggguacccgucuaucucugguuggggugaggugugcgucccugucccguagguguccacaucuguguguccagggguguguguguaugugucacacucuugcugaauacgcccacugcuaacaauauggacgcccaggugccagaaaggucaggcaguguauuccccugccuccggacuaaaaauauaucuaucucuccaugcauccuuccauccagagaggagagaaucugggcgguuuuuaaagaccucccgaggagugaccacugugccugugugcacucacauccacuugucauccgccuuacacacacccacgguguuucugggccaccagagguguguguguccagaaagggugcauauaacauagaggggccguuucaggugacggccuuucuuccuggacuucacacgacgaggcaggcaaaggcaaggcaggugagggacgugggugggcuggggggcagggagccuagguagaggccgcacaugagcgcagcccccgcacugagcaugcgcccccauacgcgugugccgcgcguguacccaacccccaaucccugcagcagcaaaaggcccgggcacucugcuuguggggagaggguagagguccccagggccagaccugggggccaggucaguggugacaauugaggagggguucuccaagagucagagacuccugcuuguuaagaugggggcaguccuuuggcaggggugcucaaguuggucgauuaucccaacggugccagagcggcagugauuugugggugggcaggcuccuucccuaggggagacaaguaaugcucaugagucacaccacccgaaauacaugcaaagcugccuccaucgccuuuugcugcggcccagauugacaaguuuguuugaaaucgcgauccaugggcuuuauuuauaauugcaccuuaaaaaaaucuugcaggccuccccucccucgacagccagccgcucagcugguggggcuuuugcaagcaacgauaccuagcugguguguaggggggagcaccaccugccgccccgagcugcucucucaccagaguccaugggcuugguggccucagcgggaaggggguaaggggcggggggagugagacgggaggaguggccaggcagcccgugccaggcgcucaguccacgagcgguggccgcccguucacccccgaucgacccccagcuauggaauuucauuuauuaaaugucgaggaggcugcuggcagcccugccgcuuggcugucuuuguuucuccgcugugugggcgcgucucgagcacguggcagcugagagcgcgggccgaagcgcaagcgaccuggguucagugucuaccgccgccuggcaaaaaaagaacacggccgcccaggggacaguuccccacaaucgacaacuccccacaauccauccugaacucccccuguccucggacuccugggcuuugcuggggaagaaggaugauucacucugcuuaccccuccaccccacuccccaucuccugguuggcucagagacuaccugggaguggcccuggcgcggacacaucguccaaacuuuguuucccccagccccgucacagccaaacuucugggccugggacuggagauaaaaggguuucuggauucccccguggagaugucaccaccccaggaagcaggacugcuacaguggaaucacacacaagguucgaaaaacaauuuaauaaggaaaugcacaggcaugcucccggccacuccuagaugccccucaaccgcgccagcccccuccccugcacuggcugcagccacgacacucugcugaccccugguggugcaggcgggcagcggucccgggcccccggagacgccagcuggcuccucccaggcgggagaaaggggcgaggcagcccgcuccucccucaucucuucccgcuggggccuggcaccacaggguguggaggaggaaggagggaagaccacacaaagaaaccugagagaguuugcaagcuuuugcuggcaccucccacacaaacacuucuuggauuguuguuuuaaguagggccgguguggaaucccuuauuccugccuuguucugaggugggcucaagaaggcaccgugccuggucccgccaccugucucggcccgccugguugggggagggaggcgcuguuuccagggcagucauuauccuuagcucaccccaggagguaguaucuagauucucauuuugaaggggaguggaccgagaaagucggaaaaauuaagcaguuugcucuuuuaaggucaggcaguuggagcuauucgaacucuggucucucugacaucacaguccccucccuccagggacugguccaagccucuugguccuuccaggccuugcaauuggcgcuugagaggccaauucaacuuuuaccacacccucugcagggaccauucuggaaguaccucuucacccuggggucauucaggaaggagacagucucuggaaucagucacuucccuuccugaagggccagcuggguggaggaacggagcugccaccugcugcuuuuucuguccaaccucacucugguucuugcuggggacagugugcggggggaaagggaccaucuuucccgcguuacuggacauucuguuuccaaugacauguguggaagauggaguuuaauuuucuaacagggcagggaagacuccucagaaauguuccaggggccagaccccuggcugcuccaaugacccuugguacugaugccccacaccuuucucaggaguucccaaucagacgcucucuucugggaauccggauccuucuucauggccccugggacccaagcucaauucugaagaccacaccuccaccccgucucccaaacgcucgaccuaggcccgugcccccccacuuccccagcaaaaggcaaaaugccagcgggggaggugcgucccagcccaccuggcgucagggccccgcccgcgucugggccaggccugacuccccgcccacucucccacgagauccggggacagugcagacccucuucggccaccugccacccccaguuucacgaggcggacuacaaaccccaugaugccgcggggcugagcugacaagcucuacccggggcgccugguccccuuccucucuccccaucauccccacauccccguaucccgcgccggccgcucgggcugagggccgggcuaugcagcuguggggacccgggggcugcgggcgcgcgucccugcggcggcguccccggggcccgcgucccgugcgcccccgcgcccgcugcgggcgccugcucccuccgccgagcggcgucuuugugugcgggggugugggaggcgagcgcgaguccgcgcagcgccgccgagugcccgcucccucccagggcgggugggggccucuccgcgccgcccgccgccgccgccucgcgaggacgcccgucgcccgcgccgcccgcaccgcgccgggcgcgccgcccccgcccgccgccgcucgcacaugcccgagccgcagccccgcgagcaggcagcgccggccccccgccccgcggccccgggccccggcuccggcgccgucccuccuccccggccgggcgccgcggccccggcaugaggagcgggcgaugauccccgccaacgccuccgccaggaaggggcccgagggcaaguauccgcugcacuaccucguguggcacaaccgccaccgcgagcuggagaaggagguccgcgcgggccagguaggagcgccuucggggcgccgcggggaccccgcggccgggcacgcccguccggccuggggagggggugcggcgcgggcugu

SEQ ID NO: 16705 - RNA, 7009 nt, Homo sapiens
cucucggcagcgcagcacgggcgagaugcaggcggcgccugucacguagcuggaggagccgcacucgcccagguaggacaggagcagcgccgagcccgagccuucgcucaccgcgaacagcggcgccgccgggugucggaagcggauguaugugaccgccuccuugaggucggacggguccccgaaaggcugcagccgggggcugaccagugggcaaccgugguggccgcggcgauggaagaugaccggguaguagccgcgcuccagggcgagcaagcaaaggccgagcacguugcgggugaggcgaccccacgcauuggggaucaccagaagcaccgcaggaaggcccccggcgcuggugauccggcggccccgaacacaagguccuaccacccaguccagggccacuagcccaucguccgccaacugcagguacucccgggccagcucaggcccaggcgcuacgggcaggacgaaguggcagagggucugcagguggggcccggagaaccaggagcgcgggccggccuccagcgccucugagcgccgcagggcgcgcagcaggcacugggccagggccgacggcuugcaaacaaggcugcacccucccggcaguggcucgcgcccgucgcugaacugguccgccgggccuccgccguccgccuccuccccgucgucucggucuugggcccccggcaggguccucucuccgacggcgcgcccccaggguccccggagccgcgggccgagcaggccgagaagggcgagcacggccaagaugagcgcgagggcggcgccccacggcggcauggcgaagcuggagagccccggcgggcagcgggcggcggggccgucuacucggcgagcuccgcgcuuugcccgcggcuccgcccgccggcggcggcugcccagggcccucccgcgcgggcgcgcucuggauuggccguggccgggcagaggcagccaguucgggcccggcugcccucgcccgccccccacccccgccccggcccuuuguacagcaauugcaacaagugggagcagagggugagaggagccggggccaccagggagggagggcgcgccggcagccggaagggaguggggagggcacgagccggggagagcgguguuggccauggagacguggggagacuggaggccgaggcuuggggacccgacugucaucagggucuuccgccagacccugggcgcugcgcccucagaggccgaugaaaagaagcagaagggagaggugaguaagucgcagcuccgggcgccggcucccgggaccccguggggcggcggccgcgcgcgcgcucugcccucgggcggcccugcucucccccgcccggccccgcaaccccgcaauaacuuggcugggcgggguccggcacugggcuagagaggucgagcgcggcgucuugagccgcuggcgggaggcugcugcuuccccgccugcaucagugcgggucccguggacuccucgcccccguccccgcgagcucggggcuccacaucaaggaaauccucagcccgggaguggcuuccccagaaacagcagccccaagccuccgagagucagucggagaaaaggacacacucaggcgcccugcgacagggaugcccguccgaccuacaaggaacgccucguaaaccggggugcaugggagaccacggaaauaacacguucucgcuguuuccaagcuuugggauaggcaucucgacccucgcucucuacccacguuucccccccaaauccuggagagggaaccagaaccagcgccccgcugcggggcgggccggccagcgcaccuccugggggugaggccuguggcguccccaucucgcggcgaccaaucucuuucuagacgcgcgccugccaccgcugggcgacggcggagguggggaagacagcagccucucggcuagcuccggccucccggggcuucuggguuuggagaguuuggggagcggagacaccucccgaggcuccuccgcguuggacccuauuugcgagggcgggagcggggugggccgacggcgaagcuccagaggugggacccucucccuucagcagcucuuccugacuucaugauucugccccucuucucauugcaggucacaccgacaaaucugaagcggguuugccaggggaguguacccgucuccccagccugggccacccgguccacagggauuccauuuccggccuuacacuccgcuccacgaucucauccaggcgcugcagcugugcagcugcucuacagacugcagggaccugcugagacgaauccccggacgaggaaaggggccccccgccugcccuacugagccuugcgcgcugacccgguuccuacacuuaacuuuuccggcuucggguuuaagacgcgugcgcgcacacuccgcugcugugggcgggcauuggggcggggcgauaccgggggcccacugucuggggaggggcgcgcgcgagcccagggccaacggacgcgcgggcggcgcgggcggcgcgggggcgcuggggcuggaggggcggggcgcgcgcgcucccucgcuggcggagcggcugggcggcgggccgggcccggggccgcuuggaauggcgccuccuccgccuucgccccaacugcuucuccuggcagcccucgcgaggcuccugggucccagcgagguaaggugacccgcuccugggaaggccucggcccgcgagcucaaagcgcuuugccaaaaguucguccuggaaggaguggcgcgccgagggggacgcggaguucuuccgcuggcgggcugggccuggggagagagagggcagggccucgccgcguccagcgccccaacucuucgcuuuggacccacaggugauggcuggaccggcggaggaggcgggagcccauugucccgagagccuguggccucugccuccgcagguaggagcccuggagggcccagggagagagggaugugaaaggcuagcccagucccgcucuguucucgccgcacccuccacagucaccaucugaggaccucugccgguuccucaguccucaguagccaacuucuccaucccagccuggcgcuuggggccugccguccccuccccaccacacacacacggagucccccaacugcccuaagcucuguucuuuccccauguauaggugucaccaagagugaccuacacacgagugagcccagggcaggugaguacaagcaggggcccaccacccuugguguccacgccuggagacaggcgcuccuagcaggcuucgcugccuguucugcugaucggccccauuccuuaccacuucccucaggcagaggcaggguucuaguucucugccccaccuccaagcccaggacagaucagccccaggacagauggcucaaagacagugagccauaggccugucaucugcaaugcugugucaggaugcuguuggguagcuggcucuguggacaaguggcugugaguggaacucucucugagaguagcuggaaaaaacccaggcuccagcucccugaggagacagcgggaagucuccugacuuugugggccccagcuuucuguaggagaggguauuaauucugucucuaccugugagcagcgagggaggguaugugccagcaccguguacaguacagagcugcaucgugcaaggagugugccuccaguugccaggcuccacacugcgggcucagcuugcgugguagcaucuccaucuucaucgccagcuccucugaauuuuccuuugaaauacuuauuauuauuauuauuugaaauggaaucucacucuguugcccaggcuggagugcaguggcacucacugcaaccucugccuccagguucaagcaauucuuaugccacagccucccgagcagcugggauuacaggcgugugccaccuagcuuagcuaauuuuguauuuuuaguagagacgagguuucaccauguugcccacgcuggucuugagcuccugaccucaagugaucugccugccucagccucccaagugcugggauuacaggugugagccaccaugccuggccugaaauaccuaacuuaaauuggccaggcaugguggcucacaccuguaaucccaguacuuuaggaggcugaggcggguggaacaccugaggucaggaguucaagaccagcuuggccaacauggugaaacccugucucuacuaaaaauacaaaaauuagcugggcgugguggcacaccccuguaaucccagcuacuugggaggcugaggcaggagaauugcuugagcccaggaggcagagguugcagugagccgagaccaugccacugcacuccagccuggcgacagagcgagacugucucaaaaaaaaaaaaaaauucucuguaauagcuccaggccaagaguuguugccucacgccaccuaucagauuccuuuccucaaacagcccuuucaugaagucauuccucuguucacaaacugucaauggcuccuuauuucccaccuuaucguggccauauucuccggccuggcuuuucaggccuuacuuaaguaagcuucgucugaccucuccacauccuugguuccucuccaguugugucgggcuguuugccacacaaaugagugccagccucgcccuuaccacagccccuuugcuccuguuuauucuccuccacaccuggccuauccugacucggagagugcagcucccugcccuccugccauacucccccagccaucuucccagucccagcuggcaucagcucccccugagacacugcccgauggcaucagccuuuauuccuccccuccuccucugaaucuaucucugauaauuuaacaacuaaucacuaaguuuuauuaguuugcuguuuuauuugcauuaguuguuucccugaguuucucacacacuccuugcaagcagaguccaggaguucuuuggcaucucccacagcaucuagcacagcacugagcaccaagucaacucaaucaaagaauaaugaaugauugauggaguauuuccauccugagauugugcaccugcugccugccugcccuguauuuggaugcucuugggagacuguauagauuggaucgauggucuucauuuggggguugcuuauggcuuggauuguggaccuguagagccaucguuacaccugcagggaaauauggcuagaguguggucugagucuggcaggauuauccaggcaugcugugagcuuugaaggguggcacuugauggagaggaagggugaaaggaacacucagaggcaagaguggguacaugccaauacccagggcccuuuguccuuuccugggcccugaagguagaagagccauccagcuauccugggaguaccuuuaaacugguccccuggaugggagaacuugagauucucugggagggcucugggccugcuuugaugucucugugccuuuccuccaggcugaggaugucaccuuccucuaccaccccugugcccaucccuggcugaagcuccagcuugcccuccuggccuaugcuuguauggcuaacccuucccucaccccugacuucagccucacgcaggaucggguauguagcugaugaaaggcgcuugccuggcccuggcagaaggcuauggccccgugugcagggaauggaaaauucaaggguuuccucuuguuuguccccaccuuccucguagcucuaacaguuaccuccucucguagccccuggugcugacugcaugggggcuggcgcuggagauggccuggguagagccagccugggcugcccacuggcugaugaggaggcggaggaggaagcagaggaagaagaaggcauggaucuacugugaaagccuuucagggccugcucccuccgagccaacucccgguagagggaggcugugccgaagagggugugugcaggugagagacgcugggcccaggcuuguuggcccucggguucucugagaggggcagcagggugauugcucucucuccucuccuuaggcccuggcucuggccuuugcucugcggagcuggcggcccccuggcacagaggugacaucucaagggcccaggcagcccucuucuaguggugccaagaggcggaggcugcgggcugcccuugguccccagcccacucgcucagcccugagguuucccucugcuuccccagggagcuugaaggccaagcaguccauggcgggaaucccugguagggagaguaaugccccaucugugcccacugucucccugcugccgggggcgccuggaggcaaugccagcuccaggacagaggcucaggugcccaacgggcaaggcagcccagggggcugugucuguucaagucaggcuuccccggccccucgcgcagcagcgccuccacgggcagcccggggccccaccccacgcacugaagaggccgccugggcugccauggcccugaccuuccugcuggugcugcucacccuggccacgcucugcacacggcugcacagaaacuuccgacgcggggagagcaucuacugggggcccacagcggacagccaggacacaguggcuggugaggaguucccucccuacccuacccgaggcccccgccccaccucgcgucgcccgccgccccccguagcuucccugcccucccgcccuugacugcucggcgcccggcccacagcugugcugaagcggaggcugcugcagcccucgcgccgggucaagcgcucgcgccggagaccccuccucccgcccacgccggacagcggcccggaaggcgagagcucggagugacggccugggaccugccacuguggcgugcggcuccuccccgcgccgcgaggccgcgaccucugccacguggaccgcgcgcggggcgcucccugguggcgauggcgcggcacuggccgagcacugcgggggcuuuccuccuuguugguugcugagugggcggccaaggggagaaaaggagccgcuucugccucccuugccaaaacuccguuucuaauuaaauuauuuuuaguagacucuggag

SEQ ID NO: 16706 - RNA, 7669 nt, Homo sapiens
augguaguuaauucagucuacaaaguuuuuuuuuuuuaaaugacguuuauuguggauuucagcagcuaacauuugaaagcaaugucugugagcagaacauaaaacuuauucuagagugcuuagcaaggucucaugcuugaggaauuaucguacuuggagcuuuuaaucagcuacuguuggauucggcgaaucgauuggaucugcgaagucugggcaugagagccccacucucuccaauguuuauagucuccuccaugauggucacauuccaagauauacugauacccacgauauccaggauauugguagcaaacccagcuaggaaauucaaaguacauuucauuauuaaaacuaauuaggaaucugguuaauaccccaaaaccugagccucuuuacucaacacaaugguaugagaugcuuuuaggcuuagaaaaaauagccauccuaaaugugucaggcacuauuuguaagcauaauauggcuauagcuaguuaauuagccuuaaucaucaaaacagguauaaguagucaacguaaauucuuccauagaggcaugucugggggagauaaaucugcaaccuaaagugguaguugguauaaagaaauugagauucaaaauuauguagaacuagaaugugacaucuauaccgauacguaugaaaucugauuaaaacauaacuauugaugcaaccucaggaguuacuuugaaguauauuccaacccuguuuuuguacuuacgccccacuuuguaucuucauggagccgacuucguuguugaaccagcccauggcuugcaaggagggguagucgucagagaucucccacuggcguccaauaaaguuuuccuucucaaagauggucaucuuagacuccuuaugauucuguaauucagaaauuguuuuaaaauguuuaguacuagugcuauggcuaucauucuucauguuuuucaaaauugaaacacuuuuggauuauacaaggaagcacaugauaauuuaaaaagauuaaggcaacagauuugugagaaaaaaguuacccauaauuuuguuuauuccaauuuaaauaccauaacauuuugaauguacaaauaacugauauacuauuuuggaacaaugaagaggauuugacagugagaaaaaguacuaacaaaaugcagccaaccaagggauuaauauucacuaaugugaaaaaagaucucacagauuauuacaaaaaguaagcccaaauauguaugugugcgcuugcguguguauguguguuguuggauauaaccuguauguccaguaggggacaugaauacuacacaagcauuaaaaagacagagacuaaccuguaugaacuucaaaaauggacaaaacuguuugguaauagaaagugguaggggagcaauugaguggaaagggacaccagggaacuaugauggaauguucuuuauaugguuaggguguugguuacauggaucuauauauuuuucaaaaacucaugagaauauucacuuagggucugugcauuuuacuguaugucaguuauaccuuagggugggcaaaugaaauguuuuuaaaagugagauugaaauaauuuccagacaggcaacuauuuauuuggauuagaacuauuuagguuaacuucuccaccaguugaauuuuggcaagacuuugaaccaagaugagauuauuaaccaaaaucacgagaaacucucacauagacugaauauuuggaaagguucuagcccaaccuaacuccuaauacagggaucauuuucaacacaccccuuaaggucauucugcuuucugcuugaacuguuuccaaagaccagaaacaucccagccugaugcauuauugaguaauacuuaaguguucagaacaagaagauuauuaucaaucaguguagaucgauacuggaagacuugccuauuucgucagucauucccacuuacugaaagguuacuucagcauuuuccuguuucugcaguaaaaauguuacacagauugaaauuuaacuggccaaggauuuacuuuuugcugcaggguaagcacuuucacucauuuacuaguguuucacaaguuuacugggcucuugaguauccacuuauugccacuuguaagacccuuaguuuuagcuuaagggaaguaccaccugguggagaaaaaucaaauagcaggcuuagagaagaaagugauguuuucucuuuuuuuacuuuugucuuuuuuccugccacauucagcauaacugaugauaaauagcaugaacgucagucuguccacacccucuugucccaucccucauaugcacggaaguggaaauuucagagacucacagcugaacagauggggcggaaggacaugagacgcucaaugugguaggcauuacucccacuccaggcaucccagcgaggguauucuccucucuccaggauaaacuguugcccacagaagcugguaugcucauaaccaauccagcugccaaagacauguaguguuuguucaugguguucaaagccuauauggccuuggggagaaggcaucuuucguuuuagauaagucaauagugggguaaaauaucaagccaaucccaguagagcuguacaaaguaauuugucacaagaguugaggaaugaguugacagguauacuaagcagguuagugaauguaauauuuguuuggggguuaucacugaaaaggucuaucuacuucacuggucugagugaaguguauuagcaaagccaaucuaaaauuauauuuccuggcuggguguggugucucacgccuguaguuccaacgcuucaggaggccaaggcaagcagaucgcuugagcccaugaguuggagaccagccugggaaacauggcgaaaccccgucuacaaaacucaaaaauuagccaggcguggugacccacuacuggcagucccagcuauucagggggcugaggguugagccuuggagguggaggcugcagugagccaugauugugccacugcacuccagccugggcaacagagugacaccuugccucaaaaaaaaaaaaaauuuuuuuuucuuuuucuccaaaucaccuauucucuaccuguuucaggaucuagugacuguugcaagcuuguccaaccuguugcccaagggcugcaugcagcucaggacagcuuugaacgcagcccaacacaaauuuguaaacuuccucaaaacauuaugaguuguuuuuguuguuguuaggucaucagcuaucguuaugguauuuuauauguggcccaagacaauucuuucaguguggccuagggaagccaaaaagauuagacaccccuggacuauugcuuuggcucaagccaaaccuguuggcuucuucuuaagaaagcacagggaugaacaagcaacugauggauuacuagucuuuuuucuuccugugacuugcgaguucuuucuccuagugccccauaccuguacuuaaaacuugaaacacucagcucaguuuuucacaacugggucucaguuagugaugacaccuuaaaguguuacaucuuuuaaaggacugaagagcuuaauuuugguggcaagcaacuuguggaagccuauccacaugcaaggccaauucugccuagucaagggugagucuuuuccuuagguauuuucaggcuaaugauaaaggccucaacuacucugccaagagucagaggacaaaaaugagagggucucccucaccaagauuaaccaucaacaagaaacugccugaaagaugaaucaggagcuaauaugucucuggagucgugggguuaagguuuuuuuuuucauaaagaaauuagcuaacagugucugcucugggauaugcaggaggagaguuagccaugaagaggcagccacuugacacuuucuucucuaccaauuuucugcaggcaagaaaaacucaagggucuuguggcuguucugagggcacccuagguagcagccugugagcuccagaagcaaaauuuugauuacugccacugucccaccccauuguauguauuucuuuauccagccccugaaaucuaguaccaagccacuaagaaccucauguuccuuccuucuagcuuuggcuuacuaaauuaugcauguagugauuucuuucgaggccugucuccgagaaaugacuagagccuaggggaacauccuucuuccccuauccccacucuaugguccccugucugaagggaccugaaauaaggggcugcgguucugcggaaguccauacucacgcgccacuuuccaccuucagggaccggacauuaucaaaacugcgcucagagacauuuggacaggagcuggugaacuccauccucuugcccugaaaguucuccugaucauagaugguuaucugaaaugagauugaauggcgcaagagagcuagaacaucaggaaaaacagagguccaggucaacagcuuaacuucagucugacucugugcuuucuguuaccagcuguagccugggaugccugaugaggucucuuccaguguagacagggcaggaagggguuugaauuaaugccacugguugguguucauuugcccagaguagggaugagguggagggaggauugguuuaugauagaaauggucugccagggauaauaucuagaccaauggacaggccaaggacuuaugggcucccauuccaccacaguuccuucauaagcauggcccagaggccaggauucugggagucccaggagcuccuuauagauucuuagcuucuccagccauacccccuauagaaaccuagaguguaaaggagaguuauggucaacccuuuuuguacauugaacuaaaaccuggcucguggaccuggccagaggaccacucgcaaagcugugagcuggccucagaguugacccaaugaggagaguggggaguguuggagagaggccagugagaggccugaggaucagccacuucggccaaugguuaaagccaaccucaggaugggaggcugaguccuguaauuuauuugggaucuaguaguaaauaucuuuaugggcccucauuuucuccauggacauaacuguugcugggcugcuguauuuuaagaugacuuuaguggggaggagagaggaguuaggaaacuagguaucaucucccacccaucaauggcauccacagucauccuuccuuuguccagugggacauccugagagauccuuccuucgacagcacuggagcuuguguggaccuuuccccuacaaacugggguuuuucuggucagucacugccuuauggacgagcacaggccuggggccugcucugugcagcaugucaccccugcccuguuggaugugaugggggugggcuuaccuuccauggccccagggaccccggcguaggguuggucugagccaucuuggugguuggaaggguuucuggaagacagagcacacacgaaugauguggccucuugggaggagggggaggugagggaaugccuugaaagguaaaggagacuugaagucugcaagacagacuuugguugaaauucuggcucugcugcucacuagcugugccucgggguuuguuguuguuguuguugcuauuuugagacagggucuuucucugucauccaggcuggagugcaguggcacaaucucacuucacugcaaccucugccuccugggcucaagugauccuuccgccucagccucccauguagcugggacuacaggcaugcaccacuauguccagcuaguuuuuguauuuuuaguagagauggggguuucaccauguuggccaggcuggucccaaacuccugaccucaagugauccaccgcgcccagccugagccucaguuuuuccauugguaaagcuucgacaugcaguuauuguaaggaucagaaauaauaggccgggcacggugguucacgccuguaaucccagcacuuugggaggccaaagcgggcggaucaccugaggucgggaguuugagaccagccuggccaacguggugaaaccccgucucuacuaaaaauacaaaaauuagccggguaugauggcacacgccuguagucccagcuacucgggaggcugaggcaggagaaucgcuugaacccgggaggcagagguugcagugagcugagaucgugccacugcacuccagcuugggcaacagagugagacuccaucucaaaaaaaaaaaaaagaaaaaaaacaaggaucagaaacaauaaugcagguaaagcacugagacccuguccucucacuugcuuucaggugacagcauuaccucugucugcaauauaaacucuuuggcaaccaccuaggccagaccccucaugugacuggccaaacagccagccaugccaggaucccaagccccagacucccucguaacccuucacggucucauccuuaucuggccucuuucugcuuuucuuuuucuuuuuuuuuuuuugagauagaguuucacucuuguugcccaggcuggagugcaauggcgcaaucucggcucaccgcaaccuccgccucccagguucaagcgauucuccugucucagccucccuaguagcugggauuacaggcaugugccaccacgcccggcuaauuuuguauuuuuaguagagacgggguuucucccuguuggucaggcuggucuugaacucccgaccucaggugaucugcccgccuuggccucccaaagugcugcgauuacaggcaugagccacggcgccuggccauuccuuucugcuuuucuaucuccuagauccuacccagccuugaccuugccuucucagaggcuuuccugccuucuccagcccacagccacuugcuugcuuucuugauuuauagcacucaucacaguaccaaucuguguucugguuggauguccuggugagcaccucaauggcaaggccucggucuucuaggggauugguauagcaucgugcugagcacauguggagaugagggaucagggggacauugaaaaagacuuauugaaggaaagugaagaagaaaagaguuauaauacuuacacucaaaaauggcuaucuacauguccggcccuguuuuaaaugcuuuacaugcauucaugcauuuaaucuucacauacagacuaugaauuaagaauuaucauuauccccauuuuacagaugaggauacugaggcucaaagagguuagguagacagugaagaugguaggacgaguuuuaaaaaaggaaggacagagcaagaaagaggaaggaaaagugggggaggaagggaagaaggaagacaggcagguguguauuagguuucuuaggacagauauucauggcccuccuccuggcugguauugggcccaggaaugaugcaugucaacucuguaauauauuuuuccauucugaaucucugaauaagcaacauuucccagguccugcucccauaccuucucccugcucguuucuugggggcccaugcccaucccccagccuuaguugcuagggcagugguuauugcuauauaagugacuccucuuggggugacaagagaaggcugucuuccgccagaguuccccacucuucuccagccacccuagaaggcucuacacacuaggcaggagaacugggcccucuccugggcaugucucugcagggcaaggagaggaagggcaagggcacccugagggccuuacucacccagcuccugcugcucagccugggucuccaucugguaccacuug

SEQ ID NO: 16707 - RNA, 1740 nt, Homo sapiens
gggugagaagaagauucaggauuacaugggggcuacgcagugucugucucagaccuuggaggaaugcgccugucucacuggcuguaggucucugaggggcuggaauguggcccaguggggcuuccucuucccuuccgcugcucucccugaacugccuucauacuggaaugucagcaggaugggaauuuucacagcaaggaucuuacccagucacagcaauggauuccagcuggagccuggggacagcucccacaugucccuaccagggaggagagagugggugcuaaggcagccccaguugcucugcuccuggggcccaggcucagcucccauccccucugggagacaguuuugguuccuggaaccuucccgcucugacuggccuaggugacuugucuguaggaccuuagcaugucccuacuaggccaggucauggggaaccugggcuucuggagcuguagggcucaggagagggagugggaggccuuggagcccagagacuccaucucugaggagagaaugaggcuggccaugucccacaaggccuugcuaccucuggugugaacaugagucagggaggggagccgccucggauuccauccucagguggggccaggccucuggacccagguucucuggccuacuggggccacccagccucgguuggagguggcccugccgaauucaucaccuguaucugucuuguacucugugggucccgcaacaccuucggggccugguucccucucuuagugaccuuucuggcuccugugcccuuugcccccgaucucauuucugcuggcuccucccucccacucagauuucugcagggagcugacucacuuccucccucccuccccagcaccucucacugccaggcccuggggcaagcaggguccacacagggcggcagguucuucccauggagcucuucucuggcagcaggacugaggcugccccggcccuggggcagaagagggcugcaugugugguggggaggaggcagagcucugugcuguaggaaaggccagauguggauguccccagagccuuguugcaaucagggugggacgucaggacaccuugaugaacacugcucccugucagccccugagccugguucuguggagaagaaaggcugaagauagcacccugugaugauggagccugugcuucugcaaggacagaagacgugugcaggaagaucuaucucagcccuggguggcaugggcuagaggccaggcagugacagcaccgucaggcagcgugagacugucaugacucuccgugacacccaguuucaugcccggccccaacacaucaaggggaaaguaucuagagauuccaguagaaccuuccagggacauggcgaggggaagggucugauaccaucuccuugugugguuaguucuuccugcugggggcccuucccucaugccccugccccucccucauguguggacugcuuugguuguggagcugauugcagaagcacugggcucagagcaguaaaagauuuccuccccggcugggcuggcaucuucugccucgcccuccccagagcuguccaggcugugggagcuagugugccuggcacuucaggcauggggggaacccagcaugugcugagccuggcacagcccugccuccucucagcaggcaccuauguucccuaaaggacacgggcacaggcugggucgaguccccacucacuuggccaugccucaagaucaacagagg

SEQ ID NO: 16708 - RNA, 15010 nt, Homo sapiens
aaaaauuuaauauggcaauaaaaugaaaugagggggguggugaagaccuccaaaggacagcaagcccugacugagaaucugugaaauuccucaagcuguacaguuucugaaucagcucaggauucacuccaauagugcuggucucuuucuuucucaccagacaaggaauuagggccuauaaccuagaagaaaugagguagggucuaacauaaaccaggcugccaggcaggaauaacuuuauaauaauauacagcauagcaacaguaauggcucaguugaaccuguuuucauacuuuuuugaagaacuuuucaucucccuuugguucuccacauuuuccuugaggcuacccacugcugucagguuccuggggaggaaaggaugggacccaagaccuugucuaaagggccacuguuugaagucugccagcaagacccacauuucccggggcuggguguuggucucagacaacaacucucucuccuucccagggcccauuucacccgucaacacccagcuucugucaccugucucugagucucagguuccucacuuguaaaaugaggguaaucagccugauuaugagaugugguugccagucaacagacuguauggcaagggugccaccugcuagaacagaagguccccagggcuggaguugcuugcaagcacccacccugggggaagaaucuagacagcaaguccgagaccugguauagccguuauuuauaagcugaugacagauauuuucaauccgcuguguugugagaauuaaauaagacaugugcgucuguguuugaggaugcaggccauccauccagccuagaaaacgcugcaugaaggaugaauucucuccagccccaccaaucccaucuuccuaugccucuacuacucggacaucuccuuguauugucauugugcaacuuguuucaugaacaguguccccagacuaauuccucaacaacacaauuuggguccuaaucauuuuaauacaucacguaguagauccccagaaacuguuugcugaaugaauaaguggaugcuauuuauaaggccaugauccuuguaaauucucacuaggcugccucuuguuccugccccugaagcugcugaagaccugcguucccggucugaauucacucuaaacuggacccagaggaggugggagcagagaaauucagggagcagcacaguguggugaaaaguagacuaggggucauccugaagcggcggccagagaagacacaaagacaugagcaucggaucaccaugccuuucuuggccauccagaaaagauucggccuuaacauagaucaaugguggacaauccagagugcugaacagcccuacaagauugcugcucgaugccaugcuuuugaaaaagaauggauagaaugugcauauggaaucaguguuauccgggcagagaaagagugcaagauagaaucugaugauuucguagaguguuugcuucggcagaaaacgaugagacgugcagguaccaucaggaagcagcaggauaagcugauaaaggaagggaaguacaccccuccaccucaccacauuggcaaggaggagccucagcccugagcagagcagcugcugaugucuggaggcugaauuuccuguucucuguuccucacuggaaagauuguuuauggaaaaccuccuugucaaaguguauaaaaauaaaggauugcuccauccuaaaaaaaaaacaaaaagaagaagaagaagaaaaaaaaaaaggaaaagaaaaguagaguggggcugucguccuggccaucagagacuuaaccucucugggcucagugucuucaucuauauauggucauuaguagagcagaucgggguugaaaacucaaaugcccacagaggccaggaaaauaauguagacaaggcaacaaagggggaagguggcacccucccuuuguuggagagcaggcaugcuccuugcacagcgcugcccuucuugcccgcugaucaucgccaauugaugcaagacugugggucaagucuuguggcaagauugucugaucuuucaagggaagccagcaaaguggauuuuuaugugaagucucuugaauaggucaaacucaaguccauaggccauuuaccaccuggaggccacugguuugcagucucagcaccagcggaccaccuggcuuccuuccagcucuucaauucugugcguucaggagaggagaacauucuuguaaguaacuguuuaaagggaaggacucaaagucuggaccucauucuggccgcugggccuccgguaacugccagccugaccccuaaacugcagcuuuaugcaaggcaugccccccgucugccagcccccaccccccugccccaccaacacacgcacaucagggggcagaaauggggggugaggaggagacaaugauccuuuguccuggggugggccaggguucagccccuccuguucugccccuaggagugcccgcccugccuagagagcuaggccuaggggcaaacugcccacucuuaggcuacccugcacaggggugccuaccggugauacagucucaccuaauaaauuccugucagaaaagcugucagggccugggaaauaaauaaugauauuuaacauuuuguaauaacaacaauuaaccaguaaauaauguccuuuaaacugcaaacgcuagaguaaauuaauucuucuaaugagcugucaggcacggaagaaaaaaguccccguguucuuugcugccacgcggcugccgugugagcagccgaggaagcucaccucgggcccugggagcucauuacagggaagcacgcggcgcgggguuccagggaaaucagcccggccuagccugcacccacgugggcacucggccgccgcccgcacccggagccccacggccccgcccucauugugcacggcgcgccccuccaggugccgaucgcaaaugggcagcgcggagggcauuucaauuagagaccucccccucucccuucuggucaccugggcggcgcucagccucgagguggcgggggacaggagcugggaacugaggcgggaggagggggagaaacucugcgcgucccuaguccuugcugcgugaccuuggagagguuucuugccucucugggcagggacguuguaaauggaaaugugaagcuaaucaaaccagaugugauuauuucugagcuccugagaaguccgugaccauaaaaagacaccuaagagugaggcagcucuuuauguacugauucggaguaaucuccaagauauauugucaggugacaaaagcgaggcacagaagagcuugcaggggaugcuacaucuuguguauuaaaagcaggacucaagaaagaguauguguccguguuugcucuuauaggucuagacaggaagcagguaacauugcuugccucuggggaggggaagcuggagacgggggcuggagggagaguucagugaacaaccuuuuauacccuuauuauuugaaccauguacagguauuaccuauucaaaaaauaaacguuacgaaaaacaaagccauacacaucaggggucagcuugucucucaguagcuuucaggaaguggaagccacaggggcccagcugcacugaagccccaugugaaaucccuccaaagagagagagcacacugccucucuaauaaccuauucuagagacaagcuaaugagucaggaaguccuucccaguagcuaaucccauucccuccugcuacaauuuaaguuucucucuucauguucuguguuuggugggugaaagggcugauagauaauucucugcagagagcuggggguagaggacagccacuguauggacaggagagaaugaacggcagucccagcccucuggagcccacaggccuagguuugaauucacuucugucacuugcucacuguaugguguuguaugucacucuccccacugcgcuuccacuuccuguggucccugccucccucgggaggauauuaagugcuggaccuggugaacaggcaucuacuucccauggaagcccacagguccauugcugcccaagauggacagagacccccugcacaauccugggucaucugcccaccccuucccagaucuauggcucucccagcugcgacgcccaaccccaccucccacccggagcagccagauacagccucccuauggccagacgcagcuuugcccauuuggcaccuaaauugucaugcccugaauccagaacagguucaagguagcugguggcucagagauaguguuggagccagaaaucaccagaggugaucacuucugagcuccugagaagcccgugaccuaagacaccuaagagugaggcagcccuuuaugugcuggcccagggcuugaggaaagcacuugagcggcugcuuuggggcugagggugagagagggguucaagccaggagaacucccagcccccuaucaccaucugaccaacucccccuuuaucuauuuuguauccuugccaucuucauaaagugucuuuugauuaaagaguuucuuagcuggccaggcgcgguagcucacgccuguaaucccagcacuuugggaggcugaggcaggcagaucacaaggucaggaguucaagaccagccuggccagcauagugaaacuccaucucuacuaaaaauacaaaaaugagccgggcgugguggcacacgccuguagucccagcuacucgggaggcuaaggcaggagaaucgcuugacuuugggagguggagguugcagugagaucacgccacuacacuccaacuugggcaacagagcgagacuccaucucaaaaaaacaaaagaguuucuuggcuaaaacauauuugaaaugcccugaccucggccauucagaacugggcaccuaaggcaugggguuucagaaagagcagggacaagagggggaaagaacccaaugccuacuaaggacccacuuuaugccaggcacuucccaugcaauuuucccucuuaauccgcacaaccugugguuugaguaauauuauccccacgguauggacaggaugagggaaguuccaagggguuaauagacuugcccagguguauucaacaaauaaguuguaguugggcuagaauuuggacccagaucugcugacuucaaagccacaucuccuaacacacugcugccugucccagccccucaccucaccaucuagaucuauuaaugugauggggugcaaguggggugggacagagcuggggugugggaaggaggccagcucagccucuugacccucucuuuccucaacauccucuacucaguaccugaagcauugagaugaaaauucaaggaacaauugcugauuguaagaauucaugagaaaggcuccccuucccugggagccuagaggaaaugcacuggcuucuccucucagaaucugcuuccuccucucuaaaguaggaauuacuuaaccagguaauaucuagccagggggagaguaugggcaccucugaugucaucuuuaggagacugugguggcugaagcuuaggcacagaagucuaauacacaugaguucaaauccacgcucuaccacuuacaagcugugugacucaggacaaguuacuuaaccucuuugagcuuuguuuuccuucccugcaaaauguggaucauugccacugaucucuuugggcuguuacaaagguuaagaagaugacguguauaaacugcuuagcauggugccugggcauuaaguaggcacccaauacaugacuacaucuguccugaugaguuuuuuguugcccugccagacaaacucaaucucccagaccaaaaaggcaguuguccuggugccugagauaggcagccuaccucugcagcuuccugauuugggaggcagcccagagaggccuccaggcuugguuuuuugcaaagggcagcggaaaaucgaagcugaagccagcaaaacaaggaucccagcaguggaucugagucagcugcuucugggucuggggguucaagagucuuccucaaaguaacauagcuuccugguuacccuguccucccuguagcugcccccuuggccugaguccucugagggcccugggcaccugugugcacagagcaucagcugggaaagaggggugcuccagugaguagaggaagcugggucucagccacgcggaaauuaaaaccagcuugcccagcacugaguuaccaugucgccugaaaucagauugauuuauugggcuuguugugacggcaguguugcaauugauucgucuggauggcggggaguuuaucuauucagagcugucugucacugaucugaauaagcugcuaaaacagcccaaauaccuggcgagggcgaggucaccaccaaccucggcucaauguuaauuauaauaaugaacaggcaugaggaggguugguucauugcucgcccagcagggcuggccucuaugagguuugguguuuaauauucauuucaugucaacaaugugcaaagagcgaguagacucuccuaagcugagagaaguuugcaagggcaaugauguugaucugugcuuccaugggacuaagaaggagccagugcugcugaaacagaaaagguuuagguuagaccuuaagaagaacuuccuaaugaccaacaguggauggacauagaauaucuaauucacuuauuagccuggacaaguuacugcuccuccuugacucagcuuccuccucugccuggccaacauggugaaaccccaucucuacaaaaaauacaaauauaggccgggcgcgguggcucacaccuauaaucccagcacuuugggaggccgaggcgggcgaaucacgaggucaggagaucgagaccaucuuggcuaacauggugaaaccccaucucuacuaaaaauacaaaaaauuagcagggugcgguggcgggcgccuguagucccagcuacucaggaggcugaggcaggagaauggcaugaacccgggaggcagagcuugcagugagccgagacagcgccacugcaguccggccugggcaaaagagcgagacuccaucucaacaacaacaaaaaaauacaaauaucagcugggugugguggugcaugccuauagucccagcuacuugggaggcugagaugggaggaucaccugagcauggggagguugaggcuacagugagccaugauugugccacuauacuccagccuggauaacagagugagauccugucucaaauaauaauaauaauaauaauaauaauaauaauacuuacuucuuggagcugcugcuacugcugcuccuggccaaauagcaagaaaaggaaaaacaaaacuacaaaacuggcaggcucuucuggguuguugguucagggagcaacaaagggguccuacuuugggugacagaucacccuucucagccuugguacggagcgagcauuccaucaauggggcuuuuguaauaguuauugauucugugacuauuuauugagccccuucuauaugcccgaaccugaagaaaaacuauugaacaagccaugauccccagccuuuaaggagacuaauucugggguuacuaugggagcuagggcacccuccucaccggaggcucucaggaauaagggugagcccuaucucugggagauagcuuagaaagugcuccuggaggcaggcagauggaugugaagaccucaugcgguagcugcuugggguuguuugaggcauaauuauccagcagaagagccuacuaaacaucagucaagaagagccccuccagaauauuguucuuucagaaaggggaggauccuucucccgaugggucuugcaaaaauguggucagacuugggguucaagucugcaagaagccaacagugaccaauugacuccccugccccuaaagacaccaacugaaauugcagcaagaaacauggagguuaaaugagauuuggaaagcagugaaggagaccaugaugaaaagauuccccugucugucuggaagccuggucagcugccuuccuugugacauuccuuucucuguuccuacaaagcucuccucucucuccaccucagcugcugguggagacccccauggccagccuuaagagaaacaucagaagaaaguuaauagcgaaacggucuggcggaucuaauugauuuuuuuccuauugguucccuaauauaggcaacaccguuccugccgcuuuucugggcuggagauuaugucauaaauaaagagauuugcucccuauuuccaugugcuuaucuuuaauaaguuaagaacucaacaagcuuuaggaggacuugaaauaagcaagagauccggugguggcuuuggcuguggcaguggcuuuauuucaacaaagggggaggcagauugcugaggcuaguggaagagaauuuccauucuuugaguugcacugggccugggcucagcugggagaagagaggggcaagugagagagcugggggaggaaauucgugguggcagauauaguaaaauggauggacccagcccauggggcugcggguaaugugguaguuaagaacauagguucuagagccagguagccuggguucaaauccgagcuucgucauugcuuacuaguugugugacuuugggcaaauuacuuagccucucuguucccacauuuuaaaaauggauaauaucuagcucauagguuguugugaggaucaaaauguaaagugcuuagaccagagccuggcacagaauaugcacagaauauauguuagccaguauauuauuaagauauccucuaacucaguuuaccuuaacuguugcugagccugugccaugugucaggcccuggucugggcuucauagaugaguucacucugacuucaaggagcacccagccccugugacugguaugagcuggguguccgcacuagagggaauccagaaagugagcggucaccccuuucggggagagacugccauccuauggcccugucuugagguucacccacucuccgguucuggacaccccacagauuaauucacauuuccugaaaacugacagugaacacaaacugugcagcgcaugcagaaacagccucacucaaguuuaaguaccaugcaccucaugugccaagcucugcuauuuauuugcagggucucauuuaguccuaaucaacccuaugaagacaacaguauugcuaucucccauuucacaguuaaggaaaccaagaaacagaaaggugauuugcucaaaggugauuugcucaaaggcuuacagcuagcaaauagcagagcgaggauuugaauccagguccauugacuuccccugcucuaaacauugcccuguagcccucauccugcacuuacagugcacuuacaauugcaagcauuaauaaggcacauauaauaugcaagauccuaggcauaagggcugaggggguagaaaaagaaauagaaacaaguacaaguagauagaaacaagcaccuacuaugugccaggcucuccaacagguuaucucacugaauacuuuucugaaaggcaaguggcaucauuuuccuuucauagguaaagaaauggagguuccaaaacuugcccaaggcaaacauuagguugggaugauuugaacucaggccugccucugagguccagccaaugcucaggaugacccucaauccuccacuucuccuuuuuuuuuuuuuuuuuuuugagagagucuugcucuuucacccaggcuggaguacaguggcacgaucuuggcucaccacaaccuccgccucucagguucaagcgauuauccugccucagccuccugaguagcugagacuauaggcgugcacuaccacacccggcuaauuuuuguauuuuuaguagagacaggguuuugccauguuggccaggcuggucucgaacuccugaccucaggugauccacccaccuuggacuuccagagugcugggauuacaggcaugaaccaccgugcccagccucccucaguuucuugaugagcaguuucccuuuccagcaggccuugcucuugccuaccccgaauguggaccuacugcagaugggcugagaaguggagcccucccccugacaggccuuggguggccucccccuuuccuaggagaugaucucuaucccaggcuuccauuuuguauucuuccuuucucuugcaggccauugucuggacccacauauucuguugcuuuaaggacuggugaccucacaaucaguugccauagagaccauugugaugucacaaauagaggacaaguaguucaaggaggagugggggagggaauaugcugaauuaagggacauugggaauuucuguccuauuuucaugcccagaaaaggaaguggcuagaaguguaucuaagccuggguucugaugucuaagggagacuugaccauguucucauaucacuuccccuggguucuccugagacugugaugucucuaaggcccaaauaaagggucaaugagaaggaacaucagaaacacucccugccacucuggggcuauaagaagcgggcugcuuuuguagcaggaaggaauaguauuagaugccaggaggaucugugugaauggaagaucuccccggagguaaugaaggacccuugccuugggaagcuugaagcaugggagacuuggccucuagggcuuccagagccuuguuuaaguaccuuguggagauaaacaugcugucuuacaggguguuggggcuguuuccccuccccagucugggugcuccuugagggcucucccucuccaguagcuaguucagguccuggcauacacacagugcucaauaagugcucacucauucaguaaaugaaugagugggugaugaaugaauugggagguaguagggugaaggacgaacgaauaaauggacagauggaugggcagguaggacuccuagagauuucauaccagccacuaagcuuugcuacaccccagcucuccagcuacaucccacaccacaacucuuguuugcugccauccagcuacacuaaccaucucuuaguccugccuaccgauguacaugcuguucccucugcauggaaugcacuucucuuccucuucaauuaaauaacucauccgcaucucccuguagccucccgaugcccaccugccaggggcagcccacaggaugcacccggggccucuucccucuuucucaggaacucaccccaccuggugacucacucucucaucacauggccaucaaccugguaccagguucccagccccagagcagcaccauaaacccaaugccucuggacagauguauuuuauguaaguucaagcacuagaaauauugaguucagaggauuuuauuucuagagcccucuauauuucucugggauuaucgccugucuuuguucccucccucucuugguuauuaucuuuggacccuuuccaagccaagcugccuugauugcuugggaugacaaaggcccccagcauccucccauggugucucugggucuggugagagugaccuugggggacccuuucuucuuccuucagcauaacccugcagguggccacaaugccaggcagccuuggcuuuuaggagcuggcuucacuaagagacuaagugucagggaacaugaaggggauggugaaaguggaggccucaugccccccaguugcagaaggcuaugcuuagaauaagcucugugguacagaggggauggagaaggccagcuguucucuuuccuacaccaugccaaccuagccugacaccaaauuaauaguauucaaaugagaugcaaagcauuaugcaaaucuagaggagaaagccacucuuaccaggcuguuggaaggccagcaccuugaguccuuuauggaggaccccacgggcuucuuucaacuucaaccccugaaccuucagcaccagcuggugugaagaauccaaugagacuggugcagccuucucccugaucaucugagcuggagcucacucuggccucaccccaccgcagguacucagggccuccugaaaugauacagaggcagccacggaagguagaacaaccucccucuggaugccagaauuccagcaccccacucaucagcaguguaugcaaaguagaugcaggguuuuuuugcaucuauuuaaccguccauuaaaauggccccucgcccgucaccucugcacaggcucaggcuuccaaauugccaacccccgcugccugcaagcaccaugugguuccugcgccugguaauugcugugguguuuguugagcuguauuugcauuugauugucauuuaacuuuccaucuuucuccuucaaucaaaccagagauugggcuuuugcaauugauuauucauuuauuuucauccccuugguaguuuucaaagaguuuucuuuauuagugccccaaauuugaacccugggacuucuccugccacaugaugggggaaagccuccucccauccaucccagagcuccuaugugaaaauaaucuagccaacauuguacgucuuaaguccuauccccagucucccuguuucagcaccugccucauuccugcccagccgguggcauuaaacauuuauggagcuguggaggaucaaaggccucggcuggggguggugggcaggcuggaggccucuguuuggagauggaaaguagcucacaucaaaccacuuucugcugcugucuccaucuacccugagcucuuccugcagucaauccuggagcaagagcaaaugccuggagccaggacucuccauuuaucagagcagggcccuccuccugccccuaaauucaauggguugacuuuggguaaugcagggagcccuggcuggagcacuggcaucccugacuguuccaggagcugcaaggucuggaauccugcuccaugaaguggguugagguaagcaggcagcucugaaccccugggagccucuggagugagguggcagccccugcccuugccucccugaaacaccaaaaccccuuuggcuccacaaaagauauagcucugguuugaaagcugucuuagaagagaguaauuuucuccuccucucgugcagaaagcaagugucaucucagcagagacuucaaaauaagucaccaaugugccugugauccuacagauugaugggcuguuuggaacuggggaaguaaagcuggcuucuccagcuucaauggauggaugggggcucuauguaugucuggcuuugucugggcagggguuggggugucugggauugaagagccccuucuucccucucucuggucucucaaaccuaauucagucacuguagcucagacacacaccccacccccuggcuucggagucagcagugaaccccacaguuccuaccacuugccacagugcuugaaaacauaccuuaaugaugccagauugcucuguuucagugcaaauaucuucgugaugggguaaucccuucaguauagccaccaaggauguccuucagcucaggugaccaccaagccauucacagcuaggccccagccuacucuagcccuuucuccuacuucccagcagggacucugcuccagcagaaccagucuucucacugacccagacuagcuugcauuuuccaacgcugugcauaaacuacaccccccaacuuugaaugucuucccucucccucuccauugaaucauaagacuuauuugggcuaggggcagugguucaugccuguaaucucaguccuuugggaggccaaggugggaggaucacuugagcccaggaauuugagaccagccuggacuacauacagagaccucaucucuacaaaaaaguaaaaaauuagcugggcaugcuggcucaugccuguggucccaguuauucaggaggcugagaugggagaaucacuucagcccaggaagucaaggcugcagugagcccugaucacaccacugcaucccagccugggugacagaguaagaaccugucucaaaaauuaauuaauuaauuuuuaaaaacauauucaacuugguuucacccauccauugugugaagauuucacugaccuugccucauccccaaaagaaacaauugcccuuuucuucauuaucucacagcacucauuugacaccaaugaccggccuugggcuuuagacacuccucaucccuguuguuuauucacaaauauuuauugaacaucuacuaugugccagccacugagcuagauuguggguagaugagacagacacggucugugccuucgcaaagucaacaacuaguagagcagacagacaauuaagcaagcaauuacacagacaggggaagcccaggguucucugggagcaaaaagccaggugggggaugcagagaacagaagugagagcagugaggggagccuugcaaguccacccagacugccacuuucaaaggugccuaugaauugaguagacuauaagccugccagcccuguauacagcugauuguccccuugggcauuuuauuguucucaauuuguagguaauaucaaggucugguuaggacgagccccuuggagggcaugauagagggcaccugacagaagcucugcuguuucccaguuuggcccaggcucugccucaaccugccuaggaacccacugcauaaaggcuauguuaacugccuuuaggagggagggacagccccggugcauugucaugcccaucaugcaguacaagcccaucuucugagcucaggguacaguacuguauucugggacuuguagucuccauuggacccucuagguuaguucaggccauagggaaggugaugugacaaguuccaggauggcuucucucccccuccuuuaugugcauagugcccagcccaucaaggagcccuguugcuaagagagucagacaagccugccaccaaccuccaaauccccaugaaucauccuggcaauacaagauucaucccuaggucaugacucacuccccuugcccaagcugccuagccaugagggaccaggaauacuagaggagcccaggaauacuuucaaggaggaaaagaggaaucucaugacauuugccagcauuuuccuaaacuucccccggucacacaaccuucuaccucugug

SEQ ID NO: 16709 - RNA, 4269 nt, Homo sapiens
gcaguauuguugccaaagugcagagugucaucaguaaguuggagcagagaucuguggccacaaagcugaggccccagucagggugguucugacuugcugcccauggucugucucuugccuucccaguccuauuggccaagcucuacuuccucgugggcccagggcaggccacagagaagcaagugcugaguacccccauguguguacacaccuguggggacuucagacuccaccaacccuuucugagcauccuuccucccuagucaugcagcaguuggaauggggagaugcaggagcccaaccuuggcaaacagcccacauggguuggcugcucacuguuccucuucugugaccaucccccuuuuucccagggcgccgccggcaccagaaacaggacgaagagccaagugaggaggcagccaugaugaguucccaggcccaggggccgcagcggagacccugcaauugcaaagccagcagcucgagcuugauugggggcaguggggccggcugggagggcacagccuuacugcaccauggcagcuacaucaagcugggcugccugcaguuugucuucagcaucacugaguuugcgaccaaacagcccaaaggcgaugccagccugcugcaggauggggucuuggccgagaagcucucucucaagccccaccagggcccugugcugcgcuccaacucuguuccuuaggacuggcggcuaccccgccacuggccuguacacccacccaagacuccugcaaugcaaaaauguacacaaaccaagcccggguguuuucuauacucuaccagaaacccuucaacuacaaucuuugcaugaaaugaagaaaaccuuuugacuguuuuuuaaaaauccuuuuucuuuucucaaguucuagggggcauuugcacauauauuuguacucaacauuucaugggaaagcggcagaccugagcugaggaacagcgugggcagggagggaaagacccagggucuggacacuuccuccaacacaaaacccuuccccacccaccuccugcucccucccccucgcccaccauuguaaaauaaucagaaacuuguucuauuuuguggcagugacaauaguuuuauauuaaaagaaaaaauacaguuuucauacagcaaaaucuauacaauaucauuguuuuauuuaauauaaagaucgcuacccaccuuccuuccaugguucccacccuccacguuauuuucccuuucugcagcgguugcacuacagguagcuacuguguauuauggacaaaugagaaaugaauucuuuuucuggcuguccaucuauuuuauuucaaauaaggaaaaguguauuuggauuuuguguaaauacaucuagugaugacauuuuuucaauguuuuuaaaaaccguguacaguacuacaugugguagagcguuuucucaaauugucuauuguagcaaaaauguuuuugucguaaaccuguuuugucuccuuuuuuuguucucuugccacuucucuccucuuccuccugccccugguucccuccucuccucccacccccacaaccaguaccaauguacauaguaauuguaauguuuuagacuuuacagaaacuuuccuguauucuguauauaaaaaacaaaaauacuucaaauuguuuucugacugucuguccuaccugucaucacccuuagaggagacccuccccuagaucugggucuagcagguggggggccuuuugaacaggucucauucccauagggaaguuugguaggggagguguuggagaaaagugagccaggguggguggaugacaauggaaugacaugggugcgucugcuggcccggggggagcuguuucuccagagaacccugacugauaguggaaucuagucuugaccugucacuucuagucaugugaucugcagucacacuucucuacaacugcuauuccucaucaaaaaacgagucugcugcauuaccuuaauucucaagucccggggaccuucauuaaaccaaauuccaugcuuuccucccagaucuuagugaaaaacucuccaggaaguuuuccugaggucagccuccucagauggagagcaccucuguguauauuccagcacuguuuguguaggugcaucugcuugugugucaggauuuugccuuagggauagaaaaugaauauucuacccccagccucaucccacagcaucuacaauggaaacccgaauccgcagugcagcuaaauaggaaacuggcccuggaaucugaggucugucccugacuuucaucugcccaugcaggcgucaucacucugcucccggugcccuaaugggcuuuuugaacucccuaaggacagaaacuuguauaucuuccacucggaauuuccaagucuaacuacacugcugggcacaccauaagugccaaauaccagguucuaaauuguacugaauguaucaggcaacggccuucugcccuggaauggucuuacccauuuguuccuagccagccccacccuuccugccaucauggucacuuguaauugagugauggagcuucucugccugucucuuaucaccuaugagaaccauuccaaaggcaaauuuccuccugaaaggcaauaacagauuuuacucucuaucucuuccugcuucccuucagccauggaaggcacuagugggguugagguagggagauacagagggggaaugaaggagugaauucugacaccccuuaacugccugugccaccuuuaacaguguccucucuagccuguguggggagaacacggaagaauccuagaagcugggggcuggaugugaagauaagaaaacgaaggauuuggcccagugcagaggcucacaccuguaaucccagcacuuugagaggcugaggcaggugggucacuuaaggucagaaguuugagaccaaccuggccaacauagugaaaacccuucucuacuaaaauacaaaaauuagccggguguggugucacacaccugugaucccagcuacucuggauucugaggcaggagaauugcuugaacccgggaagcggagguugcagugagccgggaucacgccacugcacuccagccugggcaacgagagugaaacuccgucucaaaagaaagaaagaaaggaaagaaggaaggaagggagggagggaaggaaggaaggaaggaagggaggaaggaaggaagggaaggaaggaaggaaggaaggaaggaaggaaaggaaaggaaggaaaggagaaggauuugugcagaagggaaggaaggagaaggauuuguucuuagagggaaaagcaucuaggacuagacucaaagacacacguguauucauguacacaccuaacuucagaagggagggacugugcuacauacaccucgaguaaacauauggagauaugcaagcacaugcacuggcagagacuacagaugcaggcacauaccuggagggacucugccagaaugcacacaaacaccuacaaggugcuuacaggagcucacacacaggauccagaggcacgcacacaacccaaagggugauccucagggacaugggcacauacacaccuagagaucauucacauacaagcguugcagaugcaugcacauaccuagcgugcacucacaggguguacguggacacacacacccaggaguucacacaggcacacaccuagggggcgcucccagggcccaagcgcacacacucaccucaaagguguccacagaggcacacgcccccaggacgccgacgcacgccuagggggcgcucgcagggccggcgcgcacccgcacgcgcacacgccccugcccagccuccugcccgccuccgccuucggaggcugacgcgcccgggcgccguuccaggccugugcagggcggaucggcagccgccuggcggcgauccagggcggugcggggccugggcgggagccgggaggcgcggccggcauggaggcgcugcugcugggcgcgggguugcugcugggcgcuuacgugcuugucuacuacaaccuggugaaggccccgccgugcggcggcaugggcaaccugcggggccgcacggccguggucacgggugagugcggaggcgggugagugcgagcuggcggggcgcgcggagaggaggccgggccggcgguagcagcggcccgccgggcucagcucagcucggcucccgcccgcgguccgcaggcgccaacagcggcaucggaaagaugacggcgcuggagcuggcgcgccggggagcgcgcguggugcuggccugccgcagcca

SEQ ID NO: 16710 - RNA, 4269 nt, Homo sapiens
uggcugcggcaggccagcaccacgcgcgcuccccggcgcgccagcuccagcgccgucaucuuuccgaugccgcuguuggcgccugcggaccgcgggcgggagccgagcugagcugagcccggcgggccgcugcuaccgccggcccggccuccucuccgcgcgccccgccagcucgcacucacccgccuccgcacucacccgugaccacggccgugcggccccgcagguugcccaugccgccgcacggcggggccuucaccagguuguaguagacaagcacguaagcgcccagcagcaaccccgcgcccagcagcagcgccuccaugccggccgcgccucccggcucccgcccaggccccgcaccgcccuggaucgccgccaggcggcugccgauccgcccugcacaggccuggaacggcgcccgggcgcgucagccuccgaaggcggaggcgggcaggaggcugggcaggggcgugugcgcgugcgggugcgcgccggcccugcgagcgcccccuaggcgugcgucggcguccugggggcgugugccucuguggacaccuuugaggugagugugugcgcuugggcccugggagcgcccccuaggugugugccugugugaacuccuggguguguguguccacguacacccugugagugcacgcuagguaugugcaugcaucugcaacgcuuguaugugaaugaucucuagguguguaugugcccaugucccugaggaucacccuuuggguugugugcgugccucuggauccugugugugagcuccuguaagcaccuuguagguguuugugugcauucuggcagagucccuccagguaugugccugcaucuguagucucugccagugcaugugcuugcauaucuccauauguuuacucgagguguauguagcacagucccucccuucugaaguuagguguguacaugaauacacgugugucuuugagucuaguccuagaugcuuuucccucuaagaacaaauccuucuccuuccuucccuucugcacaaauccuucuccuuuccuuccuuuccuuuccuuccuuccuuccuuccuuccuuccuucccuuccuuccuuccucccuuccuuccuuccuuccuucccucccucccuuccuuccuucuuuccuuucuuucuuucuuuugagacggaguuucacucucguugcccaggcuggagugcaguggcgugaucccggcucacugcaaccuccgcuucccggguucaagcaauucuccugccucagaauccagaguagcugggaucacaggugugugacaccacacccggcuaauuuuuguauuuuaguagagaaggguuuucacuauguuggccagguuggucucaaacuucugaccuuaagugacccaccugccucagccucucaaagugcugggauuacaggugugagccucugcacugggccaaauccuucguuuucuuaucuucacauccagcccccagcuucuaggauucuuccguguucuccccacacaggcuagagaggacacuguuaaagguggcacaggcaguuaaggggugucagaauucacuccuucauucccccucuguaucucccuaccucaaccccacuagugccuuccauggcugaagggaagcaggaagagauagagaguaaaaucuguuauugccuuucaggaggaaauuugccuuuggaaugguucucauaggugauaagagacaggcagagaagcuccaucacucaauuacaagugaccaugauggcaggaaggguggggcuggcuaggaacaaauggguaagaccauuccagggcagaaggccguugccugauacauucaguacaauuuagaaccugguauuuggcacuuauggugugcccagcaguguaguuagacuuggaaauuccgaguggaagauauacaaguuucuguccuuagggaguucaaaaagcccauuagggcaccgggagcagagugaugacgccugcaugggcagaugaaagucagggacagaccucagauuccagggccaguuuccuauuuagcugcacugcggauucggguuuccauuguagaugcugugggaugaggcuggggguagaauauucauuuucuaucccuaaggcaaaauccugacacacaagcagaugcaccuacacaaacagugcuggaauauacacagaggugcucuccaucugaggaggcugaccucaggaaaacuuccuggagaguuuuucacuaagaucugggaggaaagcauggaauuugguuuaaugaagguccccgggacuugagaauuaagguaaugcagcagacucguuuuuugaugaggaauagcaguuguagagaagugugacugcagaucacaugacuagaagugacaggucaagacuagauuccacuaucagucaggguucucuggagaaacagcuccccccgggccagcagacgcacccaugucauuccauugucauccacccacccuggcucacuuuucuccaacaccuccccuaccaaacuucccuaugggaaugagaccuguucaaaaggccccccaccugcuagacccagaucuaggggagggucuccucuaagggugaugacagguaggacagacagucagaaaacaauuugaaguauuuuuguuuuuuauauacagaauacaggaaaguuucuguaaagucuaaaacauuacaauuacuauguacauugguacugguugugggggugggaggagaggagggaaccaggggcaggaggaagaggagagaaguggcaagagaacaaaaaaaggagacaaaacagguuuacgacaaaaacauuuuugcuacaauagacaauuugagaaaacgcucuaccacauguaguacuguacacgguuuuuaaaaacauugaaaaaaugucaucacuagauguauuuacacaaaauccaaauacacuuuuccuuauuugaaauaaaauagauggacagccagaaaaagaauucauuucucauuuguccauaauacacaguagcuaccuguagugcaaccgcugcagaaagggaaaauaacguggagggugggaaccauggaaggaagguggguagcgaucuuuauauuaaauaaaacaaugauauuguauagauuuugcuguaugaaaacuguauuuuuucuuuuaauauaaaacuauugucacugccacaaaauagaacaaguuucugauuauuuuacaauggugggcgagggggagggagcaggagguggguggggaaggguuuuguguuggaggaaguguccagacccugggucuuucccucccugcccacgcuguuccucagcucaggucugccgcuuucccaugaaauguugaguacaaauauaugugcaaaugcccccuagaacuugagaaaagaaaaaggauuuuuaaaaaacagucaaaagguuuucuucauuucaugcaaagauuguaguugaaggguuucugguagaguauagaaaacacccgggcuugguuuguguacauuuuugcauugcaggagucuuggguggguguacaggccaguggcgggguagccgccaguccuaaggaacagaguuggagcgcagcacagggcccugguggggcuugagagagagcuucucggccaagaccccauccugcagcaggcuggcaucgccuuugggcuguuuggucgcaaacucagugaugcugaagacaaacugcaggcagcccagcuugauguagcugccauggugcaguaaggcugugcccucccagccggccccacugcccccaaucaagcucgagcugcuggcuuugcaauugcagggucuccgcugcggccccugggccugggaacucaucauggcugccuccucacuuggcucuucguccuguuucuggugccggcggcgcccugggaaaaagggggauggucacagaagaggaacagugagcagccaacccaugugggcuguuugccaagguugggcuccugcaucuccccauuccaacugcugcaugacuagggaggaaggaugcucagaaaggguugguggagucugaaguccccacagguguguacacacauggggguacucagcacuugcuucucuguggccugcccugggcccacgaggaaguagagcuuggccaauaggacugggaaggcaagagacagaccaugggcagcaagucagaaccacccugacuggggccucagcuuuguggccacagaucucugcuccaacuuacugaugacacucugcacuuuggcaacaauacugc

SEQ ID NO: 16711 - RNA, 17760 nt, Homo sapiens
ucucuuccggagggcgggcuucacagccgagcccuggccgcgaccgccagucggcgccgcccggagccgggagcgccgcuccagcgaggcgcgggcuguggggccgccgcgugccuggccccgcucgcccgugccggccgcucgcccgccaugccuggcuucgacuacaaguuccuggagaagcccaagcgacggcugcugugcccacugugcgggaagcccaugcgcgagccugugcagguuuccaccugcggccaccguuucugcgauaccugccugcaggaguuccucaggugcuggccggggagcaggggacagcgggggcggggcggggcggggggcgccgccuggggagggucucgggcccggggcaaggcgggccuuugucugcgcugcgacccugugaccucaggggcgccccgugacgucacggggagggaugacgucaagccccgagggaggccccccccgcaggaauccgagggguccgggcgggucccaacugcccggcccggggcggaagaccucggcgccuucucguggggucaggaggggaagaggcccuuccccgucaccugagagccggcgcggccucagccuugaacuuugaauccugggggaagaggacaaaacccgcucccgcguggcaguuugagccuccggagcuuucccccaucuaaccucuucugauucuucgaacguucagagaacgguagcuauuguucucccauuucacagaucaugaaacgagauucaaagaaaggcugcgacuugcccagggucacauaguuacuuaaaggcuuaacuaggauuuaaacccggacugcuuaugaucacacaauggaggaaggacugaauccucccccgaagaaggaccccucuaggcggcuccccucucucccgggggcuggaguaaggcgggugguccauaagucaugaagaagggggucgcacucguguuguuacugaacucccgcugcccucucaggacgcagguuagcccuuggcucuugggcauccaucaaguuucugggcgcccuguaugucuugaaucuccugcucacgcagggaaccccucaggcccgggugugggaagcagggugaaggagccccgacucuucggaggucaugcccccagagcgcaggggaaggccgagucggccacugccuggcuguuugcugggacgaggggaucgagggccuggcagggauaguaccucugagacgccugccuccggugcucccucccgccgugccucccucccucgcucgguccuccguagcuccuacuggcggaaaucucagcaggcccuuuguuuucuguuccccacagccugggccggcuccugcccucacauaugcuccggcacaagcugcaggacugcccccucccccucggcaguguacacauuuacucuccuacagacacagccccauugucuccgccacugcucuuccccggcccucuggguuccagaugaggccagcugagccccccgacccccccacagcugacccacccugacugccucgggaaaggagcgggggagggggccgucaggccggauuccuuccaccaccuucuuggccccccucucugccacucccccucccggaaauccccucuuccucucccacucccacacccccuccccccauccugucuucuucccugggccuuggccuccacugcacagccuggagcagccucugcccugccugucccccaucccccagugccugagcugugcugcugaggcuucugaaggggagagaggugguuggguggucccugcuccucacccgccacgguacaagcacaagugaggguguccacagcccuggcugggccccaagcugcaggcuaagcuucugccugaagccuagggacuugccucuguccccucccuuucuccaaaaccacucagucagcacauuccugaagcagccaaguggacccccucccccugggcccaccccucuuuccccacuccugccugagcuguuagguuggcccaggaaggcugguugcccugugggcagacacaccccuucagugccugugguuguauuguccuuggcauugaagcauggccagugguagugggaucaaggggaggaggugggugcuagaaauccuuggggcaguuggggcauggacugccuggguccuggagagugccucuagaacugggcucccaugugggcucugguuccgccuggaucccugccugccuuccaccuaccugacucagaccugccaggaaugcccugccccagggcccugaguccugcugggugagccauugcucugccugagccaugccaggcaugugugacuggcccuggcuggggucagcaagggcaugucgacagaaagaagcaugccaacaggcuccuugggugcugacggccagguaggguuuggugcaggagaaggcgggcagcuagcaggaggggacggucaccaggcuucagaagcccacugagcagugcccagagucuuagcugugcuugcuggacauuuuuccuugccccagcuucucuuccuugugugugugguguaguagagccugucugagcuguggagucagacacacauagccaggugcugcuucaccuguaagccucuucguuucaucuguaaaaugggggcauuccaccccuucucagaggcagguggcaagggccgggugggaauguaaacaggugccaaggagcaugccuuuccuccccuuuucugugggagacacacccucaaaggagcagggcaggguaagguggccgcaagcugaccuuugcccugguucuuggcagaggaccuuccuggggacugggcagccuucgcacuuaaucucagcccaucccuguucccccucccagucagcuuucagcgcagccaaugaaaacuaaccuagggggagggggugacugugcagcguguuccuuucccaguccagcugccauccugggggagggggugccagcugccaccuguuggccaaguccugacugaggcagcugucugugccuccucuaggcccagaccccccuucccaggacaggggcuggggucuucugggauccuggggaaguagagccccucaggccucugcuugcccuuuugucucaucuaggcugguugggaaccggucuggugaggaagggaggcugccucaguggaggggguggggccaggccucccuuuccccuaaugagaaaccuuuuuccugccccucccccauuucagugaaggagucuucaagugcccugaggaccagcuuccucuggacuaugccaaggugaguccacacugccaggaagaagcccaagcacagucuguugcccuuggaggccggagcugcuggcagccagugggcucagggccagugucaaccaaaagccuugggauggugcgccuccacaaagguagccuguucccucccaccaggccaguuugcaaacgaggccccuguuugcccuggagggcaugcacaaugcccagccuguaggggugcacagagcugcucugugcccgcaagaaguguucccuccccuuccgguggcaagccagaccuguggcugagggccaguaucccuccaccaggggaaaggaagcagagccccagggacagccugggauugagcaggcugauuggcugccucuucaaaggaagcguccugugcaggcauguuaggacccagcaucagagcagaugcugccugcugugcccuucaucccuggacucaagaggggcaaagagcccaagagaggcuauuacaggcuccaagguagagccagcccaguugggucuaggggugggaacugggcacugcagucagcucugacccuggccaguucccccaucccuacccccagaucuacccagacccggagcuggaaguacaaguauugggccugccuauccgcugcauccacagugaggagggcugccgcuggagugggccacuacgucaucuacaggugaggcucugaugugagggcuggcaccaccucucccuuggcaggcacuaauugcagccuucccaccagggccaccugaauaccugcagcuucaaugucauucccugcccuaaucgcugccccaugaagcugagccgccgugaucuaccugcacacuugcagcaugacugccccaagcggcgccucaagugcgaguuuuguggcugugacuucaguggggaggccuaugagguggguggggucuggcugaauguggaggaggggguaccugauggccuaggcaucucuuaacucagcaccucugacauuuccagagccaugaggguaugugcccccaggagagugucuacugugagaauaaguguggugcccgcaugaugcggcggcugcuggcccagcaugccaccucugagugccccaagcgcacucagcccugcaccuacugcacuaaggaguucgucuuugacaccauccaggugaggccuucccugaacuguggguugcaggguaggugacagguagucaggauauugacuccugccucucuacuucuguggccccagagccaccaguaccagugcccaaggcugccuguugccugccccaaccaauguggugugggcacuguggcucgggaggaccugccaggccaucugaaggacagcuguaacaccgcccuggugcucugcccauucaaagacuccggcugcaagcacagggugagaugccccuuuuccugucagcccccuuuugcccuugaagcccuagacagaggcucagcuucugauguacuuaggccuugguggucccugcugugcugcucugaaacccucaguccuucccucugcugccagcuccagccucuuccuaacacccucugucuuccucacguagagcugggugccugcuacccuguacccacuccucuccucucccuggaccucccccuacugauaacucuccucccuucccccauggccuggggcuuugccaacagugcccuaagcuggcaauggcacggcauguggaggagagugugaagccacaucuggccaugaugugugcccuggugagccggcaacggcaggagcugcaggagcuucggcgagagcuggaggagcuaucagugggcagugauggcgugcucaucuggaagauuggcagcuauggacggcggcuacaggaggccaaggccaagcccaaccuugagugcuucagcccagccuucuacacacauaaguaugguuacaagcugcaggugucugcauuccucaauggcaauggcaguggugagggcacacaccucucacuguacauucgugugcugccuggugccuuugacaaucuccuugaguggcccuuugcccgccgugucaccuucucccugcuggaucagagcgacccugggcuggcuaaaccacagcacgucacugagaccuuccaccccgacccaaacuggaagaauuuccagaagccaggcacguggcggggcucccuggaugagaguucucugggcuuugguuaucccaaguucaucucccaccaggacauucgaaagcgaaacuaugugcgggaugaugcagucuucauccgugcugcuguugaacugccccggaagauccucagcugagugcaggugggguucgaggggaaaggacgauggggcaugaccucagucaggcacuggcugaacuuggagagggggccggacccccgucagcugcuucugcugccuagguucuguuaccccauccucccucccccagccaccacccucaggugccuccaauuggugcuucagcccuggccccuguggggaacaggucuuggggucaugaagggcuggaaacaagugaccccagggccugucucccuucuuggguagggcagacaugccuuggugccggucacacucuacacggacugaggugccugcucaggugcuaugucccaagagccauaagggggugggaauuggggagggagaaaggguaguucaaagagucugucuugagaucugauuuuuucccccuuuaccuagcugugcccccucugguuauuuauuuccuuagugccaggagggcacagcaggggagcccugauuuuuaauaaauccggaauuguauuuauuaauuugcuuccagccugacuuaccuggguugguuaggucccugggaggcucaaccaaacugaaggcaaagaaaggaccagucagagaagggccgcugccugggucuggccccaggauccagcuuaccugcuggcucgcccucugauggacgccgggaaaacugcaucgggcuuuguguggaagacggucccugccacugcccucugccgaugaaaugcgggaaguguauggccuagauguuucauaaggcuggagucccuggucagccccaccagauuagugcuucuacccuaggcagggcuuucuuggucuaaugguaauaagcaccgacacugcuaagcacuuuacgugcauuauuauuucauugaaaagaacugucaagugaaauacuuuuuagcacaguaacuggcuuugugggcucuagagaagaguuaaugaggcagugcauguucuuggcccagaguaagugcuuagugaaugcuuucuaacuccgaaccccagccacauccagggacuggguguugagcaaaaggggccuucaagauguucaaggcacuuggauuuucuccugucucucaucggcuuuucuuaacgggccucagugggugcaugugauuauccacguuucaccuaugaaacaugaacagaggagacugacuuaucagugauucuuccgcggguucggacagggccucgauucuguuuuaaacuccaguagucccuagaaauuguagcucccucuaguuguggcaauagguguggguccuugugcuugcuuuuggcaaguuucugagcuacacagggccuccauuaccgucacuggugaaaugcggcucaccucccagauuuguuguaaagauuaaaugaacuggucagcacacagugccuuacugucuugccuagcccugagaagaggcuguauguacgagaaucauuaguaagggaagguucaaggacuguaguucuuucuuuucccaugcagaggcugaggguuuaaacaaaaaaaaaaaaaacucagccucugcugcacacgacuagcuacucaggaggcugaggugggaggauggcuugagcccaggaggcagagguuaaagugagcagagauugcgcuacugcacuccagccuguguggcagagccagacccugucucaaaaaaaaaggccuugggcugggcgaaguggcucacucacaccuguaaucccagcauuuugggagguugagguggacggaucacgaggucaggagaucaagaccauccuggcuaacauggugaaaccccgucucuacuaaaaauacaaaaaaaaauuagcugguguggugacacgcaccuguagucccaacuacucagaaggcugaggcaggagaaucacuugaacccgggaggcggagguugcagugagccaagaucgcgucauugcacuccggccuggcgacagggagaauaaaaaaaaaaaaaacccuuuauggggugacaggacaggacuaagccucagugagccaggcuggggaggucaucaucggcccaaucuuucuuuucaaaaaggucaaauugacuuacuuaucuagggagaaauggggcccuccugccuaggugagaaacuagagcugggcuucuucaccagauaaaccgucuugguacggugaugccuggagacugguagaggcaaccaugggcuccagcagcauaaaugcuuucaggcaacaggcugaaacaccuuuccagaaucccagcuacacaccugaccgagcacaguggcugaugccuauaaucccagcacuuugggagccugaguuggagaugacccugggcaacaaagggagccaccccguaucuacaaaaaaauauaaggagccgggcacaguggcucacaccuguaaucgcaacacuuugggaggcuaaggagggcggauuaccugaggucaggaguucaacaccagccuggccaacauggugaaacaaaagucucuacuaaaaauacaaaaauuagcugggcgugguggcaggugccuauaaucacaccuacuugggaggcugagacaggaguauugcuugaaccugggagguagagucugcagugagcugagaucgcaccacugcacuccagccugggcaacaaugagcaaaacuccaucucaaaaaaaaaaaaaaaaaauuaguugggcaugguggugcacaccuguagucccagcuacuugggaggcccaggcagaagaaucacuugaaccugggagguggagguugcagugagcugaacuccagccugggaaacauagugagacuccgucucuaaauaaauaaauacacugucacugcaugcuuccgggggucacauucacauagucuagauggugccuccuagaguugcaugcaaacaauggggcuguuaaccccauacucugcaagccuugcacaccuggaccuuauucagugcuagucauaacuugcagaauucaggccauguucugcaauaaaagugugagcugcacuccccaaggaucuaccucagcccaggaaucauucacucuggaggaagcgcuguacuuuacuaaugucuagcuccgcuuuugggccgacugcagaucuuaucugacacaggcagaagacagcuuccuuucacagggguggcaugaggcauaaaggagucaaaacacuuucacaaaagaacacccucggccaggcacaguggcucacgccuguaaucccagcacuuugggagguugaggcgagcggaucacaagaucaggaguucaagaccagccugaccaacauggcgaaaccccgucucuacuaaaaauacaaaaauuaccugggcaugguggcgcacaccuguagucccagcuucucauggggcugaggcaggagaaucacuugaacccgggagguggagguugcagugagcuaagaucgugccacugcccgccugaacgacagagcaagagacuaucucaaggaaaaaaaagcacccccauccuggcuaacauggugaaaccccaucucuacuaaaaauacaaaaauuagccaggcauggcggcgggcgccuguagucccagcuacucaggaggcugaggcaggagaauggugugaacccaggagguggagccugcagugagccuagauugcgccacugcacuccagccugggcgacagagugagacuccgucugaaaaaaaauaaaaaaacaaaagcacccuacagaaaagggugugcucaagaaagaaggcuggugcuuuagcuccgucagcauucaggaagccaccugcggacucuugccgccaagggucugauucuacccucccugaaucccccaucuuguggaaucuauauguguauauauauaaucuauauauauauuauauaauuauauauauagauauuauauguauacauauagauauuauaauuauauauauauauacacacauauauauauaaucuuuuuuuugagacagagucucacucuuuuugcccaggcuggagugcaguggcacgauuucagcucaccgcaaccucugccucccggguucacaagcgauucuccugccucagccucccgaguagcugggauuacaggccccugccaccaugccuggcuaauuuuuguaucuuuaguagagacgggauuucaccauguuggccaggcuggucucaaacuccugaccuuaggugaucuggcuggccuucacuucccaaagugcugggauuacagaggugagccacugugccaagccucaauuuucuuuucucuuuuuuuuuuuuacggaguuuuuucucgucauccaggcuggagugcaguggcgcgaucuuggcucacugcaaccucugccucccagguucaagugauucucgugccucagccuccugaguagcugggacuacaggcgcccgcugccaugccuggcuaauuuuuguauuuuuaguagagacggguuuucaccauguuggccaggcuggucucgaacuccugaccuuaggugauccagcuggccucagccucccaaagugcugggauuacaggugugagccaccacacccggccucaguuuucuuuuuuuaaaaaaauaguuuuuucauuuagagaugggggucucacuccugucacccagauacuggcacugcagccguaaacucucgggcuugaggaauccuaccacuucagccucccaagcagcugggacuacagguaugugccaucacacccaacuuuuguuuuuuuuuuuuuuuuuuuuugagacugaguuucacucguugcccaggcuggagugcaauggcgcgaucucggcucaccacaaccuccgccuccgagguucaagcaacucuccugccucagccucccgaguagcugggauuacaggcaugcgccaccaugcccagcuaauuuuguauuuuuaauagagacaagguuucuccauguuggucaggccggucuugaacucccgaccucaggugauccgccugccucggccucccaaagugcugggauuacaggcgugagccacuguacccggacuacacacccaacuuuuuacaauuuuugaagacacagggucucaccccugggcacaagcaauccacuucagccacccagagcuaggauuacaggcaugagccaccgcacccagccagaaucaacuuuuccuuccauuacaucuuagcucaaacccaagcucaacagaagaggaggguaacuuaauucauuuuuuuuuuuuuuuuccugagacgggagucucacugucgcccaggcuggagugcaguggcauaaucucggcucacugcaaccuccgccucccagguucaagcgauucuccugucucacccuccugaguagcuggaauuacaggcgcgugguaccacgcccagcuaauuuuuguauuguuaguagagacuggguuuccccguguuugucagguuggucuugaacuccugaccucagaugauccaccugcuuuggccucccaaagugcugggauuacaggcaugagccacugugccuggcugcaaucacuuaguguuuuuuuuuuuuccucugcagacaaaaaaauaaaguuauccaaaauucaacauaagaaaacuguaaucaccaagaggagccaguuacauugcagauaacagugccuaucaccuucaccucugucagaggcccucagaauuuccaaaguguuggaaguggaagaaggcagguuugaaguuuuagguuggguuauuagcaaaccagauccccauuucuuggcugggcauggugguucacgccuguaaucucagcacuuugggaggccgaggcagguguaucacuugaggucgggaguucgagaccagccuggccaacauggugaaaccccaucucuacuaauaauacaaaaaauuagcugagcgugguggcaggcaccuguaaucccagcuacucaggaggcugagacaggagaauccuuugaaccugggaaguggagguugcagugagccgagaucgugccacuggacuccagccugggcgacagagcaagacuucgccucaaacaaaacaaaacaaccagaucgccauuucucaaugacuuauggcccuuggaaugcaaguggcaggaccuuuugggccuccagugagggacagcaaaccacacuuauccucaaacuucacaguaagcccacagcagcccugcccagggagagggccugucagccggguacccuguguccaggguuucauugaagaacugucuacaaucaccauagcaccuggccuuaaauaauggauuuggagacggcuucugggugggaugcauauuacagggguaccccuuuuaaaaauuaggaauuacuccuaugaagugagguauguuagaaacuguuaagaaaaaguuaccucaaacauucacagcacuaaacgaauagaacaaggucagaaagcgagguuuucuuauuuuuacugguuuauaauaaucuuaaaaaccccaucacacccauaaaccaccacaggugaggugagagagauggagaaugaaugcuacaguauguggauagaauggggaauccagguauucccuaggguaguguaggauggagacagggaguguggagaggaggcccuggcuuggacccuuauugcuggcuggggguuggcuggcagaggggagagggacucaggcugaacuccgaaagaaggaacaucucacaccaaaggcgagggcaguugggggcagggggaucacaguacauuuuccaugcagacuaagggugggagugagagcuucagaggcuugcaccccuacacaggaagagauggguuugagguuguuugacuuaaagcccccaaguuggugucugguccaguuuccuaaaauagcagcucaccuuucagggagagguauuggggaggaaaaaaaaauacagcaagaauaucugcuuuggagaucaagcaagggguagggggaagacaguggugcucuuuaaaucugacucagaaaagcaggaacuggaagagggcccugggugagauggcggccaacaccuucggagaaggcauugagucagaagcuacaggugcuccugggggaucaggacagggagguaccaguguucacagacggcaggaaaacaauugggaacaauaaauuaggacuucauguugcuaucauuuggcauaacacaaucaggcuuuuuuuuuuuucuuuuuccuuuuaaauauaaggcaacuugccaacacauaacuuaaaacuggucuucagucacauugcuucagaucacuagagaauuucuggcuaacgaacaguaguggauagugaacaaaaugcaaaaccuuaaauaagaaccaucagcugacauuccccagagacaagaggaaagguaagggcuuauuucaucuguaaaaaauaaaaaagcccaauucugcaucuuuaacagaauggugcaaaaauuuguaacaaaacagucuaaguuuaaaauuacagaaaaguguuucuagccaacuaauugucgcuugggaugagacgugcugagcauggaguggaugaagguaugcucuaagaauggacagagggcaggaggggcuuguuuccaauguaggcccagcuccagguguuagaaccaugcucauuugguaaaggaaguacucaaagagcuuaaggcuuuguguuuguuuuuuuuuccuucauuaaacugaggggcugcacuagagggugaauguaccuguggggccacucacacacaaugcuacucaaacccacacuacauucauacagaaacguaacguuuaaaacuuacaguguagagcaauauucuuagccaguguagagagaaccaaaugcauuuuuuuuuuuuugguguuuuuaaucccaaacuccaaugugaucauuccuuaccuaccuaauuccucaaguaagguagauuuuguuuuuguugagggggaaaggauaggggcuguggggaggugaguuaggggacaggcaacagugagaaagggaucuuggguaugcucaaaggucacuguauuuuucuagguuuggaaaggggagucuggaaccaagaugccaauacaaagacuuuuuccccccauaucucaagaaauggucaaauacuuccaagaugcccuugagaucaaguguggcaagggcaagugcaguggcugugggaucaauauagacacaaaacaaagccuugaggaauggaaaggaacuugaaggauaugaagacugggucagcuuugauuugagauccuucgaugaguaaguaauuagcuuucagagcaccugggaaaucuugcuucuuaguccuggagggaggggaagggggguagcaacagguagaggucuggauuaggggccugagcaccuauacuaccucaacuagggcauuccgucagcccacaccucagucguccuaagggaaacaggaagagauucaagaaaagaugggugggagcuggcuggaaauggccaagguggagagacuagcugacaggcagucaguggagagaaaagccugggcuuaggguuagguucuaacauaaaaccaaaaguugcuggaggggaggacgagaggaccccuucuguccccacuuagaucccaccaaauucccuuucuuagacaucuaagaaugaucacacuggagcagugaaacuuugaaacuauccaguuacuuaaaagacuaaaccuaggagggugauguaugauguguugcacguggagggcagcagggcuaccuaucuauacccugggugcugaauaugaagacuucgacucucugugggaucgggggcucgguugccaggggcucggugggccuugcucagcauggccaggcucuguucucggaagcaggccuguuggaaauccccacuuagguaauccacuguuugcaucaagcuguucuggcuugccacuggaccgcccccggucccugcucgguagugggccccgggagcugccgcacagucgaggggugcaccugugggcugcccaccguggaacggcauggcaagguccugagaccccgagcugucgcuauugggagugggcagaauguuguuccacagggguuggaaguagugaccauugggguaggccaauggggcugccaugccguugacugguggggauggggucggcuuuuccagggguggcuucagauggaaggacugcgccaggcagaguuccugcggguaggcaggggccuugcccacaaagccaggcccugccaacucgcguccugccgcaugcuugccugucaggccaggggcuggcgucccacuagccucgcugcacaucugcuguaggugggccagcuggugcugguuccaggugacuggcuugaggucgcuaggguagccaguggggacgcgagagaugccugugggcagguugacaggaccugcagcaggcaacgcggcgguggccgcgugggugugcuccaugggauugaccacacaugaaggcauugguguggggacgcugugggucgacacccgggugcuugcauugaugagcagacugcgacuaauggggcugggguuggcgaucuggcccucacacacugagguagugcugaugccugcccucgucuggcaaaacugguugaucuggugcacgaugcuacucagguccggaggcuggcugugcugcagaguggccgccauugaaagggggauaguugagguagacacggucacauucgggggggcaucugagucuggcaucuuccggccuccaugcagcaagggauugugggggugcuggagacccuggugagccagggccugaggguggaccaagcccuggguuugggccaugggcugaggguggcccaggcccugaggcugcuggaggcucugagggugggacagugccugggguggcgggauacccugagggugcugcagcgucuggggaggggcaugggccagggucugugcaugcugcagggccugcuggcgggccagagccugggccugggggugggcuaaagugcugggugccacaguagcauagggugccacugggggguucaugauggccucagggagcaaccgggcucgggugccgucaaaguccuugaguaugcuuuuggcuggcacuuugacaauggcaagcaggccugccuugguggcagccugugucggguaggggcuguagcgcugggcugaugugucgaggccguucacaguacgacgaacguguuuccgcuggggaaccuucacacuguuggggaagauuuuuauagucaguggguuguuugcgaccuucuuagcauacgcauccaauucggcugggguaggauagugagcaguucucauuuucuguguaguguccccuagagagagagaaugggaaggagagcaaagagggagagggagcucaucagugccaaggcaaacagcccuuccagauuccccuuuugagggccuggggugggguggggaaaugacuagauugucaucuguagccuucauucgagacccagcuucagucuucacauuaacaagcacugcuaauguucaguaagugcuuauagugggccaggccuucugccagaugacaggccaucucaaugaauccucacuauugcuguagaagcaggcacuaucaucauuuacauuuuauaaaugagguaaguagagaucagaacagcaaagcaucuuucaaagucucauaucuugcagaaccagaauuuggccaauucucagagagguaaccgagaguucucccccuacacagaaauucagggucgcugggcacgguggcucacacuuguaaaucccagcauuuugggaggccaagguggguggaucaucugaggucaggaguucaagaccagccugggcaacauggcgaaaccccgucucuacuaaaaauacaaaaaguuagccaggcgugauggcaagcaccuguaaucccagcuacuugggaggcugaggcaggaggauuaauugcuugaacccaggaggcggagguugcagugagccgacaucgcaccacugcacuccaaccugggcgacagagcaagacucugucucagaaaaagaaaaaaaaaaaagagagaaaugcagggucuggaacucuaccagcccauguggcuuggggguagguucuaagcaaagcuccuugucagggccaugguggcccuucagucuagaggguacccagagcuacgacucuucagucugcagggaccaaugagggaucagcuuucccuugcaucuuggcagcuggggggcuuugcccacugggugggcacccugaacaguagacagaaugcuuccuuucaggagcagaggaauaagcugccaacaucucuccccuuccccaugucacaaguucacuuuuguuuacaguuuacucuaugcccgacuggaugaggaucaaaggcuuuauuuauuugcuugagaaggaagauaauaaugacagggcagcagggagggaauugagaagaaaggauucagagcaucuuucaguccuuucaguccugagagccaaaaauagucuguauuugguccaugucagcugucauuuuccaaaaagaaagaggaaaaaccugccugccuuuggagacugcggaaaugcccacucggugugccucauuaauguuaacagucucuuuguucccaucuccuguugccucccaucagggggcucagcggauguccggcuuccagucaaaaaggaaaagguucugagaacaagggcucuuuaaggaugccaaccuccugcaagggggcucugcucuacucucucgucucugagggagggucuccccugaguauacacaaaaggugccuaauaaaugcuugcugaaugaguacacagacugcccaaagcagaaguggcuuggcaggaagcccaggcucagcuagccgacucucuccuuacuuccuccucuugcaaaaggcaggaggauaggccaacgacuaaucugacugaaugcccagcuuguggccucagguggccuuggcccaaaggagacucuauucaaagucacaucacugggcaucaccuagaacaaagguaggcuaaugagcauauuagaaggaaaauggguacagcucucuuuguuuggugauaaugcugguuagcaacuccugcucugggaagcaggaaaagaaagcucaagucaggaggggcagagagauuugggcccaugcucacaagcagaucugggc

SEQ ID NO: 16712 - RNA, 6198 nt, Homo sapiens
cagcgcccuagguguggguuccgccacgcguccguauuugugggccugcaccacacaccucccgcugcgacacgccgucacuuuuccccucacgacccugccccacgcaguguccaagaauagggcaagaaaauagggcgcgcccgcaauggcgggcacgguacccgccccucccacacauauacccagcccuuguaaagcuugcuagacuaaaaggaugucgcguucccgagaguuaaaccccacaggccgggaaggggugggaagagaagauugacccccuucuugcccacgagugacgcuauuucaggagaaagcggguucuccuuggcacgcaaacgauaaacacacccaaaacgaccgagaccagcgcuccugggagaaggcagcaggguugguuucguguuugccuggggagggacgggggaaaucccaagucgugcaaguugauucaccugaagaggacaugacacggucucgggccgucccgacuagugagcgccgcgcucgucagcacucucaacuccccuuucacacacgcgcugcaggaggguaaucugcccucagugcucaucuucccaugggggaagaugggggcgguagugggucaguaccugaaagcaucaaggggagaaggaaagaccgcgguuucgccgaaaugagcucaaggcaaaagccuagaggcagggggcugguuagugugaccagcuaggcucuuuaccggaagugagguuaauuccagguucucccgggcuccugcucugcgggagcucuagaaaaacucaguauucggccaggcgcgguggcucacgccuguaauuccagcacuuuggggaggccgaggcgggcggaucaccugaggucaggaguuugagaccaaccuggccaacaugguaaaaccucgucucuacuaaaaauacaaaaauuaguugggcacgguggcgcgcgcuuguaaucccagcuacucgggaggcugaggcaggagaaucgcuugaaucugggaggcggagguugcagugagccgagaucgugccauugcacuccagccugggcgauagagugagccuccaucucaaaaaaaaaaaaagaaagaaagaaaacaucaguauucaggaggaggauggucacuagcugaagguuagcgucccuguaucagagugggcaaggggugugaggaaaggggcguuuuaucuucugccccuguccuggcucucgcaaggguauccaaacccacccacguggaaugacugcuggaagggcgcuggcucaggccggugucggccggcggacagagcagcucugugagccaaggggaggggcgggaaagccgcucacccaggacacccguguucucaccuagaaaccgacugggcuuugguugacuuaagagucccacagggguuaauguguaaccuuggagccauaggggaggaaaacacucaaacggcuuggucccuggguccuugcgccucagguuuucucggcuucuuccucccgcccgcagcaccuuuccccucccccgcuucuucccgccccuccucuauuacuacccucuucucccuccccgcucucaucuccgcuuaacuucccucgcuggcucucagcugcuccuccuuucgcccagaguuuauaccuaaacucuccccgaaagcagcugccucgcucggaggcgggagggggagcccgcgccacagugagggcaggcugacaccuaguggcuaggagccgcaacugcugcaagcuaccggcuuggagagcgcgggucacuccagcugucccggcaaaucggaggucuugcuugcccagccuccggggagccgggccgagggccgggacugucugagggaggacugugacagccgcccggccccaggaguuuaagagccggcgggaagagguggcgauggguuacucagcaguucccaagugcccaccucgcgggcgcgggagggacagguaaacacgggacuccggccagaagacugcgaguggugcgguaggggcacugggucugcacggagaccacugucggacgcggggcuccggagcccaccccaggaccaggacuuagggggcgugggcgugucgggucccguccagcucugcgcagaaaguagagggcggagagagcucucgcgguacccgcccagggcgggguagccgguggcccggggaaaaguggggacgcggguuaaugaggccaggcgagcgagggcagcggggacuccgucggcagucgggaggcgccagcgaggggugucucggcgacgacgcccccagcacagcuccuaguuacccgaaguccgcgggagccggccgguggccgagaggccacggggacacccggcucgcgcggcagcagcgccugaggggcgggggcaggcggacggggcgggggcaggcgggcggggcgggggcgcgggcggcugggggcgggggcagaggccucgcagggagggcgaggaggagccaaggggccuagagggcuucgccaacuguguggggcuggcggccggcgggagaggcggccggccuggacuggcccgagagggaucccgguucccagaacagaccuaggaggcggccucgagggcggacggcagggagggccagcaugccccgacugcugcaccccgcccugccgcugcuccugggcgccacgcugaccuuccgggcgcuccggcgcgcgcucugucgccugccccuacccgugcacgugcgcgccgacccccugcgcaccuggcgcuggcacaaccugcucgucuccuucgcucacuccauugugucggggaucugggcacugcuguggugagugagcgacuguggaaaugagguggccaggggauccugagcggggagccggggccggcucuuguguuacuacccccaucgcucacuggcgggcugaggccacgcagucucaccugaucccguuugguauccuauccaaccaaaagccgcaguggccccaggggagggggaucgccccugggaaacuggaggcucuuggguuuugcccagccacucuuagcuucccagucagccacuagcgcgagcccaggaucccccggggcugcgaaggguaaccgagaaguugaugguccuugagggugccgaaaugcagagccuccucuucccuccuuuccaguguauggcagacuccugacauguuaguggagauugagacggcguggucacuuucuggcuauuugcucguuugcuucucugcggguaggucuugcccaggaagcgggaggcaaauuggggacagggagaaggaagcugcuuguucaguucaugaucucuugccccaucccuccacuaggguauuucauccacgauacgguggacaucguggcuagcggacagacgcgagccucuugggaauaccuuguccaucacgucaugguaagagagaagcagacuaugugguauaggccuggugucaguaaucuagucucagcuccgucuuucugaaucugggagaaggccguguuuucuuaccacccacccccgaccugugugcuacuucuuaugcuaggaugcuggagguuggcagucuguacuuguucacugaggccagcaacccaugguuucacugccucuuuagacugaacaucacccacagccagcugugagcagcaaucaaaaucuaguaauguugaacuaacaaaacaaagcaucuuacccacuauaaacuauuauuccagggggaaauuugggauuuuccagcccucaaucugauagccacaccccccaaacuuccaggaaagcgucugcaucuggguucccuaacuccuauucuuucuucccucuaggccaugggugccuucuucuccggcaucuuuuggagcagcuuugucggugggggugucuuaacacuacugguggaagucagcaacaucuuccucaccauucgcaugaugaugaaaaucaguaaugcccaggaucaucuccucuaccggguuaacaaguaugugaaccuggucauguacuuucucuuccgccuggccccucaggccuaccucacccauuucuucuugcguuaugugaaccagaggacccugggcaccuuccugcuggguauccugcucaugcuggacgugaugaucauaaucuacuuuucccgccuccuccgcucugacuucugcccugagcauguccccaagaagcaacacaaagacaaguucuugacugagugaggggcacagagccugggacaacaaaaacggacaaggccagaaacagcuucauauggacacugggacuuagccccaagccuggguguccucugaggccagccucuccaccuucugagccugcgcccacacuauugaaaacacuaaugaaaguacuccucugaaguccuuguccuuuauugggcaaggggugagggaagcagacagaccgguuggacauaguagaugggugugugaggacaaaaugcuaccagagagccagccaauccacacuccccugaaauggaugcuaacacccuucaaacccugggcauugguuucauacacagccucuuccagggauaaaagggguucuuguacagcuuguuacucaaccauggaggcaaguucugaguucugguuuuccuaggacacuaacucuagucacaaagaucucuggaaugaucauacaugguggaguggcagggugagguauuucaaaaggauaaguagaacaggagucuugcccaagcccugucaugucaguguguguguguggccucccagcccaaccagaaauugacagacaggcauguauauggugaaaagauauauauauauauauauucagaauuaggcagcuggacucaguuuagaugaucccaaucugaaaaacaaaagggagccucguuacuggaguugaaauaugaagauuaagcuggaauguuauuuuuagaaagcaaaaugaggaaugugaggauaagguuugucaaggauaggggugcagucaguuaauuaugacuaaucagcaaagaucaggcuuuggucgcuaacauaugcaucauuugcacccaaggggugagcauuaagggguuuguaggaaggaaacuuacuuuguuggcaacauccaaagcaucguaaucaggagccagucgaacauaugccuucuucucuccaucaggccuaggguagagaaggaagccuuagucccugccacccucacugcccccacacccucccccuuccuccuccaguccuccggcacuucagugguuccuuuguucaugucauucuuuuccaauaaugauuuuuccaucauuagcccagaggacaccaugaagccacaaagccaauucucuuaugggaaacaccacaggccacauuaagacuuaaaccaagguaaucugccacgugucgcacucuaguugccuuucccaauagaaguagggacccagaaaaugaggaccaacccccaaucaaguccuagaaagccucagguccacacaaaggucuguaacuaaagcagccuguaauuccugccucaaggcucacacacacugcuaaaccuacaccaaguuuaagucaaggaaccuuuuuccccugcugaaagguccaggggauuuuuuuuuuuuuuuuuuuuaaaaagggccuugcuugguugcucaggcuggaguacaauggggcaaucaugggugauuccuggccucaagagauccuccugcauagcucggacuacacguguaguccugcauuaccaggacuaccuaaacaucaaaaagcuucauggaaugcagguuuuuuuggcuccagacugcugguccagccugcuccccaucccuugaggcccaacucaccgaaucaggguguugaccuuggccacaucaaugucauacagcuucuucacagccuguuuaaucuggugcuuguuggcuuuaacauccacaaugaacacaaguguguuguugucuucuaucuucuucauggcagacucaguggucagcggaaacuugaugauagcauaguggucaagccugggagaggcaaaauggggucaccuggccugggcccauucuuuuggagcccagagccaggagagccuaggugcaucagacaacgagguaccaaucacuuuguucagacuuuggucgcuuuacagugucaucaucugcacccugaaaucuaagggccugaagccccaaucccaggggcagaacguugugcauuuucuuucucuugaagg

SEQ ID NO: 16713 - RNA, 3983 nt, Homo sapiens
uaagcccgugggaacgagcauuggagacccuuuucacaagauggcgccgaaagcgaagaaggaagguguguguuggugauggggccgcagcugguuuaccggggauugccgcgccgcagagcgaacgaauugggaacacggcugcugggcuaagcccugagggcucugcuccggggcugcucccugcguuucggacacgcugcaguauacgugggccgcgugggcccagccucgugggcugaguuccgguagagggaguugggggggggcaacgcggcaggcaucauccgccagggagggccagacauucgguucugggaagcuacaugcauccacugguuggagcuccauguccccgggccuguaaggaauuagugcccucagcuuuaaccauuuuccuucugguucauguucaaccgggcuacauuacccgccccucucuccgcagcgugguuuugcgaugggguauguguaaaauucguaggacauuuucuggaaaguaucaagcguucauucagugcuacuuuguuucauagucguaucccuggaguuacuuagaguuggucgcuuucgccucugguaucgugcauaugauggaaaaguuuuaaucuccugacacuugugaugucuucaaaggaaccacugaugcaccuguggccaggguggcccacugcaguucuuggggccggaagugaccgauuucuaaaucccgcacccacguuuucuuuccuuuucucccagcuccugccccuccuaaagcugaagccaaagcgaaggcuuuaaaggccaagaaggcaguguugaaagguguccacagccacaaaaagaagaagauccgcacgucacccaccuuccggcggccgaagacacugcgacuccggagacagcccaaauauccucggaagagcgcucccaggagaaacaagucaguacugcccccuguacccaugaaaagauuuggguauucuccauugguaauuuggaaauucacucacucugcgugaugguuucucaaacgcaaauuguguccagugugcuucucuaauuggaaguaugaggagauuguuucugcugcauuuacaaaacuggcaggaucagcccagaggccgggcgcgguggcucacgucuguaaucccagcacuuugggaggccgagggggggcggaucacuugaggucagggguucgagaccagccugagugacauggagaaaccccgcgucuauuaaaaauagaaaauucgccgggcaugguggcgcaugucuguaaucccagcuacucgcgggaggcugaggcaggagaaucgcuugaacccgggagguggagguugcggugagcggagaucguaccauugcauuccagccugggcaauaagagugaaacucugucucaaaaaaaaaaaaacccugagucucucaaaauuuguuagguuaauuauugcuucacauguggucacgguuugaaaacuuauuuuggggggaguauaaaguagaauacagagauuccuugcucauagcuccuacugcuaucgggaacaauccuugagggugagaacguggauugauucuugauugauaguggggauuccauuaucuguauuuggcaguuauggccugcugcgguguauagaagcuucuuuccauucauuuucccgaauuuucauacugcucaaggaacaguugggggggaaugggcagaagguugggcacuugaguauuugagcuaucgguaauaacugacuuuuuagggagcacagauuugaguagagccaugguaguaguuaguaccaauggguuuuugcugcuucuacucuuucuuaacagaaaaaguggauuguguucauauaggaaagcaguucacagacugucuuccugccccucccgccaccaagcuggaccuagaaucaagugugacuuuaaauggggaaagcuguguuacaguugugcuuaagccacugcuguggcuuaaccucaccuaugcauaagaauuugcucguggcuggccgggcgcgguggcucgagccuguaaucccagcacuuugggaggcugaggcgggcggaucacgaggucaggagauugagaccaucguggcuaacacggugaaaccccgucucuacuaaaaauacaaaaaaaauuagccgggcgugguggcaggcgccgcuagucccacuacugagucccaggcugaagcaggagaauggugugaacccaggaggcggagcuugcagcgagccgagauccugucacugcacuccagccugggcgaagcgagacucugucucaaaaaaaaaaaaaaaaaaggaauuugccccuggcccgauucuccugccucagccucuugaguagcucggacuacaggcgugcaccaccaugaccagcuaauuuuuguauuuuuaguugagagggaguuucaccauguuggccaggauggucacgaucucuugaccucgugaucagccugccucagccucccaaagugcugggaauacagccaugagccagcacaccuggcccagagaugauucuuuaaucacuugagguuguaagagcccuucaagagaaagaaaaugcacaacguucugccccugggauuggggcuucaggcccuuagauuucagggugcagaugaugacacuguaaagcgaccaaagucugaacaaagugauugguaccucguugucugaugcaccuaggcucuccuggcucugggcuccaaaagaaugggcccaggccaggugaccccauuuugccucucccaggcuugaccacuaugcuaucaucaaguuuccgcugaccacugagucugccaugaagaagauagaagacaacaacacacuuguguucauuguggauguuaaagccaacaagcaccagauuaaacaggcugugaagaagcuguaugacauugauguggccaaggucaacacccugauucggugaguugggccucaagggauggggagcaggcuggaccagcagucuggagccaaaaaaaccugcauuccaugaagcuuuuugauguuuagguaguccugguaaugcaggacuacacguguaguccgagcuaugcaggaggaucucuugaggccaggaaucacccaugauugccccauuguacuccagccugagcaaccaagcaaggcccuuuuuaaaaaaaaaaaaaaaaaaaauccccuggaccuuucagcaggggaaaaagguuccuugacuuaaacuugguguagguuuagcagugugugugagccuugaggcaggaauuacaggcugcuuuaguuacagaccuuuguguggaccugaggcuuucuaggacuugauuggggguugguccucauuuucugggucccuacuucuauugggaaaggcaacuagagugcgacacguggcagauuaccuugguuuaagucuuaauguggccugugguguuucccauaagagaauuggcuuuguggcuucaugguguccucugggcuaaugauggaaaaaucauuauuggaaaagaaugacaugaacaaaggaaccacugaagugccggaggacuggaggaggaagggggagggugugggggcagugaggguggcagggacuaaggcuuccuucucuacccuaggccugauggagagaagaaggcauauguucgacuggcuccugauuacgaugcuuuggauguugccaacaaaguaaguuuccuuccuacaaaccccuuaaugcucaccccuugggugcaaaugaugcauauguuagcgaccaaagccugaucuuugcugauuagucauaauuaacugacugcaccccuauccuugacaaaccuuauccucacauuccucauuuugcuuucuaaaaauaacauuccagcuuaaucuucauauuucaacuccaguaacgaggcucccuuuuguuuuucagauugggaucaucuaaacugaguccagcugccuaauucugaauauauauauauauauaucuuuucaccauauacaugccuguc

SEQ ID NO: 16714 - RNA, 1705 nt, Homo sapiens
auuucuccaagauucgcuaguuuuuccgguuaguaacuucacucacaauccccugcccuaaacuagucuucccuuccguguccuggucaucuuuacauccucaaauucagcuccagacacagagaaagguuucuuaacacucagguucgcuucuccuaaggugugugccuaacccauccccacuugauccuuucuucuucccucucccuucauaaaaccagacauguccccuuugacggugaaauugauugugcacugcccccucuucuauccugcaggacuuugcacaaaggaguugucccugggggauagauuccaauggggccagaacaaugaacacccauaccagaggggaguccccgccucccagagcggagaccaccccgaagagcagaguuuccggguccacuuagcccuucuuuaaccucccucgagggaacuugaucuucagcccucccaccucacaaucuacacagcagccuugaaggaaaagacgccagacuucagacgucucucuccucggugggcaccucauucuaacccuggcacccccuucgcacgcuuccccuccaccauccucacccccgaccucccagggcagaagggcgagagggggcagacucuaugagucaccucccaggccuggaguugaggagggaagcgccgccucuccuugggccccuucucucccccuuuccccucccugcugguuccuggcaucgccagaugcugcgcagcagucuccgauuccccaucaccaauucggcuggguaaggguccccaugaaggcgcagccggguauagaggugcaggggagagcagccuggggagucccuaucuggauaggcuccagccugggucggggcgguccuggugcccggugaagcgucaaaagagggagccugagcggggcaacgcagaaggguggagaggaggggguggcgagggcgggcagcgaggccuggagccgccaggagaggggcggggggcggcccuucuccaggaauuuccggggaucguguuacagcguuggcggagcccgagcggagugggacucgaggcccuguagccggacugggccccucgcccccuccuccagcggccugcgggccuuggcagcgccgccccugcccacacugaccccguguggcggggccgcuccgcgcccccgggccgcucuguaaugguagggcagccucagccccgagaugacgucgggucuccgcggccccggguuauuguaggaaccauccggccccgcguaaucguaggaacuauccggccccgcguaaucguagggucugcgcgggcccggcccccaccagacgggacuccccgcccccaauuggcggccgaagagucuccucgccccagagucaucuucgggacgcccagggcccgggugauuuugggcucgccgcggccccgggugauuguuucaucuccguggcccgcgguggucguagcgucuccgagaccgcggacucccguaggguccccguggccccgaguuguagucgggacaccccggccgcgggugaucgucgggucuccacgcgcccgggucgcugacgcggauccggccucggcgccuucucagggcgcccugcaaggccgcaggcaggaugaacauucuggcacccgugcggagggaucgcguccuggcggagcugccccagguaggcgccggggccacgucgggcuu

SEQ ID NO: 16715 - RNA, 30796 nt, Homo sapiens
uggcagcugcaggauguucuggguugaugagggaggaauacacagauugaaugcaugcacucaacacacacacacaaaaaugagcaucaaauuuaaaauaucuuuuuuuuucucuuuaaaucauuuugccauucuccaggguauauccuacggggaaggguaggggacccauggccagcccuggcuccuacugccauccucccaagugaacuuagcacagagacuggggagggguugacccccacuccagaacaccaauaccucuuucaaacaugacaguggagugaggaucagaggaucagcccccucccguuuccuggcacagaggaaggacaguuacacuuagaaauauauauauaauauauauauauuuauauaugucuauaaaaauuuaucacacuugaucaggacuaucccccuacccuuucacuugaccccaagggaauaggguccugcccugggcccauucccugggucuugcucucuuguugccucucuggcccugagccugaucagugugagacagaacucagcauuacuguccaccaugcccugcagcgaacagaccaggugcugaagagugaugccuaugggcucugacacccacaaauccucguggauaacgggaagccccucccaccccacaagucccuggagccugagccagagucagauccuguacugcagccacucgaaucgccaaaucauuugcgccugccaaagauggacuucuugccaggguucuugucgcccacacuuaaaccaaugaggagccgggcuuucuccuccucuuccugcuguugcauguucagguccgauuuaguuucuagcuuuccccggaccucagagccuguugcagacuucagccuuagcuucucuuugauuaccuggcagauuggagaggaguaaaagaaaauguaaauauuagugggcaggcagaauaaaucaaaaugaaccaagacaauaaagauuuauuaaacacauccaaggcacaauggggcaauucacauacaauggucucugcuuucaagaagcuuacagucuaauuauaaccccuucuaaacuuuagguuguguuagcucucaguucccuaaaaucaauggugcuauacgaaacacucaguaaacacugaauuuaauaaucugagugaggucauggagaggguaggcauagaagccacucacuucaugcaccugccccuucccaaggauauuuauucauggauucuaaaaugaaaggcuccugaaaagaggaucugccugccagccccauuagccaaacagccaugagcccuggcgggauaccugggcaaccagggcuuugcggcugucccuuuugacagccauggcaaagucuagccauguccauguguuguugugguacuccagacagggcagcaccagguuaaggucaccccaguccacacuguucuucucacccuguaagaggagggggaggggaaagaaaaaaagagggguggggaauacaucagcugccauuuugagucccagccagccacuugagugccaaguccuacaauaguaaccuacagauacugauuuccccuuaccucagccucguaaugaugcugacucuugaggggagcagagggaacagcagauuuaucacccacagcucagcaucacaaacaaccuagcugucucccuguauagaaucucugaucuuaucugguucccuucccacccuguucuacaaagugcuugagaggugcagaccuuguagcugacacacaguggaaccuguggaaucuuuauguagaugaaggaguuguucauggcagcucgcucuuucaucuugucaaugucauccacagggugcuaagaaaggcaggcaaggagugugagcccugaauccaucagaagaaacucaggaccccaaacaucucccucuucuuuuaucccuagaauggacuuagaggaaaccgaagaaaucccaagccacaccaaacaggaccucaagacucucccauuuuucuaucaucaggggcauguuugguaccucuggcgauuugcgaaaugaccuucugaccccagaacuccgagucaaacccugugccacacccuucccagggcccagugguacugcaucaucuguugcaaucagcugccgaggcuucaccacugguauuccuaugaaaaagcaaguguaccagcugucauccauccucguucugaagucucagcugucuuugggguugcuacccuauucuucuggggcuccaccauaaaaguucucaccaguagucaccaguuuggacuuauccucuucaucaccaacuucaucaucuuccacacuucggccaggaaagaaaaagcccaucauucuguggaagaacuggugugucagcuggauggugagaggcaccacauuuaccuaaaaaggaaaaagauucaagaagcaauuaagcucagauaccaucaucaguuuaccuacuccuaauaucguguaacacacagguggcuuuugaaugucccuuguucccaggucccuaagggacugcuuacuaaccucaaaaugcuccuuaacagagauacccccaacagggggccgaacuuugcugaagaggcggagagcuagcugucgcccagacuggcaggagcucuggggccgcaguacuaccuguaggauagagaguaaagaagagcccaacccaauguccuuccugccauaaagcaacccacaaauccucugcagaaugagaggagaagcaaugguacugcuaagcugggcaagcuuucacccucucagaucaccacauuguuuuccauaguggauuuauacugaagggccguuauaaaugccccgugcuaaaaacaugcaaauggacuaggaaaggggaaaaaagacuugccuuauagacagcauuggggaggagguuguucaugguaaaccagcccaacuccagaagauguucugcugugucaucagacuuauucaccuauaaagacagauuuugccccaucuacuauaauaaaccuuucucagaagucuacuagacaauuguuauguauccaguuuguuuucaggcucuacauaugccuaaucccaaccuugagaucuccuucaaacucauacaaucaacacucuuuaauccagugugucucaugggcacuauuguccaggacacuaaaugcugguaguacuaucuagccauugugacauuaaaaaauguucuaauucauuuccaaacgccucugguaggagaaaguaauaaauaauacugccuucuuuacgucaauggcagaaaagcugaaugucaguauuagaauauucuauuccaagcuagacaugaaagauuauuugccucugggccauacuucuagggaucaucuucuuacucaacaagagaagcaucugaucaaacucaccuguaucuguaucuuauuuuuauuuuuuugagacagggucucacucuguugcccaggcugaagugcagugacacaaucuuggcucaccgcaacauccaucuccuuccuggguucaagcgauucuccugcuucagccuccugaguagcugggcuuacaggcacacaccaccacacccaauuuucuuuuuuuuuuuuuuuuuuuugagauggagucuugcucugucaccaggcugcagugcaguggcacgaucucggcucacugcaaccuccaccucccagguucaaacgauucuccugccucagccucucaagcaacugggaccacaggcgugcaccaccacgccuggcuaauuuuuguauucuuaguagagaugggguuucaccauguuagccaggcuggucuucagcuccugaccucaggugaugcaccugccucggccuuccagagugcugggauuacaggugugagccaccgugcccggccuaucauauauguuuuuaauuauuuauuuucuuuuuuagagacagggucucacucuguugcccaggcuggagugcaguggugugaucacagcucacugcaggcucgaacuccagggcucaagcaauccuccugccucagccucccaaguagcugggaccacagguaugcaccacgaugcccagcuaauuuuuaaaauuuuuguugaacucuugacuuuaagcaauccucccaccucagccucccaaaguuaugggauuacaggcaugaaccacuacacguggccuguaucauuuuuuaaaaauuauuuuauuucuuuguucauucuuacucucccccuauggcaucagagcuauauguguaucauucauuauaaacagauauaucuaaggaagcucugcucauuaauaugauuaaugagcucguuaauauuaaugauacuaucauuaauaaucauacaauaauuaacccccuuuuauuucucuuuuaugaguuagacuccuaagcuaggucaaugucucucaauacagcugccuuugugugaccauauaccccagauaccuugcuguagaggaaccucugcaguucuaauucagcaauucccagcuguccaucuuccucugucaggcgccaccgugccugagcaaaguaaaacucagugcgacggaccacacucacaucuucuugcugcuuucgcagcuccaucuuguuagcccgcugcaguuggaaauccuuaaaacaccuguaaguggacaggggagccaaagccaguaagggaaacagcacauggguugggggugggauagaaugcucuagaaugaugcaggagguaaacccagaaauuaaccuauucuggguuagccagucccuacauuuuuuucacugaauuuauugcuccugacauucuaggucauaggagcacaaaucccaucuuucagcucuauagcuucuugauaaaguagugucuucccacuaauaauuccuacaauuuuaucugcaacuguauacugaucaacuucaagacauuuucauauguuuaugucagguucauuaaaaaaaaaaagauauuuucaguucagaugcauaguaucaaggccaccaaagugaucuuucagcugggugugguaaucccagcucacgccuguaaucccagcacuuugggaggccaaggcaggaggacugcuugagcccgggaguuccagaccagccuggucaacauagugagaccacuuugucucuaaaaaaaaaaaaagugauccuucccaacuacccauuuucuuauucaggaagagaugucugaaccuacuccuacaucagccuuugauaaugcacacuagaccuaaagacagucaaaacaugggcaagaaagagaacugccucuagcuggggcacuggaaaagggcaaggaaagaaugcuggggcaccugaugaggauauucaguucuucacuuuccagcugcagguuggccuucuccugguuuagcugcaacugaagcuucugguucaggucaagcagauucucauucuugcugucauccugcaaagacuagggaaccaggauagaaacugagagaccgcccucguucuaggagacuuccugguucucaaacuaucuaucugcagugacuaccuucaugauagaauacaucugcuucuccagcugucguauuugggccacaugcugccgcacagccuccugcaaaugcaguaugcugcugcguugcuccucuggauugcuagagaucucaagcuggaaccugacccguugcuucuucucacuauguuccuaaaggaauggaaagggaaaugaauaugauuuuuaaguagacaagucuuguaguaaagugaaauagagaaaggagaaagaaauggggggggucucuucuagaaagcuaaccuuuaucugucacugguaauagcaacaguaguaggucaaugcagaaaauguggcaauguggauuucacaauaggucaggcccaacaggaugggauggagguggaagcagggaauaguaaauguuuuuagaggugucuaggugacugaguagagaaaugacuaggagaaaacaaucaggcaaacaagcccuacggucugagagauauucaggccuuuccuaaguaaguggaauuucaauugucacugccgacuaagagaaucuaccaaccacaaggcccuuuuucagugugaagcauggcuuuuguuacagaagcccaaauaaagcacaaagucuggguguuccugugaggcuaaccagcauucuacaagggcccaugcucaccuuccgcuuagguucuacauggagcagcagguuguugacaauguccaggaucauggcauacugagcuggguugguggaaauuuccagcucaugguggauaagggugaagguauccacagccccuagauaauuguuagcagcuaaauaaaaggcucaaguuucuaccuaaauaucuacuccaucucuuaacccacauuuggaaccaccccacuagucaaccccacagaaagggugagaguugcucaugggcagaaacauguuuacuucagaaucauaaacaaugcccauucaucccagcucccuccaagaauagagguuauuuucucauagcagaacuuacaaaaaguagagcaaagugaaauguuaaugccagugcacaguggauuuuuaauaacucuacugucucaaaaccaccaaggaaauaacuacuuucacaauuucucuagucccuuccuaaaagccuuucaagcccugaauaccuuccugcuucuuuaggagaucuuccuuuuccugguucucaagaacuucagguggcuuaaucugaguugcuaguucaggaucaaugucauggcuguaacuaauauaguacauucggcaguugcaacgcgaaaugauccgcuggacuugcugggcuugcugugccucagcuggcugguuccaaucugggaagaggugggaaagagauaagaaaaagacauucucaauaaagauaaugugagagccucccagcuaugucucagaaacuccagaaacacugcuuucaacccagccuagcacaaaaugguccuacuccagcauacacugacguuaagaauagguagggaaaugaggucccuuugggaugcacaucugcuccuaaucauuugaugcagaggagggggagggcugaccugugguugugguaaccaugccgcccacugccugcccacucuccaucagcuccugcacagaguccagacuacgcugccggugcuccucgauauucuucaccugaagaaagagaugcaggcaacuuuagcuccugggaaaagaguggcuuguccuggacaauugggugacagaucuccauguuucaaguaguuacacuuacuaucuggaccuccacugcauggaauagcuugaaccauaucucccaggauagaggacauacuugucucauucucuugccccagucuacccaaauucuccaacccaacugaguuacaugcacacuuugccaggcccacaggucucgagccagaaaaacaaugagaaagguucaaaucuaaucaugucaugggcaaaauaucucauuaaaaaaaaugacuuucucacacauuuugguauuuguuccauuuguguucuugcuuuuucuaucuucagauagauaaccacucugacaauguugccaugggcgaagggaauugaauuauuuuuauucacucugccaagcugaagucagagugaauaacauugagugagaugggaagaccacagcagaugguggaucugacaagucucaaaaaaauauaggaaaggccagaucaaagucccuuguaccuaagcccaagauguuccacucuaaugcuaguaucgcagccugaggggggcggggggaaagaguucacccacaaaagaaggcaugccuaaaagcagcagaggugcaaaaaaugccagaaagauccugauagcucauccauucuacuucugcauggguaguuaacaccugugcuuaccuccuaagacuacugauaaagagcacugcuugucugaaugaaccacagcucuuauauaucagcaugacuucucauauuaccaacaaccggucccuuacacggcuuaacaucugaucuaaaugcucauuaccucuuauuacacuugagguugccuggauuaagcccuaagguccuugauaaaagaagcaucagccagggaggugaaaagagggaucaguuuuauccccacuaaguagaacugcaaauggacuuaucacugugguccuuaccagauacagcuaaauccuguaacucauauaggggguguaccaugcccaguacaauguggacacuuaacaccuguuaaauaaguaauaacgcacaauauugccuaggcauaucucauaaucaauagacucuccaauaauucugaugauauuauaucuuagaaguuacaggguaaaauauaaccugguucaguuuuaccaagaagcugaaaagaaaauuaacaaccacgcaaugcaaagacaggcuccuucccuuguuucugccaacugcucacaaucucaccaucuaacaaaaacauuaucuuggcugggugggguggcucacgccuguaaucccagcacuuugggaggccgaggcgggcggaucacgaggucaggagcgugagaccagccuggccaacauggugaaacccugucucuacuaaaaauacaaaaauuagccgggcaugguggggcacgccuguaaucccagcuacucaggaggcugaggcaggagaauggcuugaacccgggaggcagagguugcagugagcugaguucgcgccauugcacuccagccugggcuacagagcaaacucugucucaaaaaacaaacaaacaaaaaaaacaaaaccacauuaccuugccacacacuuagaccuccccagacauacugacuuaaaaaaaaaaauaagaguacuuuccaccugaauaaagcuuuauauuuucaaagcaccuuaugugauccuuucaacaaucuugugagggugaaguaucaauuccauuucacgauuaaaggugacuuguccaagagcucauggcuacuauaaugggaaagcuaucauuagaaaucacauaaccugacuccuaggcagucuuucauucaaccucacugccuugcugaaauaaccaaucagucauuuucaugagaggacagagaaagggcagauagugaacuuacugaaaauucucagucacugccuguuuucuuggcugccugcugauuagugugaacauuaauagggaucagcaaucuuaaaaacaguuccaguccauuuuauacgaguucugagaaaugagaguuucuuuugcaaugaaauagaacaccaugaggaaaaaaaaaaaaagcacuacaugcuuccagaccagagauugcccacauucaagguguuauuagccucauuauucugcuaagcuaguaacagcagguuacugucaagaaucuuccagccauuagaaagucuacggaaaaccaggaauauaaugggccuucacaaacucacugacuaaccucuaaccagagcugucggccauccugcucuguggggcugcuuucagugguggcaaaguacugcaugccauccaagaggcaaguccaggaugucuuuugcuucaauguaucaccauaccaggcuggauggugcuggcacugcagcaguugggcuuuggcagcugacacaaugacacagccuucugucucugcuccacgaagaaccaucuaugccagagauagaagcagaguuaagcuaccaaggacgaugagguuagugagcacauuguaucaaccacugcagcuaggucuaaugcuggcuuaccaaguaaauuuuacuggcuuuuagacauagaagugauuaccuaugauaccuaugagaaggccaaauuuuuuggagcucuauucacccauucauauuuagaggugggggaaggggaacaauaugaucaugaucuagccugauguugagguaacuuguaaagagaagguaccugacaguugaccaauucaauaaggcaguuucgguuguauaugucauccgucuggcaggcagcaaugccacacaacuggucacucaugccugauuccucuucugugaacacuacaaaccuaucugucucuucaauuagcuucugcaacauguaagcaccuggcagagaaauaggaagcagggaaaggucacagucucaaagggaaagacuuuucccuuuccagagccaaauugaucuucccucaauuuaucuggcuagguaagagcuuagaauacauccucccaaaccuaaaacucuagcccagcccaucccuugacccaugaaggcaaaacaaggguuauuucacuuucccuucaauuuuaauaaaaguaacagauucccaacagaaacuuagaaaugcuagguaacauuuuuuucucuuagguauuacucuaugaucucucccuuacccccauuuuauuucuuuuuucauuucauauuauuuuacauguuauuugaccacucuuuuccacuugaaaccacucucuugccaucaaugucauuauauucucugaggucugcugcuuccccugauuaugucuccaggcccucuuccuucucccaggucuaagcuccucagauccauccuuggcauguucccuucucuuuccuacucuuucucuuaauggguuugucuaacagaguguaugguuaagagcacagucuccagaaucagacuagucugccuguauugugaccuugggcagucugcccucuuugcaucauaguuuacuuguuuguaaaagaguaacucucucaugagauugcuaugaaaguuuaacggggccaggcgcgguggcucacgccuguaaucccagcacuuugggaggcugaagugggcagaucacgaggucaggauauugagaccauccuggccaacauggugauacuccaucucuacuaaaaauacaaaaauuagccaggugugguggcaugcaccuguaaucccagcuacuugggaggcugagguagaagaauagcuugaauccaggaggcagagguugcagugagccgagauugcaccacugcacuccagccuggugacagagcaagacuccgucucaaaaaaaaaaaaaaaaaaaaaaaagaaaaagaaaaagaaaaagaaaaaagaaaaaauggaaaaauacauaaaaauauucucuuaccucuaugcugaaauucccaaauaucuaucuuuagcccuaagcuuuuagacucuaauuuccagcuguuuguuagacauuauauugauaccuuacuagugacgcaaauucagcaugcccaaaugugaacucaacaauccuacaccucccaaaccuguuuagucucaggcucuauuucugauauuacuguuaccaucaugccagucaucaggcucaaaaucuagucguuauaauuuucucccuuaaacuccuccuuccaaccaguggucaguucacccauaugcaucuuaaucuuuccauccaucuuaucuccauucccacugccucuaccuaguucuagcccucaaugcuuuuuuuucuucccuugagauggaguuucacucuuguugcccaggcuggagugcaauggcgcaaucucggcucacugcaaccuccacccccagguucaagcaauucuaccgucucagccucccgaguagcugggauuacaggcacacaccaccaugcccagcuaauuuuuguauuuuuaguagagacaggguuucaccaugguggccaggcuggucucaagcuccugaccucgugauccauccgccucggccucccaaagugcugggacuacgggcgugagccaccaugccuggccccaguucucaaugcuucuuacugagacaccaugauaguuuccuaauuugucuccccaccuccaguuucuuccucuccaauccuccuacacacuacucccagaucugucuucauaaaaguaaaacaaugacacacccauguucaaaaacauucaguaguucaccacugccuacuguacaaggaccaaaaacuacuuagcccuauaugaaaggucuuugaugaucuaccccagcuuuccuuuccaguccuuucucucacuccucucccuuaguuacucucugucuacuaaaagagacuguuuacucucugugauacugugaaauauauauuuggucuucccugcuuccuggcauauaaaaucuaaaaucauuagugccuccuaagugaugucuuuuugugugcugaguugacuaguugcuggcagccccuaaguagcuuccagaugguggcuggucacuggaaagacccaggcaggauuagaggguuauaauuuucagccccccacccaacccacacuuccugggaagagaggggcugaaggcuaaguuaaucaccaauggccaaugguuuaaucaaucaugccuacauaaugaagucuccauuaaaaacccaaaaggacaggguuuggagagcuucuggauagcugaacacguagagguuccuggggcauagcaugccugccuggggagggcacagaagcuucccgccacuucccauaccucgcacuaugcaucucuucauccauauccuuuguaauacccuuuacaguaauccaguaaacauguuuccuucaguccugugagcugcucuagcaaauuaauugaacccaaggaggggguugugggaacccguuuauagccaguuggugagaagcacagauaaagcaaccuggagccugugacuggcauaugaaggagaagggcgggcuuagagacugagucgucaaccuuuggaaucugaugcugucccuggguagauagugucagaauugaacugaauuagaggacacccaacugguguccacugcagaauuaauugcuugcuuauugguugggaaaaauucccacacauuuggucacagaagucuucugugucaauuguuuucgagugagggaauagaaaaaacacuuuugaguuuggguuuuuccacucaagacucugcuuugaacgcacuaggcuuucaaacuccacuccuacucagauuauucccucugcauugauugcccuucuaccccauuucuacauguucaaaccauacuaggcuuucaaggccuggcucaaaugcuacuuccucaauaaacccuccccugaugguauuccccccuucacuccugucagcaauaccuccauuuuuuuuuuuuuugagacagagacuugcucuguggcccaggcuggagugcaguggugcgaucuaggcucacugcaagcucugccucccagguucaugccauucuccugccucagccucccaaguagcugggacuacaagcacccgccaccaugcacggcuaauuuuuuuguauuuuuaguagagaugggguuucaccguguuagccaggauagucucgaucuccugacccacccaccucagccucccaaaguacugggauuacaggcgugagccacugcgcccggccccauauucuuuuuuugagauggaguccugcucuaucaccuccaccuccuggguucaagcgaaucucgugccuuagccucccgaguagcugggauuacagguacuugccaccaugccugguuaauuuuuuuuguauuauuuuuaguagagaugggguuuugccauguuggccaggcuggucuugaacuccucacuucaagugacccacccaccucggccuccaaaagugcuggaauuacaggagugagccacugugcccauccaacucccauuuucuuuuauuucucucuuauggcauuuaccacuuugcuucuuucccuuacucaucuuguuuuggcuccaacacuccccuucugauucucuucuggccauaggaccagaccauuuaaugccccaacaucacuguuacuuaauauguaagacuuagguggccuaagaaggaaaaauaauaguuucacuucuuuaccuagauagaagcaccaugacucaguccuuuuaaaacuccuguccaagcccauauccauguucuaaacccaaacccaaaaagucucaucuccccgagcuuaccuccugaugaccccuuaucagguuguccacugaagcugggaguguuaacacgagguggggcugaggcacuaguugggacaccccgcuuuggcuuuuuggcuggcaucuguggaucaaucuuuaaccccuucagggccucaguagaaagauuacguuugaguacagcugccuuuuuguacccaucauauaacccaaaggcaaugucucgauugguaguuguccaggaaauccguaaaucuacuaagugcagcugauguguaugaaagguaggauccccaucacgagcagagagcuccuaagaaacaggaaaaggacuucaggguagcauggaaauugcccccagugccacagaggcagugauaaaaguuuguugaauaagaaaccuguuggccagaugccauggcucaugcccguaaucccagcacuuugggaggccgaagugggcaaaucacgagaucaggaguuugggaccagccuggccaaccuggugaaaccccaucucuacuaaaaauacaaaaaauuagcugggcaugguggcuggcacugguaaucccagcuacucaggaagcugaggcaggagaaucgcuugaaccuggcagguggagguugcagugagccgagaucacaccacugcacucuagcccaggcgacagagagagacgcagucucaaaaaaaaaaaaaaauucacugggcgugguggggagacagacccuggagaagaaaaacuaaguggucuuggcuuuuauauuauauuacauucaaacuauaccuacuguauuuuauucuuuaucaaaaaacguuuucagaguuccucuaaaauuuuuuuuuuaagaaauggagucuauuuuguccagacuggucuugaacuccuggcuucaagcaaucuuccugccuuagucucccaaguagcugggacuacgggcacaagccacugugcuggcccauuuuauuuuuuaaauauauuuauuuauuuuuauuuauuuauuugagacagaaucugguucugucucccaggcugaagugcaguggugugauuuuuuuuugagacagagucucacuccaucacccacgcuggagugcaguggcaugaucuuggcuaacugcaaccucugccucccagguucaagcgauucucaugcuucagucuccaaguaccuggggauuacagguaugugcuaccacaccuggcuaauuuauuuauuuuuuauuuauuuauuuauuuauuuuuuggaaacagagucucacucuugucguccaggcugaaggcaauggugcgaucucagcuggcugcaaccuccacuucccggguucaagcgauucuccugccucagccucccgaguagcucggauuacaggcaccugccaccacgcccagcaaauuuuuguauuuuuuaguaaagaugggguuucaccauauuggccaggcuggucucaaacuccugaccucaaaugauccgcccaccuuggcaucccaaagugcugggauuacagucgugagccacuauaccuggccuaauuuuuguauuuuuaguagagacaggguuucaccauguuggccagucuggucucaaacuccugaccucgacugauccaucugccucagccucccaaaguguagggauuacaggugugagccacugcacccagccuuaauggugcaauccuggcucacuacaaccucugccucuugggcucaagccauccuccuaccucagccuccuaaauagcuaggacuacaggugcaugccaccaugccuggcuaauuuuuuuguauuuuuuguagaaacacgguuucaccauguugcccaggcuggucuggaacucuugagcucaagggauccacccacccuggccucccagagugcugggauuacaggcaugagccaucacacuuugccuauuuauuucugagauggggucucacucugucacccaggcuggagagcagugaugcggucauggcucacugcagccucgauuucccagacuccagccaucuucccaccucagccucccgaguagcugggaccacaggcacaugccaccacacccagauaauuuuuuguauuuuugguagagacaggguuuccucauguugcccagacuggucucaaacuccugagcucaagcaauccaccugcuucagccucccaaaguguugggauuacaggcaugagccaccugagcccagcccccacuguuuuuuuuuuuuuuuuuuuuuuuuuguauuuuggagacagcaucuugcucugucacccagcuuggagcgcacuggugugaccucggcucucugcaaccuccaccucccggguucaagagauucuccugccucaaccucccaaguagcuggaacuacggucauguaccaccauucccagcuaauucuuuuguauuuuuaguagagauggggguuucaccauguuggucaggcuagucuugaacuccugacuucaaaugauccauccgccuuggccucccaaagugcugggauuacaggcaugagccaccgcacccagcccucccccacuguauuuuaaaugacuugagaauuucaacuuaaaauccuucccuaauugggggaaaggcaguaccaauuuuuuuuucaguguuaggaaaaaauuuuacucuauuuccuaaagaguaacauacuauuuuuaggagagaaagaaaaaguauuuucaaaaagaaggaugcugauacagcuaaaccaaaugaguuugucauaaaguaaugacauacaugcuuggaauauaugagaaaccuuaccagggacuuaaucugcaaccuacuccuauggacuuuacuguguuccccccaaauucauauguugaaguccuaacccccaauguaacaguauguggagaugggccuuugggagguaaugacauaaggucacgaggguggggcacucaugacagaauuagugcuuuuacaauaagagaaaccagagcacucgugcacacuugugcucucucucccucucugccaugugaggacagacacaaggcagccaucugcaagccaggaagacagcccucaccagaacccaaccaugcgggcaccgugaucuuggacuucccaguagccaaaacucauaaauaaauuuuuguuguauaaaccucccagucucugguauuuuguuauggcagcccaaguaggcugagauaccuacuaauauaaauaagguaauaaagaaagugugucagggaguaccuccucagcugugcgauugcuaugccguugguaggugagggaggacaagcucagcaggugggucuuuguuaccaagggaucaagacagugaucagcauucucuucagugggugaggccaucaggugaacggucaccugacuuaggucacucaccaucuggguaacacuccaaucagagauaaggcgccgcaucacugugccugcugagaaaaagaggcacacagagaccaugcugaccaguucagaggauaguguaagacagagauggaggaggggaauggaacugagaagggaaaaacaaggaacaggauaggagaaaugaaaggagucuuucauuuuaccuugagguauaagccgcugagucccccgagugaagacauggcccugacugcacucaaucuggaugccccguugcugggcaaaugaggcccaauaauguaccuggcaacaagagagcauaacauuaacaaaggauggcaugagagggaugauuaagggacucaauaugagaaacaagaaaacuagaagcagaauaaagugaagaugucagcagggacaucagugccuuaccugcagcuggggaaagagggcuguauaggaaaguugcuuguagugcugaccaaguuucuucuugcuggguuucagguuauugaagagcuuuccccugcagauaggccuugugacacuuguccaaguugcccagaaguuuugcauccagcgcaggguacuacuauauagcagaauucggggcugggauauugcugcaaagagaaagacagacauuuccuaguuauggaugaaacacagagguaaagcuaaauccuucccuugcugcagguuguagagguuuaaaaauccaaaauccaaacagcaccuagccucacauucagcauccccaacucccucuucuuucaaggaucuaagcucucugcuuuccccuacugcuauggucuaaauguuugcaucuccccaaaauucaugcugaaauaccccuaagguaaugauguuaagaggugggccucugggaggucacuagaucaugacgguggagccuucaugaauaggauuagugcccuuuuaaaagugguccaagggagcucacugacuccuuccaccauauuaggacacagcaaaaaggcaccaucuaugaggaaugggcccucacugacacugaaucuaucagcucuuuuugaucuucgacuuucaagccuccagaacugugagagauaaacgcuuguuguuuauaagcuaccaaacuugugguauuacuguuauagcagccaaaaaggacuaagacaccaacccuuuccccugccaaaaaacaaaaaaaaagguccuaaccuagauucucccuugcccuucuccccuccccuccccuccccagagggucaagcuaaaguccccagcauccaugcccguccucccaagcccuuccuccccacugccccaggcccaagccucacuuccacugugccgagucagauccaucuugauggagagauugagguucuccgagcgaaaggcccgguaggagucaugaagcuggcccaagggcaccucaggcaggaacucuggggcccgcagagugacacuauggugaucauggggguucccauggcacagccacugcagguccagugucaugcagaggucaggcaggugaaggaagcagcagucgucauaccugccucacaauggaaccccagcccucagugcccuggucacucacuuccccuuggcucuucccccucccuccaaccugagccccucaucccauggaggacccucccuucacuccacucacuuagaggcuguucucacguugauauccaagucacccuugaacacaaacugaccagguuuccaaugaaaagacagguggcuccacucccagugcauauuuucaguuguguuguauggauccuaugaccacccccgagaauuuggugagauauagguaagaaaaccauccucaucucccaaaucagcaccugucucucuucccacaugugcuauacagaccucaaccauaccauccugauaggauaaaaguaucaugacaccccucaccucaguggccagcuggugcagguucgccuguucaauguccaugugccagucuccauggaacagaagacggcucuugucccaccagggcaaaggugggcuggggucagcugagggcuuggucaagagguccacacacuggccaauuaguguccaggcuggaucccagcaugggccccacaccacuguguacuggaauauuuccgcugggguagaggaacaaaggcuauaacuuguucacaacauuaccccucucuuccuccuucacuccagaagggucucagcucaccucccauuucacccaucacaaacgucccucagccaaaccaacugccucaucucuacucacagugaaagucaugguagaauuugagugggggcauguuccucuccacugccacguuaccccacggaagccccaagugcaagaucugacgccgacgggagcaaggcugaccacucugcucggugcccacaagucgacccauuagccgccagucacggaucucaaacagguaccguggauagucccugauccgaacuguuaccagaggaaggguacacacuggcuacucaggggcagucugagcacucucgggccuaucuuuuuccucaccacuauuuuacccaucuauauuuacaaagucaauugagagaacaagggcaggcaguugacacagcaagcugaaaaaugacagugacccuggagcaggugguuaagggcauagcacugagauccaagagacacaauaaccuuaaagaugacuguguuagcuuucccuuuauguuagccaagcaauuucacggugaaauucaggaacaaagaaagggaagggaagcccacccaucccacuccacccacccaaaacggcacaguucccaauauaaccuaguuccucugaaaucacugagagcuccccagagcucagcgggcaaacacggggucugcaaauaaaggaaacacuacuuacccagaaagcucuugacauugcacuugagcauucgacaccacugaaugacaagaucuaaucccucagggggaaaagggcugccuggaucaagcucuugaaccuguucuaccacaugcucaggaccauggaaggaggcaucugccagagcuaccaguucuagcccugcuaagcuccaaguaagcagugcccggcgcauggguguguugccauagagacgacgggaacgcuggauguagauuucaauguuuuugcguuccaaagaggcauagagcuccucaauuuugcgggcaggcaacaacuccccaugcugcuuccgaagggcggccacuuuagcauccaguagcuguagucuuuuggcacucuccuuacuuucauccuucaucagcucguaguuaucaugaaguuucaccucaaaaacaucauccaagaaaacccaugagaagugcucaaccuuuaagaguagaucaggugggagugggacagggcuuggagaggcccaagcacgagucccuugauguagucccuucagccacuucugaacucccacagccucaucuagaguucgagaaaagucauacugauaaggaaacuccaccgagacugagccgaaagagaggagccaaacacgguuccggagggucugcagcgcagggaagggguuccgguggaggaucaucucuuccagcucagguagcagcugcaccuccaccuccuugaaguugaagauacuauugccaucaaagccagcagccagcucuggacaguaugccugcagggaaccuccaugccggcucagugacacacucucugcagccaggguaaugaacuuguccucagcuacaaaagcugugagcuuggcugugcucaccuccaggguuagguuuagcagccgcuuuggggguaauggcucaggggcacggccuucuagcucagaaguaguuccugaagucucuagugcaagggaugguacagucucaggaaacacaguggcucuuaguaggucucggcacuguagaguggccaggacaugcugguacagguacaugugaucuggggggcuccaaaguaaggucagcccugcaccacacugaaccuuuagggagcagaagaaaaggaucugucaauuaccaugucacaaaacaguagagauggcaaggauuaugacacaugcacaccuggcucaagaaccaucuccacccagaaguuguuccugaguaaucacauuaauuacugccuugcuuuguuccuguuagcacuaaugugcugagcugacaguugauagugucugacauuuaagagcacuuauacuuuuuaaguucucuucaacuggauucuaaauugucugaaaauaggggccaugugucuuaauucuuugguaucuaccauaguauacucaguauagacagcagguacucaauaaaucaucuggcuucauguuucugcuuaugaguuaccuuucuaucagcaacuacacugucuaguaaccacugcaacagucaacuugaaaagguuucaugaguugauugcaucaauuuaauucucaaaauauagcauaauaaaguacugagcacacaagucaauauggcagcugacuuacguaaaaguaugccucaaggagagaguagugucuuugucagcuucugaauagcuaaguggacagagaaaaguaaaauuccaggacauaaaauucucaaguucuagucucuaaaaaggaaacucuucaguuuccaaaggacggugaagucugacaaggaggaacuaacgccccacccuccuccuaagagggucccauguccauuuguuacccugaggauaaagauacuggaaagccucucaaaaccugccagugccucuaucuucugacuccuuccagucuuuuaaugggccgagggcuucagcaaaauaacaccagaucauucuuuuuaaaaagccccuuauuuuucagagaugcauagugaaauauuuauaguugaaauuauauaugucugauacguacuuaccuacuucaaaauaaucccagagccugaggcaggggaaauuggugacaguauaauuaaaagaaguuggucaugaauugguaauuauugaaucuugguauacaaaagcuuauaaauucucucuaguuuuguauguauuuuaaauuccacaaaaaguuaaaaacauacgagcuagaaaaaauaaagaagaucaggugucauauuucucaugaaaccaguuucacaacaugaguuaaaaagagaggcugggcgugguggcucacaccuguaaucccagcacuuugggaggccaagauaggaggacugcuugagcccaguaguuuaagaccagucugggcaacaugugacacucuguuuugggaaaagacaagaaaaaaaaaaaaaaagacagagaaaggcucuaagcugaggaaaaaaccagccuggccccaccucuccacaggaacauuaccuccagagagcggaugcugcugugauaggugauggagagcauggaaaggcugagcacugggguagggaugucaggggccuugcaacaggguugcaucuucuccgugacugauuucaccagcgcuaacacaaguccuugaauccccacaguggacgucucugcacugcccaggauaguuaggguguccagucguaccucugaagcaccuaacaaccagaaaccaugucagccuugguucccggcucucaaagggcaacaauaguccucacucgccuuucucacuuauucccuuaacuaucuuuauuccucaugccucccuaaguucauuucuuagguuuuaaguaaacuuucccuuucccaucuuaaccuaacuagauucggcagaaucaaaguuguuccuuaacuccuacaaauugcacagagacauaccauuuacucucuagaacuaaacacacaaggaaauaaaaaguuauauggaucucucuugacuagaucaaggcuuuuucuuauaugucuugcuuaguacuugccuuucauaagcccuuaagaaauaccaagaagucuaauauuuaugcaagacuuucaagcaucucgugccucuaauuuagaaaaauuccagauaaucagcuucauuaaaugaggagcagacuaaaccaacauaaucugcuaagguuacacacuacacacuucaguauauuuauuuacuuauuuuauuuuauuuuuuggagacagagucucgcucguuugcccaggcucgagugcaguggcaccaucucagcucacugcaaacucugccuccuggguugaagugauucuccugccucagucucccaaguagcacacuucaguauagacuccuugucccacuuaccaaccaaggcagaaaggguaaacaaguucaugucuucgaccuucaaguccaccuuccacaguaaugacacagauuccccaaaugaagagugccuagagacagcugacuucccagauuguggacccaucagggauaagauacgagacagacauugggcacagguaucugaugcuuccaccugaaguccucgaaugguacaaucaagaaaaaggguaucugacugggugcuggacaggcccagaggcugguuauagcuacccuagagaagaagcagacggaucccauuagaaguaugcaggcgcacaguuuuauaaugcccuaaugcacuuccugcugcauuaggaugcucagcgcucugacgcaugacaggaugaggaaagcugugcaggccccuauucaccaaagcccucaccuaccuguagugugaaggaguccagaacaagugccucaccccaaacaugcauauuggguggguguggcgcccgcugaaugugggagucacugcccacacgccagcagaggugguccacaguuaggacgccccgcugauggaugcuuuguggccugaggugcugguaaucugaacaaaggugagaaagagggauugcauggagccacuguggccaucaauugggccuagcuccacuaacggacagauucuuguuccuauuccaucugagagccuuacccagagagauagaauugaaucccaaggcaaaaggugguguaucuccaaguugaauggaaauguugacauuggagauggaggugcuaaagaugaugggagccaggauuugggggaagguucugcauaggaacaagacaucauuguuugguaagaaaagaacugcagcuuccuaucauggaacaguuucugaagcucucacaaucagagugagaauucagaguuuuauugugauucuuaggacgagacacaccuagaagauaaaaggcugaacucaucaguuuauugcuacucuuaaugguaaucugcaggaaccccaaaaggauauuagguugacucauauaaaauuaucauuuucauaggccaaauacaaugaacaccagcaauacuauacgcuugaaccuaaaauaaccaagaagcaucacuucuaaaccauaaccuuaaguucucugugcagcacaauagaagcacuacacaaagacaugacugccaccuuacaaucaaaggcaggcaagacaaagacauuccuuaucauuuaaguucaguucaacaaacauuuauuuuguauaaaacacuacacugagcaccgaggacauaaaaacaaagaggacagcauucugcuaucaaggagucuagucuaaugggaaagauauauaaaacaggauugcuguugagacucggauuugaggaggucaaacaaccaaauacauauuuaacacaggaugccaauuuggaccaaaagaaucccagagaauccaacugacaagaagguggcugaaaaagaucagacugaccuuuuuuuccuuugcuuuagaacaggugaacuagacccuuggguuuccagugcuagcaggugcagccagugagagaauuccuggugccgguagugaaugaugcaaguguucagaacuagggaggcugagaggucaaugguggucaccugaaauaagaagaccagaacuguggguuuggguuuuauuucacaaacucaaaacgaaauaauguagcgggagaauagagaaaggaacaauucuugguaccacaaucaucacaccugcacacuagccuugagggaguugaggcagacaaugcguuggcgacucugggacaacaacaacccaucuguaagaggccagaggacagaucagaggagagcacuggaagggcaagagguaaaacugggagagggucagaagccggcaaagggaucaacagacugucaucaaaacuugugagcuggggcuauuuucucucaguauguucccuccuuccacuccccaguuacacugagauuagauuaaggagaccauauggggcaugagcaaagagaguaucuaguccucccauucucgcucaguaccaguaccccgacccaugaaccuuccagcagcaguucagugcucaucugugccauaucagaguuugcugugaagcuucgaaggggcagcugauccucaucacggugguacaggaacugcagcagcuucagaguccaagucaggugccuggaccgagacagauuccagcucaggaagauguggaaugccauuccuacuucuuuuacuuuuauuuuuuaaaaguaauuauuuuuuggccaggcgcaguggcucacucuuguaaucccagcccuuugggaggccgaggcagggggaucacgaggucaggagaucgagaccauccuggccaacacagugaaacccugccucuacuaaaauacaaaaaauuagccgggcgugguggcacgugccuauaaucccagcuauucgggaggcugaggcaggagaaucgcuugaaccugggaggcagagguuguggugagccaagaucgcaccacugaacuccagccugggcaacagagcaagacuccgucucaaaaauaauaauaauuuuuuuaauuuuucccacacuacauggauguaaccauuucuacuuccuuucuccccguagacaagcucagcaaauacuaggcugguuacagagauaccaacauacagcucccacuaucacucucccaucuucugugucaggagagaccucaccucuuuugacuauucauggacaauaccacgcuuguguucuccaucuuaaccuugaccuggucuggcagcugcuggagaaggaauaggccaggcagaguuggcucaacuaaguuuucugucaccucugaaaauaugaaugaauaacguaagaaccaucaauucuuaacacucccaguucucccgaaaugcccuggccucuauggucaaauccucccacauaaaguaggcuaagcaaaugccuaagcuggauggaccauaaggcgaaugccccagagauccaggcaccugcaguacuucuuucuccagucucuaaaaaccuaaagaguacaaggagcagguugguaaaugaaaagaauguggaccuuagggccaaauaauuuaaacaucauuuuuacuacugacugccuguaugacuucagucaaguuaccuagcuaaccuuccuaggcuucaguuuccuuauuugugaaaugcugaggauuuaguuagagaauauacagucauccuuugguauccuuggagcuuugguuccaggacccccugcagauaccaaaguccgcacauacucaaguccagcaguugucccugugggaacucauguauacaaaaagucagcccuccauauuggugaguuucauauccugcaaauauuggcauuuuccauccacacuugcuuguggaugcggaacacacagauauggagagccaacuguauuuauugaaaaaaauccacauaaguggauccgcacagcucaaaccuguguuguucaguggucaacuguauauaaaacacauaguacaaggccaggcaugguggcucacgccuguaaucccagcacuuugggaggccaaggcuggcggaucacgaggucaggagaucgagaccauccuggcuaacacggcgaaaucccgucucuacuaaaaauacaaaaauuagccaggcaugguggcggaugacuguaaucccagcuacucaggaggcugaggcaggagaaucacuugaacccagaagguuaaagguugcagugagccgagaucacgccauugcacuccagccugggugacagagcaagacuccaucuuuuuuuuuaaaaaaaaaggaaaaaaaaaaaacccauaguacaggucuaacucaugauaggugcccacucaaugcugguucugccacucagcacaagcaaaugcccuauuuccucuaacuauccuuagggucaaaguccauggugacuagugaaucacaucuaaauaagcagugagaccacuauuuuuucuacuuccaaaacaaacccugagaacaaggcagccaagaagcucaaucacuggggcuuuaccugaacagggaacaggcuuagaugcuaggcuugggcccuggcacagcaguuggcucuggaagaggcccucaugcaguucagcauggaguguccacacauccacagugauagcagugagaugccgacugcuaaugcccaccuuuagacacagguccagggccagugaaagcuccacuaggcagguguccuccuguggggaugauaagccucuaagguguauguaagaaaguuuggaaguuuuaggucaaaauguggugaucuggaacacuggguacugacuugagggaacccccuaaggucaaagaaccuaggauguaagcccuaagcuccuucacacuuuacgcccaggaggaaaugaggcaucugaaugaucauggcauacuuaccagcugaccacucuuuagaacuuugcuguugaucuuacauaagcucaccucacagauuagccugggaaaggaaaaaaauuaagagcacuuggccuugccgggcgcgguggcucacgccuguaaccccagcacuuugggaggccaaggugggaggaucaugaggucaggagaucaagaccauccugacuaacacggugaaaccucaucucuacuaaaaauacaaaaaauuagccaggcgcgguggcggccgccuguagucccagcuacucgggaggcugaggcaggagaauggucugaacccaggaggcggagcuugcagugagccaagaccgcaccacugcacuccagccuaggcaacagagcaagacucugucucaaaaaaaaaauuuaaaaaaaagagaacuuggucccuuuccucaccacuuaccuccagucaagcucugguggcuagaagggacaaggcaauuggaaaugucuaaucuuagcaucuccuccaacugcacagaaugagaacuuaacaccuugauaaggaggcccugaagcaacucugaggcaagaauaggacggcuagauccucugcuccccagugcuuaccuuuucccaucacuauccaaaagaaaucugcuucuacugaucugaauaugccauaaggacucagagguauccaccuugagaaccaugauguuuauagcaucuacaugaauggagaauagcuggaaggaagaagcaaggaugaacaauaauuaauguuaaggaacugcccuuccuuuccagaugagaaagaggggcagcucuuagcauuaugcccuaaaaacagaaaaaucuacccauaacuccaaagccaaccaugccaaaguacaguccaggauagcaggagaaguugucucacuuggcagaagaucuucaauaaggaugggcugaaggacaguuccuuuugauccaccccagcgcucugggagaauggggcagacaggucagaaacuuucuguagguccguucugauacgcacuucuccaaagcacaaugccacauagugucugcccagaagagaaaucucacugccaccagguccaucccucccauagcagucuauuccccacccucacauucacuuucucauccuuccuagaaauauagcucaaaucacagagauuaguuucauagcaguuaucaauaucuuccucacaacacaauggcacccaggcuaacaggaagacuucagcaacaaccucccuuccuccuuggauugugaugccucugcagaagagugucacucugcaaacaccaacuccaaaguacucuucuaggggagaagugagaauauaggguacucacggaagaucauggcuaaggaguuugcuggaaauccacagguuaucaauuuccuaaaacagugagggagaaagcucugugugcuagcugcuaaauaagccacgagcagcuugacaagccaggaaauguucuggauuauuagaauuucucuuucauagccauguugccuugaaucccaucuuaaauuagaacaguaaaaucuucgauuuccuguuaucuuucuucuguaucuuuguuaugugcccuggacacucuguguccuacaaacauuuuuaacugaacaacuugcagcguucuccaacuagcucuaagaucaucuuggcaaagaaauggcaaggcugggauuaacuagaaaagccaccaggauuucuauuuuuaaaaaaaggaaauuaagaguuuaaauucaauuggaucaacccuacacacauauccagaguuucccagaacucaccacuguuugcugguguugcugaaacuuaagacugacauucuggauccaaaaaaagcggaaggagccaaucuuuagcuccgccugcagcuuccgcugacaccacuugguggccaaccggaccacaagccaccugcagaaaaauuccuguuaauucauaggaccuuuuuccaaugaugguuucccucaccccuugcuggucuuucaaagccuugcaaaaggucguuccugaaacuggaucugagcaacucuccuuucuuccaaagcaccacucugucauauacauucagccacgcugaucaagauccuagcucccgacugaccccuccacccagaugaaaccagaaacugcacccucuaaguugaagacaaaaacaaaaucccucaaauuguuaugaaucccagaggcagagagagaagaccccagcaagagucaaagcggaggcggcucugucacaugugccaucacacuccccagagggucugucugucuccugcucccacccuccagacagguauccacgagaaggcacuuugaggucagacccggcagcucgaaugcuguucuccccagaccgaugcugcaggugcccaucgcgcuuggcgaaagggacaugcagggguggguggagggggaaagggaagccacugaaccaggccccuuccucacacuccuauucaguuccuggccucagcauuuccucagaccccgcccgcuuccucagucuccccaacucgcagcccaucccugggagcucgggccacgcgccuccucacgaucccuccccucgccgcgcgcccccucccuccacccuacccacucugccucacgcgccucaguaaggcgcgcgcccccuccucagucuuucuuccuccucuccgcccccucccucccgccgccgccgccgccgccggcgcggccgggaacccucaccggccuagaaagagggcgcuaagcgcaacuagcagcaagaccaacagcgcggagaagaacagaggcauuuagguccggguccggcccggcuuggccccggcccccgccaugccgggccccgacgccggauccgcgcagcaccgccgcgggccgaccagcugcgcgcg

SEQ ID NO: 16716 - RNA, 287 nt, Homo sapiens
ccuaagagaaaaaaauguuaccuagcauuucuaaguuucuguugggaaucuguuacuuuuauuaaaauugaagggaaagugaaauaacccuuguuuugccuucaugggucaagggaugggcugggcuagaguuuuagguuugggaggauguauucuaagcucuuaccuagccagauaaauugagggaagaucaauuuggcucuggaaagggaaaagucuuucccuuugagacugugaccuuucccugcuuccuauuucucugccaggugcuuacauguugcagaagc

SEQ ID NO: 16717 - RNA, 5105 nt, Homo sapiens
ccacggaugccuggcggggcgcucacuccaccucgccgccccgccucugagggcguggucuugccccggacaccaguccuggggaggggguguggucagggcggggcaugcaggccacgcccccggaggagucacguagcucugcgacauccgcagccucauuuaccagagggagccagggcugcagccucaucuguuugcggaucagaacccgagcugugcuuguggcugcggcugcuaacuggcugcgcacagguaaggccaggcaaggcgggagccacucaacaucuccgcuucauuuccuuggcucuuccccugccauccucguccugcuaccugggacuccgggaugugcccuuucgacccuuuccuaacaucuuugcuccuuuccgcguacuugaaaccccauggcucaaccucuucuguucuaucccucuucagcucucccagcuggaccucagcuuuuccaaucccaaauccuccucuacuuguuggauuuuuccuuggagucugucucuccuacccagagcauuuccuucucagccugcucccucuccuccuaggcuagguccucucuccaguucucccgccuucucugccccccggucuaggucucucccgcugacugguuagccugcaucaccacuagcuccccucagucucaucucucucucaggcucucuacuccuuucagccuugguccucugcccucccgucugggugucugaguuguggggaauugaagugcuuccuauugcuauccuccugccaaacaggugaagugcuuccugggcacagagaugacccggaggugucacuagcccuagucuccacacacuaacacagcugacccgcugggcccucuuuccuacaucacugcagccccacuggggccaaccucugguacugggugggaauaggcaauaggcauaggcaggcagguuuggaguacagaaaaggagaagcugcaggagccugugacugguauuugugccacuccuacucccuaccuguucuuccaaccuuuuccucuagaagcugagagaagaggguggcaauaaguacuuuugccucauucugaagccuuggaaguaaguacacuuucccuagggguccuguggaggaugagaaaagggaagcuggaaaggccaggacuuuugccuaccucaacaagggaccaaguucagugaaagaaggguuggcauccuugauugggcagcagauuuaucagaagagcuguggcuucagggcugcucaccuccccacccccacccugcaucuuuccccagggcugggaaggaugccuaccagggacaaaaggagaugugggaacuggagcccuaagcuugcuagcugucagaaggacuggugccacuugaugcccaggacucaugccaaggacugcugcccuguucccagccccuugcuugauggggaggccauuuggcccaucuggccaggagaggcagcagagggugaggucuggcuuuuuuaucuugucuccacuccagggagcugucaccaugccucacucguacccagcccuuucugcugagcagaagaaggaguugucugacauugcccugcggauuguagccccgggcaaaggcauucuggcugcggaugagucuguagguaaguggacaucuguagccagguaggguacagguggcuaggggacccuggggauguucucacugccucucuuuguuugccccuaggcagcauggccaagcggcugagccaaauugggguggaaaacacagaggagaaccgccggcuguaccgccagguccuguucagugcugaugaccgugugaaaaagugcauuggaggcgucauuuucuuccaugagacccucuaccagaaagaugauaaugguguucccuucguccgaaccauccaggauaagggcaucgucgugggcaucaaggugcagccccuggcccugcucugaauggaagcugggugugaaaauaagcuuguguaggagggguagcaaggagaauccugccuggauucaacccucugcuuguacuuccucuacagguugacaaggguguggugccucuagcugggacugauggagaaaccaccacucaagguauaggaugggugggcuugaggaccaaagagguguuagauaguugaugcugguaaaagaggggcagaguaaugagguuggcacugugcuugcagggcuggaugggcucucagaacgcugugcccaauacaagaaggauggugcugacuuugccaaguggcgcugugugcugaaaaucagugagcguacacccucugcacuugccauucuggagaacgccaacgugcuggcccguuaugccaguaucugccagcagguguguguguugggaggguggugagcuaggugcccuguaugccugguggggagagagucacaaggcuuucuucaucuccccuacugccccucccaagcaucucugcucuugccugcagaauggcauugugccuauuguggaaccugaaauauugccugauggagaccacgaccucaaacguugucaguauguuacagagaaggugaguccacaccugggcacacaaacauacugcagggacagcucggcaggagugucuguuccccagaacccccagcuuagauccaggcacacuuuccccuagcacuuuuucacuucaucccggcacaggccugugaucugagccuguacugagcccucacagucugugcccaucuaccccuacauagggagcaucgagcaguaaccagugggggcccagacccuuaguaaaccuccucuaauccccacccaggucuuggcugcuguguacaaggcccugagugaccaucauguauaccuggaggggacccugcucaagcccaacauggugaccccgggccaugccugucccaucaaguauaccccagaggagauugccauggcaacugucacugcccugcgucgcacugugcccccagcugucccagguacuacccagcucccuaaccugcuccuaucccuaaggcccaucuucagguccuucuuguggccuucagggguucccuauccuggaaaaauugggagugaccagucaguuugucuucucuccuccacacuaggagugaccuuccugucugggggucagagcgaagaagaggcaucauucaaccucaaugccaucaaccgcugcccccuuccccgacccugggcgcuuaccuucuccuaugggcgugcccugcaagccucugcacucaaugccuggcgagggcaacgggacaaugcuggggcugccacugaggaguucaucaagcgggcugagguugggagcuacaggugguggugggugggggcagcacccagaggcuauagccugggcagggcuuggcaccugugggcuggcucagccugcuuacuccacgcucccuuuugcaggugaaugggcuugcagcccagggcaaguaugaaggcaguggagaagaugguggagcagcagcacagucacucuacauugccaaccaugccuacugaguauccacuccauaccacagcccuuggcccagccaucugcacccacuuuugcuuguagucauggccagggccaaauagcuaugcagagcagagaugccuucaccuggcaccaacuugucuuccuuucucucuucccuuccccucucucauugcugcaccugggaccauaggaugggaggauagggagccccucaugacugagggcagaagaaauugcuagaagucagaacaggauggcugggucucccccuaccucuuccagcucccacaauuuucccaugaugagguagcuucucccugggcucuccuucuugccugcccugucuccugggaucagaggguaguacagaagcccugacucaugccuugaguacauaccauacagcaaauaaaugguagcaaaacauucuacuuugccugucuguuuuacacaucaaauucccaccucccaguuucugaucucugcuaauucuaucucugggcccucugacucuggagguggagagggugggauuugagucuuacugggcuucaaguuauggaggaagggcacaugcagucaccauccccagcucaggcucuugcucucuugauguccaagucuggaguggggcaaugaggaagacugcaagucuucuagggacugccacaucaguggcacugggcugcagcuacagaaguauggagugaggccaaacuggcaacuccugaaggcagauuugugcaaggcucaaagcagggaggcagcaagacaggcugggauaagagugggugggagucucucccaucucgcaguguuaagcccagcugggaccugguaccuuccacuagggugagccacaccaguaagggcaagcgagcaccuggacucccgcccaaagaggaaaaccaaggcucugcgggcugccagggcugagcagggcaucuaggagguugccaagggcuauggcccauuuucauuugggguagaagugggcacaaagggagccaauuggagggucuggguaaggacagcucuggugaggccugaugcugaacuuuaaccacugggcuggguugugagguaggcugagaaccugggucuaagcagauaaaaagaagagauaacaagcugcguguguucugugucaacuggggaggcuacaaaugcuccacccuguguggccugacuuuauaauaacaaaaauagcuugcacauagcaccaacccuguucuaaucacuuuauauguacugacacauuucauacaacucuauaaaguagguacuauuacuaucaucccuauuuuaauagagaaaacaggcacagauaggcacagaacgaucuucucacgaucacucaccuaauaagugaugaagccaggauuugaaccgcagugaucagcaucuagagucugggcucaugacuuuucaagauuuuuaagugaaguauucugaguuuuccaaguuggaaaugaauuaaaacguauuuuaaaauagcgagagagccaauugugcuaaaacauacuagcuugcuaccuccguguuugaggcuuugaggagagggcacccuaagaggaguucuacgauaaggauaa

SEQ ID NO: 16718 - RNA, 12629 nt, Homo sapiens
aggggcacguuccgcuuugaaagaccugauggcucccacuuugauguucggauuccucccuucucccuggaaagcaauaaagaugagaagacaccacccucaggccuucacugguaggccagcugaggccccaagugcccaggcuuggucaccgggaagaacaacucucaucccacaauugcugcagaacucuucucuccccaucaugggccacagugggucucuuaauuugauugugggguucuuuuuguggggaggggugguauaacuuuucuucagaagacccaugugggacaccuccaaggcuggccuccucauaagcccugccuacaccauguuccaguaaaccucuccaccaaggaacuguguucagcugccacaggccuggaggaguuuccuggccugucacgugagguuugaucaguaaaccagugcacgcuuggccacccuugccauuucugcucccagagucucaggcuccccuucugacccagugugcgcccuugacugcuuucuuugcugcccuuccagggagcugccccccugguagggcaugugccuguuucccucucagccuggaggcuggcuggacaucuccuagggucacugugccucucagcuaguuggcgggggugcuggacuggacucuuguucacuuuaccuucugccaaaugcagagagggaggccagugucagggucggaguggccuggcucuuagcacugaccgaccauugccauuucuggccucgcuaggcccaggagaggagggaggcaagccagucggguuuccuggagcaaugggugugccagcccucagcaugacucugccaagcauccagaccacaaaugcaggaauuuggcugaggagcagcuuuagguauggauugaugacuaagucaagcuacuuccugagcuucucucagauuuccaagagccagagaugaauugugcugcaucuugccccaauucuuaggauuucuuuuccuccgccacugcagugauuguuagagguaguuuucuugaauuaauauuaaaucacaguuccagcccuuguuauucuuguccuuaguccuccagggggagcugggguugcagggcaacaguacagucgcgcuuacgaccuggcuagaacacaaggucagaugauaaacagaagcacaggaacucagcccauggccgcaagcuggucaaggccugcucacuguaaacauggcucuguaccauugaguuuaacacaauuuuauuagaaauuaguguuugcuuccaucacuuaugcugagcaaccaaauauuacaguuaugugauaaaggaaaaauucuuuccugcccaggaccugcgccauccuuuaggccgaccuuggucacauaccaaauucaauaaaacccaauacuggccuguguuguuaacagcaggcugccagguuucucagaaacugacaagaaaaucugaccuucauccauacuuuguuuacuuaccccugggcugcuuggaguugaaaaaugcacacagccaagaguugcuuucugaauagggcuggaaacuuucaaagaaaacccccaaacuuuuaagucacaaagucugauuaaagaagcuaagaucaugucagugaguucaauguuaguauuuuccuuaagaccaaggagagauuuucagucagagaagauaaaugcccagucccagacuacugugcuuucucggcaaaaaagacugagacacugaggaugugaaugucaaaguaguaagcagggacuaaaggggauggggaggucaaaaggcaagcaucacaacaccucaguggggagcugggaauuugaguguuaaaggaccucaagagggcagcugagaaaauaggccaguggucucaggcugacgcauuccagucucugugggaaagucauaaagccaaagccugaauuuggccaaagaaguggauuugucuuuaucuuguuaccucaaugagggcuggaagaacuaguagcugaucaccaagguaccugaccugagagucuuagugcuguuuauacauucaagacugugacuaacauaaaaugccuaauuagaaagucacauuuccccugucccgccgucaugucacuucagguccuugugucuaacccugggucuggcauuugcccauaggcucuguggcaucagcuaucauaagaguagucaagagagaugaacuugauaaccuguguucucuccaaagagcagaaaguggguacuauacguggcuacguugcuuuguuaggcuggcagaacagucccucccugacagcauuccuuuggaaaauaauucagauaagcugaauucugguuuggccaagccaaacaaaaaggaaugaaaaccaaagcccuaaagaggaacucaccuccuggcuagugcuuggcaucuccauggcugaguuacccaacaaggagugaaggccuucagggugcuucgguugcuccugucaucccgcgcucagagacaccacugggcagaaccgccaucccagccagcaccaaccaagagcauagauggugugggcagggaguagauguguggccaagcaugugccaccucuguaggggcugcugggaguuugcuguccucagcugaugggcaugccagccaacaccaugcagugcccacgggcuccacggucuuccugccguggcucauguuucuggcccaugugacagcucuuuggcuuuaccguaugugaggacagcauggcuggaagccaaggguacucaagagaaucacaaagagcagucgugcuagaccuaggagucagugaugugacuaugauguggggguaaaauguccuuucucacaggcacccugugaggacugccggucccagcuuagccauccuucccuccucggugcacucugagcugcuggccaggcugcaaagccagagcugcucugucggauguuuuuuuuuuauugcuuccucuuuauccccucccucagauugauucugcagggaaguggggauuaggguagaaagacaugggucaaggagauuaucaaccuccugaauaacaguacaaagugcuuuaaagaaacagaucccacaggcauggagaagggccaaggguucugucauauguagggucuuggcacccuggagggcaaaagaaaugcucaguuuccucauuacuagauuuagaauuauucauuuccuagauuauuuuuuaaaaaccaaacuuaucaagccugugcuuaaacaccuuaggaaaaaagacgucccacuuucugcaccagggccucuacagcaccagaacugccuuucccccagcugaggccuaaggggcaguagccuucugcacagggccuaggggaagguucucagcaggaggugggucaguccauaugccccagggagcagaagcagcuccgucgggcaggaagggugauggugagcagauaggacaggacgcagucuccagaagugcucaggggcaaggcaggggaauguggucccuccucugcccagacccucugaccucugagcagggccugucaugccucugggugcuagagcagagacccaggcagcagcagcaugggguggccaauggggcggguuccacaggaugggagauagggccucccgugcccugacucccugagggucuggucagucgcgauggguagacugguggccgagcugccggucaucguaagugcuguagcgcuugacguggaugcggcggacacggucccgcaguucaaaggucuccucaucuucacugggggaagccuggcugcggcuacggcuuguggccuccaacaaggaguugucggggacgcggggagucucauagaguaggacguugagugucuccucauagauucgggccucugggaauuccaccugggguuagggaggaagaagguggagcaagguuucaucuucaagaggaagccaugcgucagagcggcuggcccugaggcuccauaaggccuccgcuaccucucauaaaacagguggcgguccgucuccagggaaagccagccucccuccgaaggcggggugaggggauguacucuacagacaugaggacagggaagaccaacauccuccacaccccugccccagccugagaccaagggacuagugggcauagagggugggccagagcuaggucccaacacagcucuaccacuugcuagcuguggagccuugggcugaacccuucugggcugcagcucccauauguacaaaagguugguucagcucaaccccugagaguugcugucaacauuacgggaaagaugugauugcuuagcagaagauuggcacacagcaaaccaccaagcagaggcauacacagagcagcugcuaugcugagugguuaugcugccuuucucugccugccugacgcagugugucaccggcaugaccugccuggaggaaggagaaagggaaggcagucaagcaccugaauucuagccagaccugcucuguuggacugagcuucuguucacucaucugucacauggggagaguggcucuagcccugcgugucucacaggcauguugugaggggucacacgaguucaugaaagacaacacacuuaagaagaugccaggugcgcugccacuuccgucgcagcaucaccagccacuggagaccugccccugaacccuuucaccaccgauagggucaggaaccaccugucgcccucccucccaccccuacaccaaaaaccgcagaaggaagcagggccaccuguaaguuggccuuccccaaacccucugcagaucucccagcuggaggcaccuggaguaguuugggggucgacaaguugcuuggcaagucuggcuacuuugagcucuucacacccacauggcccuuccuggaugaccugccauccaccccagcguaucaucuccaggaccugcacucacaggaggcagcuacucucugggguaacugacugcagccugggggagaggggccaccugaguuugugaugacugucaccuaucaaaugccuccuguguaccuggcacuaaguugauuagccagaaacccccagcugguuggggccaguaaggagauuuuauuuuauuauuauuaaaaguguuuggaaguggaaucuugcuauuuugcuuaggcuggccucaaacuccugggcucaagggaucuucccacagcagccuccugaguacuugggacuacaggcaugugccacgaugccuggcuaauuuuucuauuuuuuguaaagacgggguuucaccauguuguccaggguggucuugaacuccugggcucaagugcugugcccaccugugucccuggcucagacaggagaucugaacagcauucuaacacgaaagcccaagcuguuucuacaccacacugcugcuccaaagaguuguaucauuuucauaucucguuaaauucauacuaucauccccaugucugcaaaugaggaaccugaggcccagauggcuuaaguggcuuauccaaagucagaaaacuggcaaguggugugagccagcguucaaaccugaauugggccaacuucaaagacccaguccuucccacuguacuaggcuacuuccugguggucaacggccccugcccugcgcugucaggaacaaagcaguucccguccauuccccacaccccuuguucuggccuuguccuugcccagcaccauuaccguguuuggaaaaaagagccaaguccaugccccuuuugcuccgugcuggucacagcccgaccacgucccccgcacaguggguguguguccuccccuacccaggcaggggcaaucccccacaccuuggucugcuucuucuccguggcauacacgauggagguacagcacaccucugccagcuuacggcccuggccauaaaaggaccagcagcagaucucgucaccaaugacauccuugaugaagagcacgcggccguugaagcgcagggagagcuugucaaacagcucgauguuuuucagcagguggucgucagaguugcugaaaaaaacaugagggccaagcggcugggagugagguuccaguccaagggagggugcuagacaaguggggcccuccccucccucccuucccccauccuguccugccgaaaugaaagcaagaugccagggggccaggagagaaaggaucauaggguacccucuggguuggggggccugugaggaaaaggaacucaguugguuuuaagucaaaguagggacagcugaggaaggaggucuccccucacuaacccuggaaggaaggagacaaggcugcuaugucagugggaggcauuccuucccuuacugugggggugacaguggcaauaugccuggccacagggaaucauagggaggguuugggacucugaaccugcagccaccugcgucuaccuaacuguggccuauggagaggacauggccuggaggguguggggagggaaucggcccagugugaacugcacaggcuggcuugggggacucccagcucaccggccuccuagcauccccuccacccgguaggaugacacgugugaaaacaccugccaugcugccuucgugauacacguugagggcgcauuucaccuucaaucauuuauaucccagccagggcacccugcugaguuccaaaggccucugucccaauuucccuucuacuuucuguuuuuccccaacuuggcacagccaguuccaagacccaggcccagacccacgccgaccgugcugggaguacaggcaguacuccuugggucugcugcccagugucuguugagcccugugacgcacccuaccugguguaggaauacuuguuguugcuucuguuguacagcagcuucaccacgggcugugaaggaguucagagugaggggccaggccaggggacuggcauccccggcccgcaccccucagagguccugguaccuugguggaggauucgaugagccgcuccuccuccuuuagggaugugaugauggggauguugcacacaggcugguaggaguccuucuuguccugugcgacacagaacagagaacccucuuuaggaucuucugcuucccaggcuuaucgagguauaccucuggagccccucugccauggccacccgcugcuuggugaggaagugucagauacagaucaugaggccccugacaauagaaacugccagcuggaaagcagacccccaguuagaaaacccaagauccaggccgggugcgguagcucacaccugcaaucccagcacuuugggaggcugaggcaggcagaucacuugagcccagcaguucgagacuagccuggaaaacauggugaaaccucaucucuacaaaaaauacaaagauuagcugggugccauggcgcaugcuggcauucccagcuacucugaaggccaaaucacgagaaucacuugaacccaggaggcagaaguugcagugagcugacaucgcaccacugcacuccagccugggugacaggagugaaacccugucucaaaaaacaaaaacaaaaacagaaacaaaagcaaaaacagaaaaacccccuaaaauccggguagcaaagcauagaaaccagaagcagggccuacucacgcugccaagugugaacaccuggcugccagguuggugggccuggguggcaucucacuugucucauuagguuugcacucaucaaccacgccucccacacaaccugccaggaaccagaguccuccaucccacaagaagggggcaacuccugaccucaucugcccgcccugcuccgccccacccauguaccugcagggcacucuggcacauauucaccagccccuggaugagguaauacuuugcuucagccaucaauuccuugauuucuugccgguucugagggagggugauggugucaucucggagguaauucaaaauggugccaaagugcuuuccacaacggucuaugaggauccagccuaggggugcagaaggcccuacaggguuaguuugccgccagguaccuccgaggcaggcaaaggccaccugacaagcuggcggcagguggcagggaaggggguccacgagcacaaagcccuuacgcagggugacagaggcggggauggagguucuagcacucaggcccauggcugcucuucacccuuccucucugaaacccagaacuggcacaucccacgggggauacagcccuccaggcuguagaagccacaggggccuaggcucaggguaccaggcccagcccaacacagaaaccaccagccacugccggccuucugcccgcugcccagucuuaaggugacggcuccuaugagaaucuuguccuauuuaaauauuuuaaaaguauggcucuucuuccuggaaaaugcauaaacacagcauuccauauacaauuucacagaauucugaagcucuacuagggacuccaggugaagacacccuacauaaagugaagaggaaaagugacugaauucuagaucuggucauuuccuugggaacuccuccugcccuccccaccccgagcggcagccccagugccucaccuucuuugucggucagcaccuccaugcgcccacugaacauggccuugagcauggugucguggcgggucagggcccgcacagugguguaguacagagagccgcccacguugagcuggacauacuuguugcccaacccuccucccuugaagccacugagcuugggcuuggccccugaggcugggcacaggcaggugucccccgacaucucccgcugcagguagaucaccacacggcaggagguaggcuuggaaggcuccgccgugguggaaagggucacgagugaguggccaguggaggccagagccucauaaucucagugcuguacaugggagagggaagagaagacacgaaccagcugagacagcccaggaggagacaauagcagaaacacgaccguacucauucucucccugacaagcccaagcacugcucccuggcagaggcuaagucccugccauuuugcuuucuuuuuuuuuuuuuuuuuucuuagagacagggucucacucugucacccaggcuggagugcaguggugccaucucggcucacugcagccuuugccucccaggcucaagugauccucccaccucagccuccugaguagcugggaccacaggugcacaccaccacacccagcuaauuuuuuuuuuuuuuuuuuuugguagagacaggguuuuaccaugcugcccaggcuggucucgaauuccugagcgcaggcgauccgcccaccucagucucccaaagugcugggauuauaaguaugaaucaccgcgucuggccucccugccauuuuuacuauagcaggaaccagggcuggaggcagucucccagacuccugcccuggucaccucaucagccucccugagacucagcuccacucagggcagcgaggaagacaagcaaacccauggaaccaguuagagagggccagaggaacagaucacccuagagaucuaccagucagauuccaguuacuuucuugucaagguucccaggaucccagacuuccaaccaaaccuacugggaauccagccagucuaggaguuucccaggagccagagggacaggaugcacuuccuuucuaaagauuccagccuccagagcagucugugccaguguuuauuuugagcaccaccgagagucuggcuucaggaaggaaaguaaaagcagcuucaggagagaaugcaguaagccagggucgggggugccggccaguguucuuggugcagguuaccugggcuucggcuggggcuuccugaccuuccccuuucuuggcaccagccuugucccaaguuccugaaauugucaccauuuuucagggaagaacagcuauaggauggcuguuuuccuuucuuuuuccugagagggagcccagcccuacucuccucuucccucccaauaagaaugggagaagaaaggacuagaaaagaucagaggauaaaucuaaaaacaaugaggugagaugugugcugccaccugccuguacuccuggcuacucaguaggccgaggugggaggaucucuugagcccaggagucaagaccagccuuggcaacauagcaagaccccaucucuuggcauuuaauauguacuagcucauuuaacucauucagcaauuaaacuacugagugccuacuauguuaagcaguagggaacaaugaaaaaauauugucuuugccuucaaacaguucaaagaagcaucauaacaggaauuuuuaaaaagagagaaagcuagcauuuauuguaccccuacgugccaggcauuggguacucagaagagaacacauauagaaagucauguccacauggagcuuacauucuaguggaaggaaacagacuagcaacaaggacuuaaauaaauaagcagauaauuccagaaccugauaaaugcaauaaagauaauaaaacagugauaugagagugauuagggagaggcacuaauuuagacaaagggacaggaaaagcaucuuugggauggugacauuucagcugagguuugaagagagcauuguagacagauggaagaguaagugcaaaguuccuguuagaaacaaguuuuagggggcgggugugguggcucacaccuguaauccuagcacuuuaggaggccgaaguggguggauugcuugagcccaggaguucaagaccagucugggcaacauagugagaguuuguuucuacaaauaaaaaaaaauuagccagauaugguggcucaugccuguggucccagcugcucgggaggcugaggugggaugacugcuugagccugggaaagucagccugggugacauagggaaaucucaucucaacaaugacaaaauuaaaacaaguuugaggaucagaaauacggucauaauggcuggugcacagacaguagggggaaguugguuugaugucaagucagggaaggcaggcguuagaugauaacaaagguggauuucauacuaauugcuauauaguauaugaaucaauuggaggguugcaagcaggggagugauaugaucugacuugcuuguaguguauuuugaaaagauaacuugcugcuggguagagaaugaauuguaaaggugcaagagagaaagugggaagaccagaggaagcaguagucuaggcaagaagagaugauggcagccuggaccacauugguaauaauggagacagaaaaaaaguggaaugauuucaccgaaugcucaucacaugcaggaguuuacaguugcucaugccuuguaagugcaacccagaagcagggcacugguuucccaaguuuaccgcuguguuccccuaauggugcucagcacaaugccaugcacauuuuaaguauuuaacauacgucaguuuguuagacugaaauugucccugaaaagauuuagguaagucccugggaagaauguccaaggaaguggacagccagcgugggugcugugugaagcagugaauuccuuuggcggcuugucugggagacucuuucauuugccacagggguuggguaugggaggugagcccucaccaggagguugccaaugacuaagaaacacuagaaugguaugagaucaccuucccuuuucccgcccaccucaaaggaauaaauccaccucucuaacagguauuagcaaguucccuguguauuuugugucuaguccuaguuuucccaggaucagagaaagcacacauacauguucugccaaugcaaaggagcucaaaggauaggccugccaagagaggucggcggauccagagcuaaucucuuccuuuccuacaaagcaauugcuuugagccccuggaugacgucaaucacauuccgcccagaccaauggguuccaggaauucuguggcaggugacgccccagaaaguaauuccagugagaaugaaguuuccacugauagccacagugcucuuccuuccgcacuuuguguguggauauuuggggaugcccggggcuaagggcggauccguggcucacgcaacgaagcuaaugggaacccaagcacaacaaagggcaaacagccgcggagguggaaagaggaggggucuaaaaggaagaaggacccagaaauccgucagacacggaggacggcgggaggaaagcugagggcuagaguggcggaucuagcagaaacccuagguguaaagguuaagcgucacccaaaaaguccugggaaauguggccggugugggcucuucucuagcccggaccacuccucacuaccgagaaacccacaccgguucucacgcccacccuccgugggagaucggagcucuccaucuccccuacgccgcccgcgccuuuucccccaggacccggccgggcucgcucuacuccagcaggggccguccaucccuuccccgagggcaucggcgggcccggcucucaccguccccgggggcgccucuccucucagcuggguggccagcggacuccgagccgccccuagccugcagccgccugccccucagcagucccaagcugugagcucacauccugcgcucgucgacuccgcccggagugcugcccagcccagccggcuggggagccugagacuacaagucccugcaugcauagcgcucuauccgggaaaggguggaggcggaaucccccgagggucuucgcggagagagcagagcua

SEQ ID NO: 16719 - RNA, 7277 nt, Homo sapiens
ggcgcuaaggcuucugggucuuguaggccgggccuccccucgggccucuguuucccagcaggcucuguggaaugggggcuguaagugcuuccggagucaggaagguagugacgucauagguaaacaggcucuguauccguggcagcggccguggcaggcuggcuggguaccggcugucgcugacccaggagaagcugccugucuacaucagccugggcugcagcgcgcugccgccgcggggccggcagguaggcugaccucgggucgggggacgcgggcggaccaggggcgagaggagccugacaggcccgcguccugaggaaaggcaguaccgggcggggagagacgugggaauuccgccccacucucaggggggcgcuuucacacccagcuuaggccuggaguuugaugcguugaugcuugccacgaucuuacgaggaaacugcggcucggauaaguucggggaguuuacauaguaaagagucggcucgcagugccucgcaugcaucugggagagccggggcgcagaaaguaugccaccgccucaugcucagggagcuuagucccagcucuugggccagguguugcucagaugcucagacacgcgugugaugggaguugguagauaaucugugaacucuuucccugcaccucuucuuccaucuuaccuaucucuuuaagccagcccuuccaaucagauaggugggccaagccagauucaugggagucaugccugacuuguuuuucucuuauccccaaacccccacauucagucaguccauugcuaagccccaucaccucgacuuacaaaacaucucaacucggaacacuuguguucggcugccagccuugguuacugcaauagucuccuguuuccacggucauucauuccacaaacauuuacugagugccaguuaugugugggcaccaugcuaggugcuaggguuagagugaugaacaagaagguacuuggggcuuugcccucucuuguucccuccaaucgguucucucaggcugagcaagagugaucuuucuaagucugauuuuguuggucugcugagaacccgcuggcugucccauuacccuucugauaaaauccaagcucaugacugcgucuuucagagccuucggugauccagcuguugucucccugucuagccucauucuguucccuucucuugcucagucucuguucucggaaugcaucaaauuuccuguugccucaggaucuucacauacguguuuccuucugccugcaaugccuugcuuccccuuucacuugacauacuuuuggacagucuuuaggucuguuuaagugucauuuuuuucagaaggccucuguuggcccuccccuccaaguccgccccccaugaacuguguccuccugcagcacuucacacagcaccauguacuuuuccuuauaguaauaucacgauuugugauuauuucuuuaccaucuguccagaggcauuguuuucacuagucuguccccagagcagggacugaguggauguuucugaauaaaugcaugcucucagggaaggggguggaaguugaagcagauauuugcucccucauguuacuucaaucuuucuggagcagcuggucagauuaaugaccuguagcugcgaaagacagauuuuuugguuuuuuuuuugagacagggucucacucuguugcccaggcuggagugcaguggugugaacacggcucacugcagccuccaccuccugggcuuaagcgauccucccagcuuacccucccaaguagcugggacuacaggcaccugucaccaggucuggcuaucuuagaaaucuuuuguagagacgguauuuugccacauugcccaggcugguuucagacuccugugcccaagugauccucccaccucagucucccaaagugcugggauuacaggcaugagcuacugcacuggccagaucuuuuuaaaaagcccuauuuuaaggaagcuacagaugaacaaaaugcuucaaaaggaugaugcuagcucacuuacaucaguggauuccagugaggccaaaggccagagucgucuacagacagcucauagacauguauuaguuggcccaugcaguguuggauguggguuuucccccuuacuuaaaauuuuuggauuacauaccaacauugagguacuggauuucuggucaucuuaaaaaccagaaguucuggaaacagugagacuugauuauuuuccagccauugcuccuccuuggcacaccugcccuggacagccaaccccagaaucaccccauucagaacaggacuucucuaaggaagccagaagggaaacagcugaggcugggggcagugggggcagagggaaggggcuggugcaaguccaggugaugguagacuuuggagcaccuggguuuuagaauuggcauagcagccaauugcuagauguaaguagcauugccucccuuuuuaaacaggucauaaagaugucuauguuuaauuguguguguguguguguguguguguguguguguguuuugagccagaacaagagugaguuuucaguauuuccuuccuagaauugaggcauccuuuggaacaggaaugcaagguggcuugguaagggagaagauaucucuguuaguucucuguugccuacagaaaaaauccaaacuccuuagcuuggcaugcagggucuuccuggucuggcuccagcucaccuuuccagcuccauucuuuuuccucucguccuuaggugagauagguccuuucagugacuucaggccuuuguccaugcuguuuucucugcuuggaauaccuaucccuguucuccugccuugauauguucuugcugauacuucauuccuuuuuguguuuucugcuaggaagagaaugacccaacuuugauucccaauucaggcaagcauacguuuugaguaauauucuuacuccugacuuuuuauuuuuuaaccauaauuuuuaauuuacucggauuuccuuuauuugguuuuuguguuguuccaguauauguauuugagaagccuuuucaugugcuuuucaguacauaacuggugauauauaaaguaaauacacugauggcuuacaacuuaguucacaugucacuccuucauuaauggcucuguccuccucuggcucuuuacugauguuucuaaacaagcauuuaacgcagugugguuuuucaguuuccgugucugucuucuuccagcugaacuaugugcucuucagggcgggcaccguguugcauucaucuuuguacccccagcaucuagcaguguuggcauguaguaggcacucaagaaauguguguugaaugaacgaugccugugacaagcaagcggacuuuauucuuuccugacccuugcuccuaugacacaccuccuccugacugccacugucacuccuucagagcagaacuccucuagggaaccuggaugggaaacaggugaggcucagagaggugguggcagagggaacggggauccuuuggaacaccuggguuuuuggcauugguguccaagggcaggaguggggcuggcuuggcagcaggcauuuccuuggguggcugggaagugaugaggaauugggccuguuucuuuacagccauggccaaggacauccugggugaagcagggcuacacuuugaugaacugaacaagcugaggguguuggacccagagguuacccagcagaccauagagcugaaggaagagugcaaagacuuuguggacagugaguauuggggagauacagugccacucagcuuugagcugccauuucaacuguaccccaggcucaucuuggcccugccacaguggagcugcuggcucccuggagguugaaucuggcgucugugaguucccacgugccacccuuuucugucugcccucuugugcucucauguguccccaacagggcaccagucaaaccaaacaccgggauggggaggggagggugucuuuagauaugccaucuuucauuucuugcucuuagaaaccuuaaacuuucugggaacacaaccauggcuugggugugggaaauagaauuauguacucaugauuugauuucuucagagaaagucuucucaggggcagguucucuguuauuuggaguuagaagugauaggugaaguuucuagaagcagcucaacagacuuacugaagucaucuuuuggcuggaaaucuucaggaagccuccugucccagcagccaagcaagcccaaugcccguacagagccagaucuagcuagaacaagggacuucugagcuuucugggggguuuccuagguuguggagagagcuugguuagugaaagguagcuuggguucugucacuaaccugugauugcugugccaugcacacaccucucugggccuuaguuuccccucaguaaauugucacauccaggacauuggagaaagugagugggagauuaggcacuuaaugcugugagcuugcuuuuuugugguuacaagugggaagcccccauccccacuguuaauugaaaucuggugucauaccuguagcuaguccagaggcagcgcuuguguccugaggcugcccuuuugugaacaacagugcuuccugucacuccuggggaagcaggguuggggucugucuggagaaugagcccagcaagggccuagugcuuucauagccggaggucauagcggcuggcuggcucaguggggaugcaagguccgaguaugcccugguccagcuggccacccuucucuagguucagaccaaggguaggagacaggccaacaggcaccaaaguguuuaagcgacagggucuugcuauguuccccaggcuggaaugcaguggcaguucacaggcaugaucacacauccucuaacuccuggguucaagugauccucccaccucagcccccugaguagcugggacuacaguugcucuccaccacgccuggcccacaccgaacuauuuuaacacaaauuagaaggggcaguccgcucugcccucucacugccuuagcacucuaccgaaggggagugaugauacuaaggaaauauuuuauuuuuuguucuuuuccuaaaagaaauuggccaguuucagaaaauaguuggugguuuaauugagcuuguugaucaacuugcaaaagaagcagaaaaugaaaagaugaagguaagaucagcaugucuuccgccuacaucuuggccugggacccuaguucacuacccucucaucccucuucccucuugauuuauuuagagggguagagggcugggugggugaauuuuuauuuaagauuuuaauaacuucugguccacuuaaccuacugaacuuuugccaaucuuuauuuccuuuaaucuuuauuuuuuuuuuuuuuuugagacagagucuugcugugucacccaggcuggagugcacuggugcaaucucggcucacugcaagcucugccucucagauucaagcgauucucccaccucacccucccgaguaggugggacuacaggugugugccaccacacccagcugagguuuuuguauuuuuuuuuuuuuuuuugagacggaguuuucucucguugcccaggcuggagugcaauggugcgaucuuggcucacugcaaccuccgccuccuggguucaagcgauucuccugccucagccucccgaguagcugggauuacaggcaugugccaccaugccuggcuaauuuuguauuuuuaguagagacaggguuucuccauguuggucaggcuggucucaaacucccaaccuuaggugauccgcccgccucagccucccaaagugcugggauuaaggcgugagugacugcgcccggccauuuuuuuguauuuuuaguaaagaugggguuucaccauguuggccaggcugguugcaaacuccuggccucaagugaacugccuaccuuggccucccaaagugcugggauugcaggugugagccaccacaccuggccucguuucaucuucauaucagcacugauguagauggucuuauccucauuuuauaaaugaagaaaugaaggcuuacauaguaugauuggugaaaggcacaaggcugaauggcaccaccaaaugugcuauugugccugugucccuggcucuaggaauacuccuagaccugccucaaagcugccgucuaguucuugaggcacuuugugaucaguagguuaauccuucugacuuaacccaaaagcuuuggggcuccacuuucuuuuccucucugaagacugacacagcucccagauaaccccuccccacuuugaggacuugaugcuguagaugguuuuaaugaagccauggccuucucuggcaauacuguaggccaucggugcucggaacuugcucaaaucuauagcaaagcagagagaagcucaacagcagcaacuucaagcccuaauagcagaaaagaaaaugcagcuagaaagguaagaagucaugauguaaagcaaguucuuuacacagcugaauuuccacucuuccuucuggaaugaucacuucuuguccuuauucuucaucauuguuuucccaggaauagcaucucacuugucauccugauuugaagauuuuaaaaaauaaaauuacauuugaugggaaggaaauagaaaacuuguuaauaucaaaccaccucuaguaguuugagcaugaaaggguccacgaaguuggcuggcucucugaaagaagacuuuccuagggcuggagauuucucauggguggcucuggguagggcuuugccucuuucuuucuucauucugaacucacaccauuucuugaaaucauuuaaaccucuauauccuucucuagaagaauuaggucugugguuuacuucaucuuuuuuucagggccucuaacaauuuuguuuuucagguaucggguugaauaugaagcuuuguguaaaguagaagcagaacaaaaugaauuuauugaccaauuuauuuuucagaaaugaacugaaaauuucgcuuuuauaguaggaaggcaaaacaaaaaaaagccucucaaaaccaaaaaaaccucuguagcauuccagcggcuugaccaaugaccuaugucacaagagguggcguguaaggaaugcagcccccugaagacagcacuacaagucugggggagccaguuuuaacaucagugcacagcugcugcugguggcccugcaguguacguucucaccucuuaugcuuaguuggaacuaagcaguuuguaaacuuucauccuuuuuuuuguaaauucacaaagcuuuggaaggagaagcaauaaauuuuuguuuucaaauggcuugauguaccuuuu

SEQ ID NO: 16720 - RNA, 10125 nt, Homo sapiens
agagagaagcucaacagcagcaacuucaagcccuaauagcagaaaagaaaaugcagcuagaaagguaagaagucaugauguaaagcaaguucuuuacacagcugaauuuccacucuuccuucuggaaugaucacuucuuguccuuauucuucaucauuguuuucccaggaauagcaucucacuugucauccugauuugaagauuuuaaaaaauaaaauuacauuugaugggaaggaaauagaaaacuuguuaauaucaaaccaccucuaguaguuugagcaugaaaggguccacgaaguuggcuggcucucugaaagaagacuuuccuagggcuggagauuucucauggguggcucuggguagggcuuugccucuuucuuucuucauucugaacucacaccauuucuugaaaucauuuaaaccucuauauccuucucuagaagaauuaggucugugguuuacuucaucuuuuuuucagggccucuaacaauuuuguuuuucagguaucggguugaauaugaagcuuuguguaaaguagaagcagaacaaaaugaauuuauugaccaauuuauuuuucagaaaugaacugaaaauuucgcuuuuauaguaggaaggcaaaacaaaaaaaagccucucaaaaccaaaaaaaccucuguagcauuccagcggcuugaccaaugaccuaugucacaagagguggcguguaaggaaugcagcccccugaagacagcacuacaagucugggggagccaguuuuaacaucagugcacagcugcugcugguggcccugcaguguacguucucaccucuuaugcuuaguuggaacuaagcaguuuguaaacuuucauccuuuuuuuuguaaauucacaaagcuuuggaaggagaagcaauaaauuuuuguuuucaaauggcuugauguaccuuuuuuccuguugcucuugaaauauguuuaacuccucaugagagaacccuggauucucuauccccuaguccacaaaacaaaccaggcaguggucagcagcuaccuuuauuuggaucacacacgugagucagacaguaccacuaaucgggccaauauggcuugugagcaaaaugggugaaaauagagggaacugacugggaccuguugucuaacaucauuuuaagguugaacuugagcaaagacuuagagaaagcugauggaaugccaagcaucaacgugaagagacccucuaugcacacaguggauauguuaugccuggcuguagccaccuucucuucugaaaacaagaugggaaugacggaacuguauuaaaagauuaaguuauccacuagggagcauacuagcacacuuccagaucagccuugagaugcuagacuucagauacagggacuugugucagguggccucuagaaauguggaagacuaagauuuagaaauaaacuaauuuaaaagcaaacaaacaaaaaaaacuuucgccuaggaugaucuguuuacaacagaaacaaaaacauuuuccaguuuaauccauuugacugaaagucauuguugggcugacccuuaaggaaaacuuaaguuuaaacuuccuuugcauaguauguuuucucuuuuuuccuuggguuagaggugggaacaagaaaacauugauauaguuuugaauuaacauuaaagaggcaaaauuucacauuuaaaauggcccaaaauaucccacuauucauuuugcugacaggugauacacucuugagaaucaggaguggaggguuuagucauaagcauauaugcugugggucaggugacucaugaacaugucaaacaggccauguucuuuagcaguuucuggucugguccugcuuuuaguaaucuugcgguggaacucaggcacacaguuauuugguaccacuuccuuauaaccuagcccacaccccuuugcccacccucaagccgaucggucuguucaucccagugcccuuagaaggugaagguuugggcugggcccagugguucacgucuguaaucccagcacuuagggagacugaggugggcagaucacuugagccuaggcguucgagaccaaccugggcaacauggcaaaacccugucuccacacacacaaaaaaaacaaaacaaauuagccauacguguugguacacaccuguaguucuagcuacuugggaggcuaaggaagauggcuugagcccaggaggcggagguugcagugagccgagaucaugccacugcccuuuacuccagccugggcaacagagugagacugucuuaaaaaaaaaaaaaaaauggaagaaggugaggguuugacaugguuccugacaccaucuugcucuugugcauugcugccaguguuucaaaugcugcugaagacguggguucugagcaguguuccuuguauuguauccaacaagcaaccacccuguaggcaucucuacccugggccagugguuguuuccuucauuuuuuuuuucuuuucucuucauacuuguaguaggggcuccgcaacaugaaaauuaaaaguaugaaugggaugaguaaguagggggcauagacagacacaaggguuaaccguucaugcaaagucucaggucuuugucccuugaaaccacuggcuuuggagaaauccucaaacagaaauguggagaguaucggaauuaagguugucauggugugaacagaguagaugauugcaggaguucgaauccacuugcagcuuccugagguagucaggggaaaagaaaaaugguuaggucuguucaugacucaaagguguccaugaccuucccacugucucugccugccugcuuucuucuacucccuucuccaaguggaaacucggaacuggaaaccuggaugugccacacugcccaacaugcagacuuacgugacagcucaccgacagcucgccaaagaaccaagaaugggggucagaacauaacucggaaaagcucuagggcaauaaaacugccauuaccgguuaaaccugugugguacaaaauccaaggggagggaaaucccugccccauggcaucuguuuguucaguaauuauauauaggugagaggaucagaaggcagauucagugaccccagggggugccaaugggaaacgagcauuuucagugguuuuagcuuaucaaguacacguguauggucaccuuuuuaaaaaagcauugauuauaugagaacacuaagaauaauuuuaaaaugagaagcacauuagggauuagccugaugcuacagcuuauaagucaguaugauacuauccaacgcagagaaauaaaagccaacaaaaagagaaauuaauucuguuggggaacaaaacaaaagggaacaagcucauuguuuaaguggucucaggcuucauguguaugcaagggauuuccagacgacugaggcagccgugcaggccugcugaccacagacaugagccugagccacacuaaugucccuuuacaagaucuacccuggcuauuuaccccagauccuguagcauucucccacaaacuauggggaccauccccuucccuuuggagauacuuucccaaaagauuucugggaccugauuucugaguaaaaaugggauuuucccaccauuuaccaaccuuugaggaaggcauacguugcaaugggaaagaaaggcagcugaaacacaagcucgcaaaacagaaaggacuuaaaccaggcugggggcuccuguagcagugggucuuugaacuccuuagcauaccacuucagcagguuucuaaacugaaaaagaaaacgaucaugaugaauuacagccacuugcccucaacaggcucggcgcuagcucauuugaaaauacacuggaggagccugucauuaauuagccaccccccacuaccccggcagcagauggcauguccagcuggcuuuugugacacagccuagguggucauuuaauaaaaacuuacuaucccuaacucaaauguucccuucucugaaauuuucucaacucuuccagccccuucuuuguguuacccagaaucuguucauaauuccaagauaacacauccagguguguuggccacugucaggagcaacaauaaguaucuggcacuugguaggcacucaggguguucgcugaaugaacaaaugugacauuucugucaacaauaucauucuuuguuuaaaaaaacaaauacacaugaaaaccauccugacacuuucccuuuuguaauggcaacuacacaccaaacuccuccaaaggccagauucccucaaaugcagaaaugaauugaauuucccucuucuuuuugcggggugggggugggagugaaaggggaaguaaaucuaaccucuguggcgauguaauuuuggacacuuuaauuccaauaugacaaacaaguuccuuaacuccccuaauucuaauuuuugguuuauuuuaggagacaggauuuuaguggaagaacaaacucugccccaaacuacaaacuaccuaguagcuucuugguuaugcaggguuuuagcgucucaguucuagcuugggccccacgcuuguaauuaccuugucaaauaaaaaggaugcggauccaugcugaccuggcuacaggcagagaaaagaagcagaguuuaaggcuucccaucuugggcuuuuauaggagcccaaagccuagugcucuuggcucuauguggacuacuaaacguuugucacauuuaaccuccuagauguggcgcugcccugacacacaggccuucaaagacaaauaagucuugauauuaugauuaauaaaggcaacuccaggguaagaauuuaucuuacuuacaauggaaaauccaagaauauuuuuccuguuaauuuuuaaucaaaagauaaagccucgcuauugugaaauagaagccccacugcugcaagagcacuuuaagcaaacauccagaaacaaauauccuguuagcauauuauuaauuucagaaaggcuuuggcuagauaaccaauuuauugaccaaaggauauccaaauuuguacuuaauuugaaauugaaauucauagcaaugcccuucgcuuccuucuaagcacuuuucuggaugggaaugugguuugaauaggauugaauugauaagaaacacaaaggcuaagucacugucccucuccaggguucuacuuccucaucuguaaaaugagcaacuuggacuagauguuuucuuaagaucccuuuuuugcuuuuuagauuuuuaaaaauacuggaugacacuaccugcuuuaaaagauugacuauaaaauuauuauuauuuuuuuugagacagucucuguugcccaggcugguggaguguggugauuugaucucggcccacugcagccucaacaucccgggcucagaugauucugucaccucagcuuccccaguagcugggacuacagguaugcgccaccaagcccagcuaauuuucuguagagacgggguuuugccacauugcccaggcugguuucgaacuccugggcacaagcgauccucgcuucagccucccaaagugcugggauuacaggugugagccacugcacccggccugacugcaaaauuuaagaggcauucugggccaggcccgguggcucaugccuauaaucccagcacuuugggaggucaaggcggguggaucaccugaggucaggaguuugagaccagccuggccaacauggugaaaccucgucucuacuaaaaauacaaaaauuagcugggugugguggcucacgccuguaauccuagcaacucuggaggcugagguugcagugagccgagaucgagccacugcacuccggccugggugacagagcgagacuccaucucaaaaaaaaauuaaaaaaaaaaaaaggcauucuggccauuugaacuucacuuucuauucaauuuguuuacaaccucucugauccaacuauuucauaaacugaggcagacuuguacagcacuuuaauuucuaaggccuacaagaugagaucagcaaaauuuaaaaaacaaucacccagaugucguaauaaugaauuaucauaaucguaaccaaccaucugcccacagucauauaccugccaccugaugccagaaugaggcugggacuaauugugaguaggagaguagaaagcccaggcaccuggcagaugggugaggcguguaggaccugggguagagugccuggcuuuaggcaaggccuuuaaucucccuacacuuguguccccaucaauaaaauagagccaguaauagugccuacuucacuauugguaagagagugacuuaauacauguagucuuuaaaauaauggcuagcacauaaugauuaauugaauguaauuaauacauauuuggagauauucaaguuuaaucccauuaaaaucgcagcucacgacuggucauuaaaaauuauuaguuauggccucccuaccaaagguaaugaaacuguuuccacuuauaccugacucuauuugacucaacccacccuuguuauacauaaaagauucaccuggccugcacgcacgaucucuaaaccagugguugcuacucaccaaucuuguacuucuauaauuuagaaugggaacacagacugauuucagagccagaugcucacuuguuuuuccuuauuuuuaccagaagcaauguuacccagcugcaaaugauacuacaaaaugcuucccauccucuccuuaccauguucuuauccaaacuaaauucuuacuguuucauaauaaaauaagaguuuuuccaggccaggcguggugguucacaccuguaaucccagcacuuugggaggcugaggcaugcagaucgcuugaggucaggaguuugagaccagccuggccaacauggugaaacaccaucuauaacaaaauauaaaaauuagccaggcguuguggcaagcaccuguaaucccagcuauuugggaugcugaggcaggagaauugcuugaacccgagaggcagagguugcagugagccgagauugcaccacugcacuacagccugggcgacaagagacugucucaaaaacaaaaucaaaaaaaaaaaagaaagaaaaacaaaaaguaaauaaaaaaaugaguuuuuccaagcagugauuuggugcaauccaagaaaaaaaauuuauugugcauguuucagcccaaccacuaggugaucuccuacagguuuuuuaacucuagggaaacauuccuucuauuucaggaagaaaaugacagauguuaaauuuuggcauuuuucaaagagaauaugagaauaacucaaggcguuuauuauuauuugccccauagagaagcaacaaaaucagcauuuccuacaccaaagcaacaagaauggaggcacagaccuuccaugccaggaugccaccgagcuaaugccuucaaacaucaucacacacacagauacacacacacccaggaugcccgugcuaaugccuaaaucucacacaaacacacacacacacacacacacacacacacacacacacacacagguucuggccagaugcugccugcacuggcccuugggccuucugcaguaagucagcauuaaaaaaauaaagcugacgcugggcacggugggucacaccuguaaucucagcacuuugggagcccgaggcaggaggauggcuugagcccagaagaccagccuggguaacacaguaagacaucaucucuacaaaaaauaaaaaauuagccaggugugguggugugcaccuauaguccuagcuacucaggagacaggugggaggaucucuugugcucagguucaaggcugugguaagccaugacugcaucacagcacgccaagccugggugacaaaggacccuguuucuaaaaaaaagacugagaaaauuuuaucaaauguaaacauuuaaaugggaucuuuaugauaugaugcugagcaccuuuuaaguguauuuuguuaggggugagcaagacgggcuugugagaauggcacauccaggaaggauaaagaagacaacagcugugaagucuggaauggcuacauggaguagcaggcuaauuaccaaguauuaaaagguccuauaacaccagagauuguaaacaggcagccugucugaguauugcuggccacacagguuucaaaaaccacagauaggccaacacuguaguagauuuuccuuucuucagggcaauuaaugguuacugcagagcugcgaugaccucuucggucuuugggaagagucuguacucucuggcccuguaguaggcugaauaauggcccccaaagauaaccacauccuaaucccuggaaccugugacuauuacuuuauuuggcaaaagggacuuugcagauguaauuaaggauuuugaaaugggagauuuucuggguuaucuggugggcccugaauguaugacaagugucuuuauaaaagcgaagcagagggaacucugacuacagaaagggaggcaaugugaugacccgaagcagagauugaagugacgugaacacaagccaaggaacauuggcagccaccagaaaauggaagaggcaagaaccagauucuccccuggagcccucagaaggagugagcccugccuugauuugagcacuguaagauuucauugugaacuucuggccuccagaacuguaaacaaauaaaucuguuaaaucacuacauuugugguaacuacaacagcaauaugaaaacuaacccacccuguauauguuugagcuuauaauuuaacucaacucucucaacaguugaggaggauauagagcccugaccugcccaagucaccuccaguucuuggaagaaccaaguccccagacugcaacuugcuacacgcuaccuacgcuuuucccaugcaaaaggaggucagaggucuuccaguuguguuugguucuagaagcaaacaaaaaagagugacuuaugggagugguagaacauucuugagccguggccuuuuugggagaguuaggccccuugaaaagucgauggaagcuauauucuccuugcaggaaacaaaaggcacacacacuugcacccauuuuugggaguucaugacccucagguaaagaaccccuccucggcagauaaaaagcauuuaaggaaaaacagacgcaaaauaaaaucuucggguagacaagucaguccugccuacaguuauagauaagauggagaaacaaaacugaggacaggaauuccauggaagaaggucacaggguccagauacgagaaaaaaaccucaacgaaccgggaaacuaaaacuauagcuuugaagaaaaaaacaaagcauuaaagcagaguuugggguugaaagaaugcucuccaacaaccaggaaaucgggauuuucaccuuuauuuuuacucaggagaucauuguuacucgaacccaauauugaagagccaaucugaaaagauggcaauuuacuccugagcucuggaaguugcuggaaccugaucucgaagcagugacgaucugugaacgccccagcugcaccaaccaaggugcuaaaccuucagacaggucuauuucuacucggauuuuuucuuugggaucagacugguauuuuaaagcccuuccaaacaaacaaacaaaaaaccagaagcuuaaagcaaaccuaacaugugacuuuggacaccacuucauccagacuacuucccucagacacugacaaccggccagagguggaaucgcgggaaaccuuaaacccagggaagaagugacuuuaaaggaaacaaagcguucgcccccgccgcuugggagaaggggcugggauagagacaaagcccgaggaaaacaccgaacuaaaguuggguuaggagcgggggaggcaugggcaggacccgagagaggcaacuggaacccagagugcgcgagcgcggaggaggugaaggcccuguggacgcagcgccgggagagccucagcgggccgggauaagaggggcgccccucaccucgacuggguagagcucgcgcggcagcaccgccugcagguccaugaacagggugauggggauguggcugaggaaguagaggcccagcagccacuccacgcagcgccugguugccggagcccccauagucugucgguugggccuggacccgcugaugugagaagaggggccaaauccgcgcgccuucccagacccacgcgccucggucgccgccuugcccccgcgagggcuaggcagaccgcuuccauuggcug

SEQ ID NO: 16721 - RNA, 2352 nt, Homo sapiens
ugcuuguuucagcauuuaauaagguagugcauacuucuuucauauggaaggaaaacaucauauuaaguuaauauuuaaacguacacaauuauaauuugcaaaaaaaaaucaagaugauaauuucuuaaauaguaaauugaaauaaaugauauuuuccuagcaugcuugucauucagcaauaauaagaaacugagauaagaaugcaggcaguugaaguucacuucagccugagugcaaguauacacaaaacagcaaaaauauuacauagaaaauaaauguuguccauuggauugaguauggugcuaccauuugucacaguguucauauucauaguuguggcuaucuuuggggucacugcuguauucagacuugucuuggaauuuggagucaucuagggauuugaggucauuuugagauuugggcuugucccaggauuggugcuaccauuugucacaguauucauauucauaguuguggcucuuuggggucacugcucuauucagacuugucuuggaauuuggagucaucuugggacucgaggucauuuugagaucugggcuuaucccaggauugggguucauucugggauuggugcucuuccugggauuaggucuggucccgggauucaggcuugacgcaggauuggauacugccauagaauuugagguuguugauguugaaguuuguccccggaauguuaacaaacaugaagagcaggccaaucggugauagcuugaacaucauccuccucuguuucacaauaauuauauaauuuuaauugaacacuuggaucacaaauaggcaagcauauauccuuaauuguguuuaucaguacauuuguguuauguaaauguuugcuuuuucacuauuagugaacaaauuaaaagcuucccuuucuuuguugucaacaucugcugacacaagaccuauuuucuauugagggcuaccaacugaaggcaaaaacaaucccaagacugaaaaagagcuuaauuggcauuuuucuauuuaaaaaaggaaaaaaauaaaacucuagacauucaaugcaauaaauaugggggcuugagaucaguauagaguaggguaggggcaaagacugagaggcaauuugggacaguagagcaacaaaagaaauaaugaaauaaauauugguauuuucuugauuucucaugaccuuuauuccaacaauuuaagguuuuaguuuaggucacaaauuaggauauuacuucuaaauauuuacccaaagacuaaagagguuaaaccaaagcauuuccccagugcugggaugagguuuucuucauuaacaacaacaacaacaacaauaacaaacuagagaaguucauaguuuuaagauuuagaaaugaacaaaaccaacuccuucauuuugcaaaugggcucagacaaggggcauaacuuaccugagggugcauaucuaaaaaugacccaagcuagaacuuaagucugugacuuaaagcccaaauuuuaacuguagaacucuaacauauauauuaaaaguuacauuuggcucuaauauguaauugagaacauuucaaauuaauguuaccuuuugauauuuuucuuugaagaguaagaauucagucuuucuccagcgucuauggggaaucugauuucucacucacugcaugcuauuuaaauauaauuagugaggaagucauguguucuaaacuugaccugccauuugcucuuuggaaguauccaacugaguguuuccagacaacuacauauaaacagauagacuuuggcagagauuaaagaauucaaauaaaguucuaaaaucugcuugcuaauuuaaagaauccagugaauagcauuuguuauuccucuuaccauguauacauuaaugaauugcuucacuggauugacucuaacuagaugaauuuacuauuuugccugcugugauuauuaugauuuuaaaccaaguaaguguauuaaaggugucugcguuuuccuuagaacaucuguacauauguuuauagggcaguuucuacccaugguuauuuugaaguuuaaaaaauaauucaguaauacaacauuucagguauuuaauuuuugguaaauaaaguaaccuuagaaaagaaguuaaacuucauuaauaugaaacuuaagaaaaggauuacauaugaaagugauacuuuuucauacugaguuuacaaacuuuuguguguuuguguaugguuuuuuaauguauuaaaccagucaccuugaagugcauaaaguaaauuuuuugaaggaauuuugucuuuuggucagccguuuuccaugauaacuagcauauagggaaauuggguuguauucugcuaauguuuucaucauauuggccagcacacuuuaaaa

SEQ ID NO: 16722 - RNA, 3068 nt, Homo sapiens
uuaaauuuuuucauuauguuuuuaacacuuuucuuacaugcaaaaaacacaaccguuaaacuuuucuuauuaaaaugcaaagccuagugucuucuagcuuuuugaagagcuuuuguccauuauauaaucugucaaguagccaagaguuccucagaagcaggacaucauuuagauuuaaaacaauuauggcuugucuguaaaauaauguuguagcauaaccauucaugggauggcagcuacgauuuuacuucaguaaaauauccuuggauacuaccgccauuuuauuuaccuuaaagauuuuaccaagguacccuagaacaaaaauggugaggucauuuugauucugcuaaaguugguaugacuggaaagccaaaugacacaguuaugagcauagaccuuuuauuuuccagauguuugacaguguaaacauacauaaaauacauauuaaaguuuagaugcuuuauauuuugugcaauaaauugaagccuuaaaacauuucauuuuuuuuauaaaagaaacucauuaguuuacuuaauuaagacaguaaaauagcagcaaguaccaagacauugugcauuucuuuuauuuaagacaaguuacuucauuuacaucagaguuagaaauguuaagacuggcuuucuugaauacuuaaauauagcucgaaucacugguuagauauggacauauuuucccaacuguacaucagggaggagugcuuucauuaguuucagaaaaugcagacccucagacagccagcaugaccacaacauugagcaauaagagaaaugaagcauuuacuuuccaagcauuugccacagaagguaauggagucuuuacauuugugguugucucuucccuccauaaguuaaggguugugcuuuguugaggcauuucagagaaauuauuuggcaugccacuagugauacuuagggucauggguguuggggaugauuuuguugagcuagugaggcuuguguuugugaccauuccaucuuggagaugaauaguuagaguugcagcugcugcuucaugugaauugauagucucuguggauguaucuucuggauagggcacaaaagccuuaucagugcuaguaaagguggugucuuugcuuagaguggcaccaaacguuguuuccuuuguucgauauuguuuggguauuuuggucacuuuggguugaguuaccacacucagagaguuaaugguguccacugucugcaucccacuuacagugaauaagcuugagguaaauccagaaggugugggauacauguuauguuccuuuaaagaugauauuuggguagaacauggagucccuaucacaugggcuuuuguuuccaucauccacuucaguaaguaaguaauguuuuguuuguggucacaugaccaccuguuauuguaaaggguuaucucuugcaacugaaagaguuggucaaaagauuggucuggaaugaaugugaacuuauuguugugcagguaaagaugugugagauuugucagguuuauuaauguaccuggaagaauuugugucaaagaauuauuagacagguccacgauauguaguuuggagggcauguugguuggaacuguccaaaguuuguuacuacugagguugagaaccucgagacuucuuaguguauuuuuaaugaggacaaccuuuuccagcauguucuuagaaacauccagauauuuaagauuccacugauaagcaguaucagauuugucaagaaguuuaauguuguuguuagcagcagacauguuccacagagaccgagguaagugagcaggcaggcuuucaagccuguuguuugaaauguccaggguccucagauugguauauuggguuaacugguuaugcagaucaguaaagugguuauaagacagguuuaaauguauaauauucucuugcaguccagaugguaauguagacaaguuucugccugaacaguccacaugccugugccucucugugcauauacauuggagaggacaaaugcauaaaauaccaggugugagaaacagaaggaugaacaggcagagagacauuuucaauaucugauauuccaucaaagccuagaaacaaacagauacacccuucuuuuaauaugcaaauacaguuuaggcaucugcaugggucaguuagcauuaggcaaaauuuucaauaaaccucguuguugucgaguccuuuuauaauuguuccagugauuaaacuaacaaagcuccccuucauuuauaguccaaaugcuuaauccuucaauugggcuaugugguagagagagacucucucccuacucucuccugcauuuucuccuuuauuuucucucucccuccccccuuuucuaaccauauucuuucuuauuuaucuuucuagagccuuaauaugauaaaauagcauucuuugcaaauaaauaguugcaguuguaggcuauuacuauuuuugaugauaugcuuucuuacucagaugagaaaaaauggcugucgugucuuuuuuuuuuaaucucugcaguaauguaauucaauguguguauauaggguagauuuuauuuagauauuaaagcaguucuucgaaauuuuaucuguauguuuuuaggauaaauauaucuuuguaaaaagcacuugaaaaauccagaccaacacaguaccuauaaaccucacauuuuauaaagugauuuuuuucuguauauuucagugcccauuuuaaaggaaaacaauauguauauuuacagagugacugaauguauaaaaaauaucccucaacugacacugcagcaaauuucuggugcaugcacuugcuauugaauauauauuuaauccuaacguugacuuuuucuuaaaagaaaaaggaaaaagauuccaaagucagccuuuuacugauuuaaauaacaucuuaccguggugucgucuucaacaucagcaucucauuuucucugggaaacuuaaaggucgucuuguucuguagagucggaacuguuucuggcugugggcugugcuugccugcucagcugcauuguguugcugugagcugaagcucugcaaccaccugaucaguaccacauaggaggacugca

SEQ ID NO: 16723 - RNA, 146567 nt, Homo sapiens
ccccuccccucccuuccccuccggagcggcuggggcugcggcgccgcugcugacacggaucggccgcggccgccaccgggcggaggcugcgcggcgcagacccagacgggcggccccggagggcgcgcggcgauggcggcggcgggcaggcggcgggcgcggcgggcgagggguccgggcugagcugcgggccggcccggauggcgggcggcgcgggcuggucgggcgcccccgcggcucugcugcgcuccgugcgccgccugcgcgagguguucgaggugugcggccgcgaccccgacggcuuccugcgcguggagcgcgucgcggcgcucggacugcgcuucggccagggcgaggagguaagcuggcccgaccccagucccggcccggggaccccagcccagccccgccgccccucccccagcucccccgccgggucacccgcguggcccgaggcgguggccucccucccaauccccucccuccgccggagcccaggaccucggccccccccggguaucccuggcccagccgggcccucgcuuuccgccccccggcgcccgugccccgagcgucacgcgucacgccuaggguggcuucugcgcccaccuuccuuccucggccaugcagguccuucugagcggucugcacauccacccuugucugggggagagagcugccagaauccggcccuaggcuccccaccccacccggcgcugcggagaccaagaugcaagggucuguguacguccugcugggccgggccagggggugaaagggaccgguaggggugcucugcagccuuggcuccucggcugcacacacccugcccagacacggaaggaggugucugcuggggccaccguguacucccgggccagugucgggugaccucucauucaggcucugcugggcagccaggcuggcagcuggcuguguugguugcagcaggccaggcaaagccaggcucggggagugguggcugagcagagggcuuucauguggcggggccgcaucuauuuggggaaagcaggacuuacguagauuguuaacagggcuggaagcggagggucggugccgccaguaggguggacggagucauaucacuaaacgcacacuacaccaguguccucuggugccaccggcauggggacuggggacugugucucaaggggaggacaagacacccaccuggcugaaauggucagggguuuccccuggagccaaaagcccugagaaguggguuuccaaggccaucuaaggccucaggcccugcauggggggccuggggccaugggccucaaaugggcacuggcuggcauuguguucccagaacaggucggaccaggcauuucagaacaugggagaagcugggugauggccagguugggcccgugccucugcgucaccagagagugggaggcgauugagaaucaucucuccacccgcaccugggcaugggccgggacuugugagucgcugagagcugugggcagaagagagugaggcagcuucagggcuugagaacucagguacccaccacaggaaagaccacugcagugccugugagagcccagacugcccucugcggggcuuugcugagggacacugccugcugccaccaugacccuucuuccccaaaggccagccaagcccuuccguuuuuccaguggcucccaucuggggcaggcugagcagacuccuggcauggggauagucgcgcuccuuccucucagaacacagacugcaggucggguaaagaagcuaccagcucuggcugaaaccuggaguccccgaacucagagccucaguagugggaagggccucccaacaaccucuggcaggggccaccggccucagccacgugcccagcaagccucacccacuucucccccagcuggacaguuccugccauuagaaccuucucccucauacacucuagagacagaccugcuugucacuuagucaucaccguucugcacggggacucacauaggucucucuucuuugggggagccuuuaaauauuugaaaauagcacuccugccccuucucuccuucccagcuccauacucccauuuucccuucuccaggccaaauaccccaguuccugaagcccuaggccauuuccaugugacccaguagccagaccucuggcuucuggccuuggagcugccaucgacuaauucugugauucaguuuuccuagcaauaacaugaaagggcuggacaagcagaccgccccccgccgcccccaccaggacuauauuagccccaagaccucacacauaugcacacagcuuaggguggggcugccucugaauggggcacugcacucugcuuauauuaaguuucuggccaccgaaaccuccagggaucuguuuuagaaaccucugccaagccagggauucuccacccuucggggagggucagugauuuuuuucuuuuaaaagcauacucugagauuacuacagaagcgguggauaugcauugcagaaaacuggaaauagggacaagcaaaauaaaaaguauuguguccuaucucucaggcagcgccucaaugacacuucugucagaccuuuccagagcuguuuccaugcuuauaugucaauuuucuccagaaaaugagaucauacugugcauacuguuuuguaaccugauuuuuuuugccgguaaaugaucaugacuuuucugcuucaauaaauuuucaucugguuuaauaugcagaccuuuuucagauuucccuauuugaccccaaaauguccauuuuugcuguuuccucuccaggacugugcaguguaugugguuguugucaccuuuuagucucucuuacuguacacaauuccuuuuucuuuucuuuucuuuucuuuuuucuuuuaacaauccuggcuuguggaagcauucgggccuguugucugucaguaauuucuggaaucuaagccuguuucuuggcccuuauucccauuuaauuucgucuuguucauuucaucacauuguaucugucaagaaagagaaucuagcauccuaccucuaucacucucagcugugcugcugccugcgggcuggagaagcagugcuuggugugucugaauccacaaggcugguuaaacauugcagggcaggaccauggacagggccccgaggcacuuguaggggugguuuucggcuuaugcuguauugaccgagacccguggaaauauauuuugcaucucuacucacuacccaucuuauccccugaugcauuaaaaaaucggaguguuguuuuccagcggugggguggcggggggcggggggggggggcucccuuacgaaaugcaguguacucugacuguuucuauuuuauuuguuuuaaaaucaggcagugacauugauuucccagccacuugugcucugggauggauaaugaucauucauuagauauguaguucagugaacuuagagcugauuguccacaguuuaccaccuacccccagaauaccagggauaccaggaucaaaugcuuugcaaaaaccaaaauauacuaggucauaaaguaugaaauaaauauccaugaggccauaaugaaauauauauauguauaaauuauugaacagaugauaauaaauaaauaggaaaaucucucguauagaagaaaucugaauaacguauguugauaauugccccauugaggaagugaagcauaacgucccaccguguaagcaugagaugugcguaguggcuuccuuauaaaggguagaguuuggaaaguggggggaacagcaacuguauaguggagaaacccaacaaacacugucucagaaggugaucaaggacaacaucgauagugacagauugugaugauggcauacacccuuggugugauguggugagaauagaacuuuuccucuguggucuuccucccaaaccaguaaucccagucuaguccugagaaaaaugccagacaaaucccauccgagaggcauucuacaaaaugccugauuaggaccucucaaaauugucaaggucauccaaaacaaggaaauuuugagacacugucagagccaaguggagacuaaggaggcagcugacuaaaugcagugugguguccuggaugggacccuagaaucaagaagaggacauuagguaaaaacuaaggaagucaggaucaaguaugaauguuacuuaauaauguuauuuauggauuagguuagucccugauaguucccuacuuuguugaccuagguaucacagcagaaaagaggagacaaugggccgggcgugguggcucaugccgguaauccuaacacuuugggaggcugaggugggaggaucacuggagcucaggaguuccacaccagccuggguaacauggugagaccccccaucucuacaaaaaauacaaaaauuagcccgguguaguggcgugcaccuguaaucccagcuaguugggagacugaggcaggagaaucgcuucaaccugggaggcggagguugcagugagcugagauuacaucgcugcacucuagccugggugacagagugagacccugccacaaaaaaaaaaaaaagaaaagaaaagaaaagaaaagaaagaaaugcagauuuuugagggaugggggcacaccacugcccugauccugaaagucuacaaugccagggagcaggacucugauaaguauguaacaugauggcucaacauccugacccuguguugccuucugauauauugcauugucucccuaaccucuuuaggccucuauuuacucauccaucaaauggggcugaucagaguccccauucuauaggguuauugugggguuugagugaguuaauacauacaaagggcuuaguccaguaucugcacagaguaggcauaauaucagaauugcuggugcucuccuugucauuauuauuauuuucuaaacacuugcaagcauuuuugagaggcuguucuaggcuggagauuugcuaggaauugaggucaagaucuggcaccggccucugugugcucaacucacccuccuuaaccagcugugguguuccugccccucuuacguccccucggcagucagaaugguagacauugaaagcagccagagauguccuggaccacacuucccugugacaugguccucuucccuuuccaguuugaagaccguccuucuugcuagaaaaauagaaauaagaaucaccaaguaggccucucccaugcauuaacacagcaccaucuccucuggacagugggccuguccugccugcuuggaaaugaaaugaugguccccacugggcucccugaguccucagguccccucugagcuaaugccugcuaugggggaauugcuagugccacuuggguuaagccugggucuuugaaauggcaaagggguuggggugcuaggaugggcugagaccggccaggagccagcccuggggcugggaucgaugucuuuugagauacguggcuuccaggaacaggagcaccuggaacuaaagcuccucugcucaggaguagcaauuggauaacagggaagaaacaacuguauccccacagcuguggcuggaggaaggggugaaggggaagguagggccagaucagugguucccuguaggcagugagaccuaggcagccaagaguggauguguaugagagaacaggggauggggagcaggauuggaggcaggaggccuccucgggacuguggcacaugguaagagaggaagagcauccuaacuugggcaguggcggggggugcagaauugacaggggccuggaaggccggcaaagucccaacgagcuacucccaaaaggugauaguuaaaggugcucuuuugagaccaggcaaccucuaugugccccacccuaaugaggcuaccaugcagagugacaaggcuggcacaucagaaggaaggcccaggugcccugagccuggcagaaaaggugggagugccugggaccugagguggaagcaggacaagagugagcccagagagauguucucuuuccuaugcuucugggaaacugugcuccugagguuggaggucaucauggaaguggggccagggcuggggaucccuuggggccuggggaugggcauguggcaccacacucugcauugaggcgggaggacgaguccuagcuggggcacccucuggccucuugugcccaccaguuuggcugugcugggaggaggccagaugcagaaagucugcugggacucauccaucuuaucagacacgccccugccuuuuuuuuuuuuuuuaauugaaacaggcucucgcuuuguagcucaggcuggaguucaggggugcaucauggcucacugcagccucgagcucuugggcucaaaccguccuccugccccagccucccaaguagcuggcacugcaaguauaugccaccaugcucagcuaauuuuuugucagacacuuuuuuuuuuugagacggagucucacucugucacccaggcuggagugcaguggcucguugcaaccuccaacuccgggguucaagcgauucucucaccucagccucccgaguagcugggauuacagccaugugccaccacgcccagcuaauuuuuuguauuuuuaguagagacaggguuuugccauguuggccaggcuggucuuuuaacuccugaccucuggugauccacugccugagccucccaaggugcugggauuacaggcgugagccaccacagcuggccugucagacacucuugacgaagccugaauccauuuggcaaaaccuugcugaguuccagcgucauucccaagacacuggaguucuagagaaggaggaaaugccagcguugagagaccgugccaugggggguggggggugugaucccugccuccauuggugagaccugaaugggggacauauagaccugaguagggggaagaaucagcccuucccaucagcaagacgugcccuccgagggauaucaguggguagagaaccuugaaccauccacaagcuucccuuaugggcguccagcccaugaagugugacguucccccuuguacaggugggucacgaggcuggacaggcagcguggcuuucagaccuggcccuggcucugaggcuuaggagccuucccuagcaccgggaagaaaaccaaagaggaaaagaagaagaaaggaccggacagagggaggagaggcugggccaggagauuccugugugcugccugggcuggugggcggggaguagggagcccaggaaccugggaacgggggcgauggcuacaaagccaccccuuuuuccuucagcagggccuccacugccugagaaguucggcacugggcaacacugccuuggagggcagugcauugcuagggugggcagcaggcuccuggacaauggugccccggccugggcaaccuucggccggcaggaauagggguguucacagguccacauggaggagggguucugccucagcccuggaguguagggcggagggcuccuucccuuccuguugcagcaccccuuuggcccacugagcagucauccccaccccagcccugagcagugccaccaggaacagugcagaaggggaaccugacagcuggcugagauagacucuuagagcugagucacaccaaccugggcgggauggaggggaaaugcccgcuggccuggaaauggcauauggcuugcccaagucacugcuguccuccuagccccaaguuauuggguaaaugcgcugaaauuuuuauagaguugauuuuauggaaguaucccuuacauuuacccuuaacacggguccagauuuaaaaauuuuuuauucuaggccaggugugguggcucaacccugucaucccagcacuuugggaggccgaggcgggcagauugcuugaggucaggaguucgagaccagccuggccaacauggugaaacccugucucuacuaaaaauacaaaaauuagccgggcgugguggcaugcgccuguagucccagcuacuugggaggcugagauaggagaauugcuuaaacccgggaggcggagguugcagugagcugagauugcaccacugcacuccagccuggaugacagagcgagacucagucucaaaaaauaaaaauaaauacauaaauacaaauaaaaaauuuuuauuccuaggcccagcgcaguggcucaagccuguaauccuagcacuuugggaggcugaggcaggcggaucaccugaggucaggaguucaagaccacccuggccaacauggugaaacuugucucuauuaaaaauacaagaauuagccgggcgugaugaugcacgccuguuaucucagcuacucgggaggcugaggcaggagaaucgcuuaaacccaggaggaggagguugcagugagccgagauugcgccacugcacuccagccuaggcgacagagugagauuccaucucaaaaaaaaaaaaaagccauuuuauuccauuaacaucuuggguaccuacugugugccaacccugcccugggcacugggaaauaggaaacaacagggaccugggcucgcauucugauaggggucgcagaaaagaggcaaaggaauagaaacaacugucaggugcggguaaguggcagaaagaaacauuagugccgaaacaaaagccaguguacuuagaacaaugucauagauggcuauugagguggagcccagaaugaaaugggggcugcaccuugcauaugucuuggaaacgugguccaggcagaggcaggagccugcccaggggcuuagaggcacagugagcccgaagacaaggguggggccaguuccuguggccuucccugcaggggcuuuggcuuucuuggaaugagauggaagcccccaaaggguucugagcggaggagauacaggaucagacuuagguuuaauggggaccacccuggcugcuguguggcuccucggagaggcagaaggggccggggagaggcagggagaccagcaccaaggcuaguucuucacccaggugaugggcgcugggggccaggagcagaggagaagccguggagcaguggcuggaucuugaaaauggagccgauuggcagugggagugagcaagaggagacuuuggagacaagcugccguugcuggguggggaggcagagaggaagagggcugggugaggacucgggagcuccacguuggccugugagaccugagugcagcuguggagccaguggcgauggacaggucuggggaccacgcuucagcccccaccgccuggcacauccugggcucuuucucccuuuccuucuacccuggcccuggggucucaucucauugcccacaacaaaggaguuuacagaagcugaccuagguguggucuggcccccuuuaaaagugaggcuuggccgggagcgguggcucaugccuguaaucccagcacucugggaggccaaggcaggcagaucacgaggucaggagacccagcccauccuggcuaacacggugaaaccccgucucuacuaaagauacaaaaacaaaauuagcugggcaugguggugggcgacuguagucccaguuacucgggaggcugaggugggagaauggcaugaacccgggagguggagcuugcagugagccaagaucacgccacugcacuccagccugggcgacacagcgagacucugucuaauuaaaaaaaaaaaaaaaugccaggcuugccccagcaucuucagauucuuggagacucccccaggggccauagcuuagggucaccaauucccugcaaccugucaccccugaggucacugcugaggacccauuguccauagcuucugugcccuugagggcaggaugagcagagcagcccagaauccuuauagguuucuauaacaacccaugacccaagacggggagcaggcuccauacagcuguagcccagauuccagcuguaaggaccucuggcuucccuggagaccaaggccuugaguccaacacacacugcaguugcuguggcucagggcuuacaggcgcaaaacccggagaagauugccagcuuccuccaaaguguuugcugaugacacaugggccugcagugggcacuguccccaggaagaucccagucuaaggcuagcaccuggacaggauagacagaggauugauuugaaccaaaacaaaaaccagaaggggaguagaggucauucaaugagacucccauucagugccugcaucacucaguagccaagagacagggacgcgcugccucccaaggcaagcccauucucaccuggcagggcucuggcugaguucuuguucauauaacgagcugaaaucuaucuccuagaguuccaucugcucacacuuccuccacccauucauccaaccaucugccugccgguucaccuaagcauccacuuacccauccaucuacccauccaucaucccuuccauccauauauacccaaccauguaccuccugauccauccguccagugaaccgcccauccaacaguccauccacccauccauucauuagccacgcaccccuuaguccacccaucuguuuauccacccuucugcccacuuccguagccuccccaucuguccaugcauccauccauccauccauccauccauccauccauccauccacccaccaucuaccacuuccugaguaucagucaugcaaaaguccuaagcacagacccagggauggggacugguauuuucagggagugacaagugucuccauguggugaaaggacagggagggcagggagacugagaacucaggcuggaacagggaccagauggugacuuucgggagggcucaggagcugggagggucugaguagcucagaugaguuuuggaugagcagcaacaccucagugcagugauuccugcccucuauggaaucaacucuuuuuuaugauuucucacuucccacacaggccauugggucuggcaagagcugggaccuugcugaaaaaugugaaggcucagauuauuuuauuuauuuuuauuuauuuauuuauuuauuuauuuauuuauuuauuuuugagacagagucuugcuuugucgcccaggcuggcgugcaguggcgcaaucuugacucacugcaagcucugccucccagguucacgccauucuccugccucagccucccaaguagcugggacuacaggcgcccaccaucacuccuggcuaauuuuuuuuuuguauuuuuaguagagacgggguuucaccguguuagccaggauggucucgaucuccugaccuugugauccacccgccuuggccucccaaagugcugggauuacaggcgugagccaccgcgccuggccagauuauuuuuaaaggugcuuauuaugauagguggaccucaguuuccuuaucuguaaaauagaggucauaccccuauuuguggcacuguugugaugguuggagauugaauauauagagauauaugaguaugacugagcaugguggcuauugcaucauuucuucaccgccccgcccccccgcccagccaugacccacauggguacugcgcugcccucaguccuaggacugcaccucugaccccuuucucugcccaguacaccccaggcauggggcucccuugugcaaugaccaaagucuucugcagccacuggugauuuuccauggacagagaggauauggagacccaaggacuccaggacccaccaaaacuugcuggcugccuuuguauuucuuucuuucuuucuuuuuuuuuuuugagauggagucucgcucugucacccaggcuggagugcaguggcgcaaucucggcucacugcaaccucugccucccagguuccagcaauucuccugccucagccucccaaguagcugggacuacaggagugcaccaccacacccagcuaauuuuuuguauuuuuaguagaaacgggguuucaccauguuggccaggaugaucucgaucuccugaccuugugauccacccaucuuggccucccaaaguccugggguuacaggcaugagccaccgcgcccggcccugccuuuguauuucuuaaucccuuucgucaucacggcaaccaggagccuccaugaggugaagugacuuguccagggucuugaguaacugguggagcugggauuagaacccaggucugucagguucuaaagcugccuuuuuagcuuccugcugugggggucucauguucuuagaaggucagaggagggagagagugaccugaucugaguuccagaaaucuaacauuggagaaaucugaaauuugagacuuccucuggcuggggacuuugagccugguguggucucgguugggaaaugcgcagaucagaaguaggucugggcucugcaggaugggcggccaggggcccucucaugggcacugcaucccagcacugggcagggagggaggcugccagcgaacugugcccagaauuaugcaucugcgccacuuccuguucaaauggugauuccauggccccaggaggugcgcauuucucugacugcuccgauuuccugccaggcacucauagguaauccucugcaggcccaggcuguguggggcugagucuucuuugucuccaguuggccgccccgccagcccguggaccacacacuccuguuccugcauccuccucggccugcacugcagauccuccccagucagaggcccugcagccccagccggccuuggccccauccugcucuccgccccguccccacuuccacuuuucuacugcaccucagaucaggccaggccaucucucagguucucucccugcccuggggaagugacugggagcugggcccuagugucagacacaucugguuugagacccagcucugcaacuuacuugcugcgugacucugagaaguuacuuaaccucuuuaugccucagucuccucaucuguauaguggggauaauauuagcaaugcauguuaaacccucaaaacgacacgugacauagugucacauauguuuguuaaaaugaccguuaccaccaccucuagguuuucugagucagcugucugauccacucuuuuacagauuuuuugaggucagauucugugucauguuuggggccagaggguauacagaugaguaagauaggauuccuucccugcggugggggcgggggacugacauggaaaccagaccugcgggaagggugcgggcuugugcagguguggcugaggcaugaagauaggagagucacucugccugggagaugagaaagccuuucuggagugggacuucagaaauggauggcggggcugaguuuggaacagggucugccaggguggagggaaggacagguaugccaaaggugagaccuaccugugcagaggcccaccugcagggguggaggggcugaccaggcaggcuggaggcaggagguggcagggcuugauuuuaucccaaagguuucgggauaaaauguugaagagguuuaagcagagggccacacagcucuauugccuuuagacaaacccaccuagaaguagcguggguuggggagaaggggcugaggugggaggcuucugucccaguucaggggcaaggagaggggacccugaggauggagagaaggggagggucagagggaggcucccaggcggucuggaggcguucacauggguccuccaugauucccaccuccaugacugggugcuggagcccugagcccagcgcagguggcacucauaggccugccaagcucacgcagccucagggccugcccuugcucucaggaaucauuugaagggcagcugaucuuuuuuuuuuuuugagacggagucucgcucugucgcccaggcuggagugcaguggcgugaucucggcucacugcagccuccaccucccugguucaagcgauucuccugccucugccucccaaguagcugggacuacaggcauuugcgcugccacacccagcuaauuuuuuguauuuuuaguagagacgggguuucacuguguuggcaaggcuggucuggaacuccugaccucaggcgauccgcccuccuaggccucccaaagugcuaccgcacccagccugcucuuuauuuuaaaagcaaaaaaauuaucaaauauuguucuugauauagaaauuuaaauuacuuuauacuuaguuuuucuuaguuuucuuuauacuuaguuuuacuuuuauaguaggaaaaagaaagcuaacuagcacugaauugaauuucuguaccuuaaaacccacaucugguuaugauugccuggugugagcuaucgugacccuuuuucaccucgagguguuuacugugccugaaucuguucuagagaugguggugucuccucccucucccaccccugccucaucccaggcaccgacuggcccucacaccagucacuauuagugucugcacuaauagugcagacacucugcucugcccagcccagcucacugagcccagcccaccuggcagggcaccugggccagcuggucaaccccugggcucagcuccugcucuggugcaagcaggguggggcccagggauacuuugcuccccagaugaugcccuccagagggcggaagggggguugucuggagccaggcucacugcagaaagccuggaggaggaguccuggguacccugagcugagcugcaccucccucaguaccacugacugucccuugggcucugcucccagcgcaggcgcucagcugccagccagaggaguggccucuggugugggcaucucacaaccccugacccccaggaggcacguccuagacacuguguggguggaauccagggccugucugcucauuugucuggccagaggcacuggcuuugggcuucuggucaccuuuucuaaaaauggucgugucuccuccuucugucuccccugccucaaagcaagccuugcuccaggcacgagggugcuguuucugcacgaccccaucagcacuauuauuuuaauguauuuguuucugccaguuugauagguguguaaugguauuucacaucuuguuuacacuugcauuuuuaauugcucaugagacuuugcauuuuuuccauguugcuauuuacucuugguauuucuuucugcauaaacuguccuaucgaucuuuuuucagcauuuaucaaggggaauuuuuguuuugcccuuuauuuuaaagucaguucuauauauuucagcacuguuugucaugccauuuuuucuugcucuguugcuuuccucuuucucucuguuaaucauaucuuauugcucaaaaguuuuccugugugugaauauguuuucuuucaauuauaucacaucugcuuuguuucugauuauaucuaucacuucuuuaguaguuagacacuuauuuuccaucucuaacaagaauaaauaagccauuuuguuuauaacccccaguuaacucaccaacuguuuaguguuuugacacauuuguuuuuuuguuucacuugauuuuuuuuuuuuuuuuuuuuuuuuuuuuugagacaaggcuucgcucagucacccagacuggaguacaguggugugaucuuggcucacugcagccucaacuuccugggcucaagcgauccucagccucuugaauagcugggacuaacaggugugugccaccacguccugcuaauuuauuuuuauuuuuuguagaaaugggggucucacuauguuacucaagcuugucuugaacuccugggaucaagcaauccuccugccucagccucccaaagugcugggauuacaggcaugagccaucguggcuggcuuucacccuaccucuuaucugucugucuuaucuauccaucuaucaucuaacuccauuucuguuguuuuguuuugcuugaaccauuuucaguagaugaaagacaucuugaccuuucucccauaaauacuugacaguuuccugcccaaaugcagugccaugaucacccagggauuucacauuaauucagcgaugucaucuaagauucagcucauaaucagauuucccuaguugucauaacauugauguuucugaggaguccaggccaguuguccuauagacugucccaucaccuggaugugucuguuuccucgagguuagauacacaguaagcguuuuuggcagggacagguggugguguguccucagagcaucucaugaggggccacaugauguucauuuguucuauuuuggggaugcugaguucaaucacuugauuaagguggugucuaccucaucuauucaacauaaugguacuuuuccccuuauaauuaauagguaaucugugggaccauaccuugggacaguguaaacauuugguuuacauaauaguuuuagcauccacugaugccccuugccugaguaaauuacacuggugguugccaaauggugauuuuuuucuaauucucucauucuuuccacagauagagcauuguucuguuaaaaaaaaaaauucuuuccuuccaccccccuuuucugaguaucacuaugaacuuguggcuccuuaccuccccagccugucauaccuuguuaccuucauucuuuuuaaugcucaacaguuuuuuguuuuguuuuuaaugcaacauuauaacauuuugagcauuaugacuuggaauaauguauuuuuaauugaaacaagccaaucauuauuaccuuuuaaaaauccuucugauagucuucauuauuuauggauuuugaagaauguaacacauuuuucagggucuguaacggguauugcauucagucuauuagauuagagagugcugccaucuuuacauacuauauuuaguccucccaauaggagcaaaauauuaacauuaaaaauagguguuuuacaauuggacuaaauaaauguuuaauauuuaauguguuuuauuacugcugagaauuaaguacuuuuuuuccauugauuuuuuuccuagcugcaugucacuagcauauaggaauauaauugauuuuuuguaaauguuuucucuaaucucaccacugguaugaauucauuuaucauuucuaguaguuuucugguugaugacuuugcauuuccuagguaagccaugccauccaguucaaaagucauuguuuugugucuucuuuugaguucaauuacuuuuucuucugagaugggagccgccagcauuucuagagcuaagcggggugggcacaggagacaucgccccaacugacaugugcuggaacauuggccacaggcccagcugugagucaaggagaacagcuggggcaggggcaguggucuuaacagacagggucccaaaggaaguggugaauccugaagaggucgaggcugguguuggcacaagagguggccuaauagagagggaagggggccagcaagaggccaucaggccuccugcuaugguucaggggaggacuccagccucauggcagaaaaaccaagucccaggcagcagagcagggaugauggaccagaugaaacaugcacacagacggccgcagaguugauccgggcagccagaugcagcuagcugggcugaggcuguucccuggcccguguguggucuuggauggugguggagccaguagggauaaggguugguaagggaugguggaggcaggaccccaucauccuuuccuuauaauuuuuuacaguggagagacaguagcuuccuaccauuaaguaccuugucaguacuuagguuuaggucaauauucuuuugcauauuaauaaagaccacccccucuccgcuccguucuccuuuuguuagagucuuauucaagaccagaugguaaauuguaucaaaugucuucccagcaucuauuaaauguuucaacgaugcuugcuauuuucccaguugauguaaagaauuaugcuuggaauggaugagucuccacuuggccaggccuggucaggugcccauccucagcggcaguccacccaaaucacagagaauggggaggagcagcuccccagaggaaaaucagggugcacuuaccaggugaggggcauugcaacguuggguagaaagaaacuccagauguguaggaaaacuuagccuuuuagcccaagcucucuugguucccacccugcacucaaggagcagggaggagcauuuauuucugugauucuccuggcaugaggacagaugcuggguuucugcagcccucugccuccaacacaggguguuguacugguacacaguacuggguuuauaguguguaacaggggcacaguguuacuuaaccgacugggugaguaaacaaauagagugcaaggggaccagcccggaacccaggagccccagcuccuccugagcccugcccccaaaaucuugugauuuggaagcaaguuccucucugcuucuugaggcugcuagaugguuugggaggcaggagggcuuugugaucaaggacucagugucugaacgggucagaggucaacucccagauuuccagcuugccggcucuaugaccugggaugggccucuguacuuccuggugccucaccugcgaaauugggaugcgauacuguuccccugagaggguucucaugaugcuaaugaaagaaggagggugaagcacuuagcacagcccuugugcauccuaagcccuuuaccgagaggaguuauuagggugcacucugugucuuuggggauauuuagaagaggaaguucugcgcugguuauagauuauuuggggcucuuguggggauagggauaaguauccaaguccauaagucacugggauugugcgcuugcugcugccaccacguggucccaggaugaugaggaugaugaugaugaugaaggagaaacauaccugcaccugcggcugcagauacagggguaaauugaaaaggugguauugcauaguagaaaauagugcaaguugggcugggugugguggcucacgucuguaaucccagcacuuugggaggcugaggugggcggaucacuugaggcuaggaguuggagaccauccuggccaacauggugaaacccugucucuacuaaaaauacagaaauuggccaggcaugguggugcgcaccuguagucccagcacugcaccgagggggcugaagggggcgggggcauggugucacacccuuggaggggcugggacugcugugggcugagucugccugggaaggggugauggcacagcccuucuguuuccacuguugcugcugggaauauucccacugccaccaccuaaccaccuuucugccagccucagagggcaugugccagcuccaagaccagggcccugguugaagaccagcuccugccacucccugcugggugagguccaccagccgcccaaucuggauuccccucucagggucucaucaucagaaucuccaggggaggcccuggaaaaugcagcuuccagggucccacccuggugaacaggcucugcagaucuguguugagaugacaggaugagaaucccucccaucuuuccacccuggauggcacacgguuuaauggaggaugcguaggcccuggaucagaaugccaggcucaaaccucacuuuccaggccgggcgcgguggcucacgccuguaaucccagcgcuuugggaggccgaggcggguggauuccaaggucaacagaucgagaccauccuggcuaacauggugaaaccccgucucuacuaaaaauacaaaaaaauuagccaggcgugauggcgggcgccuguagucccagcuacucuggaggcugaggcaggagaauagcgugaaccugggaggcagagguugcagugagccaagaucgcaccacuucacuccagccugggcgacagagugcgauuccaucucaaaaacaaacaaacaaacaaacaaacaaaacaaccucgcuuuccucucuucuagcccagagaucccagcuaagucccugacucucuggagcuuugguuuucugguuuauuaagugaggccaguaacuucccuccaagggcucgcaugaggauaaaccaggggaaggguguguaggugccacacgccugaguccuuucugauacccaggacucuguuacacugguccuccaccccaggccucugagcuacuuucuuuugggaaagagguuuaaauuauaaauaagggccucaaucauggaugaggccucuugccuccugccgugcuugcuggaaaagaacuuugccucugcaaagagcgucuacaaaaugaguagacucaagaccuccccuguggcccuuggcccugccauacgggcccugaggaauuugcugagcugccugggggugccucccaugaggacagcuacucagacugcagggcguccuuccgaggagaaggugcaguugcagcagagaggaagcgagggcuagaaagccugagacauagacagccccucuggccaucguccuugccucagucggggcucugggagggccgcagccaggcuggguaggaccgagcaucucaugaggggccgugugagguucacuuguucuguuuggggaugcugaguucaaucaccuggggagcagcuugguccugggaggacccaccagaauuucuccuccccaagugagugcaucagugcuggcagcugaacccacgagcugcaggcagggguguggagcaagugaaccuagacaguucauccucuaggggugacugcgcacaccaccacccuccucucacacagaugccgguuuugccauggaaauggcccauuuaauguccugugcaagggagaaaagcucuagauccccagagcaggggucccacccguguccagcaaacagagggaggaaaggguauucugauccagcaguuggucaagcaauguggaaauggagcccgcucccccuucacuuuaguccaggaaagccuccggguaaaaaugcugacuccagccuaaccugucucaaacuuacggauuucagaaaccuuucuacauguaacacauugacacucucuaagaaaugccauccuggugaucuugggugaaggacucaaccucucugggucccacuugcuucaucagugaaacuggaaccuuaauccccauccugcccugucccaucacagggaccacggauaggaaggggcggggccaccuuaaucucugcugcccacagagccugggagcuccucuuguccccagccccuggcuagaccuggcccaggaaauguacgugaacaccagugagucccagggagcaggcagacaccaggcgcagauagguuucagguccucugccagggcuacaggcugcaccuccccugggauccaagugggguuuccgugguggagagauugaccagugggcagugaggugaggagcaguaccugccccauuucacaggcaaaaaaacugaggcucagagaggucggggucugccagggccucaugguacguuugaaauuccauuaugggauucccagaacaagucgcccuucucacuugccaucuuguguuguacugacagcaacaguggaauuucugccuggagccacuguauuuugcuuuguuucuguagcuaaaccucaauuuacugaaaggccaugagguguccugguuaacucauuuucuggggaauggagggaggacuggcgggagcuuuucaguuugagucuaguugaagugucagagcuggggagcucggcauguuucggauggggcgggauagauggguuagaggaggcaggguccagggaccacagcucagaguggcccaacuccugcaggccagcaccccccuuugaugagcagacauucccauguaaccuuaaauaaugggucuaaagccaaccaaagcccacagcgagcagcgccuuucaaacuaugcugagagccagagaugucaacagagggccucacacggagggcacggagggagcuguccuuccauaggccccccgagaagagagugucuucccucuucccccgcccccauauuuagccucccccugcccuccagccacugagaacagcuggugguuccucagacccuucgagcaccucuacggccuggccuuggcuacccucucccuccucccucccuuuugcucacaccaacgccccgcuucuugaauucccauuccccacaccugcugugucaguucuuccaccugcaguccagcauaacccccuccuccuccaaggcccuuccacaucucccaagcccucugggcugucugucuccucugggccccaaaacugcaaggauuugggguaacaccuucgaggggguuacauugugauggauucugucuuaucuuccccuacagugcuaucagcaguuuuucaaaagagucauaagaguuucauugaguuuuuuuccccgaaguuuaaaaaugauccaguucauauuuuaaauucagccaguuaaaaauugcuggaagaagaggugcaacgacuggcugucccagcucaugagguucacggguguccgcagcuuccugaccagcguccaggcaugcucugccuaugaaagccucauuuaucccgagccugcucugugucagcugccaggcugucuugauaugccauccccucucaguccuaacacaugaugaggcaaugauguugcucagggagguugagucauccaccacuggucacacagcugggaaauggaggaggugggauuccagcucagcaaugucugccuccagaggcugggagccacgcuacccugccucugggcguguggcaguauuaacagucaccuacacacuuuuaugcuauucccgaggcuauuuuuauuucacucaaaaauaacuccaggacaucuguuccuucccugggagcuuccugggagccucucugucuccccacaggccagucagucuggcugaagagcuguggaaacauuugcaaaaggaacggacagaugggcggaugccugcagaggccaguccacuucagagaccacccaggcuucugucacuuucgcuccuauucagaccccaaacaaagcccuuguggguggccggagggauucugucagcccagacucaggcugugaaugaggggccaccugaugacacucagauggauggagguguuggcggucccauaaaggaagaugucuccagcuguggcggcugggacagcgcuucccaggaggcgguggccuggguaccaugucacugggccauggugcuggccagcccucuggaugucuagccacccuggccagaggcacuccaaagccgcacaggcccucuccaccuccccucccaucaccaccuuuuaucccagugggucccugaggcgggguccuucauugggcaggggcccuccagcugugagaaccaggaagcaaugcaaaauaacuuacaugcugaggcaaguguauucuuccuuauaacacaaggguccaagguagggcagcuccagggcugguuccucaggggcucagaggcaccagcuaggacccaauccccuuccauugagcuucccagcguugacccaagagggcaucccuucuccagcaggggaagcagggaggggacagcuuccuguucaugggccccacccuccagagacagccucucccagagcccccugcagaugucuucucauggcuuauuggccagagauguagaacaugccuuugccugaaccaaucacuggcaagggggaagagccccccggaacuggcuugguccagucagaacucaugcuccagguugaguggccccaggcaccuggucagacaggaggugggcaccucaggcccagggggcgcucuacguggacaaagaggaggggaggggcaggauaguggugacugacgaaucugccuccguucuugucauuauuucuugacuuuauagaagaggggaaguaaaaggcucggaagagagguugaguaauuccccagggccacacccacuccaagguccccaagccauuuacuuguuccguggugaagcuccaguaaauggaggcauuuuucucccaguccucugaccccgucugcuucuccacucugguuuucuucucuuccuccccccaauccccaugcccaccccaaacaugccugaaagcauuacgaucauagagacuucagagcuggaagagacauucaauauuaauguuauccagugcugucauuguccagauggggaaacugaggccgagagaggggaaggagcucagcgagaccacucaguaaagcagucugugguggagcugggacuggauggagggcccaggaagcacagcaucccugagauucucagagggucucagggaccacccuacuuucucaccucagccccccugcggacggucuccgcagccucccagcuggcugguggccccucugccugucccuucccgggggaaggcucacccucaggcccccuuuaugcaucuuugcaccuggcacauccauggcacucugcagccucugauguccuugacucauagucugaucugaucgucacagcgguccugugagcuggucggaagugcauuauagauacagaaacugaggcccagagaggcaacagggcuugcccgaggucacgcagugguaccuuaucgaagcccaggcagagcccgcucucucggcaugcgaccugugcagucacucagggauuagugcucugggguugccuucuugaaauucgugguaauguuccccuuugcccugggcgccacuaauugcggagcugguccugggcccggggcuccugacuccuccaggaugcuuuccacaaccacauacccccucuaccaguggccuacccaggguaagucugacugauuccgugggacagcccuucacauggaggggagcgggcuuagggagugggagcaagacagugggauguuuuggccugggcucagggugcaggaacuggaaggacccacuuuggaaaugccucccucaucccuugucucaggccgguguugcugaaguucuugccuggcucccuucccauccuggccucagaauuaauggagagggccaguggcggccugugcccuuugucccaccggccggccuggggguggcggcuccagaauacaggguccuauugugugcccugaugucaggcagcuggacugcugggagugaggauaaacaagcagcuggagcaucucgccugaagccccaggagagggccagagccccugcagcagcaggagaaggggccagucugaagagggacagagcuaggggcaguuggauuccaacccugccugcugugcggugaggccagcacagcaacaggguccacugcuguaagaggggaaugacuggcgguuuggcuacuucacagggcugcugggagugaugcacuugagugcuucgaaggcugccugacaccagccagcucugccgcugucagcacuugccccugugcuuccuaucgcccauauucaggauaaagcacauacaggcccuuugccuggcucguaagcccuucucuuucaggccuguucccucucucuuuggccccaucucuugaugacgcccccuccccauauuccuuccauccaccccagacccccugcguuugccagcauugcccccucucccucuccuguucccucuugcugcccuucacguccuuccccacugucccccucaccuggccagcuccuagcaggaaacccugcaacugguccugggauuuacgaugccuccgguaccccaguguccucacaggugucuccugacuguaaggccuccagaguggccaccccugagcaaggaucuggccccagcaccugccucaccuccuccagagggucccuuccccagaagcacugccagggaaaucuaggcuccacguggguucaaaaggcacuucccggccugcugcagggagucuccaggugcccagaccugccacugucuuuguaggccccucucaccccacaggcacuguccuuuccccucuuuucccaucugucuucuauuguggcugcuaaaacagcauaaaaaugcuggggaguuucaacuucacccuacuccaagccaagcccugaaaccccuuuuguggauauagacgaugucaggugcccagccaagcccagguuagugccugggguagcaggaauugccacuccgaugcccaugggggccaggaaggaaugcagccuagguggggcugcgguggggaacuacuugagauuuggggguucccauagacagcuggggagcagaauacauucccuuucuaaagagugugcuugaauucagcugucgcucauuguugcugugggggaauaugggaccuguauugccagaucugauuuuucaagaaaagccaggggcugggcaugggggcuaugccuguaaucccaacacuuugggaagucaaggcaggaggaucacuugaggccaggaguucaagaccaaccugggcaacauaaugagaccccaucucuacaaaaaauuagccagguguagugguguaugccuguacucccagcuacuugggaggcugaguugggaggaucccuucaaccugggaggucgaggcugcugugagcuaugaucaugccacugcacuccagccugggugacagugagacccugucuauaacaaaaauaaaaauaggcuaggcguaguggcucaugccuguaaucccagcacuuugggaggacaaggcgggcggaucaccugaggucaggaguucgagaccagccuggccaacauggugaaaccucgucucuacuaaaaauacaaaaauuagcugggugugguggcaggcaccuguaaucccagcuacucaggaggcugaggcagcaaaaucgcuugaacccgggaggcggagguugcagugagccgagaucgcaccauugcauuccagccugggagacaagagugagacuucgucucaaaaaaauaaaauaaaauaaauaaaaauaaaaauuuaaagucagauauccaacuuuguaugugcaguucccuugauuuuuuuuuuuuuuuuuugagacagggucucacugugucacucaggcuggagugcaguggcacaaucacaguucacugcagccuugacuucccgggcucaggugauucucccgccucagccuccgaaguagcugggacuacaggcgugcaccaccacaccuggcuaauuuuguucauuuuuugcagagacaggguuuugccauguugcccaggcuggucuggaacuccugagcucaagcgauccuccugccuugacccacucccaaagugcugggguuacagcugugagcuaccgugcccagccaguucccuugauuuuuaaagaaaaauuuuaaaaaauuguuuuuacuuuacauacaguaaaauucgcuuuuugggggugggggaagaagugucacuauuuacauagacuccugugacucccacugccaucagggacagaacggcucaucccccaaauucucuccggcugcuccuuugucuucagucccuccuccucgcucuuggcacccacugaucuggcuuugucacuaugguuuugccuuuugcacguaaauggaaucauacaguuuguaaccuuugggagugguuucuuucccguagcauaaucauuuguucuuuuugguuagggaacacuugcuuauccauucacuuguugagagacacuggggauguuucuagguuugggugauuauguguaaugcugcuguggacauuuuugugcaguuuugugugggugugugugaauguaaguuuucauuucucuaagauaaggaaggauaaggaaguucccuuauauuucuacuuuguugagaguuuuuuuguuuuuuuuuuuugguaucaugaauggauguuaaauuuugccacuugauuucucugcaucuuuugauagguuuuucuucuuuggucauguuuagauuacauccauuaguuuucaaauguugggccagcuuugcugaauaaaccccauucggcugcuugucuuguuauauuuuucauauauaucuccuggauucgauuugcuaauauuuugcagaggcucauugcaucuguguucaugagggauauugguuuguaguuuucuuuuuucuuuuuuuuuuuuuuugagacugagucucacucugucgcccaggcuagagugcaguggggcgaucucggcucauugcaagcuccgccucccggguucacgccauucuccugccucagccucccgaguagcugggacuacaggcgcccaccaccaugcccggcuaauuuuuuguauuuuuaguagagacgggguuucacuguguuagccaggauggucucgaucuccugaucucaugauccgcccaccucagccucccaaagugcugggauuacaggcaugagccacugcgcccagcagguuuguaguuuucuuauauugcuuuuguuugguuuggguaacaggguauuauugcuggccccauaaaacgaguugggaaguggcucuucuauucucuggaagagguaguguagaauuuauguauauuuuccuuaaauacuuagugaaauuaucugguccugagguuuuccuuuuuggaaggauauaaauugggaaauuaauuucuuuaaucacucaaggacuguucagauuaucuauuucuucuugcaugaguuuugguaguuuguguuuuucaaagaauugguccauuagcucaucuaaguuguagaaauuauguguguagaaguguuucuaguguucccuuauuagccuuuuaaaggauguaagacuguaaugauaucucuguuuucuuuuuuuucgagacaaggucacacucugucacccaggcuagagugcagugguguaaucaaggcucacugcagccuugaccucccuggcucaagcgauccucccaccucacccaaccccgguagcugggaccagaggcaugugccaccaugcuuggcuaauuuuuuuaaucuuuuguagagauggggucuugcuauguugcccaggcugaucuugaaugccuggucucaagcgauccucccaccuuggccucccaaagugcugggaugacaggugugagccacugugcucagccucauuuuuuauauuggugauuuguauucucucucucuuucucucugucauucugguuagagaugcaucaguuuuguuaaucuuuucaaaaaaaaaaccagauuuggguuuuguugauuuuucucuaccagucucauuuuuaauuuuauuaauuucugcucuuaucuuuauuauuucuuuccucccuuuugcuuugggcuugaauuuuaugguauuguauuuucauuuucauuuaguuuaaauuauuuuuauuuucucuugagacuuuggggcugggugcgguggcucaugccuguaaucucagcacuuugggaggccgaaggggguggaucaccugaggucgagaguucaagcccagccugacccauaugaagaaaccccaucucuacuaaaaaauacaaaauuagccaggcaugguggugcaugccuguaaucccagcuacucgggagguugaggcaggagaauugcuugaacccgggaggcagagguugcagugagccgagaucacgccauugcacuccagccuaggcaacaagagcaaaacuccaucucaaacaaacaaacaaacaaaaagauacuucaucuuugacucaugaauuauuuagacacauacugccuaauucccaaguauuugaggauuuuucagaugccuuucuguuuuugauuuuuuugcuuguuuuaaaauuucuuuucuuuucuuuuuuuuugagacagucucgcucuguugcccaggcugaagugcagugugugaucucagcucaccgaaaucuccaucucccagguucaaguaauucucgugcuucagccucucaaguagcugggauuauaggcacaggacaccaugcccagcuaauuuuuguauuguuaguagagaugggguuucaccauguugcccaggcuggucuugaacuccugaccucaagugauccaccugccucagccuccaaaagcucugggauuacaaacgugagccacugagcccugagacugauuuuuaguuuaauuauauuauagucacaggacuuuuuuuuuuuuuuuuuugagacagaguuuugcucuuguugcccaggcuggagugcaauagcgcaaucucggcucacugcaaacuucgccuccuggguucaagugauucucuugccucagccucccuaguaagcugggauuacaggugcccaccaccacgcccagcuaauuuuuuguauuuuuaguagggaugggguuucacuauguuggccgggcuggucucaaacuccugaccucaggugauccaccugccucagccccucccaaagugccaggauuauagaugugagccaccacgcccggcaagacauacauuuauaauuucaguuuuuaaaaauuuguugccagacucuguggcucaugccuguaaucccagcacuuugggaggcuaaggcaggaggaucucuugaggccaggaguucgagaccagccugggcaacauagugagaccccccgucucuacaagaaaauuagcugggcguguugacauaucccuguagucccagcuacucgggaggcugaggugggaguauugcuugagucugggagguggaggcugcagugagcuaugaucacaccgcugcacuccagccaaggugacagaguaagauccugccuccccaccacacacaaaaaaaguauuauaguuuguuuaaucguccaagauaugaucuacaugaucuaccuuggugacaguuccauguuuacaugaagagaacguguauucugcuauucuugggugguguguucgauaaacaucaauuagguuaagcugguuaguggugguauucagaccuuuuagaucccuuguugauuuuucaucuaacuagcucuacuguuaaaaauuagauuuucuaucuaacugguuauauucucuagaggaguguugaagucuccaacuaugauugucaauuugucuauuucuccuuucaauuuuauuaguuuggcuucauguauuuugaagcucuguuuuuagggacauaugcauuuaggauuguuauguaucuucuuggugaguugacccuuuaauauaauguuugucugaauccuugguaauuuuccuuguuuggauuaggcaauuucuguuguucuaucacuguuuguacugugauuuccguucugcuauugauccaauccaaugaacuuuuauuucauauauuguauuuuuuaguucuaaaauuuccauuugguuccuuuuuucuagcaucuauuuuucugcaagaauuucgaaauuuccauuuauuucggauuguucaccuuuacugaaccauggagcaugguuauaauaacuuuuuuaaagucuuugucuaauaauggcaacaucugggucaucuuagcauugguaucuaucuauugauugccuuuuuuuuuuuuuuuuuuuugagacggagucucgcucugucacucaggcuggagugcaguggcacgaucucggcucacugcaagcucugcuuccuggguucaugccauucuccugccucagccuccugaguugcugggacuacaggugucugccaccacgaccagcuaauuuuuugcauuuuuaguagagacgggguuucaccauguuagccaggauggucucuaucuccugaccucgugauccgcccgccucugccucccaaagugcugggauuacaggcgugagccaccgcgcccagccuuuuugucuuuugucuuguacauuguugucagcuuuuccuguuucuuuguaugucaaguaauuuuggacugugucuuggacauuuggaauacuguaagacacuggggccuguuaaaauccucugaagaaugucaguuuuuucuuuguuuguuuauucguuuguuuuugagacagggucuugcucugucaccuaggcuggagugcauuggcaugaucauggcucacugcagccucaacccccuggccuuaagcaauccucuuaccuuagcuuccuaaagccuuaggguuacgagcaugagccacugugcccagucuguuuguuugcuuuuuaaaucaguuagguugacgccucagaucccaaccugcccucugugaauuauaguuucaaugucaguucaguuuucaaagccuuugcagugcuauucagauccaccccaaguauacauacuccaggggccagucuguucagucuacacuguaguucaguucucagagucuuugguagguuauuuggggucaguuccauguaugugcagcucaggaguaggcuaggaccucaaauacaacaacuuuaugggaucauauucucaagcucccuucuuucugugaugccgcccuauccagcuuccaggggccccuuuuucucauuuuuuuccagguaaaagauuuucccuuucucggaguuuuaggucccccugugugacugcuacggcugcugccaccaccuaaccuuugggacagguuuuaccuuguagggagggggcugggagagaaaaaagacccagggcacuucucccacucgauuuuucccaggaggccccccuuucccggcuucucaucagaaagagaguuucuuccguagcuuuuucucugugcaccugcugcacaguucugggauuugggcuccugagucuaggucaggaaauaugcaagcucaccaccguauucaucuuacuuaacguuuuuguuuuccuccccaauucaccuuccacuauucacuuuucacaguccuuguguaguuguuuuaugucuucugucaggguuuuuaguuauaaucaaugggaaagcuagacuguagugugcuuacuccaucuuaaccagaaccaggaggcuugcuuggcuuuaaauauuggcaucuaauuuuaagucuguccucaagccacaucugagaugcuagcuggccaccucugcuuuaguggcacagugucucaaaauuaauuuuucuuucuuuuuuucuuuugagauggagucacaaucuuggcucauugcaaccucccgccuccuggguucaagcaauucuccugccucagccuccccaguagcugggacuacaggcgcgcaccaccacacccagcuaauuuuuuuuuuuuuuuuugaggcggagucucgcucuguuguccagccuggaguagaguggcacgaucucggcucacugcaaccuccgccucccagguucaagugauucucccaccucagccucccaagcagcugggauuacagguguacaccaccacacccugccuaauuuuuguauuucuaguagagaugggguuucaccauguuggccaggcuggucucgaacuccugaccucaggugauucacccaucucggccucccaaagugcugggauuacagguaugagccacugugccuggccuaauuuuucuuuuaauacucaaauucuuaagcaaaaguugucaguaccaaugccaguuuuucuagauuaaaagagagcagaauacagauuuauucuuucucuggucagagcaagccccuaaaccugucagcauaauaauagugauugcaauuauuuuagcagaaauaauaauuacuggcuaagggcauggagucuggaaccaggccucuuguguucagccgucuucuacgaacugugugaccuuaauucugaaugacuuugccuuucuaugucucaguuuccuccccuguaaaaugggaauaauaaugguaucugcuucccaggugguggcgaggauuaaacaaauucauaugcauagagcgcucagaacagugccuggcacaaaggaaggcucgcuaagcauuugcuuugauucccgugaguaauggcugacguuuauuaggcaccuugccuugcagacagcuucacagcggcaagauaagccggcuuaucucacuugcucagaugaggcagcugagauuucagaaaggcaaauggcuugcuugaguccaucuggccuucagaccuugaaauuagggaggcguggguggcugggcauggguucagggaguaucuggcugguaaucaaucagacagcaacggcaacgaagcuuuuuaacaucaucuggucugagcuagaagagaugugacccaggggacugaguggggggaaaaaaucagcucaaagagaaaggcaacagaaauagaaggggaagccugguaauugaguggccccaaaaaggaaagaucaauauuuuacuuccagugaacaaccaauuucccuggcagcaagcuggggcccagcugugugugcuucagugacaacagcugcuucugcaaugccugccaggccuggcgaacccgucucuccuggccugggagccagagggggagccccagggcugcccagccacgcauggugugugccccagggugggggcggcccccagcuccccugccuggggcccaggcuccccacgaagaccacaugggguggcuauuugcuaugcucccugcgugaccuugagcaaaccccuccccccgcugggaccucgcuucaccaacugugaaaugacgggcugggucaguggaaugugucuggccgaggaccaucuguggcaaaagguuaccugauguccaggaaggucgagacucuuugugauccaaggcgagggguccccacguagugaguaaagcuucuuugaugcucagggcgccaggggauagaaagaacacuuuagugcagacagccccgugagagucucuggcccaggaaggcaacagggagcaguggcugacucucuggggucaguaagaccuggguucaagaguugccacuacaggugggcaaaaauuuuaaauuuaaaaaaaggaaaauaaaaggggagcguuaccacugcagugacuuugucuaaaugucuuacccucucugagccucagucuccucaauuuaaaaugggggacuauaauaauagcuacuguuaaguuugcugugaggauuaaaugagacuaugugugaacccuccguggacuccaagcauuugcaauacuucuccacauaaaugaugcuguuauuuauuuuaaaaaucacugagccugugguugaugguauguauugguaauaaccagcaugcauuguucuaauaauuucacaccuguuuucuuuuuuuucuuuuucuuuuccuuuuuuuuuuuuuuuugagacggaauuuugcucuuguugcccaggcuggagugcaauggcaccaucuuggcucaccgcaaccucugccucccggguucaagcgauucuccugccucggccucccaaguagcugggacuacaggugcacaccaccaugcccagcuacuuuuucuuguauuuuuaguagagacgggguuucaccauguuggccaggauggucucaaucucuugaccuagugaucugcccaccuuggccucccaaagugcugggauuacgggcgccaggcaccacgcccagcccaauuucacacuuguuuucuaaagggcaggacaucagugugccuggccauuuuuguuuuuuguuuuuuguuugcuuugagacggaaucuugcccugucacccaggcuggagugcaguggcacaaucucggcucacugcaaccuccaccucccuguuucaaacgauucuccugccuuagccucccugaguagcugggacuacagguacacaugaccacgccuggcuaauuuuuguauuuuuaguagagacagggguuucucuauguuggccaggcuggucucgaacuccugaccucaggugauccaccuaccucagccucccgaagugcugggauuauaggcaugagccacugcgcccggcuggccuggcacuuuuguggccacuacucuggggcugccacucuuugaagagcccugugggagcagcuguagagaggucacagccuggggugugcccccgguugcagcuugggccauggcgugggugcuucggggaccaugcaguggcccucaguaccccaucugucugccugucaucaaacaaccccacccccaccucugucccagguaggcuuuugcuggcagaggaauggacagcucgccccaccagugucucccagccucagggagcuguggacacagggauuacagaauccaaaucccugcacuccugccuccuagguggacuugaggugaggguccucaucagucagucagcacucuguggccgacuccacccuugacuugcuucagaaauaaugaaggcagagcccugaccuuggagaggacuguaggccugagcaugggaggcuggaggguagagggugcccuggcucauccccacauucacaggcccccuauaaugccagcgaugcaaaggcaggaggagaggaggcggaaugccagccaggauggugggugggcuccccugcagcccugcagguggcaccugggcauugcuauucucagaagccacgucauugccuggcagugucagaggcuggcauggcuggggggagggggcagcugcaauguugaggaggcuggcaaaaagccacuuuccuccuuuacugaaauuuugcaggucuuuccugagagcccacuagguaccagguucagggagguucacagaaagaauguggcacggccccucugcccuucccucaccccagacucaccccagaguggaaaagcagggucagcuggaaucaagaugcaagcacagagccgccagguuccaggcaaggagaagaugguuaggguggggccucuuuguccacugcucaccuuccaaagcccacugggcacagcccccauggugccaggccaccggcagugaccagggcuucagaccccugcugcagcugccacgcugugggcaugcaagaaaaacguggucccuauaaauagaugaauccccaacgugguuuggcuucggugccugugauggguggugugguaugccggcgagucugccugugauggcgugaacacugacaacagugacugugagcaguuuccugcaugcugugcucugcaggccccgggugcccucagauccaucaucugcagcccagccugagcagauucuggaaagagcucauccuggccuggcugugcuauagauacugauggugauuauuagggggagcggcaagaugccugacaaggagugugagcguguacacauguguaugcacuauuguguauguguggcuagccagcagaaccagcaccuaccaccaucaaccccugaaagagugccuggcauguaagaggugcucagucaucacuuguugaauaagugagugaaugaaugaaugaaugcuuguaugggugcugugggagggcugccacuaaguuuuagaagcaguuuuagauuuagaagcaggcuucugagccaggcgugguggcgugccuguagucccagcuacuugggaggcuaaggugggaggaucccuugagcccaggcauuugaggcugcagugaucuaugaucaugccacugcacuccagcuugggcaauaaugugaggacauggcucuuaaaaaaaaguuguuauuauuaugaugaugaugaugauuauuauuauuauuugagacggaguuucacucuugucacccaggcuggagugcaguggcgcgaucuuggaucacugcaaccuccaccuugaaggucagagguucuccugaccuuggagaggauuguaggugugagcaaaaacaaauauuaugaagccucuacuauguaccagucacggugcaagcgaccagguauacaguggugaucagaauggacaggguccuugcccuuagggagcuuacuuuguagagagaagauauaaauuaaucaaauuaucccacacacauacaacuacaugaaagaguauggagaaacuaaggcuaaggcuuucugcagugaggucgggagauacucacaccugcuaaaguucaaaccacacaauaucccaauagacuugggugugcaaccgaagucaugaucugccagucuccagcauuucucagcugcgagugcccugacuagcucaccagucagaaaggcuuugcaaucuaggauuucugcccagccaaugagcugccucugaaaacaacuuucuguggaaauccuccguaaaaauuggucuccuggcugggcgugguggaucacgccuguaauccaagcacuuugggaggccaaggugggcagaucaccugaggucaggaguuggagaccagccuggccaacauagugaaacagccucucuacuaaaaauacaaaaauuaccugggcauguuggcgggcgccuguaaucccagcuacucaggagaggcugaggcaggagaaucucuugaaccugggaggcggagcuugcagugagcugagauugcgccacugcgcuccagccugggcaacagagcgagauuccaucucaaaaaaaaaaaaaaaaaaaaaagaauccuuccuccacuugccuccugggaugcucuucggggcuguccugaucccguguaccugaauugcaauucuuuguuucccaaauaaacgcuauuuccuuugaccuccaugucaaucucuuuuuaguuaacaauagcaaguugcaacaaauuguuugaagggaaaguauaggaugcuacaagacaggauagcagcggggugggcccugauuggauggggguggucaggacagaccugucucagggagggacguuucauagagguacaaagggagaccugaaggaugaacugacauggcgaauggggaggacagcuguccaaguuguagggaauagcaugugcaaaggcccuggggcagagaagaguguggugguuuccgugaggagcugaccaaaggccagugcagcuagaguacagugagugaugaagagcaugggaggagagggaguggaaggggucagaucacauggggccuugugggccguguuguggaguuuggauuuuuuuuuuuuuuuuuuuuuuugagacagagucuugcucagucgcccaggcuggagugcaguggcgugaucucagcucaaugcaaccucugccucccagguucaugccauucuccugccucagccucccgaguagcuaggacuacaggcgcccgccacgacgcccggcuaauuuuuuuuguauuuuuaguagagaugggguuucaccauguuagccaggauggucucgaucuccugaccucgugaucuacccgccucggccucccaaagugcugggauuacaggugugagccaccgcgcccgcccuggaguuuggauuuuuauccuaagugugguggaaugauacuggaagguuuuaagcagaggagugggugacacgauccaguuagacuugcaugauccaggagagacaggaugauggcuaugaccagguggggcuccugagaggugugggaaaugagggagcugugggauacagugggagcauggauugaaugugagugacagugagcagacgcagugaugcugaagaacccugcaguggcaggaagggagggaggacggggucagggagugggacauuugaugggugguauuggagggggugaucacuggguugaccaagggacuuggugccugagguggaauaugaggcaaaaagaaagucaaggaucugagaggccggggguugaugggucauccacacagcugcaggaacccccaaagaugaauuguaaaagcaaaaagcuggaaauaaccaaaaugcccagcuauuagggguggugaaguaaauuaugaugaacccaccgggcagaauguguuacagccacuaacaacguggguuguacacaccaagcagcauggaaacuguuucuguccuaccuccuguuacacgggagagaaacucuccaaccucagggauggcugacucugccaggugaaaacuuacuuccuuauucaucuaacacucuucauugaagugcaagguacaaauagaacagaaaaguucaucagccaccaguguccaucucagugaguuuccccaucuagccagcaccuggaacaagaaauagaacaagagaaauggugggauuucugggucauuuacaaugaguuugugucuguuuugugugaaagaaaccaauuuuaaaacaucggcagagccucggcuuucauugugcagucccugggggaaggaggcucggccccugaagccgugugcucagggagggugugcucagggaggagccgguguuggcucugcuuuucuuugcccgaguugucugucaccauggggagaauaaaguggccccauggcugauacugaccccagggugaggguaagaggacugggcggggacacuggugucccucccucccucccagccuccccacccagcucccugagucuucgggagauccuugggugucucacaccugucccugcuucauucccacagguggaaaaacuugugaaauauuuggaucccaacgaccuggggagaaucaacuucaaggacuuuugccgggggguguucgccaugaaaggugaggucuucccgggaggcuuucccaggcgcucuccgguccugcccagcuggggaagcuggugugacugggggcccagccuggauuccuccccacaggggucccagagcccaggaugggccagaagucgguucugccucuggcuuccgggggggccagaggagaaggacacuguugccccagccguggggggcuguggucucacccauggaagucacuucugcccuuccccuugucugcccgccucuggagaaagccuccuucccugcuuuucuguccucuuccucucucucccgcucuggggugaccaaacccagugagucuccugggaugugggagggacuccacuuuuaagaccagggcaguccugggcaaaccuggacaaagcgcuggucacaugacugcccgccucccucugagcugcugcuuuuguguccucccugcucccgccuccucuuuuuuuuuuuuuuuuugagacagggucuggcuuugucgcccaggcuacuggagugcagugccacuaucauggcucccugcagcuucaaccuccucggcucaagcaauccuccugccucagccuccugaguagcugagacuacaggagguacaccaccaugccuggcuaauuuuuguauuuuaaguagagauggaguuuugucacguuguccagccuggucuugaacuccugagaucaagugacccucccaucucagucucccaaaguucugggauuacaggcaucagccuccaugcccugcccucucuuccucuuaauucuuccuaauuccugccuuucuuccuugccccugcuuccaguuuuaaggggacaauauaaaucccucugucuugucccaaaaauucaaaggccaguugugagaaacuugcaggaaucagaauauggccacucacuuacuacuaagcuguuuaucugagacagugagggccaggcacgguggcucacaccuauagucucagcacuuuuugggaggccgaggcaggcggauugcuugaucucagguggaucacuugaguccaggaguuugagaccagccuggccaacauggcgaaaccucaucucuacaaaaaauacaaaaaauuagccgggcauucuggugugugccuguggucccagcuaccugggaggcuaaggugggaggaucaccugagcccaggaaguugaggcugcagugagcugaggucacgccacugcacuccagccuggguaacagaguaagaaccugucucaagaaagaaaaaaaucugagacaguggcauaggucaccagccagguggacuugcuaaggccuccccacuagcugcagagagaaugcagucacuucuggagucccagggugucugcuuaucugugaaggaagccaugguuuccugucugcggcucagaucaaguuuagcccuuuucuguggggugccuaugaguccugggaggguggaacgaugcagggugagggaugaagggaaccaaauacacggugcagggggcacagaacacagaaggugcccagggaagguuuucugcguggauuugacaaugggccacugcaggcugcaccugccaugugccugugccaggcauuuugucaggucccccucccaguucaguacaaccuuggggcguuugguugggaucucaggagcgaggccagccguguacagagucagcaggaacugcagcuguccugcgggcagcccuguccuggacgucccagggucugcaggacacggggggcgcccagccucggaggaauggguguguuugcuuucuccagaggcuggcacagucguuuggagucccugcaagccaggugggcagcacugccuuagguccccucccccaggaaggccuccuuccuuccuguugccccagccugcccucugugugugggaauuagucccagaggacaagggccucuugcagcucccuccacagugccuugagcugaguuccccaccgccugggcuccaucccugccuuccagugcucagcuggccuccuggagccucgggcccccaccucagcccuucccacccuaugcccauuagucagaagcagagcagccgucccaggcugaggcucaaccccucacugucccgugugucugccugucugcgcagggugcgaggagcugcugaaggaugugcugucgguggagagcgcggggacgcugccgugcgcgccagagaucccagacugcguggagcagguaaggcuuggggggccucaaggaccuccauggcucugccuccuccuucuuggucuugccuuugcuccauuuucaguaucugggaggacccagaaccucccucugaggacccuucuugagcaucagagucaagaaauaguuuuuggaacaggagcccugaguccccuugggaagccccagcagaauguguaacagcuggggguccucacccagcaacuuuauuucccaucuguggcacggaggagagacugaguuccagacagggaaaguggcaaguggaggggaggcaggacuagaauuguuuccuuuucuucugcaccaucgcucucugagcugaacgcuuccuguuuguuuguuuucaaacaacaacgaauucuccaauucucugacacuaacugguguccagcaaucaguuccaccugccacuaacuacccagcauuagcacagacuccaugagucaaggucaacuccaugagacugccccaccucccacgccagcugcaguucuuccuggauaacugcaaacacaggguucccaggaccaccucccucgggcuggguaauucacuggaaacacucaggaaaugguuguacuuacgaugaucaguguauuacaaaggauacaacucaggauuagccacacggaagagauguacaagacaggguauggggagcagggaugcagagcuuccgcaccuucgcuuaggggcgcugccucccagcacaucaccgugcuaccagcacccgggcucucugcaucucauuguucaagaauuuguaggccuggcgugauggcugaugcuuguaaucccagcacuuugggaugcugaggcaggaggacagcuugagcccaggaguuugagagcagccugggcaagaugaugagaccccgucucuacauaaaaacuuaaaauuagcuggaugugguggugcacaccuguaaucucagcuacuggggagacugaggugggaggagcacuugagcccaguaguuugagacuucagugagcugugauugugcuacugcacuccagccagccugggugacagggccagacucaucuccaaaaauuaaacaguuuuuacaacccagucuccagccccucuccucugccuggagguuggggguaggugggaaggugagaaaguucccaccuuauuguaugcuuggucuuucuggugaccaaccccauccugaagcucuguaucaggaagcgggacaaagaccacaguccccaaggcucuguuuuucuguuaucauugccuaaugguguguuucuuaugaaacuuugaacuaguuuuccaagcagugcagcuucauccuacagagaaacaguugaaggugcacaagcugacaaccagcgaggucccuccugguggcaacacccagaacuagaagaggaugauuuugauuucuuacccagcccaacccccaaaccuuuuccccaguucugaugggugccuccucuggaccccaaaacaugaguauguuuauagcugaaggagauccaggaccccagaggccacuuuggcugaugguaggccucuuggaauccagcugggucguggggucaggguuagguucccugggcaggacuggaggagggacaguccacagagagggacacagugcugagggcugccaaguccaugguggcagagaccaaagccaggcaccaacugugggccagggcccccaggcugggagucagguggcuaggccucaggcugcugugcucaaagcaagagcccucagggaugcguggagauagcugggccccaggcccaugcccaugccagcagugauggcuccaggccugucuugauggguccagcaagcagggguugaauauguauuuggggccagcuaauggaaccaggauuaggaaagaggaccuccacugugggacaaauacugagugccccaggaacuuugcugggggggcccuuccuggauugcugagcaggaggcagcgugcagaggugugcaggacuggguccauacccacgugggccacccaggacaggccauggaaccugagcacguucuucucaaccccgcugagcgucaguguccucaacuguaaaacaaggcuugcugugccaaucuggagggucuguugugaaaguucagugggaagacagaccccuaauacgugcuaauuccucgccgccugcugcuguaagaaaauggugcugaaguuaccauuugcauuuuucaguuuacccucggauacugguguugcaaaauuauguuaaaguaaagcccugccccaggaacuggagggcagaguggagccgaggccuggggagagggggugggaguugggguaggggugacguguucccuguagucuuuggcugcuuuuguggcccccacauucugccauucacaccucuggaaaagguggcacauggagaaaagaugagcagggggugcagaagagugggccuccaccaagguacucuuuuuuguaaaccgauauugcuuuccuccaaagucuagagguuaugggaaagcagaaagaaagaccgcgucagccuaucucagcaagccuggugcuucuccuuguuucuucaugggacuuugcaauccuauagguuuuuguugcuuuggguuuuguuuuuuguuuuuuuuuuguuuuuuuuuguuuuuuguuuuuuuuguuuuuuuuguuuuuugagacggcaucuugcucuaucgcccaggcuggagugcaguggugcaaucucgguucacugcaagcuccgccucccggguucaugccauucuccugccucagccuccugaguagcugggacuacaggugcccgccaccaugcccagcuaauuuuuuuuuguauuuuuaguagagaugggguuucaccauguuagccaggauggucucgaucuccugaccucaugauccacccgccucggccucccaaugcuuuggauuuuaagcuucucgugggugaacuccuuucugcccuccauggaggucuggccccggcuugguuggccagagccuagugagauggcgguagcuguggacacaguggcagccuuguucauuaugcucgcuggggcugcuugguugaccuggacuccauucccuaccaugggcuucugcguguuggcagggagaggaagggggcacaauccgaagaccagccugacggggcagacggcuucuggauugugaaugaguccucuuccuggcuuaggcuccuguaauagcaaggucaagaccacagcucugcagaugaggugucagagugggcuggacugggcagguccgaauuucucaggcccggcucucugcgcccugcugugucuuagcuguccccuaggggucagucugagacugagaagaagcgggugccuggaucacuacguaggcuucccagaugcccccagggaacgcaaaccugaggcaugauuugaggagguguggggaugacacacagaugggauggcaggcgcuccaucccugugccaugcguguauguugggaggugaagcuuguuuuucgggcacagcccccuccccucaggguguggacggagaccucugacuuaaccacuggauguggcucguaauuaaagcagugaaugcuugagugcuggcuggugggccagcagcugccaccuggccccugagagcacccugcccuucuugacccccucccaggccccgagaagccucuagcguugggcaucaagcaggggccccugggguugcuguccagaccucaggccagugcaagucuaucccgggcaguugaugccuggaugcaccaguuccugaccuuacuggauguggcuccaccugcguccccagagcccugcgagacccuggcagagggaaacuuugaggcuugggaaccccaacuguugagcaggcuguugagagaguuuccugacccagggaaauuugcuucuggucaaagggaauguuagguguguccugaaggacuccccagguucccuggguccaugcauggggucccuggaaucgcccugggagucccucugagacuguccugcucaggcugcccaucagcccccaguccauaugcuauaggggcccccguggggagggggcauggagacacguggagagcccgacacucgggugcuaaaggcaaugggauaguugcuaggggcccguggucaccccucagcaggcaguaaugugaacccuaauccuacaagugcuguaaggcccugggcccuguucauccacccuaugguggaugaaauggagagggcauccagccaccugccccuccuguguagccaccacgccagcaaauggugucaguagccuccaacccagagagucauccucagcgccuccucaugcagcugccuugaguccucuguuccccacucaccccugccucccccuuccaucacagccacugccacccacugaccgggcguccuccuguccucagccuuccucucuccacacccccaucccgcuccugggacccguccuuaccaagggaugaaaaccaacaucagcuccuacccacuacucuagccucaucucucaccauggugcaucucacaccuaaaacuggcgauaccaaaccgcuccccguuuccugagaaagccauguucucucuugccucugaguguuaucuuucuccuaggauguccucccucccgcuuccuugucaggagcuaacgucuacucaccuuuuuaagacuuacuugccgggagugguggcucaugccuguaaucccagcacuuugggaggcugaggugggaggauuacuugagcccaggaguuugagaccagccuggacaauauagugagacugcuucucuuaaaaaaaaaauuuuuacuuagguaccgccuccuccaggaagccucccugacuccuucugccccagcccaaaggagaaggaccugcacugagcuuccugggggcccuucacccucuaccacugccugaaccucacccuucaugacagccagccccauguccacccaguggcuucagggcucaggcugagcuccuccuuuucacccccaggacagcacccacagcaagcaucguuauccaugcuccuugggugugucucuaaguauuucuagaacuagguaucuggaagcagaauugcugugucaaaggguauguagauuuuguuuuuuaacagauacggaugaaauuuucuuccacaaagccuguaccauuuguaucacccaagcacuauaugagauugccccuuuccccauggccuucgccaaccccggaagccauccauccaccugcuggucuccggccuagcagccugaggggaggaaagcccauugcugccguccucugugcugcccagcuuccuagggaggcggaccaucuuuuucuuaucuucccauacccucuggauuucugcuuuuacgaauuagcuauucauauucuuugcccauuuucgauaugguuguuugucuuuuccuuauugauuuauaagaaaucucuguauauucuguuuuuugcuuguuuguuuuuugaggcagucucgcucuacugcccaggcuggagugcaguggcucaaucucagcucacugcaaccucugccucccgggcucaagcgauccaccugccucggccccgcaauuagcugguaccacaggcacacgccaccacauccagcuaauuuuuguuuuuuuguuuguuuguuuguuuguuuuguuuuugguagagacaggguuuugcauguugcucaggcuggucuugaacuccugugcucaggugaucugcccaccucggccucccaaagugcugagauuacaggugugagccacagcaacagguugaaaucucuauauauccugauuaucaaucuuuauggauuuugcuuguguuuuaaucuuguuuuaggaguguuuuauuacacagaauguuaauucugaugucaucauuuaucaaccuuuuuaugccauuugcauuuuguguaucauuuugugccuucuguaccuccaggcuauaaacauauucuccuauauauaguuuucagauacuuuugagaaaaagaaguauuuaugcuuagcucuuuuauccaccuggagcuuauuuuugcuuuuggugggaguagagaucuggcacucuuacuuccucaauauggccaguacuuugaguuccuaauguugaauagucccucuuucucaauugauuugaaauuuuaucuuuauuguaugcuaacuuaccuuauauacguaggucucuuucuggacucuggucuguuauauugaucuguuugucuaccuacuuuuaagccaaaaccauaguuucaguuacucuuguuuauaguuugauaucugauagggaaaggcucucucauccuucuuuguuucuuuaaccuuuaaggccaggugcgguggcucaugccuguaaucccagcacuuugggaggccaaggcagguggaucacccgaggucaggaguucaagaccagccugaccaacauggugaaaccccaucucuacuaaaaauacaaaaauuaaccaggcaugguggcacaugucuguaaucccagcuacuugggaggcugaggcaggagaaucacuugaacccgggaggcggagguugcagugagcugagaucacgccauugcgcuuaagccuuggcgacaaagugagacucugucauacacacacacacaaaaacaaauaaaaaaaacuguuuuuuuguuauucuuacauauuuucuuuucuggaacagccuuuuugucaagcucuauugcaaauccuguaggagaucauauuugaaauuaaauuugugcauuaauugaaggaaauuggcuucuuuacaauauugcauucugucauccaggaaugcauauaucuuuucauuuauucuggccuuuuaugcccucuaggaaaguuuucuguuguuuuucuuuuuugguuuuuuggguuuuuugagauggaguuuugcuguuauugcccaggcuggagugcaguggcuggaucucugcucacugcaaccucugccucccagguccaagcgauuccccugccucagccucccuaguaggugggacuacaggugcccaccaccaugcccggcuaauuuuuuguauuuucaguagagaugggguucuacuacguuggccaggcuggucucaaacuccugaccucaggugauccuccugcuucggccucccaaagugcugggauuacaggugugagccaccgcaucuggccggaaaguuuuauaauuuucuuaaauagguuaugcacacuuucuucuuagggugacuauauuuggaguuuuugugcugauauguguaggaucuuuuugcuaugauauuuuauaacugguuacaacugauguauaggauagguuuucauuuuugguguuaaucuugucaugauaacccuauuaaacucuccuuauuuuauuuauuuauuuauuuauuuauugaaacagggucuugcucuuauugcccaggcuggagugcagcagugugaucucggcucacugcaaucucugccucccggguucaagcaauucuccugccucagccucucgaguagcugagauuacaggcgcccacgaccaugccuggcuaauuuuuguauuuuuaguagagacgggguuucacuauguuggccaggcuggccucgaacuccugaccucaggugaucugccugcuuuggcuucccaaggugcuaggauuagaggugugagccaccaugccuggcccauuaaacucucuuuauauuuaauaguuuauuuauaugcuauuuucuaucaugcuuaauucuauauaacaagguagccaugcugccauuuuaaauuuuaaauggcaacaugauauuucaucacaugaagacaaccaaauuuauauaccaguuucuuauuguugggcguauauacacuuuuuuuuuuuuugagacggagucucacucugucgcccaggcuggagugcaguggugcaaucucggcucaccgcaagcuccgccuccuggguucacgccauucuccugccucagccucccaaguagcugggacuacaggugcccgccaccacgccuggcuaauuuuuuuguauuuuuaguagagacaggguuucacucuguuagccaggauggucucgaucuccugaccucgugauccaccugccucggccucccaaagugcugggauuacaggcgugagccaccaugcccagccagguguauauauauauuuuuaacguaauuuggggaaugaacaaaagcaguguaauaaucauucuuauagcuaaguauuuccccacagcagcaaucguugcuuuaaaguaaaucagagguuggcaaauuacagaccccacgagccaaaucuaggagcuuguuauuguaaauaaaguuuuacuggaacacagccacacccauuuguucacaucuuaucuguggcuguuuucacacuacaguggcagagcugaaaagcugccacagaggccaaauggacugcaaagcuuagaauauuuacugucugcccuuuacagaaaaaauuugccaacccagacgguaaauucaggcaaguggaaacuguuuuaugaaaaggaugcaaaggcugggcgcgguggcucaugccuguaaucccagcacuuugggaaguggaggcagguggaucaccugaggucaggaguuugagaccagccugaccaacguggugaaaccccgucucuacuaaaaauacaaaaauuagccaggcgugauagcgcaugccuguaaucccagccucucgggaggcugaggcaggagaaucccuugaacccaagaggcggagguugcagugagcugagaucgugccauugcacuccagccugggcaacagagugagacucugucucaaaaaaaaaaaaaaagaaaaggaugcaaaauauuaaaacugccuaauacuaaucugccaaauuccucugcaggaaucccaucaggauugcgucagauuccugcuacccuuuugauacugguguugcugaguuuucagauccuuuaaauuugagaggcuaaaauuagaaccccucuuuugaauuauaauacaguuuaacuucuuaaaguacauuuuuuggucacuaagagggcguucuucaugaauugccugucgacauucuccacccuggcuauguuuacuucuauugaguauuuuuuaagaaccagaaauauaacuuuuugacauacauuaaauuuuuuccagcuuguuauuuauuuuuaacuuuguucaugauaccaaauuuaaaaauuuuuauagccaauucaucauucuuuuccuuuauggcuucagccuuugguguaaugcuuauaaaugcuuucccgcccaagauugugaaacuguucuguuuuauuuuuguguauuugauuuuuaauucguagaauugacugaugucuagagugagguagggauccaguuugccuuuuuccugucaguuccucuugcccucccucaccuggcuggaaccagcagcuucuugcuaggcuaugcuuacgcacgcaguccccugauggcaaaggaagugagguuugcccggugcaguggcucaggccuggaaucccagcacuuugagaggccgaggugggcagaucacuugaggccaggaguucaagaccagcuuggccaacauggcgaaaccccaucuuuacugaaaaaaaaagaaaaaaauuagccuggcaugauggggcaugccuguaaucccagcuacuugggaggcugaggcacaagaaucacuugaacccagaaggcagagguugcagccagcagagauugugccacugcacuccaggcugggcaacagagcaagacccuaucuaaaaaagaaaagaagaaaagaaaugggguuugcugggaacccagaccugagccugagcccaaauuggcucuuuugcucauauucagaaggggcuuugccaaacccuugucuuccuggaaguuuuuaaaaugaugauaaccugugccucucucuagaacuugcuggggaggaggccuacagccugaacaucuaagcccacccucgcuucauuucauccauccugaaacaagcauuucuaaaaccacucaugacaauggcacuuauaaguucuaaaaauacuuuuccugacaaacagcacugugauucacugugcugguggagguguggguggggugccaugcucccacuggugugguggcaggagggaguuucagagcccagggaagcagccuuucuacuuauaucuggccccaauauauuuuucuauguuucaacaccccccccacccuucuaaagagaaaaaaaaaucuacuuaucccaagccucagagcuucuguaagauccucgauuugugucuuugggaaauaacucaacucugauuaagccaaagguggcggggauggaagcagugcagauauggaagccccuuuuguucguugccucagccuggucugcccuggaccgugugucuucuaccuccuaccccugaccaucccuacccuagagacgcuaagcugagcuggccagcaagugcuacuucccacgggccaccuccugccuaacccaacccugacgcccaaguccacauguaucuuuagaaccuacucaccaaguuagagcuugacaaaaccuuggagaggcuccuuacaucccgucuuuuuaaagcugagcaggagggaaaaauuuggguuuuaugaaccuguaggacauuaaccaccuucguauauaccuuuccagucucauuucagcauccuuucuuucccugauuacauagacuuugaucccuccccuucuccuuuggaugaguuaucccuaccugcugcuucccucauuaaugagucuagugcagugcauuuuugaaacaguaacugugggaaacacacaaacacaaucacaugagggcagauguucuccgagaaagcacggucgaaaccaguggggacucuggguuagcagggccuauggugcuucaugugucagaggcugaacugggauaucaguggagauucuaaacucaccauccaguuuauaaaccucugagggcccaagcuccugcugcagauggugcaagaauaaagaguagaucacuuuuacuaaacaaagaccuagagaguugacuuggucuccaacuuuuuauuuugaaaauuuucaaccuucagaaaagagcagaacaaugaauccacauauauccuuugcuuggaugacagcuguuaacaugcugcuaaacugaguuucucugccccuguguuuguugguggggugcaugugcauacauacuacuuuuuuucuggaccauuugaaaguuaguugcggacaugacacuucauccuuaaauacuuggccauuccuaagaaggacacucuccuaugugaccacaauauaguuaugacuugcaggaaacuuaacauuggcacaauuuguuaccuauuguaaaaucuacauucaaauuuucccaauuuuauauauauauauauauauauauauauauauauauauauauauauauuuuuuuuuuuuuuuuuuuuuuuuugacacggagucuugcucugucacccaggcuggagugcaauggcgugaucuccgcucaccgcaaccuccgccuccuggguucaaacgauucuccugccucagccucccgaguagcugggauuacaggugcaugccaccacucccggcuaauuuuuuuuuuguauuuuuaguagagacuggguuuuaccauguuggccaggcuggucuugaacuccugaccucgugauccacccaccucggccucccaaagugcugggauuacaggugugagccaccgcacccagccaucccaauaauauuuuuauagcuuuuauuuuuaucucaaaucuaauacaggaucacacaguaguuuaguugccauguuucuuuaguuuccuuuaaucuagaagaguuccuuggcuuuuuuuuucuuuucuuucuuucuauuuuuuucuuuuuuuuuacuccuaaugacauugaccuuuuuaaaaacuucaggccacuugcuucgaagaaugccccucaauuuagauuugccuuuauugauuuucugguccuuugggguacugcaacuuaaauuuaaauuaaaaauaaaaugguguggcgaggagggggccaggaggggaguucuacuguguuuauuuuucaagucuaaaacacauuuaaaaugcauauuguuggcacccacucagugggccucaguuuucccagcugaaacaugaucuaaacaccccuugcagcuucugucccuucuggcauuuggggaaaaauaaaugccuaauugugugugugcggccgagcguccacccuuggcaucucucaaauuguggggaggcagccggccuugguacuuucuggcuccaggaacacgccaugggccauugaacgucugugcgauggguaacgucugugcgaugaacacuguacacuggguacaguguuaggaggugugggcucuuauacaugaccaggccacaucuccauccucuuugggcugagauuaggacauuggaguagguguauuugucuccugagaggggcaaucucaagagaaaacuagaaaagaccccccccacgucuuuggggggauuaucugagauaauguggggaagaaauccaagccccuaagauacacuggacggugcuucuccggguaccugugcccgagggagauaccagccacuugcugggacaccagggggcaucuuccuggagcagcagauugccuggaagaauuggagaaaacauuguccaacauuaaaacaaacauggaacauaauaaacauauuuugaagauaagaaagaagccuguaaucccagcacuuugagaggcccaggcuggaggaucccuugaggcuaggaguucaagaccagcuuggacagcaaagugagacccccauaucuauuaauacaaaaaagacaggcgggugccguggcucucgccuguaaucccaguacuuugggaggccaaggcgggcggaucacgaggucaggagaucgagaccauccuggcuaacacggugaaaccccgucuccacuaaaaauacaaaaaauuagccgggcgugguggugggcgccuguagucccagcuacucgggaggcugaggcaggagaauggcgugaacccgggagguggagcuugcaaugagccgagauugugccacugcacuccaaccugggccacagagcgugagacuccgucucaaacaaaacaaaacaaaacaagacaaaaauuagcugggcuugguggcaagcaccugugugucccagcuacuugggaggcugaggcaggaggauugcuuaagcccaggagauugaggcuacagugagccguuugugcgacagcacuccagccugggcaacagagcaagaucucaucucaaaaaauaaaguaaaauaaagauaaugagaaagacuuuuaucaauuuuauuuuacuuuauuuuauuuauuuauuuuuuugagauggaguuucacucauugcccaggcuggagugcaauaguacgaucuuggcucacugcaaccuccgccucccggguucaagcgauucuccugugucagccucccaaguagcugggauuacacacgcgcacccccaugcccagcaaauuuuuguauuuuuaauagagacgggguuucaccauguuggccaggcuggucucgaacuccugaccucaggugaucugcccaccuccaccucccaaauugcugggauuacaggcacaagccaccgcgcccaacugcuguauuuuauuuuugagacaggaucucacucuagcacccggguuggagugcaguggcgcgaucucagcucacugcaaccuccaccucccaggcucaagcaauccuccugccucagccucuugaguagcugggacuacaggcaugcacccagcuaauuuuuggauuuuuggagagacagggucucacuauguuacccugguuggucuugagcucccgggcugaagcgauccaccugucucggccucccaaaaugcuaggauuacagguguaagccaccgcgcccugcgggaaagacuuuuuaaauuguuuugcuuuagaggcugcucuuucgagucccacuucuacuguagacccauguccaucuucugcuguggggccgcuuuauguaagguauuacuguuauugcuauuuuguuuuccuuuucuuuuuuuuaagaaacaaagucuugcucuguuacucaggcuggagugcagucacugcagccucaaccucccaggcucaagcaauccucccaccucagccuccucaguagcugggaccacaggcucauaccaccacauccagcuaauuuuuuuuuuuuuuuuuuuggcagagaccgggucuagcuauguugcccaggauggucucaaacuccuggccucaagcaagucucccagcugggccucccaaggcacugggauuacagucaugagcaaccucuccuagcccuguuuucuuguaauaaaguaaaugcaguguucauuuuaguaacaaaacaggucuucacugggagggagaaaugaggaaauuugaccccgcguggcugaggccuggaaugagcuccaugggcaggcuccaggaaugauguaauuuugccuccucucaaggcuggccucaaggaggccugauuccagcccucuuugucuggggcugcccugaaccuguaagaauccuucugaccagauccuccagacacugcaaauucucacccagguugcucagaauccuggaaagagcucagguuugagucaaacgggcugaguguggguucugcuugaccacuuucugugugucauuuggcaagucgcuucaccucucugagccuuuuucauuucugccuaucuaaaaucagagucgucagccugauuuucaguguuguggugagaaugcaauggauuaauguuucuaaagguuccugaggagacaggucccccagucaguaguaccuaugccugcauucucuguaccacucagaacccucaggggaaucauucaggacacaggggacagaauucccuccccuucccauucccaaagucaccagccugccuccaccugcacccacacuuucagcuugcugcugggauggugaguggcaugacccugcucugacacaggccaugcccuccaaucccagcuccucacccgcacaccgccugaacacuggaucccagccccuccugccaacucaagcacucgccuucacaaacagccccucacccacagcacccgcaccacgccccugcuggguccuuuccauucgcuucuggagcugacauaauaaugcccuucccaugggcagggaagcacccgcuugaccacacauccuggcuuucuuuccuuuggucuauuuccuccaaagacuggucucaacucccuuucuugccucccuuucucucuguugccacucccaaugaugucuuggccccucuguucugcugaaacacuucucacagucaccagggacuucuuuuugagacaggggucucacucugucacccaggcuggagugcaguggugcaguccugacucacugcagccuccaacaccuggguucaagcaauccucccaccucagucucccagguagcugggaccacaggcaucugccaucauccccagcuauuuuuauuuuuuguagagaugggggucuuguucuguuccccaggcuggagugcaguagugcaguccuaguuugcugcagccucaaacuccuggccucaagcaauccuccaaucucagacccccaaagugcugguauggcaggcaugagccaccuugccuggccaccaggaacuucucacuggccaaauccaagcaucaguucucuagucacauuuuuacauagugaugguguguggugaauagaucaggguaauuagcauauccaccaucuccggcauuuaucauuucuucauuuugggaacacucgauagucuccuagcuacugaaaacucuguauuauuguuaaugauagucaucuuacagugauguagaacaauggaacuuaucccuccucuagaacuguaacucuguacuuuuaacaaacgucucccuacucuccuuccccugccauucucagccucuaguguccucugcuccauucacauuuuacuggaacccugggcagggccuggcacagccaaccucucccuucucagaucguccuuuuagcucaagccuuccuccuaccucucaggcugcuuuucuccccgcacaccacccccccgccaccggcuuuauuauuauuauuauuauuauuauuauuauuauuauuauugagacagagucucccucugucacccagguuggagugcaguggcgugaucucagcucacugcaaccuccgccuccgggguucaagcgauucuccugccucagccucccaaguagcugggauuauaggacggcgccaucacacccggcuaauuugcauauuuuugguagagaugggguuucaccauguugcccaggcuggucucgaucuccuggccucaagugaucuguccaccucagccuugcccgcccuccuccugggucccuuuaaauggcgcugggucucaggccucguccucaccccuaugcuuccugccugcccacuccccaggggagcugguuggucccagaacucuaaaagcaccauuacccugagggcucccaagauaguauuuuccccuccgacauugccuucggcuccagucucuucugucaaaccuguggcgcacccucugcauuuccaccauguuccaggcuacacccuuugaucugauccagcuccguccccucagccccaagaauguuuccccaggcuccccaucucaguaaauggcaccaccuccccuaccuggucacucugaccaaggaucaagucauccuuaauuucuuuccuccuuccacauccaacccaucaucacagccuaaugguuuuaccuccaaacuaugucccgagccauccacuucccuccaccuuggagguuacaccccagucccagcagagccgcacccuguaccugugccccgauggccugcauucucucuuguuuuuugugguccauaugacaccggaguguucuuuaaaacuuguaacuccuaguggcugggcaugguggcucacaccuauaaucccagcacuuuuggaggcugaggcagguggaucaccugaggucaggaguucgagaccagcuuggccaacauggugaaaccccgucucuacuaagaauacaaaaauuagcuggccaugguggcaggcgccuguaaucccagcuacucaggaggcugaggcagaagaaucacuuaaacccgggaggcggagguugcagugagccgagauggcgccacuacacuccagccugggcaacagagcgagacuccaucucaaaaaaaaaaaaaaaaaaaaaaauuguaagucccauccuccucucccuugcauaagagccuccagugacaaaauccaaaacccugacuucccacuguggccucgaagguuucacuuuugccugaaucuuugaccuugccccucccagauucccggugacucucacuguucagccacccugaccuguuuucuguuccucaaacugcccaagcgaguucugcacagggccuuugccuggcuuccccuucaccuagaacccuugucccccaaaucuuugcacagcugcccuugugcccuucagguuucagcacaaaugucaccuccucagagaagccuucccccaccacccucucaagaaacucccuccccacccugcccccaucacugccagagcacccugcuuauuuccuugaguaugcaccacuguuagcugcauguuuuuuuaauggcuguguaauagugauacauguuuuugggauacaugugauauuucgauaacugcauauguuguguaaugaucaaaucaggguaacugggauauccauuaccucaaaccuuugucuuuguguugggaacauuacaauucuucuagcuuuuugaaagauacaagaaauuauuaacuauaauuucccugcuguacuagcaaauacuagaacuuauuucuucucuccaacuguaucuuguuuggcacagucuugaucaucuauguguguccugucaucccccacuggccuguaagcuccguggguccagggcuuugccagugucauucacugcugcacagugccuggcauagagaggcuguuggugcagauuuguugcacaagcagauggaugaaucucagauguggaauguugacucuuugucagggagggaugggcucccaccuaggagucuccgaggaccagcucaaaggcuguaaaaaucaugcccugccucagugcucugggggauuagaaagggggugccuggauucucugagacucugcagcugggcucucucgcuuuccugugcgugucaaucacugaucuuaagaaaaugcagauucugguucacaggccugggucugcguuccuagccugcucaucagcaaugguggugcugcugaccucagaucucucuagcagcgcuuuuguaacuugcagguccugugccaucuuucccccuacaugccaugggaccacgcggaaagagccagaggggucccuucauugccuccucugccccuccucccuccauccagcagcaaguguuauuuguagcagucacugucaccuccgcauguggugaggccugcuagguuucugucuccacauuucuguuacugugacagacaagacggauucucugccaggaacugugcucagccacuugcuucuggcauugcuguuuccucucugugcaccucuuauucaggcagacuccugggggauguugccccugcuggaagucaggcccaguucauugcccuagugugggauggggcagcugaccccgcggggaacugggaggcauuaccgagagguuuccaagcuuugguuucaggaguacagguauaggccuaccugacuggcccugggggcaaaauguucauuuaaacuuggggagaggcugggcacgguggcucacgccuguaauuccaacacuuugggaggccaagguggauggauugcuugagcccaggaguuggagaccagccuaagcaacauagagagaccccauaucuacaaaaaaauuaaaaaguagccaggcaugguggcgugugccuguagucccagcuacucaggaggcugaggugggaggaucacuugagccuaggagguugaggcugcagugagcuauuauauuaucacacgacugcacuccagccuguaccauagagagagacccuaccucaaaaaaaaaaaaaaaaaaaaaaaaacaaaccuggggagaguuugggaccuuuggaguccaagaguucugaguuugaauccugaugcugucacauacuacuugggccacgccgaacaaggaacuuagccucccugagccucacuuucuucacuugcuagauggagguuguaacucgugucuuccucccagggucguugucaaaaugaaacaugaaagugcauggaaguaggaggucaaggcaggugaauuacaugaggucaggaguucgagaccagccuggccaacauggugaaaugcugucucugcuaaaaauacaaaaauuagcugggcgugguggugcaugccuguagucccaacuacuagggaggcugaggcaggagaaucacuugagcugagaucgcaccacugcacuccagccugggcacaagacucgucucaaaaaaaaaaaaaaaaaaaaagaaagaaaagaaaagaaagugcauggaaggcucuccgcacuguggaaaauacuggcauuucucaacucacaaugcauagauugugagacauaucaugguccauugaauaucuuuugacucagggguggugaccaggugcugauagcaaggccuggggcccaguccuccucccacaaccgcaucccccccagccccacccacagccaccugcugcucuagcacuagcuagaaaagucagccccugggcauucucaagaauugagcccaccccuuugucagaccauucucccagggcagagacuggccugaucacaugaaaaccacaccugccgagccagagggcaaaugcuccaacauuguauuagagagauuaaacagcuguucucaaccagaucauugcuacauuccauuuccugaccaggaaaaugaaaauggcugucauagaagacagagcauaaagucugauucuuuucuuuuugagauggagucucguucugucacccaggcuggagugcaguggugcgaucucagcucacugcaaccuccgccuccuggguucaagcgauucuccugccucagccucccgaguagcugggacuacagguaugugccaccacgcccaacuaauuuuuguauuuuuaauagagauggaguuucaccauguuggccagguuguucucgaacccaugaccucaagcaaucugcccaccuuagccucccaaagcacugggauuacaggcaugagccacugugccuugccuaagucugauucuuaagauggaaacucagucaggcggccauggcucaugccuguaaucccagcacuuugggaggccgaggcagguggaucgcuugaggucaggacuucaagaccauccuggccaacauggugaaaccccgucucuacuaaaaauacaaaaauuaaucaggcccggugguuccugccuguagucccagcuacucggguggcugaggcaggaaaaucgcuugaacccaggaggcagagguuucagugagccaagauuguaccacugcacuccagccugggcaacagaacaagacuccuucucaaaaaaaaagauggaaacugucugugggcucuagggaggcaguggaggugccaggugaacugacgauuagcaccacagugggaacaggcaggaagaggacuggucuccagucucuggucuccugucugaacaagucuguaggggaggaaaaacuucuccucuacccuuuuauguuaugucugcagucugcaaauaaaauugagcaaagacagauuaauagaaaaaaggcauacgaauuuuauuguuguuuuuaauuuuacaugcaugaaaagccaaagagauggucagacccaggguuuauauacaauuuugacaaaggaagauaaguugugggcaaguaacuaaacaaggaagagggggauuugggcuccuaagggcaguauauucugggaagguagcuaggaaauguguguuagauuggggguggugguuuagauguguuauacagauacauaaccuccccauuggauuuauucuccuuuucaugggacgggagaggggggcacauuuacaaauggaaauuuaugcccuacuuucaggcaccuaaggggagggcagagagcucauccugugucugcuguuucucaguugccuucagcucaaaauaauccuuaugccaaaguggcguauugcaggguggcauauuuggauccccuucaaguuccugccucagucccuuccccaguccucugccuuguacacauggguaccucacuguaccuacucaaacuaggucuccuuugaccacagggagugggucugcucugauaauguguugauaauugguugacuuuacaaccaauauuucaaaacaacugccuuaucgagcccagccugggguuucugucuugugcugugacuugcaacauucuuggucagaccccuucuccucaagggaaacuuuaaucuaggcugaaggggccucugagauggguaccaggcaggaggcaugucaggacccuuaccugcugcagugaaugucagcuuugccaccuucagggcugacgcucccaaggcagcugcacucacccuccgcugagagugccauccugggcuuacaggcagaggcucagcucugacaugugauaucggagaaagucagucaucuucagcaucuucaggucauguuaacccuauuccuuuagauuuuccauuaucuauccuaauaccaaguuccgugucagaaagcgcuguuugcucuuaccuccuugcaaauacgucuuuacuguuguacauuuuguuuuuauucucacggcucauugaauauugcuucaauuucauuagaauugcuacaggaaaccuuacagcugauuugucauccuguguacucuuugauccaauauauucuuuuuuugagacagggucucacugucacccaggcuggagugcaguggcacaaucuuggcccagccuucuaggcucaagcaauccucccaccucagccucccagguagcugggacuacacacaugcggcaccacucucaguuaacguuuguauuuuuuguagagacgggcuuucaccauguugcccaggcuugucucgaacuccugagcucaagcgauccgccccccucagccucccaaagugcuggaauuacaggcgugggccacccugcuggccccuaguacauucuuuuuaggauuuuguaccagaaaagaaguccuuccugaugaaaugauaccuuuuuacaucagauaacaagaguuacagcauaacuauccccuugcuguccuuuuugguuuugguaagucagaaaacuuagagcuaaugagacuggugaaucaauaaaaucugccuuuccauuuaaucauuuaccuccuuuuucucuaugguuuauuuuuauuuuuacuacucuagcuaugaaugugucuuuuauuguaaauaauuucauagcugucaggaagagauaaaaaggaaucuugauuuacuaaggagagacuuauuaaaggauuauuauugccugggggugguggggaggggacuauuccaauggaagcgggagcauugcagugggagagagcacugaccagaagauccuccugcaccuccaaaguuaagccgaaaggguuguucuuuucuaggcaagaguaaacaaggcuugaaagaacuggugcggggagguagguugaaaagguggccugguccugggggccugucuuaaugcaggccaaccuguccuccggagggcuguaaggagggauagugaguugcucaggugaggguggccaaaguucacagaacugggggaaagagagaaacuagaguuuaguuaacaagcaucguguuuuagguagagaaugggaauuuggagggccuuccucacagguucucgacuguguucuccugggggacgaggaccagcuucauggcuugcugugcccugcgcugggccugaccaaguuacuuggucccuguuuguucacugacguugacugagggccuuuccagagucaggagcugaccucucacagagauuccaagaacuagcaggucacacucucaccucuccccagggguccccaguuccggccaugcccuguguccucuccuucuccucaaagggguccccaggccuaaccuggggaagcacuauccauucccucucucaccccaccccaguccccccuggaacuggcuuccugccugcuucuuccccuuucuccgggguggggcgggacaagguggagggagagugggaaggagaggaggagucacccagcugccuccuaggacugauaagagacccagcgggagcuuugaaggcuguuacagccugggggugggagcaggccugacccccaccacccucacccccagccccgcagguggccacaccccuccugcugcccuacccucugucucucaacuuggcccuuucugugccucugugcucucucucuuugugugugucucugucugcaugugugccucccucuccgucccugacuauccucccuuccucucucuccuuuuccccuccccgcucugucucuucucucuaucugcaccccaucucucucuguccugaagucugcauucucaacacagggaaccuuccagucugacccaggucucagcaggagccagacaaaaggccuugagggaagggacagauggaguguccccaugcuaaucuccuuuaaccacccccagcagaccaacccugccaaguagguacugugguacccauuucgcugaugaggaaguugaggcucagacagcaguuaagacguguguccaaggccuuggggccacagugugcagggccaggauuuuuagcugcaucugauccaguugccucagaaugcgggcugaguccaccuuuccugaggcuccucaggugucccaggccucuccucacucccuccaccccaucccuggaggcaggaccagaggacuccuuugaggagcugcauagcuugggagcugcgcaucaggagcaucugcagugcugcaggaccaucuucuacccagaggcaugaagcaaaguaucaugggagccccgcagggcauugcggggaggcaagauucucccagccccuuccugcugcuuuuggaggccugaagauggcucugaccuggauauaggggguccuaaaauggaagcccuuugguugaagaggcagguggcacugagccugccagcuggggcugugccagggguguuuggaggugccucucagaaugggccuucucugcacgggagccugggagaugcaucaaggaaagauguaccagcuuccuggcuguggggcuucugggggucuucaaaaugcucaugugcaccucugggccucccagcacagagguggaggcaguuugccaauguucuuuccucuuggaacccuucaugcaccagcaucuuugucacauuagugaagaauggacuggccuugugggucacccagggugugaaacacguuuggggcgaagcugccacuuccuccccaggagaaaacagaauguggcccuugauagcagugugggguuuagcuggcagcuguuagcccaggagcugaagaccuguggcuacaugcacagucaugugugugaaucuggucccucuauuagccagggucacugcuaccuaacuccaaggggcacuauuaucacuguagucuauggaaauugugcaguacccaaccugugcagcugaacaugguaguccugaucucaacucucacucaucaugucugacaguugcaauggccucucugcugacuuucugccucuagucuguucccucuaguauugccuacacccccugccccgugucaauuccccaguccuacccaccuccaagucccuucuccccucagccaccugucagagagaucuacgaguacucucagcuguucagggauccugggaguagacuccuuccucugagauggaugagccauguggucuugggcaaagcacuuaaccucucugaguaaccccacacugguaucacuuauucucauuuauaaaauggggguaaaaugcccaucagguuguaguuuucuugaucacuagauucuuaacuccaggaggccagauacucucauuccucucuguacccacaucugacacauccucaguuccggugagcguuuuauuauuauuauuauuauuauuuaacaugaaugguaccauaaagcauuuguugaauaaaugagcgcaugucacuuugaccaaaaccuuucugcagcuuccacucccacgccugauggguuaacucaggacuucccaggcacugcugcccuuucuacuccugggcuuuugcccaugcuguucccucuccuagaauucccuguuucuugcagcacugucaucuuugacacagcucggcugccacccagaagcuuuuccagccccuccccccacccaaagcagccucuuuaucccccaccagucccuccccacggccccagauaccucugccugacaguggguugugccccagaggggcuccucuguuguucuggacacagggguggcugggacuuuacccuccuggggucccagggcuuguguggagccugggacuggcucaggacagaaguacacagagugcucuggaaauuggugguggccacagugcuccugccugccuugcggucacucccggcccucucaggugccucuugaggaaaaagcccugcugccuucccagacacaagcccaccaugggcugggacagaccagacugcuaaaaagccuggcuggaaugggauggggugggcacuucauggucaggcuuugggguccauugaaaaaugugucuuugggucugguggaggagcaagcacguuggagacucaugccugaugcuuuggcuuacuaggcuguuguuuaaaaaauaaagugcuuuucaaaugcuuaacucagaaccugacccaaaguaagcaguggaucagugucugccgucccugggagcaggugguguagacucaccuuagagcauggacgucaagagucagaaggaccuggguccgaaucacagcuuggcccuuccccgugagacuuuggacagguugugucaucucugaacguuguuuucuuugccuguuaaaugggcaugacccuaauguacuccucagucuuguugagaggauacaggagauaaauuagaagccgcuggcaucaguuaggauguguguuagagccugacagcaagacagagugcuagaaauguugguggcuauaaauauuacuacuugcuucuauuuucuggcaaagaaccauuaauuucuuggaccucuucauuuucucucucccuccaagacuagugguagcagguggcuuucucucugggaccauuuuuucacagacacaaaguugaguggguguauauauagagacauauauauauuucuucaagacagggucucacucugucacccaggcuggagugcaguggugugauccuagcucauugcauccuccaaauccuaggcucaagugauccucccaccuuggcuuccugaguagcuaggacugcaggugugcaccaccacgcccggccauguguguauuuuuaaucgcuucacaggaguuaccacacacagcuaguuuacagcauugugcuguaaaugcuggcugggucaugugucgagcccccuaccacccacagccuccccuguccaccaacucucaccauccacagaccuccagagcccccacauacaccaccaugaugccccccaaauccacagaccccuacucauagcccuugcugccaacaaccccccugacucccacccuuagcuuccucaccacccuuauagccccaccugucugauaaaauaccuugaggccauuugcagcagaggugcaggugugcagaugaggcagaaaagccccuccacacgcacaagccugggccuggccuuggacucagacaucaucuacguccacaucuccauccacccuacaaagcccucaccaguuccugaggugcacagcuaagaaccaucaccacgauaccaggcacuuacugagcacuuagcuuggcacugagcacugauguaagcccuggaugcucaaauaaaaaugcauggguuaccuugaugcaggacuucucagagcuuuaauaucccagcgccccucuggaugccaaagagggagaugagaguaugcagcauuugcagacuuggccagggcaaccuuucuucagcucuggagcauacuuaggaacauucuguguccuugacauuccuagugugguccauggacucaugcgugucucaucugcaaaucaccugggaucucaaacucccaaugucaggggauccaccugccucggccucccaaagugcugggaugacaagcaugauccacugcacccagccuuuuuuuuuuuuuugagacaaggucuugcucugucacccaggcuggagugcaguggcacgaucucgacucacuagagauacagaaucucacuacagauacagaaucgaaacccauuucuacugaaugggaaucugcauuuuaacacccucggagauucauucaugugcucauuaaaguuugagacacacuuuuguuggucacagggcuggaccuuggccagauauuggaaucaccuggggagcuuuaaaaacuaauguggcugggugcgguggcucaugccuguaaucccaacacuuugggaggccaagauggguggaucaccugaggucaggaguucgagaccagccugaccaauaugaugaaacccccaucucuacuaaaaauacaaaaauuagcuggaugugguggcaggugccugcuguagucccagcuacucaggaggcuaaggcaggagaauugcuugaaccugggaggcagagguugcagugagccgagaucgugccaccacacuccagugugggcaacagagcaagacuccaucucaaaaaaaacaaaaaacaaaaaaaaaaacagggccuagguucuaccuccaaauucugauguaauuggucugaaguuuggcuuggucauugggaguuugaaaagcuccccagcugauucugauguguggccagcagcauagaugagugaacauuagaaagggucuggaguauccgcuuggaaauuugcagggaagcauuuaaagucuuggaacagccccagcgaggcacagggagaacaagggacuuucccgaggucucauagcuggcugguugcaaagccuccaccagcacucaguuuccuagcaccagccucgguccggacucuuagcgucauuaucuccacaccaucuucuauuuuuucuucucuuuuauuauuuuauuuuauuuuuugagauggagucucacuuugucacccaggcuggagugcaguggugugauuuuggcucacugcaaccuccgccuccuggguucaagugauucuccugccucagcuuccaaaguagcugggauuauaugugcgugccaccacgucuggcuaauuuuuguauuuuaguggagacggaguuucgccauguuggucagacuggucucgaacuccugaccucaaaugauccgcccgccucggccucccaaagugcuggcauuacaggcgugagccaccgcgcccagccucauaccaucuucuugaaaauucucccuccugauccugagccucagcuucaguccucaaacaaaagccuugauuggguucugaucaugaggccgccucugcacuuacuuugcuggcugcuggcucagggcuccagcaaacagucccaaagccaguaaagcuuaagccaucaacaugaggaggcguuaacacauuguaaccaccagagcauagucccauuauguaaggaguccugcugcaaggccgcucagcuuaauggagaacacgagacuccaggcaggccuggguuugagccccagcccuggcacuuggcagcugugcugccaucaugaccccuuuagccucucugagccucaucuucccuaccuguaaacugggcacaaugguaauccccugcuacagguggugugcagaucauauaagauaaagaagacgaugagucccgcagugcccuggcguguggugggcacuagaucagaguuaguuggggucguugagggcucucaauuuuggcaccaacacaggaggccugggguucucagcuggccccagcaucucaaguuuccacacagcaagagcacccagaaccucccuccaccaggccagaggcagccagcaugugccuuucucuucuccucagcucacugcaaccuccgucucccaggcucaagcgaaucuccugccucagccucccgaguagcugggauuacaggcaccugccaccacaccuggcuaauuuuuuguauuuuuaguagagacgggguuucaccauguuggccaggcuggucucgaccuccugaccucaggugaucgcucgccuaggccucccaaaguguugggauuacaggugugagccacugcgccuggacuuuuuuuuuuuuuuuuuuuuuuuuuuuugagacagagucuuucucuguuguccaggcuggagugcagugacccgaucucagcucauugcaaccucagccuccugguucaagcuauucucaugccucugccuaaugaguagcugggacuacaggugcaugccaccacacucagcuaauuuuuuguauuuuuaguagaggcaggguuuugccauguuggccaggcuggucuugaacucccaaccucaggucauccgcccaccccauucucccaaagugcuaggauuauaggcgugagccgccgggcccagccucuucuccccauuuguuucuccugugccagacccgcagguucaaggaucauacuugccuguguuugaacauggcuaugaggagaccugugcugucagugugggggacccccccagcuuucucaggcugaucaagcagaaguuggccaugccggccaacaguugguggcauucuucccaucucgugggcccacucaugacagagcagcuguuacugucaugguuauuuuauuuuuauuccucccucugggagcccagaaucaaagggaaacaucagcacugcugccucauuacagagagcagagaaaauggggauggggaugggacauuaucucuuuuuuucuuuuuucuuucuuugagacggaauuucgcucuuguugcccaggcgggacugcagugucauggucucugcucacugcaaccuccaccucccagguucaagcgauucuccugccucagccucccaaguagcugggauuacaggcgcccaccaccacacccagcuaauuuuguauuuuuaguagaaacgagguuucaccauguuggucaggcuggucucaaacucccgaugucaggggauccaccugccucggccucccaaagugcugggauuacaggcaugagccacugugcccggcuuuuuuuuuuuuuuuuuuuuuuuuuuuuugagacaaggucuuucucugucacccaggcuggagugcaguggcacgaucuuggcuuacuauaaccuccgccucccaggcucaggcaauagucccaccucagccuuccuaguagcaggaacuacaggcacguaccaucaugccuggcugauuuuuguauuuuuaguagagacaguuucgccauguugcccaggcuggucucgaacuccugggcucaagugaucugccugccuuggccucccaaagugcugggauuacaggugugagcuacagugccuggccuggauauucucauccagggccuacgggcagucaguggagacuaucuggggugacauauucaucuuacagauggggaaacagguugcacagagccuggaacuucccaaggcuauguugaggccagacuagaaccugguucuccaggcuccaggucugaggucuuuccccuguagucaggaaggaaucuagguuaggacuccaaaguccuccucaaccaguguguccauguuaaaugcagauuccuaggccccauugacuagcccaggauguggguggaccugggaaucugcauccuuagcacgcuccccuaaccaaaguucuagaaugacugcugugaccucuuuccauuggccccagagcuccaggccuaugcuccgggacucugugcuucaaucccacauuacaacucaccauucaagaacugcagccccucaauacggauggcacccuguuaaaaaaaaaaaaaaaaagaaccccagccccugcugggcgcaguggugcuccuguagucccagcuaauggggaggcaggaggaucgcuagagcccaggagcucugggcugugaugcucuauguugaucggguaucuacacugaguuuggcaucaauauggugaccuccugggagcaggggaccacaguguugccugaggaggggugaacaagcccaggucaaaaacagagcaggucaaaacucccguguugaucaguggugggaucgcgccuaccaguggccacugcacucuagccuggguaacaucauagcaagacccugucuuuaaaaaauaaaaaaaagagccaggugcgguggcucaugccuguaaucccagcacuuugggaggccgaggcgggcggaucacaagaucaggagaucgagaccauccuggcuaacauggugaaaccccaucucugcuaaaaauuaaaaaaaaaaaaaaaaucagccgggugugguagcacgcgccuguaagucccagcuacucgggagggcgagacaggagaaucgcuugaacccgggaggcggagguugcagugagccgagaucacgccacugcacuccagcuugggugacagagugagacucggucucagaaaauaaaaaaagaaucccagccccugacuaaucuacuucauuuacagcauugcuuaucuggugcacuugaggacagugggucccaggggaaggaggcagagacagugucauguugugguuaaggacauacacccuggacccaggcagcccgggauugauuccugaauccgccacuucuaguccugugaccuuaauguguuucuuccccugucggugccuuuguuuccuuuccuguagguggugaugccuuccuccuaagguguuaugaggauuaaaugaauuaguaaaaaguacuuagguuagugucuaucgcauaguuaugugcuaaguguuagcagcuguuacaccauuuuacaggcugagaauguuaugcagagagaugcugagacuuugccgagguuaugcagacucugaguagcaaaguugguuggggcuucuacacucgucccacauaguuccugccugggcgucuaccgccuuccagugccaaccguggcuccgcugguagauuauagcuuggcagaaaaagacccucugcacucccccauucacucauguaccuuccuacacacucugggguugggguaauuuccccagucccaguagccaggaaggcagagucuauggaaaccagguggccauacagagcaaaguugagcuucccuuagcccucagagucccuaauggggacccagggaugcuaccaccuugagucucaaaagcucaagcuuuauuaugucaauucuuauuuauacucaaagcuuauuuccauuuuucuggacaaauuuacacuucaaaucucugcauuuugguuuaaaggaauguucucaaacauuggcucuccuggcucuuggugucaacaagaccacuuccuucccugucuggagaagaaaauggaguuaaggcccaguguccuuaaaccauaccuccugcaucuagcuccugaguauuucuuucuuuucuuuucuuuucuuuucuuuuuuugagauggagucuugcucugucgcccaggcuggagugcaguggcaugaugucgguucacugcaaccuccacuucccagguucaagcauucuccugccucagccuccugaguagcugggacuacaggcgcaugccaccacacccagcuaauuuuuguauuuuuaguagagacuaaaauggggguuucaccaaguuggccaggcuggucucgaaugccugaccucaggugaucugcccgccucugccucccaaagugcugagaauacaggcgugagccacggugccuagccacuuccuaguauuuccagaaaaaaacagaaagcagucucuucuugguacuccccuucuucauccugcccucagucuuucucucugacuuaauucucuucucugagugguucugaugcuaaguuuggcccagggacaugacagaagucuacauccccacugaucucagccucagaaugggcuuugugagcacauucugaaacucuccaccuggggagagaguagucccagcuacucucucugcucugaggacugagggacugagugaggccauucaagccuguggagggcccaggcacacacugccccacuccugccacccaccgcucuccaucucagugcccaagggagggcagcuccauuaccgcucuuuuccucuucucccaucccugcugugauagaaucugccccgagcuuggggcccauucuaauuaagguaacugaaugcccaggcagcugaaaccggccuuuugcaaaauagcaaguggaaggccugcccuugaggcccagccugccagcuccuguuugcccuugccugguguucgagaugacugggcccugcagccccagugaaggaggggccugggaaggggaaggggacagagagcagguuuauucggggugagcugcgcugguccauuguaguuugcacucagugcuuccaggagcuggaaaggcaaacaauagauuugggucacgagggguugggggaggagauggucagauuuagcaggauucugaugccaaguagcuggugcuuagggcucugggcugugaacuugggacucuucugaucagagccucugucucccuuccucgcuucgucucccuuccucgcuuccucugcucagacccccacacacaugcaaagcuggccucaggcagacacaugccaccacuguucugggcuccuuuccuuagauuugagaggccuggggcagaguggagagggcuuugguccugcauccaaauccuggcucugaauguccuugcgcagguuauuuaaucuuucugugccucagccuucucauaugcgaaaugggaagagcaaugcauucucugguggaucuggguuguguggggccugaagcucuuaccacauguagagcccuuuuuaagguaaagaauuucuggcugggcacugugucucaugccuguaaucccagcacuuugggaggccgaggcaggcggaccacaaggucaagagauugagaccauccuggccaacauggugaaaccccaucucuacuaaaaguacaaaaaauuagcugggugugguggugggcaccuguaaucccagcuacucaggaggcugaggcaggagaaucgcuugaacccaggaggcggagguugcagugagccaagaucgcaccacugcacuccagccucgugacagagcaagacucugucucaaaaaaaaaaaggaaucucaacaucuugugcaaaguuuacaaacacuuaaccaugugaacacacuggcagggccccucuggagcacgugaggguccuagaagcuuaagcucuguuagcuucacaguaaauccagauguauacaugccuaccugauaggacugugagggauuaaaugagcucauauuugagcuccuagaacagugucuggcacagaauaagccccucguaaguauuggcuuucauucuuauugcccucaggguuccugugagcauuagacauuugcagauugcccaaguaacaucaaacguggugugggcagaugcugugcaccugacacaugcauucauuagcucaucuaauauguagcguucacgaugggccaggggcuguucugagcacuggggaaccaauggccccucuuaaagcuuucggucugggagggguaauugggcaguuacucacacacauaggcagguccaaauggaaugaggacaggugcuaugagaaaacaaggcaaggccaggcacgguggcccaugccuacaaucccagcacuuugggaggaggaucacuugagcccaggaguuugagacuagccugugcaacauaaugagaucuugucuccacaaaaauaaauuuuaaaaaaaaugagcuaggcaugguggugugugccuguagucccagcuacucaggaggcugaggcaggaggaucacuugagcugaggagguugaagcugcagugaaccaugaucaugccaugccauuguacuccagccugggugacaaagugagacccucucucaaaaaaaaaaaaaaaaaaagcgagacuauaucuaggagaaagaaaagauuuugauuuggggcauaaggaaaggccucuuugagacauuacgaaagaguagggaagaauucuuauucucauuucugguuugcuugcaguuucugcaugucuauccguaaggcaaucuggcauggugacauuaauuaaagcaacuaaaccguuuggcgguccaacuaaaaucuaagcaaauauugucuccucugagccucucaacaacucugagaugaguaagcggagacccaggcaagaguggcuuuaccugagcugacauaaauacuaaaugaaggagcuggaauugaaaucuccaccugacugccucacagguccuuccuucacaccaugugccugacacagagcaggggugccccugcagacucaugugaccucaugaccuucucagaggccacacagucuaaucuccuccccucucacugugggaacagaggaagccgagggccugagagucgcugcuucugagacccaucccacauccucugccugccacuaucaaagugguugugaccucccugggguagcagaguccaagaacagucagucucccagacacaggaagcccuccugugguccucaggcaccugcaccauggguaugcagaucuggcccucauugaugcaaacaccagcccucuccuggcuuucugcucuacccccuggcacauuucuuccuggaagggugauugaugcucugcuacuuguggccuuggaggugcucacagugagagacaugagaugccuuaaaaccaugaaggucagaguucaaaaggcaaguaggcaagcagggagagcccaaguauugggcccacagaacuacaguagggaagcaggcuuauaucugagcauccccacaggccuggcagaagcaggaauggaugauacauggcucucaugauccaauggagggaagcaggugcuuaacacaugggcuggguguggcaccauggggaugagugcugccuaagcaccuaccaugugccacccacucugcuaggugcaugaagccaguuacugagugggccucuuaacuguccugugugguagguacguuuaucccuauuucacagaugugagcacugaggcucagagaggcaagugaacauugucuccucuguaaugaccguccccuauaaacuccuggcaggagggccuugccagcugagucauggcacucaucauaaaggcuucaaggaggaggggagucauuauagaggagacaaugggccacauaguagaugcaguuuucuguagaaguuuuauuuuaaaaaucaauguuauuguuuuuaaauacagaaacuuuugauauuuccauuagcccugguuaaaagcugaaggaaauguuuuaaaaucauaugucauaaaaguaugucugggaaauggaagguuuuuuuuuuuuuugagauaggguuucacugccacccaggcuggagugcaggggugcgaucauggcucacugcagccuuggccuccugaccucaaacgauccuuccaccccaaccuccuguguaccugggaccacaggcacacaccaccaugcccagcuaauuuuuuuuuuuuuuuuguagagauaagaucuuacuguguugucaaggcuggucucaaacucauggccucaggugauccuccugccucagccuucuaaagugcugggauuacagacgugagccacugcgcccagcuggaaaugggaguuuuuuaaguguccaggauuauaauauuuggucacauaucagugccggagcacucauagaaaugcacacauacugaggucacaggaacuaacugcuuuagacauguuaccccagccaagcccccaacaaccucgugagagagauacuauuccuauccccauuucacagauaacaggcucagcugucaagcaggucacccagcugggaaguggcggagcccagcugcaaagucagggcugcugaaggggagagagguggccgugugcccagcugugagcaggcuagaggugcugggggacagucugggugugcacagaagcagcucccgagcucucggugcuaaugugaggaugaaaggcccccacccugcugcugcccagugggagagccugacgcucaaguuggcgaugagccuugcaggcugggccuggaugugugucugaaacagggagccuuuucagguggggaggcgcccuggcugaagcccucaaaugcagagucacggggccgggcgcaguggcucacgccuguaaucccagcacuuugggaggcagagguggguggaucacaaggucaagagauugagaccaucccggccaacauagugaaaccccaucucuacuaaaaauacaaaaaauuagccgggcgugguggcgagugccuguaaucccagcuacucggaaggcugaggcaggagaauagcuugaacccgggaggcggagguugcagugagcugagaucgugccauugcacuccagccugggcaaaaagagcaaaagucugucucaaaaaaaaaaaaaaaugcagagucacagaacaggaaaggggcugcccaccugaggucagguccccagaccuuggcugagcaccgcccugggcucauaaagaaccacugugcagugccgcgugaugagugcuccccccauacccagcgcagggaaccuggggagagaguggcugguucugcccugggggucggggccagccgcagggagcuggcagccaagcugggccuuacgcgcugagucauggcucucaucauaaaggcuucauucagagacacggccacaggcggccccagcgcucaccaucccugguccucacaaccggcccaggaugaaucccagccgcacaccagggauacaccugcgcacaggaagacauggucccuucucucaaagaauugcggucugaggggagaagcaagaccaugaacacggaaauaagucaguagcgcccaugcugauagagaaagugcaucaagaaggcgaagcagaagggaagacagggauggccaugguggggguuuuucucuaggaagagggccucaugcaggaggugacgugagccgagccagacagaagugagggauggaggccaggcauggugguucaugcccguaaucccaguacuuugggaggcugaggaggguggaucucuugaggucaggaguucgagaccagccuggccaacauggugaaaccccaucucuacuaaaaauacgaaaauuagcugggcgugguggcaggcaccuguagacccagcuacucaggaggcugaggcaggagaaucgcuugaaccugggagguggagguugcagugagccgagauuaugccacuacacuccagccugagcaacagagcaagacucgucucaaaaaaacaaaaaagaaaaaagaagugagggauggaggcacgugaggugggggagugggaaagagcuuggcuguuugguggcugagugaugggaagguggaauggaauggaaggaggacccgggcagagguucugagagcacaagcaaggagucugcacaagaggccaggcaagggcuuuuagcugggaaaugacaagaccugccugauguuuuaaaaauaucccuggccagucacaguggcucacgcuuauaaucccagcacuuugggaggcugaggcagguggauugcuugaggccaggaguucaagaccagccuggacaacaaagcaagacccagucucuaccaaaaaaaaaaaaaaaauuagcugggcaugguggcauguuccuguaguccuagcuacucggaggcugagaugggagcaucacugcagcccagguguuagaggcugcaugagcugagaucacgccacugcgcuucagccugggcgacagagugagacucugucucaaaaaagagccccugcagcaccuggaggaagacagcacuggaaucgggaagaguuaggugguugcauuuguccagggaaaagaaggugagaaggaggcggucagcucggccaggcugccaggacugcugauguagguggaggaaagagccauccagggcuauuccaugguccucaccugagcuccugcauggagguuggugcgauuugcucagcgggcauggagggaaacuugacauuugggugguaagcauguuaauuugagcugcccacuggauagucaguugaagucgucugcacacugugguaugcauccacauccccuugagguccaaggccaccugccagaaguguuggcugcugcagaccguccccaggagccaaaggggcugccuugcccaagaugacagacccauccuggggcagcccucaucugaaggcugguccagguggggacacaaugauuuugcccccuugccucuuucugggcaacuuugaaggacuaucuuggcuccagaugccccggggaucagcugaggcucauugcagcugcaaugcaauccacuucucccucugcccauccugcaucccuugugcccucacaggccaagcccuaagacauuccccagucaacuuccucacaggcaauuggaugcauuuaguucggagcuccaggaagaggucuaggcuggguggcaacaaugugggguggggacaucagcacugguggaauuuaaagucucaggcuaggugagaagggaagaggauugaagcacagagcaugccaaccuugagagcugaggagguuggagggguggugcccuggaaccaagcuaagaaagguuuaaagggaccaggugcgguggcucacaccuguaaucccagcacuuugggaggccgaggaggguggaucacuuaaggucaggaguuugagaccagccuggccaauaugaugaaacccaucucuacugaaaauacacaaguuagccaggugugguggugcaugccuguaguuccagcuacucggggcugaggcaggagauucacuugaaccugggagacagaggcuucaguaagcugagauugcgccacugcacuccagccugggggacagagcuagacuccaucucaaaaaaaaaaaaaaaagagagaaaguguuuaaaggagagauccggugccuguaaucccaucuacuugggaggcuaaggcaggagaauagcuugaacccgggagguggagguugcagugagccaagauugcaccacugcacucuagccugggcacgacagagcgaaacacugucucaaaaaacaaaacaaaacaaaacaaaacaaaacaaaaaacaaaaaaaaaacagagauucaccucaccaggugcuaugaggauuguuaagguaagaugaggacccgugacacucuaguuaguucauuucaaccgcugugguguucagggaggaacuugaaggaacguuuaaagccaggggcauaauguggugaggagaggaacucauagagaaggagaaauggaugauucagaaggggagggcaggagcaaaaccuugaaggggaugggguccagggcccacauggaaggguccaucugugaauaaugcuuuguaucaagaagaaggcagaguagaggcaccugugcagguugguguguagagcugguggggaggucacugggcauggucacuggcugugagugaguggugggaagcagugcuggagaugagaagacaagaagagaggagagucagcuuaaccugcaagucucccagcugcaaagggcacuggugcgcuucaaaccugacucugggcuucauucacuggaaaaagcacaaagaaagacauucuaagcugucaagacgugguagguucagcaaauaauacuaguuacaguaaaaagaugugagcuguugcuacgcuuaagcauucgucgugcauucuuucauuuaacaagccaucccucaaaaccccugugacacagauacaguugguccuuauuacuugcacauucuguauuugcaaauuugccugcuugcugaaauucauuuguaacaccaaaaucaauacucgcagagccuuugugaucauuugcaaacauucucacgguggugaagaugugaguugcccaacgugcauguucccagcugaggucaaacaaggcgacaagcggccuucuuguuucagcucucauacuguaaacaaguguccucuucacggucuaguuagugccacguuuucugcauuuuugugugguuuuuuuuuuuuuuggcgauuuugcuauuugaaauggcccccaaaggcugucuaguguuccuaaaugcaagaaggcugggacgugccuuguggagaaaauaacgacugaguguuagauaagcuuugcccaggcaugagcuacagugaguucaauguuaaugaaucaacaauauguauuaaauauagugucuuuaaacagagacaugcuuaaaacaagguuaugcauugaucguuugaugaaaauguugugaucagaggcucacaggaauugaaccaguauuuccccuaggggcaaugguucaguauucacgauucuguguuuguagugacuucauagagcauaacuacugcaaauaaugagaaucgacugaacuuuuuuuuuuuuuuuuuuuuuuuuuuuuuugauacgguguccuccucugucacccaggcuggagugcaguggugcaaucuuggcucacugcaaugucugccuccuggguucaagugauucuccugccucagccucccaaguagcugggauuacaggcacgugccaucacgcccagcuaauguuuguauuuuuaguagagacgggauuucaccauguuggccaggcuggucucaaacuccuaaccucaagggauccacccaccucgggcucccaaagugcugggauuauaggugugagccaccgugccuggccucguguguacuauuaacucuguuggucacauaagaaaccaaggcuaagagacuagacgagcuacagguaguaauagcagagcuggggcugaaaccugggcugguggggcacuagggggcuucaccccaugaauguggccuugugauccaguggggaccacaggggaccuggccuggaagaaagguuucuuuuuuagggcaccccaugagcagccugccuccccacugcacuggccucuccaguuucuacgugaacacagaagcuccuucagcccuccugggcugcagccacagagcuguugcugggccgugguuuuccccuaaguggguggaacaguggcuccguguccagaggccgggcaccuuugguuuuccuuugcccagcccagcccuggcaggggaggcacaaaggaggcaucugugacugagcacggaggccagccagucucccgacaccagcccauccggucugcuguggccuccuguuuauucaggggauaaacuugggcaggccccagggagccgcccucuccccagccccaccaccuucuccacagggcagagucugcagcccuucuucugucuuuugugggguagcuugcguguugugguuugggauacuucuucaucccagcaucacugagauaauuuaggagacaauugcgggggacucugcuuucagaguggaguuacaagcccuucaguguguguccuuccaaccccagaacagacucagagucgucaucguccacugucaucccgccucucaggaggccgcuaaaucugagacuaauggcugccaccuggaguguuccucaggcagggagcaaccacacgacugugaggagggggcacuuaccugguggggggcucagugcuccccuguggggcugaggaaggagccugggcuuggggagaagcugggugcuccccgcccacccuccuugacccaucagauauagaugagaagccacggcugggagggugcgaagcugacagcagagccccagguccccagacaagcuguggggagaagagcagcgcgggcgucagaggcgccuggacaggcagccggcagguccacagcaaggcugcaccuuguucuuccuuggucucuggguggccagcacuaggucuggccugcgguuucugcucagugauucuuguuugaguaaaugaaugacggggugaaugaaugaauggucuugguucuaugaugguuacuuuggggaaguuauuuuauuauacaaaaccgagccucucuuuuuuacauaggauaacggcuaggugcacagucucuggagccaggcugccuggguuugacuccuggcucucaacuuacuagcuguauguccuugaguaaccucucugagccucaguuuccccaucuguaaaauggggauaauaccugccucguaggguugucgggaggauuaaaugagcucauaucaugugaagcacuagaacggagcuuguauauauuaagugcuauguggccauuugcuguuaauacuuuuuuuuuuuuuuuuuugagacagagucucugucacccaggcuggagugcaguggcuagaucucggcucacugcaaccuccaccuccuggguucaagcgauuccccugccucagcuuccugaguagcugggauuauaggcgaccaccaccacaccuggcuaauuuuuguauuuuuaguagagacgggguuucacuauguuggccaggcuggucucgaacucuugaccucaaaugauucacccgccuuggucucccaaagugcugggauuacaggcaugagccaccgugccuggccagcuguaaauaccuuuaagaugaacauaacgucugccuuccgcgcguguugggagccuggugcauuguuugcccaggugugcucuucucagaacacugaucccuuguguuguuaaauguuaaauaagaaggguccuguccaagcccaguugccuuaaggaagccugggguuaaaagcuagggaggcuucucuccugcagaggugccugugacaucuucaagagggagugaagaauuucaccggcugauuugaccacagaucaauuucuugcuaucagagugggaugggguuuccacaaaacacgucuuugaagacaacaaauacugcuuccuucccucccucccuggagcccuggccucauacugcuuagcuuaucugguagcagccagggaaauggcaggaugcaucucccugggcuuagaacuggggcaggaggcagcagccaagucaacagcagguaguggccaguccucagcucuaagccagcagguaggacugcagaggugcauguggcaaaucauagacaccugaugugggcugccacugacugagacacugcugagcuggacagcagacaccugcaacccaaggaugaugaagaggaacuugaggccuuuaauugcucauggucuucaaucauccuuaccaauuaguuucugcugcuucccaggcaauuccgguugcuguaaguaagccagugaugcaacaagagaggcagaagggaguccugaacgugggccagaucuggguacaaaucuugucucugccaccacuuaauccucuugagccucaguuuccuuauuuguuucaugagugcaguaacaucuacucuacaagauuguuggauuaaauuaagaaaugaaguggcuggcacauaguacauagcuguuaucaacaauaggcugcagggaaauguucucuccuugguuucagggcccuuguccaagguucccauuagguagaggaauuguuucuucagaguugagaucugaugugucugggaagagggcagccugacuugagaaggucucucaccuuucaaaugcccaucucaggaacuucagaaaaggcuuccgcuaauucaaaaaucaaguccucagcuuuccauugucugugggugagggauucucagucccauucagggcccuaaccauuccccaggugauuacugugugccagacauguuaggagcuuaaguccaaagacaccaggggcauggacccuguccucaggaauugcagaaugguaggggaccugacaggaggccaauccugacaauucaguguguuccucuuaguaacacagcuugugauugaggcauagacaucaugaagccaaggaauaauuuauuaucacuggagaagacagggaaggcaucaccugggaaaucauaccuggguggaguuuugaaggaugaauaggaguuugccugguggacagaggaggccaaaaguuugguacuaaaaacagcauaccuacucuacucccaaccaccucccuuuucuaggauugguguggguccaucugccguuagcaagcuuugugacuauagguaagucauuucuucucucucggccuguuucccauuggugaaaugggaucccuuccagcuuuaaugcauugugauuucauguuuauauaggccuagauaauuguuuuaaaguccucauauuugcaaaacacggggcaaaagucuuugacuuuuucucuucuaacgcaucucccagucuuacaaaguugguuguacucucuccauuugacugaggaggaaacugaggcucggugaaguuacuugccuuuagccaauauguggcagauccaggccucaaauccaggucuucuggcccugaguuccacuguuucuccacugcuccacacggccucucaccccacaagcccucggcggcugcacauaaaugauccuugacagauuacugccucacucaggccccugucagauguuacugcugacaguuggggaggaggaggagcgagaacauugugugccaggaugccaggccucggcccugaaggaggagcuuaugagaaagaggcaagcagggaggcagcagguaggacauugagcauggucaagaaaggcuguuuuggccagagaguggauaaaugauaaagucuggaguagcaggcaagugcacagccacccuuuccugaagcaaaaauuggugccuaaauccauagugaaaauagucccccuggccgggugcgguggcucacgccuguaaucccaccacuuugaggccgagguggguggaucgcuuuaggucaggagaucgagaccacccuggccaacauggugaaacccucucucuacuaaaaauaaaaaaauuagcugggugugguggcacgugccugugaucccagcuacucgggaggcugaggcacgaguaucgcuugaacccaggaggcagagguugcagugagccgagaucacgccacugcacuccagccuggcgacagagccagacuccagacuccgucucaaaaaaaaaaaaaaaaaaaaaaagaaagaaaauagucucccugccuccagggucucucuaugcccauacccugcuuuguuuuucuucagagcacauauuauauaugucacucauuaauuuauuguuucaucaucugacuucucccacuaaaaugucagcuccacaagaaucaaccaagacuugguacugaucaaggcugugucuacaacaccuagaacagagccuggcacuaacuguuuugaacaaaugaaggaauuaaugaaggaaugacugaaagaaugaaggaaugaaugaaauaaugaaggaaugaauuaaagaaugaaugaaggaaucaaagaacaaacgaucccuucaccugugaucaugucagcacccacuguugucagcaagccuuuagcaaagcaguucccaaacugcugcaucagaaucacugggaucuuuaaaaacugccaacaccuggcuuccaccgugacauucggauuagguugccaugggguauguuauugacauuuuuuuagguucaagugauuccaagcguuuuuuaaguucuucaagugauccugaugugcggugcaguuuaggaaccacugcuuuaaaggguuguccacuccugaaaaagggcaguccacuccuacaaagcuucuagcugaguuaauagccaaucagagacauggguaguggcacgcagggugggaccucugugcugcccaagucugggaggagguggggagggugagguguuuggggaaaggagaguuguuuuugcugccuggguuuugcugucuggguaacucugauguuaccaagaguagaggaaaacgaaguuuuucuccuugcucucacccaauucaagucaaaagaacaccuugcuggacuuccuccuccccugccaccuccucuucuuggaugacugaaugagucagggggcuuguuuguuagggaggaaacacugguuuucucaccauuuucccccuuucguugagcuugaaugaguaagaaaacccauuguuuauacaugcacagguugacacaaauagagcuuggagcuucugaagacucaaccugggcuccagagucaauaagaccaggucccaccccgucugcacagcauccagccagauguuacaagagaacccagccccgggggcaggcuggugaaaucaucccggccaguggacagucaccaacaccggaguguuugccaagggaaacaccuuguuuccacaguccaagauccucuccugggcuggcacagaguugcagaauuggaagagaccuaaagaugugcuguccagcuaaaagcucuuccaggggaggagucugaggcccaaaaaguuagggagagcccagaacccaggccuccugcaucuucacuggguuuggugggaagaggcagaggaaggaguggucagagaagaugccagcuuagugcagaccccuagacacauccccacuggcgagagagggcuuuuggauccaagagucauucccauuuuuuuucuaaauaaaaaauugggggccaggugcgguggcucacgccuguaaucccagcacuuugggaggccgaggcaggcagaucacuugaggccaguucaagacuagccuggccaacauagcaaaaccccaucucuacuaaaaauacaaaaaguuagcuaagugugguggcauaugccuguaaucucaguuacucaggaggcggaggcacaagaaucaccugaacccaggagacagagguugcagugagcaaagaucgcaccacugcacuccagcuugggcgacagagggagacucuaaaagaaaaaaaaagaaaaaaaaaagaaaagaaaaaaaauuaggaaugacuuuccuuuggggucaagaggccucugcagucucagaguccugccuauuugcuugguagucccuucccuaagccacugcuuaagucaucaaauacugaauuuaccaccugggaugaaagcugagauuuaagaguuguagcugaacuuccugagcguggagucaauggaccucugagagagaggugagagaggacaaguacuugugguaaaguccuagccagcugccaggggggcuuuuccacacauagagccccagcugggcagaaauaauguccucuggccgggggcaguggcucacacccauaaucccagcacuuugggaggccgaggcgggcggaucacgggaucaggaguucgaggcuauccugaccaacauggugaaaccccgucucuacuaaaaauacaaaaauuagccaggcguggugucaugcgccuauagucccagcuacucaggaggcugaggcaggagaaucgcuugaacccuggaggcggaguuugcagugagccgagaucaugccauugcauuccagcccgggugacagagugagacugcaucucaaaaaaaaaaaaaaaaaaaaaaaaaaaaguaaagaaagaauguccucugugugugcguugacagaaucaagcccugcuaagauggaccagguuugacugaugcucacaguccugauuaaugacugguguccaccuuggagagcacuagacugagaguaaugcaaccuggcucuacuccuggcuccaccacuaacugagugugcuacuugugaggggagaugccauuucccaccucuggggcucauuccccugucugggaaaugguuauacuauaccagugauuuuaaauauuuuuaaagccauagaacccuuuauucacaugaaguuucauacagaagacagcauguacagcagacagaaguggagcuauuuuugugguuccccuggagcacaucuucccuuuugcgaagucuccacagaacccugaggguuccaacaaacucaguuugagaacaacuugccagacuuuuuguuuuagcuccaauacuauuuaugucagcuguuguuuguucacuuggcuaauauugguuggcaucaguugcuuggcuaauguuaacauuagguaauguucagaaggguucuuuucucaaaauaaugaucaugaaaccauauauauauauauuuagccagucguuccacauggccccaaacaugugcagaauguugcuucuuuacaccauccaauguugagcuaacucuugcaugguggcagcgaaagaaaauagacacagagaggccaggcaugguggcucaugccuguaaucccagcauuuugggaagcugagguggggggauugcuugagcccaggaguuugaggcuacagugagcuaugauugugccacggcacuucagccuaggcaacagagcaagaucuuaucuuuuuuuuuuuuuuuuuuugagacagucuuccucugucaccuaggcuggagugcaguggcacaaucuuggcucacugcaaccuccaccucucagguucaagugauucuccugccucagccuccagagugucugggauuacaagcgcucgccacuacacccagcuaauuuuuguauuuuuagcagagacaggguuucgucacguuggccaggcuggucucgaauuccugaccucaggugaucugcccgccucggccucccaaagugcugggauuacaggagugagccacugcgccgggccugacauugucucuuuaaaaaaaaaaaggaaccucacagguaaugcuaagagaccaggguaccuaacucaagaccuuccuuccccacauccucauagguggugcuaugcucagaaggcaggauuauauuuccuauuaacucacucuuagcccccguuugaaccaaggacacugaauccuagccuguguuagagcccucagaucccauauucauccugugucuaaucucacccaucagauacagucaccauccccaccccaccccccacuggacuaucauugcuucucugaacccugcuggaaaguguuagcccuucccucaaaagucaggguccuaaauuuucccucaggcugccucuaauccucaccucuguuccccucagccucuugccauaaugaucauuaguaauagcuacuguuuauugguuaccugcucugugccaggcucuguucuauguauuuuacugguccugauuauuuugauccucacaauaguucuaaaauacauacuauuauuaucuccaauuuaaagaugaggaaauugagacacugggacuuaaacuugccuacguucauuuagcaacaaggugguaaagccaagauauggcccuuggccccggcacccaugcacagaaccagugcgucagacugcagcucacucaugcugcugguagugacuaggaacugccauuuauugagcaccugcagcaucuuaggcauugcacuagacacuuuaucauuucauugaaacuucacaacugcaagaggaaaugucuuauuuccauuuucuagagguagagacugaggcuccaaaacauugacuucccuugauaaguggaaccgggcaggcuucaaacccaggaguguucaaugcaucuguggccuuucucugucacucugcuuuuaaggacaaguaccugcagacauuccccacuccacuaccuuugagaaaaauaaagaaggaccuacugauaccacccguuccauagagcucuugagaaaugucgcucaggcugcccaugguggggacagggagggggcuugacaggccugacuuucuccauugaccuucucugggagagagucacgaccagagaagggaugaucacccuugguuucugcuuuucuuucuugguucuggacgauccugucaugugaccugcuuugagccuaauaauccuuaggggcaacaucggacuuggaagggaagaagggaaaccaagauagaaccccuggacucagccacauccuaaaaccuuuugggacacugcugagcuuaaggucucaggguggagaugggaaggcagauagagugggcccagggugcaugggcucaaucgcauaccacaccuuugaggagugccuaaaauuaaguguagucacugugcuaggguguacaacauccugugagguaccauucccaucuuacagaugaagacauugagucuuagagaaguaacagaacuugucccaagacaucugggaaauaagacucaauucaaacccaagucuguuugauuucaaagccagugguaugauacaccacauagguacucuuauuuuuuuuuuaaauagagacagggucagccaggcgcaguggcucacgccuguaauccuagcacuuugggaggccaaggcgggcagaucaugagguuaggaguucaagaccagccuggccaauauggugaaaccccgucucuacuaaaaauacaaaaauuagcugggcgugguggcacacaccaguagucucagcuacuugggaggcugaggcagaagaaucgcuugaacccaggaggcggagguugcagugagccaagcucacgccacugcacuccagccugggcaacagaaugaaauauaaaucucaaaauaaauaaauaaauaaacaaauagagacagggucuugcugucaaccaggcuggagugcaguggugccaucauggcucacugcagccucaaacuccugggcucaagugauccucuucagccucccaaguagcugggacuacagguacgugccaccacaccugccuaauguuuuuauuucuaauuuuuugguagggauggggucuugcuguguuguccaaucuggccucaaauaccuugcuguguuguccaagcuggccucaaauaccuagccacaaguaacccuccugcuuuggccucucauaggcacugggauuacaggcaugagccgccacauccaaccaacauguguguucuauaugauacaccacagugcuccuguguguuagagacugugggagcggacccaaacaagagaaacagucuggccucugcacauauaucucugaacagcaaggcauacuuuccgaggagagggcuggggcaguggaguuucucuuggggccacagcucuagcuccucucuuagguggcucuggccaggaggcccuccuguaccuaaugcugucccauuuggaaaguccccagcaguucugggagcuccagcggcugcuuugccucagagacaagcccugguaaacauaggggccgcugcgaauuuacuggcaggagagacugagaaggaaguugacagccaagaggcagagaagugggcaaagcuggugcgugugugcaugugugugugugcauguguggguguggguggguguguaggguggugcaggaccaaagcacccagaugccccacugguccugcccguaccaaagugccguugccacuuuguuggccagugaagacucagggaaggcaaagguggcuuugagccagacaggaagauaaaucucuccccucacucaaguuauauagugcaacagcaggucaaagggcaaccacauuugcaauauuugccgcuuuacauucaucucauuuuugucuuuuuaaaguccagggcaugguuaagagugauggggggauggggaguacauuuuuaaacauuuaauuuuuuguagagacgagaugucgcuauguugcccaggcuggucucaaacuccuggccucaaagauccuccgccucggccacuuugucugagccacugugcccggccugaggacacauguuugacauaaauaguauuuacuagcauucaacaggaaggguccucuccuuuuuuuuuuugguucuuuaguucucguugccgcuugguucuuuguguuccugggcugguuauggagaugguuccgacuucacaugaaaaggcuggaaaaguuguggguaggacucuggaugaaagucagccuaggcgcccccggacucauuaggggguggaggcggcggcggaccguguggggcggggugcgcagugugagccggggagcgccggccggaaucucacagugcggugacaaaaaaccgugaggguggcgcagaacgggcaagagacuacagcgccuaccuggcaggggcgcgagcucacacgccgacuccuggagucccagccagggcugcccugagcugggcgcgcccaggcgagcuccaccuccggaggcggggccggccgcgcggccauuggucggcgcccuggagccaccugccccuaccuugggggcgggguuaccugggccccgccccgcggcucggguuccggggccgcgucccuguccuccgcccccgcccccgccccgccccggcgcgaggccccgcccccgagucccggggcccaggcgccucgugaugucaccgcagcuugauacaaagagcccuucggcccacgcgggucucccggcaacgggcgggggcggggccgcgccuuccacuggugcccagaagugcgagcggcagcggcgcggccgcgauuguuccugcgcuucggggcugcccgccgcguccccgcgcgccgccgacccgcgcccgcuggcuuccgcgccucugccggggagcggcccgcggaugcgcaccccgccagcucucgggagccagguaagcggcggccccggggcuggcgcucgcagggcuccggcggcgcgcaccuggcucggcccggcccgcggccccgggaaguuggcggagagcggacuuggccugggaggucguguuaccugagccaucucguucggccgcgaguagaagccgcugccaggugcgcggguggcggcuccuuccccagcgcaguuccaggaagugcuuuuaguggacuaggaagggggcucgucugcuggggcgccucccuggggacccgacggcgggccccaccuccggccgcagcgccccugcccuccugcccuugcgggaucggcgugguacccagcgccguacccuugggccggguccccgagggggcugagcgccgcgaaguuuuucuguagcucuuggcggcugcacagagccuguuuccuggcuucccccgucccucugggaugguggagguggggaguccucggggccagcccaggucgugguguggggccggggcccugccucuccccagccgagaagcugcaguggugggagguguguuguggcccuugaggcggccggucuggcccgguggugggagcuguuggcacagccgcuucucugugcgggcgacaagugucuccaagguccuggcggcgcagucucuggagagcgugucugugcuguggggaacuggguuccgacacagccccgcacccuacuccucgcccaugcaaacucuccagugccuucucuuucccuuuucccucacccugcucucccacagagggcuggaaaugacaccucacucgccccgagggccaugccaguuuuccuugacugaccgauuuucucaaagcaaugugagaggucuggguccugucucugcacuuagccuccaccaggucuuggaguggcagcacccugggcugguuccuggugauccaccaaacuucugcccugcccugccagagcaggaggcagguggcauuggcuugggcuucugggacgcugaaaagcaauggggcaggcacauuccuuagaacauccccagguccuggcccagcugaaaggugguuacagugguugcugggaugggaaaaaggagacucaaaggggucggaggcaguacuaauugugugccacuagaccucugcaaugggagcgcucucacucccccccauauccuccccccaccaacuagccuugcguugguggagugccugagucgcugccuuugacuggggucucccccaggugcuggcacccuggcacuggcccaaaccuuacccugcuuucuggcuuucggggacuguugauuauguucccagggaacauuacacacgggacacuucccugccuucaagguguuugcaagcucaggcagucugaauacugggucugcucugggccugcccagcucuucuaaguugauugcaaguugccugcaguugucuuugaggucccugucacuucacaggggagagugucgccuggcggggugagggaagccgcuaggguucuucacugcagaaggcagcaccccuugggcaaaugcguaguggagaacagcuucggaauuugaagggggggccuggacuuaggcgaaggggguggaguaaaugacuaaggccaguagaagagauaagacugggccggaggcgaggggcgggacuagccaggccaggugagccagcuggaaggcaugaccuuugcccuaagggaggucuguaggagagacugccuggagccugcccucggaagggacuuuuaggcaagugggggaggaaaagcagaagaaauuagagggcccauuggguucuaagccaccuccuuugggguuccaggggcagccugcacucggaaggcucugggcugcagcuugagauacuccaccggcccucacucucccucccgaccaucugugccacuucuaaagcaugcuagugccuuccuagccccuuccccuccugguaggcaggcugcuucagacccaagguuuucucuuuggccguucaccuggggcccuugcaacucccuccuucaucuguacccguagguaucuggcaguccccgaucugggcagcccguuaugcugagguuuuucacaacugauucuguucugaggagacuucgcaauuucacuuuauauguuuuagguauggguaaggagggggugaaggggguaggagaggcucccaaugaaauagcaggugagcaguucccagaaggcaggcaucuccgaaugagaaagggcaugcuguuuccuggcacagggcucauuguguuugaaaaggaagcaucuuuuuuuuuuuuaauugaguugagacagggucuugcucuauggcccaagcuggagucaaguggugugaucagggcucacugcagccucccacccucccaggcucaagcaaucuucccaccucagucucagcugggacuacaggugugugccacccugcaucuggcuaauuuuuguuuuuguuuuuguagagaugggguuuugccauguuguccaggcuggucuuaaacuccugggcucaaggguucugccugccucaccuucccaaagcgcugggacuacaggcaugagccaccacacccagcugaagcaucuuuaucuguucgugccugcugucugguguuagcaguggggcacagugcccuggccuugccaggcauacagaaccccuggggcuggacucugucuuccucugggucagcucugcuggcucuugacucaggaacugggcaccuauggcuucaaacacuggccucgaagaucaaugcccaguuacuucaucucaggucucauggcuggauuauuggguggucccauccauaccaauuaggcaccacaagacaggccugccuauuuggcagucccaccuggugccuuacuggaugucguacgaucuuugccccugaaugguaccacagucucccucaccaggaggcguuucaggacacggaggcuuccccauuucuguuugcucagcccccagcacauuucccaguacagggcaagugguacugaauucauucaccagauucuucguugccuacuuugugccagauucugugcugggcacuggagauacagcagugaacaaaacagacgagaaccccugccuucaaggagcucgcaggaugguagugaggcagguagagcaguaaaacacggaguaugggaguuggcaggaggaagagcagggaaggggagggagugcuggguuucagagucagacagggaaguccucacugagaaggugacauccaaacgaaagagguucaggcagagaaaagaggaacugcaagggcccugaggugggacgguggcuggcaugcuaugucuguccacagaacuacaagacaggaugugauuggagagcaagccagggcuggggggacaggggacaagcucagagagaugggggaccacccaaugcugugacaacccagaaucccaggaggaggaggagaggggacugacaguacaagugagacuagaaauccacaggcacgagcugccuuccauugcucugcccuucucagagccuccgcgucgaggggauuugggcauugaggcauuucuggaggacaggcuucuguggccacugcugccacagacuucccugcccucagcuugaguugggucagacgagccuguccaugugaacguggaaacauuuccugccagacuaugcuguugccaccacacgaaucaaaccagcaaagggcacgccggcgaugugcauacagcugugucucugacagcugccugggccugccugcuguucccacgggucagcuccugucggguagggacagguccugcucucaaggcucauaaagcagccagcagccugcccguguuuuccguacucuggccugugucacccaggcugucuccucaucucuugucugauccucaaggguucccuggccucccucuucacucccucugccuguggcaggcagcagcacaguucuaugggguccuaaggaccccagggagucacucccacauuugagcagcaacuuuggguuuagucuguccagguuagggccccagaucauauauauguguguacacacacguguguuugcgugucaugcggcauucggauggggcauccuguucauccaccccccugcuaugggguggcugaagguuggggugcccucugaguuuuugguggguggggcuucagcagggugucuuggcuaccucuccuggccagcacauguuauccugggaggauuuguagcuuugggccugaccacgguuccaagcaccaugaucuggagcccacacuggguggcaggcugcagagaaggugcccccagaagccuggacugcacccuuaucuguuuucauuuggagcuauuuucucauuaucucaugccaagugucugacuacacauggcaguccuuccccaaguguuugcagcuucaucauaauacuguuaauugaauggaauuugucauuggccagcuucuguggaccccauucaaggcugaguggaugcugggggcgcccagcuggccuugcucagaggggucccgagcgucuuggugcuucaggagcugagccccccucaagagcauugaugacaagagcucagauucucagaaccccccugagcacccagacaaccuuggugguuacuucuucacuuuuucgcaugaccuggaaaggagaugagacggggaggagaacauaggcaaccagaaggacgugcagccuacaagggucguaugaaggucagagggguggcugugauggcccagagcuguggggucugagugaccuccagcccagaaccgcccagcaggccagugcuagucaugccagcacuuccaaacccacuucuugacugaccuuaagaaaugggaaguuuuccaacuguuggucacauuuuuaauugaucuaaccugcuucaucuucccagacaaguggguucuuucccaacaauguaaacauuaauucagaugaaaacaaagcucuguagaaguuauuaauaucuguggcucugcucaugggagccuuucucuuuugagguaccagaaagaggaaggccuaaacagaacuggagugugggagagugggcgggcucucucucuuuagucaucuguggucaccccccaccccccugcgcugugcaagccugauaccauggaaagggaacccacauuucaaauagcugcugcugcuccggugaacuugggguaagggagcugaggggugucuacccucugcaccagacucaagucucccuccuagaauaggagcgagaauagcagcaagucccugcccccugcucccucguuuuccuggaagaaaugccuaccuaagacacagacaccugcaucccacgcuuugucacccaaugccuguuuccuuaaggagaaaaaaugggcgccagaaaacuucuaggucuagauccuggcucuguugcucgcuaguuguggaacuuuggacaggcgaccucacccuucugauuucacuuucccuggccucacucuucacucccucugccugugggcaggcagcagcaugguucugugggguccuaaggaccccagggagucacucccacauuugggcagcagcuuuggguuuagucuguccaguuuagggccccagaucguauaugugugugugcacacacguguguguuugcgugucaggcagcauucagauggggcauccuguucauccaccccccugcuuugggguggcugaggguuggggugcccaacagguagaaugggguugauaauagcaccugccucgcagggugauggugaaaauaaaaugagccauggugauuuaagaugcccagucuagguucuggccuuuacuuaguugacacucguggacgguuagaugguuagagaggcaggccaguuuaguaccaaaaugccuucagagucaggcugucucuggguucagauccuggcucugccccuugcuauugguggaaucuuagacaaguuauuuaauuucucugugccucagcuuccccaccuguaaaacgaggaugaggcuaguaccucccucacaggguucgugguaagaggaugaggcuaguaccucccucacaggguucgugguaaggcucaaauauguaaauguaugaaaagcacuuaaaacugugcuuuggggugagcuguuauucuuaguuccugcaggcuucagcugguuugauuguugugacuaauaaccuucgcaccuaacagaaugucuugccggggagugucauggcccaaacaggaagguggcagcggaaaaacuccauuacucaagggccuuugcaagagaagcaaaacucuacuuccucagcuucuguggguuuuuaaaucuuuuuuuucaauuuuaauuuuaauuuuuuuaaaaaaaaaguagaaaugagguguuacuauguuacccaggcugaucucgaauuccugcccucaggugauccucccaccgcggccccccaaagugcugggauuacaggcaugagccucugcacccagccagcuucuguguuuuuaacaaaccuugcucgggcucugcagauacagauucugggucuggggugaagugacuagcauuuguguggcagucugugaaugagaugucaagcagcuuccgagguaacagacuucuccccagguucagugagggagacuguaccuagccuguccuuccagaggcugcucacacugccaggcuguggcuggccugccaaggggaggauggcccuccacaccucggcccaccugcccuucaccuccagccagggccugccuguccauccaccugugccuagcuggaaaagcuggcuuggagcagugcugcccaucugccacugccagcccccagcaucugccuuauuaaaaugcugaggcucuggcuggccacaagccccaggagauuuggagaaaagccagacaaaaaggugcaggcugugccaccgcccagccacacugggugacugcccuugguaguuaaccacagagucauccagcuuggcugcccagaggucuauagcuccacucaggcgaagcuggcuagccuggccuagccuggcugguuaggugggcaggacagccuccacuugacugauuuuuuuuuuuuuuuuuuuuuuuuuugagacaggguuucgcauuucugcccaggcuagagugcagcgauacaaucuuggcucacuguagccucgaccuccugggcucaagugauccucccaccucagcugccugaguagcugggugcaccaccacucccggcuauuuauucauuugguagagaugaggucucacuaugucacccaugcuggucucaaacuucuaggcgcaagcaauccuuccaccuuggccucccaaagugcuggaauuacaggcaugagccaccaugcuugacucgucugacugauguuaggcaaccuugaauugauggucuccuggugaaaugaggguucuuguugacaaggcaggucuggccaacacauuuuuguaugauuaucugcacgauugcaucaguuauuagcaaagaaggauuuuauagcagcaggugugugcucaugugcuuguguggaguuguugacugcccuucacugcacacacacagucugcggaacugugacugaaucccuguucccuacucacacuuacaugguauuuucugggauucuaaggcacauucuuuuuuuccuuuccuuuuuuuccauuuaacaucuuaaauuggaaugugucgcacauuugcggauuauuauaauuugacagcgccuuuuucuuggcauacuugaaauaacggugcauuguaaaaucagaggugucucagauuuaaugaaauagaaacuagguaaccucuggggaacuuauauaauuuguccaguuccuccaaggaugcagguggagccaccuuguagugguggcagauuauaugaggggacccugaugugguucaaggggacaaccuuggauugggcuuagauuccagcuuuauggcucgccagcuguguggccuuggcaaaguagagcgaccucucugagccucgggauuuuccucccaccacauaugaaucguggcuccacaguugucauggcugugugcaaggcaacauucccuguuucucuugcuggguaucaucuaaggucugccccguuccaucuggguuaagagggaaaaugagggcugggagugggucacuggccuucccaagggagcagagggaaacugguguuccaagggcuucuugacucaguuuauaauccuuggacauuacucuucuucccucguccuucucccccuuugccugaguuuucauuuucacauguguuuccuuuuagcaauuuucuuucaaaucucuccucucccuuucuguaaagucuucccacauguagccucuuugaagcucccuggggugggaaaggggaggagggcucugccugauggccuggauggcacagaccucagaagcccagugugcuguggucccugcaagcuucagcucaaguccaaguucugguaccaucagcguugcuaacugccauuccuguggcugcagggucagccugaguccacuccagugcacaguguuguccauggggugcuggaugucgcaucgcugagagcauuugguauucucuguacccuccuugcugcguuaaaaucagaccugguucaaaucccagcccugcgaccuuucacgaauuacuuaaccuccuugaaccuguguauucucaucuaaauaguggcugaugcacagaaauaccuggcacacaauaggugcuuagcagaugcgugcuuuccuuguucucaaauguuuaagaccccuuuguggacaggcacgaugguucaugccuguaaucccagcacuuugggaggccaacgcgggcggaucaccugaggucaagaguucgagaccagccugaccaacauggugaaaccccaucucuacugaaaauacaaaaaucagcccggcgugguggcaggcgccuguaaucccagcuaccuaggaggcugaggcaggagaaucgcuggaacccggaaggcagagccugcagugagccgagaucaugccacugcacuccagccugggcgacagagcgauacuccaucucaaaaacaaaacaaaaaaaaaacugcuuugugcuuguuuagguguuaaggaucucggggagugccagccaguggcacugcuccugagacagacggaggaguucugggcagggggcaguggcaaaggcacaggggccugugugagcaggaugugucaggggccccguccuucaggauggcugggcugcaguggggugaggcaggacggagagagaggaggaagagugguggggugggcacccagucggcaccuacaggggugcacaugacaaggcugcacagggucuggcuggagcaguacagaggguuaggugugggcuguucauggaagucggggcugaguuggggaggcaccaggagacagccacauggggaugucugggugacaguggcccccaagcaggggcugagugugcgcugcuggcuagagggaggcuuuaagagcaggugaugguuuuaaaccuuguuuuccuuggagaucuucucucugcccccucccucuugagauuccaaugaaagccaguagcccaaccuccucaguuuuguguguagugucagagauucgaagcccccucuuugaugagguggugcuuaugcccccugugcauaagaagcagcaugugcugaggcauugggguggguaaaggugcccaggagccugggguacuagggaaggggagaggcagagcauguccugaggcugagaccugcuggaaggggcuuugcgagcugcucucaggagcugggccugguucugugggcaguggggagcucacaagcucuuagaggggguucccaauggacucccugggagggagagucuccaccccaugagccccuaaugcccucucaccuguccccacugcgagaaagccugcccuggccggaggcccuaagcugagcucuggccagcuaugcuugagugacaccccccaaccccccaugcaagacagcagcuucuggaacacgaagcuuggguagcugggucuagcaaaggccacaggacaaagagagacaccugaacugagcuugcugggaagaccaugggggcuaugugcugaugggagguaccagaagauggggcagggaggaggagaggguuauaaaaaccaagggcucuggcaggaggcccugcaggguugggaggaggagagucacccugcugacccugaccugccugcuccagaagggcgggucacguggagccuuggccauuggcuguggguaaacaucggugcucugcuggcuguucaaggccugaggguucuguggcagaggaggagcugggugggaacccacccuggcuuuggaccgugggucagcuccauccaggcaugcucuccuugaguuggauaguggccucucucuggaaaguuccaugucaccucuuuggagggugcuccccugaaaauguagccugaccuacccgguggacucuacgagaagaaagagcuggccugagccacuguuuucccucccaaaccuucacuuugagugaaguguuuuuaucaucgcuccucuuaucaugaugguaaaguauggagcccccaaagcaagccccacagacucuugguugugugaguaauuaagcccucucuucaaaaagccacaucuugaaaagcuauaauuuguagcaaaaaauagcugcccguuccaagaaccaggagagcccuuuauacgcaccccauucaacugcagcacguuacuucgcuuuugaguugaguugcugggaccucugguccaugcuuuucuugggggaaccagagaugcaguggcugcaugggaacuggagcuuccgguaggcauuugggaaaucuuuucugagaauuuagaugggacgauuuaaauuagggaacuccugauuuggguuugcauggccccaacuuuuugugugacuccaaaggggaguaaagagaaaaacugcaggauacuucaggggaaaguggaugagacucucuggacaccauucccccacuuuuucuuuuccuucuuccuuucuuucuucuuuuuuuuuagauagaguuucacucugucgccaggcuggaguacaguggcacagucucagcucacugcaaccuccuacucccugguucaagcgauucuccugccuccgccucccgaguagcugggauuacaggcacgugccaccguguccagcuaauuuuuguauuuuuuaguagagaugggguuucaccauguugaccaggauggucucaaucuccugaccucgugauccgcccgucucggccucccaaagugcugggauuacaggcaugagccaccgcaccuggccacauuuccccaucuauaaggaggaaaaugauaauuacuugcagggaguuuaccaccucuguaaagcacagagcagacuggccacaugguaggcgcccuaguaugucaacuuuguucucuuucucugaguuguggcuccacuagcuauuuguagacaggagaucuuuguggcuucagguaggugaugggggacugaaagcuaagaggaaaagccuccccugaccugcagcuucucuuugagcuggcaugccuggaauucuuggggcuggcugcuggguuuguuuuccagauguggaagcaauuuaaguucuguuuucuuaauccccaacaguuugccuccgaaguccacauucucauuugaaaaucaaggccguuggcucuguuugcagggcagaggguaggcuagauagccucuucaaacccuuuuuguuuaggaaaugggcuuacuggggcacucagaucugggacccagggcauucuugggacagucacaccccauccaggacuugguuaaaaggugaguucacuuucucuguggguuuuccuuggagaugauucacugagcuaaauucagcugcaccuugguuacaaaccagcucuagaccgcuguggaguggcggggguggggcucggguuugggccaugucacaggccagcuggcgucccucugagcagggugcccacgugucccgggggcaguagcggcccuccuucccacacugaccacaacagagggaggaaaaugcuccagaugucagguagccagaaauacugucuggcacggagaaacugguaauaucuuguucaguuacugagcgcugcuggucacagaggcagccugacccaggauaaaaggcuccuugugugagggccuguggcuccagggcuaacugcugauuuauucucuuguaaagcaaucgcuguguagguaaaauaccuuuuacauuugucuuauaacuauacuaaauacaguuuugggcaaacaaaaauugccuuugcaauucuaacgucucugaacugugcauaugcuucucugaaauugaaauagaauacuuauacuacugagagaaugcacaagaaaauggaaguggcugggcaugguggcucaugccuguaaucccagcacuuugggaggcugaggcgggcagaucacgaggucaagagaucgagaccauccuggccaacauggugaaaccccgucucuacuaaaaauacaaaaauuagcugggugugauggcacgcgccuguagucccagcuacucaggaggcugaggcaggagagucgcuugaacucgggaggcagagguugcaaugagccgagaucgugccacugcacuccagccuggugacagagugagacuccaucucaaaaaaaaaaaaaagaaaauggaaauaacuuacuuagauuggcauauaguguuuauagaaugccauccugauaaucauagauucaccaagcuuugauuucaacaaaauaucaucucuuaagaaguagcaguauuucaaacuaaucgugaaagagaauaagagaauacaacuuuuuuuuuuuuuuaggacagaccaaaaauaaaucccugagucucuugaguagguucuggaaauccaguuacagaugcuccuugaugggguuacguccugauaaacccauuguauauuggaaguaucauaaguuaaaaaaaaaaaaagaaaaaaaugcguuuaauacaucucaccuaccaaacaccauagcuuagccuaggcuaccuuaaaugugcccaaacacuuacuuuagccuacaguugggcaaaaucaucuaacacagagcuuguuuuacaauaaaguguuuuaugucccacgcaauuuauuuuuuguuguuguuguuuuguuugauuugguuugguuugguuuuucuuugagauggagucuggcucuguugcccaggauggagugcaguggcgcgaucucggcucacugcaagcuccgccuuccggguucacgccauucuccugccucagccucccaaguagcugggacuacaggcgcccgccaccacgcccagcuaauuuuuuguauuuuuaguagagaugggguuucaccauggucucaaucuccugaccucgugauccgcccgccucggccucccaaagugcuggguguaauccaccgcacccagcccaucccacgcaauuuauuaaguacuaugcugaaagugaaagacaaugcucuuauggguacuugaaguaugacuucuacugacuguggaucacuuugcaccaucauacaguugaaaaaucaaagugagcccgggcauaguggcucacgguggccuguaaucccagcacguugggaggccaagguggcuggcugcaucacuugaggccaggaguuugagacuagccuggacaacaugccaaaaccccaucuguacugaaaauacaaaaauuagccaggcgugguggugggcaccuguaaucccagcuauuugggaggcugaggcaggagaaucacuugaacccaggagggggguguugcagugagcugagauggugccaucgcacucuggccugguugacagagcgauaccuugucucaaaaaaaaaaaaaauuguaagucaaaccauuguaaguugaggaccaucuguaguucucuuuaaagguugaauuggcugggcgagguggcucacaccuguaauccuagcacuuugggaagcugagguagguagaucacuugaggucaggaguucaagaccagccuggccaauauggugaaaccccaucucuacuaaaaauacaaaaauuagcugggcgugcuggugggcaccuguaaucccagcuacuugggaggcugaggcaggagaauugcuugaacccaagagacagagguugcagugagcugagauugugccacuguacuccagccugggugacagagcaagacuguaucucaaaaaauaaaaaaauaaagguugaauugaauugaccuuuaaaaaguucucuuuuguuaucagggugagaaggugggcgaaaaauccagacugagcuuggguugggguuuccaugaagccuuccuaggggaggagaagggauauugguauauuggucuauuggucugcuacggcugucauagcaaaggaccacagacugcguggcguaaacaaccaaaguguguuuuaucacaauucuggaggcugaagucuagcaucaaggugucagcaggcuugguuucuucugaguccucucuccuuggcuugcagacagccaucuucucccugugucgucacauggucuuuccuuugcguguguccuaaucuccucuuauaaggacaccagucacauugcguuagggcccacccauuaggacuucaauuuaaaugaauuaccucuuuauuauuauuauuauuauuuuguuguuuguuuuaagacagagucuugcucuguugcccaggcuggagugcaguggcacuaucucggcucacugcaaccuccaccucccagguucaagugauucuccugccucagccucccgaguagcugggacuacaggcaugugccaccacgccuggcuaauuuuuguauuuuuaguagagacuggauuucaacauguuggccaggcuagucucgaacuccugaccucaagugauccacccaccucgaccucccaaagugcugggauuguaggugugagccugcaguucagcccggccugaauuaccucuuuaaagacuaucuacaaauacagucacauucugaaguacuagggauuaggacuucaauauaugaauuuuagagggaacaggauucagcccauagcagaaaagggucuugggaaccuccuucaagggaagggggaagaggaagaggagggugggcaaagccuggcagaguagaggggaggcaguucugcuuucaggcaaaggcccaugggugagggacccccuggggauggcucuugaccaccugcucuauuuggaaacauuucuaggacuguuaugacugugaauggucuuuuagaggccggaucauucuuaugaccucagccauccauugccgcuugaucugaucauuugaaaccaagacugcucgucguucuguucucauuucauccuugaagcucauguuggucuguucgggcuccaguuucuguggacucuacccgcuaggauaguauucuuucaggauggcuucacuuuuucauauucuuuuaaguagagccagaccugucaggaaaaagcgaauaaaccgaucaaaaaaucagcaaaagauccgaauagacauuucuguuauauguaauuuauauaaauggaaaacaggcauaugaaaggugcucaacaucauugaucaucagagaaaugcaaaugaaaacuauaaugagauaucaucccauccuaguuaaaauaccuuuuauccaaaagacaggcaauaacacuuuuccuucacuaguucagcaaauuuggggcaggcuauuuuuucauguuuccauauaauguuuacuacuacuucuuuuuuuuuuuuuuuugagacauugucucgcucugucacccaggcuggagugcaguggcgcgaccucggcucacugcaagcucugccuccuggguucacgccauuccccugccacagccucccgaguagcuggaacuacaggcacccaccaccacgcccggcuaauuuuuuuguauuuuuaguagagaugggguuucacuguguuagccaggauggucuugaacuccugaccucaugauccgcuugccucggccucucaaagugcugggauuacaggugcccgccaccacgcccggcuaauuuuuuuguauuuuugguagagacaggguuucgccauguuggccaggauggucuugaacuccugaccucaugauaagcgcucgccucggucucccaaagugcugggauuacaggcgugagccaccgugccuguccuguaacuuucaaaugaaccaaguuucuuuucaaaugagccauuugaaaagaaauuagacuaaauauuaucaaaacuaaggacauuuuccuucacaacuauaugccauuaacacaccugacaaaauuaagcauaauucccuaauaucacccaauaucuacuccagauuccauccuccuuguuuauccucaaaaggucuuuuacagcugguggugguuuguuuguuugaucugggaucuaaucaaggauaauauucgguuucuaugucucucaguuaaucuagaacagugguuugcaaagugugguccugggacaaguggcauccgcaucacccgagaacuuguuagaaaugcguuuucuuccagccugccucaaccuuuagaaaugcaucuucccuguggugauguguaacuucuaucccauuuuuccguuugguagaaguuagauccuaaggcuugauuugaauugaguuaaauacuuaguuaagcccacacuauaggugaugcuguguaccucuuaggcaucgcguugggaggccagcgccugguucuuuccaauuagugaugcuaaauuugaucucugcauuaaagggacaguagucuguguucucccugguagagguauguggggugcuuugguguuuugcagcaaucuguagggugauucuucgguauugugcaaguaucuaguuuuucauuagccuuuaaucuacugguguuauucugcaguuguugaguguaguguucuguauguaucagucuggaguuuguguuguucuggucuucuguguccucucuaauucucuuguuugcuuauuccaucaguaauaauaauaauauauaauaauuauuauauauuaauauauaauuauuauauaauauauaauaauuauuauaacauauaauaauaauuauaauauauaauauauaauuauuauauuauauauaauaauuauauauuauauauaauuauuauauauuauauauaauaauaauuauaauauauaauaauauauaauaauaauuauauauuauauaauaauaauuauauauaauauauaauuauauaauaauaauuauauauaauauauaauaauuauauaauacauaauuauuauaauauauaauaauuauauauaauauauuaauaauauuauuauuacuauuauuaaagacagaaucuugagcucugucacccaggugcaaucauagcucacuguauccucgaacucguggccucaagcaauccuuuggccucagccucccgaguagcugagauuacaggcaugcaccaccuggcuauucuuuuuuacuuuuuuuuuuuuuuuguagagauggagucucauuauguuucccaggcuggccuggagcuccuggccaccugccuuggccucccaaagugcuggcauuacaggugugagccacguucagcauguuccaucaguuucugagagaggugaauuaacagcucccacuucccauucuguuaaguuuugcuuuauguuuugagacuguuagaugcauagauauaaaaguguuacaucuuguuaaauuucaauuguguuucuuguaagugguauguaguuguuuuuaauuuacucugacaauauugaucuuuuaauaggauuauuuacucaguuuucuuuaaaaguauuacugaugugguagaguuuuaauccuacauaaucuuuaaguuuuuaauugacauacaauuguacauauuuagagaguacagucugauguuuugauacacauguguauuguggaaugaucaaaucagggucauuagcaaaaccaucacuucaaacacuugucauuucuuuguggugagaacauucaaaaugcuaucuucuagcuauuuuuaaauacacauuguuguuaauuguaguaaccuuacugugcaauagaacaccaggacuuaguccucccaucugacuauagcuucgugccuguugaccaaccuuuccccguccucccuucuccuacccucuccagccucugguaaccaccauucuacuuucuacuucuaugggauaacuucuuuagauucuacauaggagugagaucaugcuguuuguccuucucuacuuggcuuauuucacuuaacacaauguucuguagguucauccaugucacaaaugacaggauuuuauucuuuuuuauggcugaauacuauuccauuguguauauauacaccccauuuuaaaaaugcauucaucuguuaauggauacuuaguugacuccauauuuuggcuauugugaauugugcuucaauaaaugugggaaugcagaucucucuuugacauacugauuucuuuucuuuuguuuguauaccuaguagaugaauuguuggaucauaugauaguuuuaaauucuuugaggaaccuccauaccguuguccauaaugauuguucuauuaauacuuacagucccaaccgggcacaguggcucacagcuguaaucccagcacugugggaggccgaggugggcggaucaugaggucaggaguuugagaccagucuggccaauauggugaaacccuuucucuacuaaagauacaaaaaauuagccaggcgugguggcaugugccuguaaucccagcuacucgggaggcugaggcaggagaaucgcuugauuccgggagguggagguugcagugagccaagaucgugcuauugcacuccagccugggcgacagggugagacuccaucucaaaaaaagaaaaaaaagguuacagucccauuaacaguguauaagaguucccuuuucuccacauccuugccagcauuuguuauuuucugucucuuugaugauagccauucuuauuagggugaggugguaucucauugugguuuugauuuguguuucccugaugauuagugauguugaacauuuuuucauauaccucuuggccauuuguguguugucuuuggagaaacaccuauucagaucuuuugcccauuuuuaaauugaauuauuuguuuuuuugcuauugaguuguuugaguuccuuauguauucuggcuaucagucaucuguccuuuuggaugauucaagcauuuuuuuauuccuucauuucucucaucuauuauuauuauuacuauuauuuuaagauauagggucucaccauguugcccagguaggccuugaacuccuagguucaagcaguccuccugccucagccucccaaauaguuggggauacagccaugcacugccaugccuggcuuagauuuuuaguaauauguuuuguuuuauuuuauuuuauuuuauuuuaacuaauuuauuuuuagacagggucucacucccguugcccaggcuggagugcaguggcaccaucacagccucgacuuccugggcucaggugauucucuauccucagccucucaaguaguugggacaacaggcaugcgccaccacaccuggcuaacuuuuuguauuuuuuguagagauaggguuucaccauguuuccuaugcuaguuucaaacuccugggcucaagugauccagccacuucagccucccaaagugcugggauuacaggugugagccacugugcccggcccguuuuuaacucccaaccuuugacaugcucacuuguuauuggaacggaaguggcacaguggggagagaggagugagagcgucuccccacaguggauggcucagcuguucgggauguuuccagugggaucacaccaugguccagggucuggucugcauccuaaugggcuugaaaaccagaucuuacuggcuuuucccacaccccacaacuugaguccacucaugcucacugauugucccuaaauggaccugcagagccaguggauccccuuguggugagaaaugcacucacaugagcuugggcagcccuucucuccugucugucagcaggcuucugggagugggugcuacgugaacuuggacacaggggccaagggcuggacagguguggaauguugagccaggccccaccgccuuuggggcaggcuggaugugcuggccagccagaccugacaccucuggccagugccugggugcacgcggcccgggucggccucagacccucccucuuggugcuucccaggagaccacucgcuuagccccucccugaggacaggcucugucuuuagaucccuuaguacuucagucccucugucagccucaggaaaugugugcaucucucuuaguugagcucccaggagguuaucugacaucucucauuucugagucuuucugggagccucagcacacaccccgcuuccucucugugggcuccucugacgcugccuuaucagcaguguguguguuggggugagguugugagaucggagagagagacagcucaagaguugugaugaaaacacugaaagaaaggcagugugggcuucagcagcccuuccucggugauguuugugcagcagcagaacuuguugagugaccgccuuugcuuuauguaaaugucaugaguucuggagaaacacaagcauggcuuucgcuuucuuuucuguucagcaccaaccugagguuccacagccagugugugccagauccagaacugaaccaaaucugcccaagagccucagucuccacaucuucaagcccaggaguuugaaaccagcacaggaaacguggugaaacccugucucuacaaaaaaucuguaaaauagggugauuuauuaccucccucugggggugaugcaagaagccugcuugcuucucaugugaaaugaaugagcaccuggggaaccccaguugucccgguugcccccgcuccuggggucugcaggcccaccuuaggauggaaguggagcgcagcaaccaggugucuacacaagauccacuccuagaagcugcagggcgggagcagugggcccugcugagggguggucuugagcuccuggccacacccuuucuggggugaguuucaggagguggauccggggcccccggcugggagaagagagucuggaagcugcccugccuuggcugccauccccugggagggaguuuagcuggaggaauggggcacugggucccucccugacaccccggggccucugagccacucuggggauggaacguagcagugcagcauuucuuccugaucagagcgggaagcucugggcugcagagcuuugaucucacaguauguggucaguccccggggcuggcugaggugugggaugaucccucgugaccuggcgaccuggugcucccaugcuuaccccuggcucuguuggggugagccgaggccucaugucugagcugagguugcuuguuguucagaaggcaaggccgaggcacugccucuggguggaugcuugaacccccuuuaucccacccuugccuuggcuggugccugggcaacucucuguugaaccaaaaccucuuaucagcaacugauaaguacccagccuugcaucugcagagcaaggccugacccagagccaggguuggcagcugcagcaggaguccguuacagccaagauugcguaccagucucugcggccaccaccuuuucaugaugagagcagccaagccacagugggguguggaagaccccagcccuagcaaucacaucccuucccuguggaccuggggacauuggcaccuaugaguuagcucaguaagcugaauuuccugcugcccauaggaaggaccccgugagaccuugaccuggcccaucucguuccagagcuguugguuggcugggaguggggugagagauucaucacaggccuagcccuggcaaccgcuggacuccccuacacuaggcuuaguguguguccacccccaccgcacacaugcacaccuucccagcggcagcgcugcacgugugccugcuggugccuugcugcaagggaagugggcaugugcccgcccaagcuauuuuuacccugccuuguccccacagagcuguucuuuggcucugaguuagugccuggggaaugaggccguugccagggcuggggguggaugagcuggaaccucggagcuucuuggacucccuuccccaggcagcaucucaucuuaaugcuuacuaaagggugugacucgugugcagggcgaccuuccauaagagugggcaggagaggacccugguggggagaaagaggcacugauguuuggagggcaggcucuggaaccugcaggucuggcuuccugcagccaaaaaaacccagccgagcugcagcccagugagccacgguggguagagggagaggucccaggggcuggaugggagccaggaggccaggagguacccuggauuguuuuccuucaacacaaugacgacaauaguaguucaguuuugggguguggugguguguaccuguaguccuagcugcuugggaggcugagcugggaggaucacuugaguccugggaguuugaagcugcagugagcugugauugcgccacugcauuccaaggguuuuuuuguuuuuguuguuguuuuuguguuuuuguuuuguuuuguuuuguuuucugagcacuuucugugugugcuaagaccauaaagugcuuaggauguguagcagcucauuuaauccuaaucacaguuaacuccauuuuauagauggggaaacuaaggcacugagcaguucaguaacccugaagcugcagagcucaugaauggugaaugguggagcagggcucuggccuggccgucuacuccagagcuuguccuuaacgccaccccgcgccuccuuuugccguguguuccgcgcccucaugacacaaggcauuguccuaguucccuguggcagccugccaggcaggugguucccuccccguguuuacaucaggcccagaaauuaaacagcugauccagcaucagacagucaggcagugaccacaccagagucggcacccaggucucaggguccuguggcugugcuguucccagcucaucauacugcaguacaguaugguuccaccaccugccaugugcucucuacagugcuaaccacugggguucugacauguaaauccccauagcuacccacuuaggguccuugcucucacagggaagguggacauguggucacuugggguccauguacucugugugucagcucagggaaacgcagggugcuggcgugugccugugagguggcuccccaugggggagguggggagggagaggaccagaugcugcauccgcucugagaguguggacaguguggcauuguuggccacucugaggcugggacggcccccacguguauugauacuuggccuuuucagcagcccugaauucaucccuugccaacuuccuacaaaagaaggggugacuuggggccugcuggcaggcgaacacggcucucaagacuggagagggccccacggcaggcugugugccucuagguucccacucccugcuggggacagggugggacagugggacagcgagguaggggugcaggggaugcagaccugcccugccagaguggcuggcuggauccuguucuccagcucucuccagaaugcccuggccucagguaauuccucagcuuggcuucucugaggagggugggcgucccuccuggcugcucgucuguccaggacauugcuggcugaccagccggggacccauggcuguaggaauagcucacccucuguugccuguagccccucgugaggccaggucagaauuuacggcuccuaccgugaccgacucuccgguguaaauugucacguguggcccccuagagcugccacugagguggaguugacuggccccauucuguaggugaggagccaggugcucacaaagguggucacuuguccaaggucacauggcuuguaaguggcugggccagcagggccggaaacccagacugcuaggccccagagcugagcccucacccaagcccacccccaggggccuccuggggcuucuggaggaacacgcugcugcauccgcucucucccuucaccccgggguccgcuggcagguggaagaaagccuggggugguguggccauguaccagccaagccugugggccuaugguggcuggcccugugucccaggguacagggagcugugagcucagggcuggcucugggucuugagggacagagcccuggcaagucagacugugccagagacgaugcccggugcugccuccugaggauaccacacugucccuuccccaaaggcccccaaaagagcagacacagccuuucugugcaaacccugggaacaccaggccaagcuccaggccuggacauguguagggucccuggguggugacuggacggccguguguggacuccuuuuucacacagcaggcgggaaugggcaggaaaccggggcucugagaggcagucuuggaagcugcccugggcacagaccuuacuugcugaccccggccaccuagaaacaugagcucuggggaggcccugucccugccccaccacuccugccagcccuccagagccaggcuugggugggcgccucuguggugaggauguagaccgugcagcuggggugagcgggcagcucucugggcauccugacgagcauagugcggugagguggggugaugguauccucucccaugacccccagucuacuuggaaguaugcucaacagggggcuccgcgugauucuuaccugcaggcagccuggccggagaggaacccaccgccuccagaagucugugacccccaggccaucuggaaaccuuaugagggcaauguuuuuauuauggccaaguucuuccuuuuccucugcaacuuuaucuaaaaaacauacaaaagggaaauuggccaagaagaguccuaguaugcuugacuccgaguucucccagcccaugaaugguggcucaaggagagagaagaggcugcguucuggcaccuuccagcaucuccccuccaggccggcgggagaaggagcaagggcuuccaccagacccuuccccagagggccggggaaacaagagcuggggcuggggacuuuggcccucagggaggagcaagggugaccauggcaaauaccaaaccaaggggaucuugggacaggcauaaaccaguacuguccugggcuaaccaaggcgugcaguaaacugucuuuauuauauuugaauuuagggggcaaacuacuagaaaugguuuuaaaguuauaauuaaaauuuccgauugccuuggacaaacaacuguggguugaaugaaaaaguauuaauguugggaauagccauuuuuaagagaaaaagcuggagagagugugugcgcauguguggccaggcaggugaggacuuggugugucagccgggugucaggucccugcaggcccucugugaacugcaagguuccagggcagccacucucccacucugagccucaucuuccccaggugucagacggagcugaugaaucccagaucucugcccugucuaccccaggcagcucgcacggggcuguugugagggauggggugugugagacaggcgaggagcuugcugaagggcugggcagauguggacucugcuuaguccaaggcugaaagccugcccgaggaggugguggucuucuuuggagggugggaaccuggugccccugcuucugcccugccugugccugagccaagccauuugaggcugcucucuccacccggucaggggcuugggccagcugcugggaguaucaggacgcugcuguagauguugggugagagggcccggugguuccaccugcaugucaugagccagguguuaguggggcagugcccggcacacacucggccucuguguccucgugucaguggccagaggccacgucagacaccugaggagcaaggacgcugaucugcacugggcccucugccugccucugggagcuggugggccauagccuccccaggauguggcuguagggggaagguggguguuggggaaacagaaucauguccggacccggcuguaaacucccacauggccccaggcaagacccuucaccuacagaaaggggaaaagaggcucagcucaucgggcugcggugaaguccagaagaaacaccauugccaaguugcugagcucucacaugagccacagggcgggcauucccagcaagggggaacucucgcuacccguguggccaggaaggugaaaaguuugcaguucuuccuggccaggugaaagaacagaccaggcgcauuguccucugagagccccaggucucuucuggucucccuccugccuuguuucucuuagguguccccgcacuaaccugcaguguccugugagggcguuaaguggauggacguggaaguugcugcguuaggcggcaugcuaaggagucauaauuagucacaugucccuauaaaaugugcucuccuuguugucaccaugagguuugaaaauccacaaagugugggaggugucaaggauaaauggaaucaaguguguggaugcaaaggcaggcgggguggggggcccugcccugcccugcccugcccucuggcuggaggacuucugaugcgcuacucuuugagccucuguuuccccaucaguaaaauggggauaaugaucacugcccugaagagcugucaugaagcacaggugggauaauaugugaaugcccagcucggucucuggaaccuaauggcugcucagugaugcugguuuccuuuuguuucuacugggaugcagcuucaggcuuggggaugaagagcuugcuuagggcacaagaugugauagguugggagccaugugaccagauuaaugacauguggguggaaggggcccugggaacccuggggggauucucauuacacaaccucagucuccacagucucugcuguuggcgugcccggcucgcugguguacguguuauugguccaucuggugcucagccuaucacagcacaggcaggaaccaggcucaugauaauauugccaucuauuuuuagcccaggggucuccugguggggacggacccccaggagggcugccagcucacugguagcagcagacggcugcacaugucugggcaggcacauccaggccugucgcugagcagcuucuucagcugucugagacuccaggaggcuuuucacagccuguuucuguugcccuucuuguagucucgggacugcaggguccuuuaauagggugcccugccagcccuggcugaggagcacaccaaagaaccuugggaacagguugacaucuccaaugggucagguagaagcggugccaccugagaaguaccuacuuccucagaggugaaguggccccaguaagugauuuacagagagcugccccucggucuagggccaacucugaaccaggccgaagcucuucuaucugaugauuuaacaaaaggugccagcaugucuuuaucacacacugucauuaugcugggccccagacccagcacaagcaacgcucagaagugaggccuggcauucuugcucccagcaaggcuguggcagggcccagacaggcaguugccuccugggcugggcaucacaucuucuggccaggguuuauucauugagguccuacugugugucagaugcgaacgugaaauaccucauuuaaucagcacagugauccuguaagauuccauugccauuccugauuuacagaagacaacugagguucagagguguuccaugaugugcacagggucauguaggguggaucccaaguugugcagcuuucacugcaccauguggcagcagacucuacuagaucaggguuguugguccuaaaagcuguucagugugacugugcccuuacaccgugcaccaagaagccuucuagaagccguuuggcuuccucugacagacuuuuguggugguuuuaccaguggaggguguccagguucuuagcgucuugaacaaaaauuggacaaaaugcacaaacaaaacaaagaaugaagcaacaaaaacagagauuuauuuuauuuuauuuuuugagacucagucuugcucugucacccaggccgaacugcaguggcgcuaucuuggcucaccgcaagcuccgccuccuagguucacgccauucuccugccucagccucccgaguagcugggacuacaggcaugcgccaccucgcccagcuaauuuuuguauuuuuaguagagacgggguuucaccguauuagccagggugaucuugaucuccugaccucgugaucugcccgccuuggccucccaagugcugggauuacaggcgugagccaccgugccuagagauuuauugaaaacgaaaguacacuccacgggaugggagcaggcccaagcauaggggaucaagaaccugguugcagaauuuucugggguuuaaauaccaucuagagguuucccauugguuacuugguguacacccuauguaaaugaaguaguggcccacagucaguuugauugguugcaggaggggaccaaucagaggccaaagugaaguuacaaaguuacacccuaugcaaacaucugauugguugcagaaagcaaucagaaagcaaccaaucagagacuaaagugaaguuacaaagugauauuccuaugcaaauuaaaacuuagccugugaccagccugauugguugcaggaggggaccaaucagagauacucucaguuuuucaucugccaggcagaaaagguuggggggcgaggaggcggugcgggggggggggcgguggggggggcgggggggaaggggaugcaaagggaguagcuacuugggcucggaaaauugggguuuuccuuuugauuuagcucuaggaagucagugugaaucagccuuauguucccugccuccagacccuauucugccucagugggggcucugaugugccaaccagggugcccugaauaaaguggcuagccugacuguggcccuucuucguggauggcuguuccugggaguucuagcuccucacuagaugcucaugagucagccaguaugagaggucccugggacuaaucaccugccagguguucccacgcuuaggguucgggaucugggccuccuguacccaaucccugcuguuuuggccuggcugaugcccuuguggucugauuggaacacugagcccugggaagcuggccucacuuaucuugucucugcucucucuuucccagggcagcgaggucacaggccccaccuuugcugauggcgagcucauccccagggaacccggcuuuuuucccgaggacgaggaggaggcuaugacgcuggcgccaccugagggcccccaggaguuguacacagacagccccauggagagcacucagagccuggaggggucugucgggaguccugccgagaaggacgggggacuugggggccuguuucugccagaagacaagugaguuaaaaccaccugaagcuccauauuugcccucucagcccagaaaugugguucuuggaaagugucuccaggaaguaaauuugaaacaugcucaaaauuuguaucagaggcauuagugucauggguauucugaauagcacaagauucuaagcagacuaaaugcuuaacaguaagggauaguuuuggaauuuuaggcagcugugcaaagucaaguuuuuaaauuuaauuuuacuuuauuuucaguccuagcugugcaggcaaagggaguuuuaaaugacuaguuaauaauaugagauauaugaucucaauuaguuuuaaaaagcagguuguggccaggcaugguggcucacaccuauaaccccaggacuuugggaggcugaggcaggaggaucgcuugagcccaggaguuuaagguuacagugagcugugaucacaucacugcacuccagccuggcaacagaucaagacccugucucaaaaaaaaaaaaaaaaaaaaagggcagguuacaaagauguccaugagaucagcuuuguuaaaaacacaaacauaugccaggcaaguggcaugugccuguagucccagauacuugggaggcugaggcaggaggaucacuuaagcccaggacuucugggcucuagugcacuaugccgaucggaugucugcacuaaguucagcaucaguauggugaccucccgggaaugggucaccaccagguugccuaaggagggaugaacuggcccaggucagaaacagagcaggucaaaacucgaguguugaucaguaguaggaucacaccugugaauagccacugcacuccagccugggcaacauagcaagaccccaucucuaaaaaaaccaaaaaacaacacacagacauauguguuaggaaaugccuagaaaaaaauuaaucuggaaaauuaagcaguuauuucuguauggugggaugauuuuuuuuguuguuguuguuguugagacagacucucacucugucaccaggcuggagugcaguggcaugaucucaccucacugcagccuccgccucccggguucaagcgauucuccugccucagccucccgaguagcugggacuacaggcgcgugccaccauguccagcuaaguuuugucuuuuuuuuuuuuuuuuuuuuuuuuugagacggagucucgcucugucgcccaggcuggagugcaguggugcaaucucagcucacugcaaccuccaccucccggguucaugccauucuccugccucagccucccaaguagcugggacuauaggugcccaccaccacgccuggcuaauuuuuuguauuuuuaguagagaugggguuucaccauguuggccaggauggucuugaucuccugaccucgugauccaccugccucggccucccaaagugcugggauuacaggugugagccaccgcaccuggccaguugaucauuuuaauuacuucccaucuacucugcuauauuuucuauauugagcauguacucccauaaucagaaauguuauuuaaaaacaguauuaagaccuaagugacuucccagugaagcaguuucaccuuuaacuuugguguuggcagaaaggagucccuuccaucucagcccucaccaagucucucgagggauacagugcugugggguggugggaagcugccaccauuguggcugaggaagccgaggggguugcaaguggcagccccuuaccagaaggugaugguuacgacugcugcagggauuuggagagggaagagagggguucccauguugguugaaccacaugaaauugacaacuuuuaaucauuuccaucuucaaaaaaguaauuucaugugguucaaccuaguauaucucaaugcaggguuucucaaacucaagugauucucagaguccugauguucuugguggggcccuuugggucuguggauggagaagaggggccgugcugcucgugcugcucucugggagcagccuuguaaucccagcaguuugggaggcugaggcgggcagaucaccugaggccaggaguuugagaccagccuggccaacauggcaaaaaccccaucucuacuaaaaauacaaaauuagcugugcaugguggcaggaggcuacucgcagcuacucaggaggcuguggcaggugaaucacuagaaccuggaaggcagagguugcaccaaugcacuccagccaggcgacaaagcaagacucugucuccaaaaaaaaaaaaaaaaaaaagacaaacuuaaaaaauaacacaguauaacaacuauuuacauagcauuuacauugcauuagguaugauaaguaaucuagagacgaucgaguauacaggaggauaugcauagguuguaugugaauacuaugccauuucauaucugggacuugagcauccucagauuuugguguccacaggggguccuggaacaaaucucucuuggaugccaagggaugaccauacucagucuuacaguaucuaaaauuuuagauccauuuauauucauuuucuguauuacuccgaauguuuuuuuuuccucuccuuaaagugaaagcaaguuuauuaaggaaauaauaaaacaauggcuacuacagaagcagagcagcuacuccgaauguuuuuuuguuuguuuuuuuguuuuuguuuuuuuugagacggagucucccucugucgcccaggcuggagugcaguggcacaaucucggcucacugcaagcuccaccucccggguucacgccauucuccucccucagccuccugaguagcugcgacuacaggugcucgccaccacgcccggcuaauuuuuuguauuucuaguagaguugggguuucaccauguuagccaggauggucucgaucuccugaccucugauccgcccgccucggccucccaaagugcugggguuacaggcgugagccaccgcgccugccacuacuacaaauguuuuaacaaaccuuucaacaacuauuugauauuccacaauuuaauaauuuacuaacauuauaauuuaauaauuauaauuugaucuagcuguagcuagacaauuagguuguaagcaguguuuugcuacuguggaguagcauggguagaauugguuugaacuguagaaaugguuucuguggugagauguuucccuuuagauagggucccugaaauguacuuaccaggucaagagcuacaaacuuaaucgguagugccaauuaaagggaaaugccugucaguuuccccaccacgggcuguggcuggggacccaugaguccuccucugacuugggugcucucggacccucaggucccugguccacacuccauccaugacgaccucagaccuuucuacacacuccaccaccucgcucaucagcaaugaggagcaguuugaagacuauggggagggugacgauguggacugugcccccagcagcccuugccccgaugaugagaccaggaccaacgucuacucggaccuggggucuucggugucuuccagguggccccuuggucugggaugucauuuggggucaaaaguugcagaagcaauuuaagcacauccuagggggugggggggugcgaguccugagcuggcccuuuuccuuuguccucagcuacuugaguucugcuccuggggcuugggguugcuaccuucgcacccugauuaggggucaggaguuccuccugaauuaacugaccuaggaggcugcacacugggggccacggggcucugugucaucuuguauccuagaaccucaguguugaagcauccuuccaagugaccccugugaucccuucucacccaccugagucaccacuuucucugaaaugagcucgcaguuugccuuagcuguuaaauggguaugccucacuggcuucucuuugagcguguuggagaagggaugaucuguugcuauauuuccacucccugccccucccccguaacaagguucaaagguacuggggacucaaguaaagucagcucagcagggugguguagggcaccagacuggacagcaguuaagguggugauuccuuucccucaugaaucagugcggggcagacgccuaggaaaaugcggcacguguacaacagcgaauugcuagauguuuacugcucucaaugcugcaagaaaaucaaccugcucaaugacuuggaagcccgacugaaaaaccugaaggccaacaggugaggcccaggcccagcuggggggugagaggccggggggccagggcagggccuggagggagaagcuacgggcauggcgaggcgaccccugcugucugggcaggugagagcucucagaggaggguugauccaggggcuuuuucugccacaggaaaucaggcuguuucuucucaggaccaagcugacuagugaauuccuuucagugggagggaagagccuuguccugcacuguggugucuuacagcuaggacagaguaagggaguggacuagaaccccucuguucaaugacuguuuccuuucucucucuagccccaaccgaaagaucuccagcacggccuuuggacgguaaggcccgccucgagggagggcaaauugagugcuguccccaugcugcccacuggccggggcucccugccagcagcccggacucagcuggugcccgcauguggcugagugagcagaggggaacgaggccaucccagggcagugcagccagggcagcgucacuucugaaaaagaggggccagcuccucccugcucucuccccaccccuugucccuucuucaaauccuaggucaccuugacuucaggcaggcaugccagggaugcccugagagagacagagcaccccacagcguucagugcccuuccugccucuuggagcuggcagccauacucaauaaagagaccccggguuuccugcaggcggggaucugggcaugagugugcgccauuggggcuggucacuuugcuccgauuaaguccugcggcaguucaguguggccccagguccacacucagggcucugggagcuggcagcaagggcccaggagcuagguggguuggccucuuggcagagacccuggcugcugccuaucagggagcuggaaggggaugucacuggggguggcagcuggauuuugccucaggcacggguuagcucagcaggcccagucccaccccagcucacugcucugcaaggccuggagaauucucugccuuugccaucccccagaguucccagagacguagcaggagccagcuugguggagaggcucaagccucaggaggcccagacccucuuccagggccauggagcugggcuaccuccuugggggcuuccccacuggaagaggagggggcucacgugccagcugaggucacuggguagcugcaggccagcaugcuggcgugaagaggguucugaggccgcaggagaagcugugcgucauuggcugugucugccaggggaccccgggggucuguacagcccauuugccauccucugggcggggugauccgcugaguuuggcaacauucuuccucucaggcugagugagggcagccuccuuaaaggggcagacccccugggguacuggaugcucgccuagccaguagugugaguaggccccugucucuggaaggccccugcagccagacacccuccucccaccccugcaggcagcucaugcacagcagcaacuucagcagcagcaauggcagcaccgaagaccuguuccgggacagcauugacucuugcgacaaugacaucacagagaaggugggccuuggguggcuggagaagggacugaaugcaugccugcucccaggggagauggggugcacucaggcuacugucuggggacuugggagacccuguaccugccuaggaauugggggcagguggcccuggucacguguuccccacucccccaccccacacaugaccguucucagauacacagugguuuggagguccugcucaugaaccucauggcgucgagguucucgguucuguggccucagaggucuucuccaccccaccccggcccccugcugcagguaagcuuccuggaaaagaaggugacagagcuggagaaugacagccugaccaauggggaccugaagagcaagcugaagcaagagaacacacagcuggugcacaggucaagcaggcagcggcgcugggggcucggccgugacgcuggggaacaaagggggguccaucuugcuaagaccuccaggaggaggcagccucaugccuuugcagcucugagggucugugacgcaucagccucuugucacauggcccugcccacauguggugcccaggacaggaccuuagggacagggagacagguuggagcuugaccuuggcucuaggcccaauggauucuacccccugaggucugaagccacagggcugguccaagaugggaguggggauccacugugucucacucauacagugacaggagccugacgucccuuccuagggacaagcucugcaggggacaggccagugugagcugggcggugggaaggguccagcacugcugcugauggagguccccugagccugccguuccugaugcugucugcagugguggauucaggguuuaguuguccucaccagauggcaugacccuugggggacauacccuggccagggguccgguccuccaacuugucacagggcccaaagaugggcccuuuuguacaccccagaaggucagccugguggaggggcuguugccagugagacguaucccagaccgaaauaccaaccaggcugucacuggggugcucacaucuacgugccccuggcccugucccaggucuggggcagacuucaggccaccagccaggaugugccuauuuugggagucaaggugcccaauaagcugaauuauuaaucagagggguggccgggaaggaacagcacaaaaagaagaggugaggccugaggugguuccggccagguguggcugcagggacuggugggggcggucccucccugugcugcccugagcgccccaccuucugacugccaggccugccccuccauggcaugugugaccgacacccccucuauaugugcgguguccccguucaucucucugaaagcuacuggcccacacgcccucaguggacaugccagugacucagggucucggggcccagggucccccgugccacagccuggguuggggugaaauggugcaggccccaagagcuugcccauugcgcuguccucagggugcaugagcuggaggagauggugaaggaucaggagaccacggccgagcaggcucuggaggaggaggcgcggcgccaccgcgaggccuacggcaagcuggagagggagaaggcuaccgagguggagcugcucaaugccaggugggccccuccaccgagcccccucccucagagggacccccuguccuggggcagcccugugggauaggcgcuauccccauuuuauagaugggaaugugaggcugaggggcagccucuugagacuuuccaguaguaacaguuccacuuuaauaccacgagaaacacagaggcaugcucuucaggaaguucgcuaaggaauguucccaggagcguggcucacauuugguaaugcaaaccacacaaaugucugucagagaaaagggccugggcugggucucacauccaggccuggagcgcccccugcugucagguucuccccugaccccugguggacugagccagagccccagggccaagguaaauggaaaacccggcuccugugccuugcguguaccuguggcuucgucauuggaacgugacgcaggcgggacaaggagcagccccgggccagggaucugaguuggucucccauuagcuccauggccuuggacguacugggucaccucccugugugccccacagagcggcugugugggugggugagccgauguaaguccagacccugcccacgggugagggcuaugaugaugccucugugaugaagccccuuugcggcccuugaccgaggccgaggaggccgccugggcuucuggcagagaggacagcugcccuggcacuccucaggcccccugaggccccagucuccaugcugaggcuucccagaguugccgagccccaccuggcggcuggugggcugcugagcaaaugacugggaguugggcucucaggcagguaccucccugcccccgugucccugccccugugcaguuuggugaggagacuucccaacuccccggugucugagaccugcuuugcuaaguuacccaccagggguucauuuuacauuuugacucuauucuagaagcugcuguuuugcaucuguuucuggaggcuggugccuaguuaagggugacugcucucgcucagcccgccucggcagcuggcccaagagagguggcugggacacgggaggugguaaaagacagugugaaccugggccacaggacaaagugcagaaagccagcccucgggaacugucuccuaacgugugcccgucacacagcuccgggggcgccauucguguaaaauauccgagugguguucccagaguccugccguaugcuugguucccuaccacuuccacccgcuuggggccaccugcuggugguggggcugaauuccucucuggagcccagagggcaguggaggcccagaagccauccuuccaggaaagaggacaugauggggaggugguggguugagaacgggaugcucugcaggagucacugccagaagugacccuguucaguucugcugccaccgacggcccaacucaccugcaccuauucucagaccauuuaaaacugaccugaggccgggcacaguggcucacgccuauaaucccagcacuuucggaggccgaggcagguggaucacgaggucaggagauggagaccauccuggccaacauggugaaaccccaucucuacuaaaaauacaaaaauuagccaggcgugguggugcgcgccuguagucccagcugcucgggaggcugaggcaggagaaucgcuugaacccgggaggcagagguugcagugagcugaggucacgccacugagacuccgucucaaaacagacaaacaaacaaaaaacugaccugaacacccaggcucugucuucuuguggaaucccuuuaggauucccuuuguggaauuccugugugaacgcuaacacagaggauuauuacugucagagcccaugccuguggucaucagagggaggugcagugagcgcucagagaagagcccuggaugagaugcuguuggcggagaaugaaaagccaauaugaucauugccuucaaguuacagagucuaacaggagggcccagucacagaagccacaagaagacuguuucuccaucuagcagaaagacauccccguguugucugaggaucugaaggaugcauacaagaagaaucugcguuccuacucucuaaugaauguuuccacuuauuggaaaaauaaaggccacgugugguggcucacucuuguaaucccaacacuuugggaggccaaggugggcggaucacaugaggccaggaguuuuugagaccagccuggccaacauggcaaaacccgucucuacuaaaaauacacaaauuagcuaggcgugguggugcaugccucuaaucccagcuauucaggaggcugaggcacgagaauugcugaaggaguuagagguugcagagcugagauugugccaccucacuccagccugggcaacagagcaggacucugucucaaaaaaaaaagaaagaaaauaagaaugauaauuuacuauuuugcuuacaaauaguccuuacuauuuugcuuuggcugauaggaagcucacggcuaaauugucuuugacauaauaaucauauucuuucucucaguugguuucugguaucuuuccucugggaggaagcagagaaucacugcagacuggcaggcgcuuaucagauagucuacauuccagguuucugagauuugucuuucuccuuucgccagggugcagcaguuggaggaagaaaauacagagcuuagaacaacagugacucggcucaagucucaaacagagaaacuggaugaggugagcagcagauccaggcuuggaggggcagggcuggccaucgggagccuuuaguuuauugcuucugaaauucuaaacaaaugccgcacccccuaagaaaugcaaaaaaagugaauaacaacuuguguuucuguauuucugauuuuccaaguuuucuacagcgaauguauuuauuacuuuauacaauggagaaaaauuaguuuuagaaagagguuagcuucuauuugggcuaacaccuucaauucagguugcaucuagcaucguugaaggacuucagaggccugagguuuuuaguuguauuucuagaaucaucggggcucuggccguuucuguaagccaagacucagggcuccgucuaagggagcugguuucacugugcaucugccucgugaagauggcugaccagaccccagggacaccccuggacauagugagccccucucugggaacucuccuccccugaucgggucucccugcuccaggagcggcagcgcaugucugaccgucuggaggacaccagccugcggcucaaagaugagauggaccuguacaagcgcaugauggacaagcugcgacagaaccgccuugaguuccagaaggagcgggaggcgacgcaggagguaggucccaggccagcaggcaccagggcuccuuccagcaucccugcuccugccaaccugcuucucucccucgcagcucaucgaggacuugcggaaggagcuggagcaccugcagauguacaagcuggacugcgagcggccaggcaggggccgcagugccuccucuggccuaggcgaguucaaugccagggcccgcgagguggagcucgagcacgaggucaagcggcucaagcaggugggucuagcagucucuguguccaguggggcaggguggccgggcccaccacguggguuuccugugcaggaucugugguaggggagcccagagcuguagcagcacugccugucugcuucucagcaaccuguuugccagggcugacugccccauuucacagcucaggaaaaucgauccaaagaucucucccuuacgucuauguaaggaaauagacccugccuuggugcucaggguggaggaugagaccauacccagcugcaguauagugccuggaggcauuggguucucccagaaguagacccucacccaagguuccuuuuuuuuuuuuuuuuucccaagagacagggucuugcucugauacccaggcuggagugcuuuggcacuccauagcucacugcagccuugaauuccugggcucaggugauccuucugccucagucucccuaguaacuaggacuacaggcacacaccaccaugcccagcuaauguuguuuuuguuuuuugaggcagggucucacuguguugcccaggguggagggcaguggugugaucacagucacuauggccucaaauuccugggcucaagcaauucuccuaccucagccucucgagcaguuaggacuacaggagagcaccaccacaccuggcuaauuuacuuauuuauguauuuauuuccagagauggggucucccuauauugcccaggcuugaacuccugggcucaagggauccucccacccuuagucuuugaaaguguugggauuacaggaaugagccacugugccuagccagaagauuacauuucaaggagcgcugccuuagcuagagaccuuugggugggggaguggaucaggaggaggcaguggccagguggugcugggugaagugucagcucugccugacccugcagguggaagagccugcagcauaaauuauccuucugaguuuguuccacuggggacaaaggugcugguggcugugcucucacagaaauccuaaaaccccaacccuucuccuagucuagggguggggugcccagggucccaggugugagcauuagggcucuuuaggcaaaagcuggagugugagaccggugcaugggaucugggcggguccgccugggucaacuccaaccaagcaggauucggaacguggcugcugggggagccaaggaaaugagcuggccagccugcccagagagcccagagcaucacuuccuucacugggcugcugggugggugaugucccuaugcagggccuagggaggaagggauggccaggagccuuggcugcgcugagcagggcuguaacuccuccacaaacccugugcacucccaggaugccaguccccuggaccaggacccagcccuccuugcccccagcgcuuggcaaaggcugcaacaucuauggccccuugaaccagccgugacacacaccugugggaauggcgcuggcggcaggucggggacgguggauguggagaaguggguuccagugggcuguggaugccucuugggguugaugucgccuucguccuucucucuguaggagaauuauaagcugcgggaucagaacgacgacuugaaugggcagauuuugagccucagccucuacgaagcaaaaaaccucuuugcugcccagacuaaagcccagucucuggcugcggagauagacaccgccucgcgcgaugagguaaccacaccaccggcucuugcuuuggggccuggccgcccucugugauuccuucucccggcccccaccugcccagagugagaaaaccagaccagggccuggcagagagucccaucuacagcuaccccacaugacagggcaaggcugugagcaggggagggggcugcuggagaaguuaagucagcucugaguuccgccugugcuggaaggagugcggguuugguucagaguggagugugagucuuaggucggccagaaaaaugccaacauagccagcugaguggaucaagcugugacucuggguuaggcuaucacucccgcucuucccaguccagagagggaggacauuagcauuuccccagcaccugcuucugcgguguguuuucacuuaaucuccugaugacucugaggcuuuaggaacagcuccacauuccaagcugggaagguggaacccaggaccacccagcuagggagggagagggacccagcucucuccaaagccaaagccuacccuuccugccacaccagaguaugcuuaugaaagaucaggccuccaaaaugccccggcugcauuguaacaugaauuacaagacacucugucacugagccucacccucugccugggacacggggugaagagcugaccucuguccucaaggagcucccaggugagcugggccccaaccccugggcagaggcagcaugucagcaauguccgaaagaacacugcccuggagaagagcaguguggggcuggggguggggagagguguuccaggcaggagacagcuccccuuuggagucuuagcggcccugggacuuugucagucuugauuuuaaaugacuuuggcuaguguuuucuacuuuugcaaaaaauuacccacaccugggcccccucuacaaacugaucacauuggaaucucuggggguggggccugggcaccugcauagguaauacuaggggcugagccacuucgacucugguccuggcauccaaaugcugaggcuguccuggggcccaccuugcccaggaucuccugaugcccucuauugucaggcacuggccugcgacaagccugggagucuggacucugccugcacccuaucccaggcccagccacugacccgucuuucccauuuccuucagcuaauggaagcccugaaggagcaggaggagaucaacuuccggcugaggcaguacauggacaagauuauccucgccauccuggaccacaaucccuccauccucgagaucaaacacuaaggcacggggcuggcugcagagcagccuuaggacccugggaccaagggcagacccugcccaaggaugcaggccuaagccgggccucacacucacacuguaaaugucucucuggccaccaugcguuacguguacccguguauauguggggaggcugugcacacgagcgaggggugaguggccguggcugugggcagcauccacacgguuagccgugcaugcacuuuguggccccuuugcaaggggcagaggguacuggaagugggaggaggcaaggucugcuaucaggaguuacuguaaaaacaagaacuggaagcucguguuuccgguacuggguaaaaugauucuaccucuggggauaaggauucacauucgcucuaguacgaugggcucuuucaccccacuccuaguccccuugggagugggagcaaaauugugaucuuuccuaggaguuugaaugccccauauuuguguccucgccagcucuuuggccaccuuucaagccccaguguucaagcucagagaggaugaaggggcaucuggaggguccaugagauggggcccucaccaaaugccuuggccaccggccagcagcccucugugaugugugugcagagugaacagaggacucagguuucauagcagcuagugcggggcauccucauccuguaccuauagaguucgugcacucccccauccaugcuaccuaccuccccguuucuguuucaguuuuaagacaaugaagcagcauucacugcgucauuguaacaugaagggauaaaaaugaaggagaaggaggguuugggaugggugucuaaggcaggaguugacaucgggcaaccaaagaaaugaguuuuggggaggaacacaacucccaucccagucaguuuccuucccauggcugcaucuuaagauggaugcacggagaaaccgucugccuggcucccugucuucauucuccacgcagccuggugauggcaggccuggguuuggauuucagaauccuagcuccgggcuccacucguguggcagcaagacugcuucguuccagcguuuagaaacacaccuguauuugauucucagccaggggagcacucgcugcacuggugggaggcgguugggaaaguugcaggaaaaccuuagucuuccauccuucugacccaugguggaaauucacaccauggauuuuuaauggaucuuuguucuaggcagcugggaauagacaugguacuuaccuuagaguuuuccaauuuaucucaauuuuauauggcuugugauucauuuucuuaauccaaauauauauaaacguguguggucuuauucuucccccugcaguuucuugcuuucuucagcacaucuuauaguaugagaaggaagguuugggcauguugggaagggcgguggagggggaguugcagaaagagagggcagugagggugaggagaggggaucuggggacuugggugugacaccugcuugacagaggcagggcuguggccaggaccaaccuucaauuccauuccaaucagccuuugcauuuguuggaucucguggcuucuuuuuaaucuuuuguuggggauuaguuucaugcugcacauaaugggguugcacuggucugacccaggacuuuggagccacccacacugggaagacuaggcuaggcagucggucuucuaggaguuucucagccccuuaggacgcgggucuccuugggcucccccaaggguucugcgaagaggcaguggaagaaggcaugaggagagggucucuugagaauuugccaauaggaaggaguggccacggcugaaaggaacaagacagauccugacauagcuuuggccuggguguuaggucagaaggaguacuggugcgugggggccuuaccccaggguugaguauuuuaucuguaaaauguuaucugcccuuuggcugcauuggaauuucagagaaggcugcagaggccuggguuacacagccugagucacaacgugggaaggaaucucugccacgggaaaggugggcggaagcagcuggcagccuggggcgugcuucaggcuccucccucuaaggggcgccaugggaacaggcuccggagggagccggcgucugaaaggcccccgggaccugcugcagugccagaggggccucuggagcaggccuggcuuuuaaauggggggcugaauuccagcucacacacaccucaaguccaaccuuacuuucuucagccagaauacauuucuuguaaaaccuggcuuguugcuuggcuuuuaaagaugguguauguuuguaaaaauauucuucugggcucaaaagcuagcuugagggggcagaugccccaggugucccagcuccacagccccuggcagaucccagaccccuugguggcaggucccagagccuaggugguaggagcuugaucuuuguuucugcccuuaccccucaguaguggggcugcgagguaguagacaggaugcccaguuaaguuugaauuucagauagaaaauaauuuuagaauaaauauguucuaucuaauacaugggacagauguuauuuuuagagauaggaucuugcucuguugcccaggcuggaguguagugguaugaucauagcucaccacaaccuugaacucccaggcucaagcgauccucccgccuuaacugccugaguagcugggacuacaggcaugcaccaccacgcccagcuaauuuuucuuauuuuuuguagagacagggucucacuguguugccucacucgagcugcugaccucaagugauccucccaccucagccugccaaagcacugggauuacaggcaugagccaccaugccuggccaggacauauuugaaauggggagauuuuaaaaauucugaugauuagacugaauccucagacguucugguuugauuguuguggguguagcccaggcaugggauuuuuuaaagagcugcucagguaauuccaauuuaauugcguguccuacuuggguuuuuuguuuguuuuuauuguuuuugcuaaaccuggcaacccuaccgaguagggauuagcaguaacuuaucugaaauuuagagguguuuuggggguggggcgaggguuucuguaguagacucagauuuuacauggcccugagcugcccuugcguucaguuggaagccacgcaaaaugaacugaaccaggagugagcuucguguacauuaucuauuagaaaaugaaguaccuucugguucagcuagucccugugcguugagaggcuuuaagaaacuucuaguaaaaauguuuuuuucuuuuagcuuugaauuggccagaguuuauccuagauuauuuuauuuuaaauugguagaauucuuugcgaacugucacagagaaauuccuuuucaugacuuuauuucugaccuauuaaaacaugaacaggccaggcaugguggcucacgccuguaauccuagcacuugggaggcaguggcaggcggaucacuugagcucaggaguccuaaaccagccugggcaacauagugauaccuugucucuaccaaaaguuaaaaaaaaaaaaaaaaaagcucaagaaccugcacgagggccuaaaacagugggcucagcuuuggcugugcauuggaaucaccuggggagauuuguaagcuucugcugucugggcugaacccccagagguucggauugaauugguguggggugugguccaggcaucgagauguguaaagaccuccccaggugaugauaugcaguccgagguugagacugcccuguccugcaaggucguuggccagagguagaggaaacuggucaaaguggcuguugggcuugucaagcccguggcugaaugacagugagcucucuugcugggaggguuccuuuuccuguuguugaaugguccuggccugcaggaugggaggccagaugccuucaggagcugguggauccagcuguucucaccagccuggagguuagcagaccagagugggugggcaggaccuuggccuggugccccuggaaucaguggguggcauguguugggauauacuggcuacaggcucaucucaaagagcagguagaacagagucagcagggaacugacagguggggcugucccccugaaagcagccgcagaaacagcugccaccuauuugcauagcugagcaggaggacauacugucuuuguggguuuugcuucuggucuguuuccugacuggguugauaaagggagucccagcucguucccuguuagccaaaccagcauccuacucacacaccggacacuccaggugcuaguccacuggugcugguguucaggggaguuggggggggggggcgcggggacagaagcgcggguucuugguuccaaugagggacuuagcagaagccuccaggggccagcagggccaggugaaacugggagaaaugaagcccucuguguccuguguguguggugggguuuaaugcauuagcaaauuuaaacuuaaaaacuaacucuaggccgggcacgguggcucacaccuguaaucccagcacuuugggaggccaaggcagguggauugccugagcucaggaguucgagaccagccuggacaacauggugaaacucuugucuuuauuuuuuuaaaaaaacaaaaaguaacuuucgaugugaucauaccaggaaaguuuugcguggucaccaugccaagaaaaugacuuugguugcccagcagauccacagcgacucuuucucaagggcuacuguggauucuagauugaggaaaggggccacuuaggacucagugcugguauccuccacaguccuuucucccagacucuggcccucccuuugggacccaggaaauccccucuagggugacgcugcuggcuaggaagacugaggucugcugcgccaaggggccucaaguuagaagggccaugccguucaguggaugacuuugagcgcugauccuagggaccugccagguccucacuuccugcccugggugcacacaugaauggggcagccagcaggaagcgggagaggcuggaaccaggagccugcccuaccugcauggcaggacaacucugaggcccuucugccauauucucugcuacccaccagagaaaauaggcugccuucuagaaagauuuguuucuaaaagcguagacccuggggaaguauaaugucaccaugcucaccaggcgagguuucccauaugaccucccugccccgaccucguagguugcuccuuuccccaucuguaagguagagaugucugccccggagcuaccagcuggggauggcauccaggccaugucuccugcaggauccaagugcuguuguccccagggugacccugccuccugcuggggcccauccgcuuugcugugcugcacaggcuguuuucaucugcaugguuuggggucuuuguccuugugccuuuucuuccccaucgccacuguacaggauuuuccacauugcccacugccuccuuuucuacaucgucucaucucccuggccuuucccgagcccuguaaauguguacuuuuucaacgugccucccccaggugaggccagcucucccgggcacauucguccacaaggaucaggccccacuuacccuuggcucgcucagccuguagacuugguaacuuuguacagaaucuuucauuauugucuuaagcauggggggcuaggacccacuuagucccuccuccagccugcagcuaauuuaggagccuugcauuccagaaaagggcaacuuuguguaaagcagcuucucccacagagcuuucccugcauuguuagugaugucgggcaaagcaucacucuuuaaccuggggcauuggccccagcagggauaucaugggaccgcagccgcuccgugcacugucucugcccccagaggaagcccuguccaugguuccuggugcacggccacaggccugccuugaggccaccacaucuggugucuagaacagcugcgggccccacuugggcagaaggaagaggugcuagcugcugccccugccugcugugaacaccugcccagcccuuccuugucugcugaggugcucagaccagagugccauuaaauaccaacugaugucacggagcggacggugcauugccaaggacucacagcugugggcucccuuccagcuccucccacuuucuuggcugggucuucugaggccuacguggaaugaacuacacauguggccucaugcccaaggguuuguuagauggccucugacucugugggauucaacuugacuuuuuugccccaggaggcucugucuggaaacaggcuuagcuuuagugcuggggugggaccugcccugugggccccagggaggggacagugggggugaggcccugaggcuguccagggucugagcucuuugccuccaaccugcuucugccccaaaaggaacaggcuguugguggcaggcuccucccggggagcuguacuguacagaccaagguguaaauaaacaguuugcucuucucgccugac

SEQ ID NO: 16724 - RNA, 789 nt, Homo sapiens
uuuaaaaucaguucuagaaugaugagcuuaacaucaaauuuuuuuuuuuuuugagauggaguuucacucuuauugcccaggcuggagugcaguggugcgaucucggcucacugcaaccuccgcuuccuggguucaagcaguuaucugccucagccuccugaguagcugggauuacaggugcccacaaccacgccaggcuaauuuuuguagagacagcguuucaccaucuugaccaggcuggucuugaacuccugaccuggugauccacccgccucggccucccaaagugcuggaauuacaggcaugagccaccacgcccggccaacaucaguuuuuuaaaaaaauuaaaagaauuccagaaacguucauuagauagauauuucugaacaggaguagcauugggaguagcauuacuccacuaagacuguaguccuggccaaacugaacuuacuuuuccccuccucuuucucucuugucguuuucuuucuuuuuuuuuucuacuggguuuguagaucagagauugucagagacauaguguguaucaggacuucagcaagagauuugccucuuggugagcaagauagaggagagugaaugugaugaguguagagaauugaaaaguuacugcuuguuuaucuauugucuguccacuuggaaagagguguacugcaagauuuuuucaucuuguaaaugcauggaagguuugaauaaagaaaaauuaugucagaccaauuuuccagugggggagaauagcuaauauguuggaugacggaaucaggauucagaaag

SEQ ID NO: 16725 - RNA, 1736 nt, Homo sapiens
cuuuuuuuuuaagcaauuuccccacucccaaguugggccaguaaagauuacaugaaaacuggcacaccuauuggcuggaauacagaugcaccaaaugaggauuuaaaaacuuuccgagcgaaaaguagaacaaaaagaaaaaagaaucuccuagcauuuucccccaagguuucacucucccgccacacacacucuccaaaggaccgcuacagauccaacucugcaagagaagacagagcagugucaaucaggaagccaugaggacaccaggaggagguuuucagucucgacacgcagaagacagagcugcccagcccugggguccugaagccagcacucaccuaugucaguuucuuggcuuuguuguagagggaauccacuacuuugcucauguucugaauuguuuccagagcagcuucguaaguuuuaucuacuggggguucaucgaaaauaaucaggacacccucccccugguccaaaaucccugcaagaaacacaagggcaacccagguaaaagaugagguuagacacaaaaguguuugugaagcagcccacucccuaguugacucacuguguccagaaaagaagggaaauagaauucaucucccuauuccauguacacaugcuuauuacacauucucaucacagggaagaggggccaggaccccagggugaaccaucgggggaaacaaauagaacaucuucuuugaaaauaaacuucuucaaccaucucaucaccaccaccagcccccuugccugugugacuguuacuuaccaugaaauuucuugucaagaaucaucugugauaauuuccuuuccacgucggccuaaaaucaaagcacaugauuaaagggaccaguauccacuagucagagaucacccugacacaguagcuuuguuggaggggucuuaggccaaauggacugaaaacaaaauagcaacaaugcaacuccuacucuaguccacacugcccauuccccacugagaagcuggggagcuuuccaaugaggccaaucaggugcaugugccaccccuccucgccaccccgucccauuccucccugcagauggccuuaagacuccuuaccuuggagaguuugaugagacuagauauguguucaaucuaaaaggaaaggcagagagacaccaacacugaaaguuuuacuuuugccuccaauaagagaagggagggaacagggggagaacugcuguauuucucaaaauucuaauguaagacccuccuuggccgugcuuaagucucuuguucucugcccaucugccugcccuucacugcuacacacaauaaacagacucuuaucccacacacccaauacagaaaacagguacaacacaugcagugacuaaaagcgaggaggaaacugcucagaacacaugcaggggcaacccacaugccucuacccacagcaucucucuccucgauuuuuguucauuuuaucaacagaggcccaagcucuugguggccucuugcccaccaggcacaccccuagaagugaguucccauucuggacagguguggaagggagguggcuacagugagaaugccuggccagaaauggaguccccagaggguucucaccuguacucuggaaaaaggcucaaugacucggaucagauucuguucuaguaaguuaucauacaacuuggccaagugugugcugaugauugggucaucccggagcucugcccgguaaucugucagagccugccaaaggaacc

SEQ ID NO: 16726 - RNA, 13777 nt, Homo sapiens
cauacacagaaaucauccucaggauucuuaggcucucuccuuccaucuaaguaugucccacaauacaccaugcauaugaauuugacucaauaacuacacacuugagggaaacauaaguauaaauuuacuauccaccuagugguagcuagguaaaauugcaggcauaaagauaaaaaagaaaucaucaacuuuguaguuccucagcuucaaacccaaaccugcaagggagaggagagacccagacgccucagggaccaggcagauaauacaaauaaaugaaacaggccaggugagagaguacaagucuugccaaaagaagaaaccccuacuuaguuucaauugauuguccucuucugaaaaugcagaucagaauugccacacauucugaccgaucgagagaggccagaaauucuaauuuuaaugugaaaccucuugauuucuuagacgguggcucaauuuucuugaaaacacuaggugagcuaaauaaagcugacaguccaccaguuuucaauacuccucuugcagagagugaauggcaucuccccuaacuguaguauuagacugccacucaccagccacaguuugcaacugcaaaagaggcauaaacugacggggaucuccugcuuuacuaugcacacacagcugaacucuccagccguggagaacaacuaacucuauaggaaaaaguagaaggcuaagcugagccauccagggauggcggcaggggccuucauggcuagcugcuggccuguaggcacuaaauugcagacugcuccugcaggaagccuucagggccugggaggccuuuaucuggcucagaagcuagggcugcuucucgaaggacuuccaaaugcuccucagcagccgacagagacuggucaauccaguccaggccucccgucagauggcaggcauuccuugucaccagcaccaggugacugacagacaggagcagggcagucguccuagggaaaaaaagaaaauagggucagguuuccuaggaaaugagggacuuugcacaaaagcccaaauagauagacuuuuugacuaguauuccccaaacugcacacccuucccuaggauguugguagguaugcaauuuaaaguuggcuccaugcucaaauaaauuuggagauggcuggguuaaacaugguuaacugaagccugccucagagccuucugagauguaccugguaaagcuccaaggagaauauaacaggcugucucucacaagcuuauuuaagacuguggaagccauuuucugcagcacaccuauuaacaucuccccaaagagcgcuuugugaaacaguucagauauagucaaucagaugagcauauuccccaaccgcugcccacugaaacauaggacagacacacccucacuuaaacauuccuuauugauuacaaauugguaaggcccagggcugguuuauccaacucaaaaaaaaaaauguaacugaaaaccaaagugaggaguagauuuuucagugcugaaagauucacuguagaauaccuuuuauaugguuaguaccaugaugcauuugagaauacauuacagauuauuaacccacggacaaagcucggcagcaguaggaguggggcagagaaaccaaagcugaagcgcugugacccacugccgaucuggcaacuguuacauguguaugacacagucauauaaauccaaggcacgaaagaaucuauauuucuuaaauggguugcaucugguauaggaacauaacaauuucauagggcuaaguacacucuguguaugcgcaugucugguggcaggugagcacagcuguggcugaccugucaccuccauucucacugcucugggaaccacugccccaccgcccaacuggguggcacucacagcuaaggcaugucugcuucugggguacaaaaaucagagggggaaaggggaaaagguagaagggaaggcacaguuaggauguaacauggccggaagucuaaucauaacaauuuaaaaucuaagacugccucuuucuucuccuggguuucaggagaggacuggccucuaucacccagucaggcgccgcucacugaaguaaauggcacgcauggcccgggcagccuaaggaggcugcaaagccacccucccuacacaagccagucagccagccucacagaucugauaaaacgguuguggaccucugcaugaaaaaccgaacaugcacccaccccuggucucaccgugcguccaggaguuugggguccaacggaggguacaucgacuucacaacaucauccacccugaccggaggcaaaagguguucaguacuucacuuuccugaucuccuuuucuccuuuuuuuuuuuuuccugagacagagucucgcucugucacccaggcuggagugcaguggugcuaucucagcucacugcaacauccaccucccaggcucaagugauucuccugccucagcuucccaaguagcugggauuacaggcacgcgccaccaugcccagcuaauuuuuguauuuuuaguagagacgggguuucaccauguuggccaggcuagccuugaacuccugaccucaggugauccacccaccucagccuuccauagugcugggauuacaggcacgugagccacacgccuggccccuuccuuccuuucuaucuuuauuccaguucuucuuuuuugguauuccagaccuggucuuuaaugguucuuucuccaauugcuucugcauucucagacagacacuuaggcacaaagacuucagguucagucuuugcagagacuacuuuguuuucuaguuuuguuucaguuccaaugguuuuuuaaaauacagucauacauauggaaugauguucaagauuacuacuauauuaaaaaggcaaauugccaaauaauauguaaagcucaaucugucauuugcauaaaaauagauaaacaaaagcucugaaaugugggguugggaaggaucuggaggaacacucaccacuuaauagugguuuuuuccuacaauugggagggaguagacuuuccaggucauguaugucugcaguauuucacauuuuuauaagcauuaauuacucuuguauucaggaaaaaaaaauacaaagcuaaagguauguaagacaccgaaaaagaaggccaugaguuucauuuggcuucacacugcucuacuggauuucuucuacccugugguuaauuuuuuuaaaucaaguucagaacuacaauucauucugauuugcguggcacaagguuuugcuccaaaucuuugcucaugaacacucgauaggaagaaaaaauaaagauguauuguuugauuucuaaaagcacuugaaaaaaagauggccucaaacacucuuauucacggcuguggagccggugaggacaugcagagacacagucacccuccgcgccuaucucagccagcuccuuucucuagugcccuggagcugaagccaccuccucgagacucacaggccaucaacacacugugugggauaaauggagcaggaaaaacaauggggacaaaacauggccagaaggagaaagaagugugagggcaaaaggacaaagcaggacccuggcugaauuauggcacggagcauucuagaaguaguccaagguacucuuuaggaugggccugugagcaccagaacagguccacucucuggacaaugccacacccucaucuuaggacccgugcugauccuacucacccaggcucacacagaaaccucaaccuccugaaagugcugccuuguaaccuguaucacaggaaucugccuggccucuaaguggcucuuagaaggcacaaaaagcaugacaaagggucuagugaauaccauagugcagaaucuuuaaaacuaauggggaaggaggccgggugugguggcucacaccuauaaucccagcacugugggaggcugaggcaggaggaucaccugaggucaggaguuugagaucagccuggccaacauggugaaaccccaucucuacuaaaaauacaaaaauuagccagacaugguagcaggcaccuguaaucacagcuacucagggggcugaggcaggagaaucgcuugaacccgguagguggggguuguagugagccaagaucgcaccaccgcacuccagccugggugacagagcaagauuccaucucaaaaauaaauaaauaaauaaaauaauggggaaggaaugcccagugcccacccagagccugggauguggguucuuauaaagccaggggcugaccauguggcuacagcccacuggaggcaauuccagagaaggcagggaacuguucucagcugagucccucccuggauuaucucccucccacucucucaacucacugaacugccuggacugaguucaagcugaccaggucguguauucccucagaggaacucacguggcaacucaggaaacuggucguuuuuauuugguuaaucuugaggcagagaaagggcugguuccucgugauuuaccuggggccauggcaacaaggaacgugugggccccuggaacucacagcagugccauuguuucagcaggcauacagaggugcccucccgggugggcggaggggccagguggcugacguggaaaacauccuggccccgacccucugcucaggcacgucggcauaccagccaccagguggcagcacaaacuuaguacagcccuuggcucuaagaaaagggcuuuauuuuuccucacgauaucaagcccaaaugaggggguguagcuguugacugcaauccugcugguugccucccacacgggauuucgcaguuagccuggaaucugggagguugaaugccauauggcuucagcucccacccagugcuggaggcugcuggccugggccagggauggagcagugggcacagccagagugggucccccaagcuagucuccaacacagauucaggcagagacaggggugugggcaucugugugacauguuggccugggaggaaggcgugucaaggggagcugguauguggcuggguaagaggggcggccacgggcucugcagggcagggucuaggacagggucaggacuaggcaccugcuggcgcuuccccaaagcccucucagaugggucaugcugcagguggggaugguggaagcccaccuuagcugagaagucucgguaucuaaacccuccuggucacucuguaaaugugugggaaacaaauagcugaaguugccugugcaccauuuuauagaagagcccagcucugcggcuaccccagcuuccagccccucucuucccucagggaguguggggaccucgaagccgccaauugcucaccuggggcugauccgcuuggccaccacaaugaugucgcugacacuggcugaagucuucaucuuggccccagagcccauugucauggcaacaagcuucucugucagagugugacaaaucuaaugcggcagggaggagagagaugagggcugaccuggcuccacucagggccucgccacccccacgagacaaaucagcccugccgugaguuccaucgcagcuggcccccaaccuaauggccagaugugaaaaguacagagaugagaggaaacgggugggaaguggcaaaagccaagggcauggcugggagaggaccuggggugggagccgcagaucaagggcagggugugggcucugggaagccuaagcugaaauaaucugucuuaagaaaaaucaugugcuccaauuucaccuucucacuuaggggaaaaaccuacuuucuuuuucuauuccuucaucucaugguuuagucuuccacaagaauaaauaucuccaacaaggcacccucaggaauggggcugaacaaagggcaauuguucccuuuaagcacaugcuccaauaacagcacuuauuucaacaauugucucagguaauauauuagcauguuuaucaagcugaugaugaaaggaccuuaggaaaagcagggaaaaggcaagacugacuacagccuucuucguggucccacccacagagcuggccaccccagagcuugcuuccccuuuccaggccaccccaugcuagaaccaaccaacaugggugcgccucuauccauggcaaggaagcaccccuaccugaccuauacuuggagcuggacaguagagggcagaaagaagcccaaagguccaccugggaguuagcccagaccccucucccagcucccaccacagagacucaagggcaggugaccuagcaaaagagucuuaagaucccaagaggagacuuagaagcccucuccuuugaucagagguucgccggguagacacagauuccaauucaauaugacucccuccagcugauucaucucacaccacaggugccauuuauccuccuaauagaugaggacaggagacaaaacccaggcccaggacacaucuuggccaggagaagggaaauguaguauaguauuaucuucuagccauuaugccuaccuagcucuaucaauaaccauauuuauaucuauagccauauuuguauauccaaagagccucucagaauuaacuaagccuggacucugagauaauaacuuccuacuaggcauuuauccauccccugagagagacagccaaagaagaggugggguaaagaauguuuuauuaauagugucuucuacugaaugacacuaaagaaaagacaaaguugucucuuuugaaaucuugaauaauuacuagucaaagagauaaaugugugauuacccagguuacugauguaaaaaaaaaaacccugauauuugcaacuggccaaauauuucaguauaguuauuauucuauuagguaggauauuaacaggcaagaauugaaaacaaaugcuaaaaccauaaaauuacccaaaaugcaaauuggaugcaauuuuucaaagauuccaggcuuucaaagaaaaaauccucugccuucagauugaaguaugccugcuuugguuuuuuaacacugauugucccauuuggcugacuacggucacagccaaagaaggcuagugaugacuuucuagucacaguagaaauccaaauacagaaagaaacucaccauacaggccugaacucucuguuagugaaaaugagugugcagggggaagcagggaaaccccauuucucuuggcagcuacacggucucaggaauacacagcuuucuccaagaggagugaaaugguggcuguguaccuaggcugucuuucccacaggucauugaauuaagacgaccagaugaaauaaagccuuugaaacagccuugagauucugugaacagccaguccaggcagggggggaaguaaaccacaaaaauuccaagugucaaguuaaggaaaggccucuugcgagaggucagugcccuuucuaaggucccguucuacuccauccacgcacaguggugcuuuucgacuacccuuuaucccacagagaaauaagagaggguuaccuucaagauggcaaugcagugggacaugagaccccuggggaaacaagaagaagucaucagugcucaucuggaggggcccaccacccuccagcucccacccuugcuucucaacuugcccugaccggugggcacagcccaauaccaaccacugagagugggaaugccucagugucaacaugaaccagcccaugaguuaaaggagggagcaccucccuucccuuccccucccugcacccaauccacucuuccagcaagcuccacugugugccuagcgagucaugcuuuaauauaacucucaagcuucugguagacuguucccucugcccaauguguccuuccccuuugcucagacuggggaacuccuccucaucuuucaagacccaagucaaaaggcaccuccucugugauaucuuccaugagauccagcucaaccuccccaacccaggcaaaccuagacacugccuucuccaugugccuacugcacuguacacaaggaucucuuacaguuucugugauacugacuauaacugucuuuucaaccguuucaauaucugcagcaccugacccaguacccuccacauaaugccccacaaacaugggaccagggaauggauggcuaaauggauaaggcaaugaaguagcagccgcuucucaaaauguaggggcuccuguuggauggagagaccccugagauccuaaagaaaagggcugcaucucugaagccugagccaaauuuaugggcacucaaggauaaccaaagcacaccagggugacuuuauaacaaccuuugccacacaacuauaggccgcaguguucaggucuacaaaauguggggagagaaggaaaggacaaacacuuucaagucauauucugauuuucccccacacuaaaggcacaggaaagagcagcaaguaacagagugacuguucuugaaugccagcuaagugcucuggcaaaggacaccagcaaagggcaucauuugccagaagcccggaagcaaacaguucccauggccuuacgaggcaucuucgauccagucuucauucuccagaauggccucaauguggggguuggugauaacgacaucguccaguucuaacucagagggcucagacugggucuccauggcaccaaugagguccacaaugggccuggaagaaaaggcccccguuaaaugguuucauggugggugaccgcugcugauccucuccucacugaggcccacauacaccauaaaagaaguaagggagucaguaagcuagggcagagaccacuugucccggauccaaaccuaagccuaguggggcugcagcugagggcagggcacauggcuagacagggaguuggggaggcaggccgggagcacuaaaacaaaagaaaagugaaauggagucagauaagcuaccaagagaaagaguaggguauaacuaccugauuacaaagauguuagggauaucccuucaggacaaaauuauauccuucuauaauguauuuucccuuuaauccuacauuuuacagagaggcggugguuccuauuacccaaaccuacauaggcuccccaccuggucugcagaauaacucuugugaaccacuuugguccaucccuauaucccugccuuuuccuaguuacacuggaaaagugaaagaaguaaaaacaccuccaauuuuacaacaggguacuuuagaaaaugagauaccauggcauucuguucaguagaagagcuuuccugggucauauaaaugggcauuuauaaauuaugaaccacuugacagagaugcugauaggauuaagacagaaggauaagaaaaacuaaggguuaaucccugaacggucuaucaauuaaaauaucccuaaauugaaaauagaaucuugcuuacaaaauauauuucacauacaaugcaucacaaagaaaucugcugggcaggccaagcaugguggcucaugccuguaaucccagcacuuugggaagcugaggcggguggaucaccugaggucaggaguucaagaccagccuggccaacauggugaaaccccgucucuacuaaaaauacaaaaauuagcugggcgugguggugcaugccuguaaucccagcuacgugggaggcugagacaggagaaucacuugaacccgggaggcggagguugcagugagccaagauugcaccauugcacuccagccugggcaacgagagugaaacucuaucucaaaaaaaaaaaaaaaaaaaaaaaucugcugugcaaagagagaaacaguccuaaguugggauuucacaaaaccaaauguuuguugcuuagauguauggccagagugugggcaucugauuucuguuccugugggucuggcuggaaagugauuuggcuuauccaaaugcuaagugagguggccaguuugagacagauggcugagcuuuuaugcuaggugaacauguucauauucagugacuuucuucuuggcucaggaagcagagaaggaggugacucaggauguugggaggcuuaaggaacauucuuaaacucugaggucuuuacagggaaggacaccugcagguaccauuuuagaaccaaaaagcugaguuagaguugcccaacacugaacuacguguuccucucuuuuucuuuaguuagagcccaccccuccuccuugcccuccauaggcucacucacuuagaaucauagcgcugcagcaggucucgcggccggcaguagcgcugccugcaaaccagcaccaaggcugcaaacgaagccagaaagaugguggccagcacaccuauggcaacaaucaccacagucuccaugcuuccagagggcuccugacucagucccggucacauccuccucaugggcuaaagcuugagagaacaugaagucagagcagaucuggucaagaagccacgaaagagagugggacaggugggucuuaccugcuggaaguggcaaauuggggaagaggauggcaggugcuagguuccuccacgacaccugcagagaccugagggccugaagagaaccaagguaaaauuuaugccaugccccaaauuugccuuuuccuuucucagaagaauuugcuccccaguuggacuaaaauuuuuuguuuguuuguuuguguuuguuuguuuuuuuaagauggagucuagcucugucacccaggcuggagugcaauggcacgaucucagcucacugcaaccucugccuccuggguucaagcgauucuccugccucagccucccaaguagcuaggauuacaggugccugacaccacacccggcuaauuuuuuguauuuuuaguagagacgggguuucaccauguuggccaggcuggucuugaacuccugaccucaaguaaugcacccaccucgggccucccaaagugcugggauuacacgcgugagacaccgagcccggccuuaaaauagcuuuuuaaacccuagacaaaaggaaacauuuuaacuagcaguuguuuucgcagccauaaaaacaugcacaaaagaacacccauuaaagagaggaaagaugaaacuguauuuacugaggaucuacucugcaccagguucuuuguuaacuuuuccaacaacaaucuuaugaaguggacauauuaguaaucccauuuuacaguugaggaaacugagguucagggagguuacagaauuuuuccaauaugcagucaggagauggaaagccauccacuuacacugagauggacauucacucuacuuuuccuuucuaaggaagaaagaagacuguaaagguucuggaaagaguucuaauugccaguuucaguguuggaaacuuagaacuggcauuaaaguguccauugccucuugccaguuuucacucaggagacuguuucacaucuauuucuuuuucucauagaauucuuuuauuuguguacaaaagaagaaugaaagaaguccgugcauuuguauauacuagugcacagaauuuuuuuaguaugaacacaucgauaggcacaaacacacauaaaauguaacuugauaacaguagcugccucuggagagaggaacugaagaacggggucuuucacaccuauuuuaaacucauaagccagaagaacaagggcaucucacagaaguacauauucacuguuauuucauuguaggccuccugcuugucucucuuugugcaagcauucuccccucucugggcuuuaauuuccccacgugaaaaaaagacacucugacuuaggaguccuuagaauaccaggagggugcuuuuccucuauuugcacuuaauucuauccuccaugucucggaggguccaaacgcucucggucaccauucacuaaguauuuauugaucaucuacuaugcaucaugcacuggagauuggagauagauaggacagagacccugaucuuaaggaguuggugggagaggcagacaggugacaaaccacuucaacuccaugugccugugcuuccugcagaagaacacagaaaagagaguaacugugcuugcaugacacuuucugggaacugacacuuucacaggaguggugaggcuagagcuggguuuugaaggaugagcaggaguuugccagguagacaagguugggacaugccuggcuuaaagugccaaggaagccuuucucaaagggcucacagagcugcucucccaucucgagcucacuggaccacaagaaggagaaggcuggcaucugccucuucugugugugucgcugauuuugugagagguaggugggggagggggguaauucucaggguccgccucuguuucucuacguguguguuucucuuuacuguccuuuuaaccaccuccuuuuggccuuuguguuuucugccuccucuuaugucugccuuuaucucuguuucucuuuccaggcaucuuucccucugcugcucccgucucccgcuucucagugucucuccuuccccucccccgguccccaggccuccaagaccacccacuugguuuccucucucuuccugugcguucugaguguuucucugaucguguuucucugggugugugugagcugagugugcuucuaaguguguuucuccguguguguuuguguuagugugcgugagcuguuuuucuguuucugugugugugagcuguuucucagagugugcuucugagugugugagcuguguuucucagaguguguuucugaguguuagcuauguuucugaguguuuucugaaugugcuugugugagcuguuuaucuugagugugcuugagugggugugagcugauuguguuucucagaguauguuucugagugugugugagcugaauguuucuccgagugugcuugugugugugagcugagugugcuucugagcgagugugaacuguuucucggaguguguuucugagugugugugaacugaauguuugagugugcuucugugugugagcugaguguuuaucuugugugccucugagugcguguguuucugagugugugugaacugaauguuucugagugugcuucugugugugagcugaguguuuaucuugugugcuucugagugcguguguuucugagugugugugaacugaauguuucuuagugugcuugugugugugaccugaguguuuaucuuaagugugcuucucagugcgugugagcugaguguguuucucggagcguguguucgugguccuucucugcagucugcguggcguuucuuuguguuuuucuuucucuauucuucccugcguacugaagaguaaguuuuccuguuuuucuccgucucuuucucucucccuuacuuucccccuuccccuccgguuccagaaccacaaggacagaacagacccaagacccuacccgcuuccccgugcucguccacccaggacgcccacucuguccccgggagggagggacccccagcccgcccgggacgcgccgcacgggccccggagcgcuccggggcgcggcuccuacuccuuuccccaacuucgggcgcgcggccccgcggcaagaacaaagcugcggcacccgccuccccucuccccggcagccgggccaggccccgcgcccccgcguccccuuccccgacucgccgcggcccgcccggcccggcggggcucacccaccucaggcuguggcucccgggcgcaucccgcgacugccccgccgauggcaaaguccgggcgcgggcgcgggccugcagcggagcaugccgggaagcgccgcggcccuaggaauccagccucgcgcccccgcgccccggcccccggcccccggcccgcgccaaauccccgccgccaggcgccgccgucaccgccaggccccccggcggccggggcagcugggaggcgggcccuggcgacccaacaccccuuccucgcgcccccgcg

SEQ ID NO: 16727 - RNA, 2130 nt, Homo sapiens
uuguaugucccuuugcagugccuaccacuauagaggugguauguagacaccacauccccauguagugccuacauguuaaaauacgugcaaugaauucauaauaguaugcauauugaugcauggagaaagaugaacgugaucacaaacauagaugcauuucuccuuuucccccucaauucuauuuuucucuuuuuuauucccauuucauuacuuauauuucauuuuauuuuaugaaagagcuaggaaauaaauaaagugaauuaaaacgaauacacaacuacuuguauggggguuauggaagucaucaaaugugaaugggcacacaaaugaagucacugugaucuguacacacuuaaguauuuuuuaaaagagcgaagagauggauagagacgggaggagguggggggcauggcuagaagaagguagguaggguugaugguaaaggaggcuguguaauaagcacgaugaucaagguaugcugaaauaccaccacugccaaccgcuggucaccaaagaucagaggcagcuguaaccacacgcauagaacacaagggggagaggaaguuccacccgggaaccaggcaaggacaaacuucucuagcgcuguuccucucucccauuuucuguagaguguagcuauggccaaggcggugcugauacaguuuuguugaaagccugucuguugauggugggcuucagggacucucugugcacuucucuuuauuugugaagcaguuggcuccagagauugagugacagggagaaagcaaacagagauggcuucuuucuucuauuuuuccuucgcaggggaaagagggacagaaguagacuaaaagaggagaacacauacagacaaaaauagaaaauaaaaauuauuuagaggaaaaaacauccaguagaggaugaauaggaaaggaguggcgugggguggaguuucacaccuuugaggaagggaaaugacacgaaauaaaaucagaaauccaagccuccugcuccuggguacuuuccuuuacccaucggagagauuugagucaggccugcuuuguuuauuuaggagaggacuuuuguuucuuuaaacagaaguacuggguuaaaggcuccucaggaucagauggcuguggucaggcaugguccagaagccccgcuuuagaccagugggaggggucagcccuuacaugacuaagggacuauagguaggugugccucuuuaaagcaaacaaaauaagggaaaauuaaaagcuacugauuuuacacugaagggcgaggacucaaauuucagacuaauuuuuuggcuauuaaaaaaugauuugaggauaaggaacaguuuggaauuccucuugugaauuuuauuccauauugcacaccagcauuuacuaaauaccuacuguaaguuauuucuguaugacaucauuauccuguuagauuggaaaguggagagaagccggcaugggaagugccaagguaagcaguccauuucaaguuggaagcgaagacagaauauuucuuuuggccgggugcagugcccaugccuguggccacugcuuugggaggcugaggcaggaggaucccuugaggccaggagcucgagacaaaccugggcaacauagggagagcccccauuucuacaaaaaagguuuuaaaaauuagcuggaugugguggcaccuuguagucucagcuacucaggaggcugaggcaggaggagagcuugaguccagaaguucaagaccacagugagcuaugaccaugucacugcacuccagccugagugacagugugagacccugucucaacaaacaaacaaaugaaaacaauuuuuuaaauaggguagcuaaacaguauucaguucauaccuaaacucaacuuucaccugcaccugugguuuuguaggcgauggagcuaaggaguacuuggucaauagcaccuuaagucaggaguuuuaaaaucagguaacucagccaagauucucugggugcacagauuccucuuggcccccugcacugacucaggcuccagugaggucuucccugggugcuggggguaacaauagacaggguugagagguaggaggugccucucaccugccucaggaaucaggcucagggcaggccccagguuccccaggauuagaa

SEQ ID NO: 16728 - RNA, 1930 nt, Homo sapiens
cagaggaaccgagaggcugagacuaacccagaaacauccaauucucaaacugaagcucgcacucucgccuccagcaugaaagucucugccgcccuucugugccugcugcucauagcagccaccuucauuccccaagggcucgcucagccagguaaggcccccucuucuucuccuugaaccacauugucuucucucugaguuaucauggaccauccaagcagacgugguacccacagucuugcuuuaacgcuacuuuuccaagauaaggugacucagaaaaggacaaggggugagcccaaccacacagcugcugcucggcagagccugaacuagaauuccagcugugaaccccaaauccagcuccuuccaggauuccagcucugggaacacacucagcgcaguuacucccccagcugcuuccagcagaguuuggggaucaggguaaucaaagagaggguggguguguaggcuguuuccagacacgcuggagacccagaaucuggucugugcuucauucaccuuagcuuccagagacggugacucugcagagguaaugaguaucagggaaacucaugaccaggcauagccuauucagagucuaaaaggaggcucauaguggggcuccccagcugaucuucccuggugcugaucaucuggauuauugguccgucuuaaugacacuuguaggcauuaucuagcuuuaacagcuccuccuucucucuguccauuaucaauguuauauacccauuuuacagcauaggaaacugagucauugggucaaagaucacauucuagcucugagguauaggcagaagcacugggauuuaaugagcucuuugucuucuccugccugccuuuugcuuuuuccucaugacucuuuucugcucuuaagaucagaauaauccaguucauccuaaaaugcuuuuucuuugugguuuauuuuccagaugcaaucaaugccccagucaccugcuguuauaacuucaccaauaggaagaucucagugcagaggcucgcgagcuauagaagaaucaccagcagcaagugucccaaagaagcugugaugugaguucagcacaccaaccuucccuggccugaaguucuuccuuguggagcaagggacaagccucauaaaccuagagucagagagugcacuauuuaacuuaauguacaaagguucccaaugggaaaacugaggcaccaagggaaaaagugaaccccaacaucacucuccaccugggugccuauucagaacaccccaauuucuuuagcuugaagucaggauggcuccaccuggacaccuauaggagcaguuugcccuggguucccuccuuccaccugcguuccuccucuagcucccauggcagcccuuuggugcagaaugggcugcacuucuagaccaaaacugcaaaggaacuucaucuaacucuguccucccuccccacagcuucaagaccauuguggccaaggagaucugugcugaccccaagcagaaguggguucaggauuccauggaccaccuggacaagcaaacccaaacuccgaagacuugaacacucacuccacaacccaagaaucugcagcuaacuuauuuuccccuagcuuuccccagacacccuguuuuauuuuauuauaaugaauuuuguuuguugaugugaaacauuaugccuuaaguaauguuaauucuuauuuaaguuauugauguuuuaaguuuaucuuucaugguacuaguguuuuuuagauacagagacuuggggaaauugcuuuuccucuugaaccacaguucuaccccugggauguuuugagggucuuugcaagaaucauuaauacaaagaauuuuuuuuaacauuccaaugcauugcuaaaauauuauuguggaaaugaauauuuuguaacuauuacaccaaauaaauauauuuuuguacaaaac

SEQ ID NO: 16729 - RNA, 1930 nt, Homo sapiens
guuuuguacaaaaauauauuuauuugguguaauaguuacaaaauauucauuuccacaauaauauuuuagcaaugcauuggaauguuaaaaaaaauucuuuguauuaaugauucuugcaaagacccucaaaacaucccagggguagaacugugguucaagaggaaaagcaauuuccccaagucucuguaucuaaaaaacacuaguaccaugaaagauaaacuuaaaacaucaauaacuuaaauaagaauuaacauuacuuaaggcauaauguuucacaucaacaaacaaaauucauuauaauaaaauaaaacagggugucuggggaaagcuaggggaaaauaaguuagcugcagauucuuggguuguggagugaguguucaagucuucggaguuuggguuugcuuguccaggugguccauggaauccugaacccacuucugcuuggggucagcacagaucuccuuggccacaauggucuugaagcuguggggagggaggacagaguuagaugaaguuccuuugcaguuuuggucuagaagugcagcccauucugcaccaaagggcugccaugggagcuagaggaggaacgcagguggaaggagggaacccagggcaaacugcuccuauagguguccagguggagccauccugacuucaagcuaaagaaauugggguguucugaauaggcacccagguggagagugauguugggguucacuuuuucccuuggugccucaguuuucccauugggaaccuuuguacauuaaguuaaauagugcacucucugacucuagguuuaugaggcuugucccuugcuccacaaggaagaacuucaggccagggaagguuggugugcugaacucacaucacagcuucuuugggacacuugcugcuggugauucuucuauagcucgcgagccucugcacugagaucuuccuauuggugaaguuauaacagcaggugacuggggcauugauugcaucuggaaaauaaaccacaaagaaaaagcauuuuaggaugaacuggauuauucugaucuuaagagcagaaaagagucaugaggaaaaagcaaaaggcaggcaggagaagacaaagagcucauuaaaucccagugcuucugccuauaccucagagcuagaaugugaucuuugacccaaugacucaguuuccuaugcuguaaaauggguauauaacauugauaauggacagagagaaggaggagcuguuaaagcuagauaaugccuacaagugucauuaagacggaccaauaauccagaugaucagcaccagggaagaucagcuggggagccccacuaugagccuccuuuuagacucugaauaggcuaugccuggucaugaguuucccugauacucauuaccucugcagagucaccgucucuggaagcuaaggugaaugaagcacagaccagauucugggucuccagcgugucuggaaacagccuacacacccacccucucuuugauuacccugauccccaaacucugcuggaagcagcugggggaguaacugcgcugaguguguucccagagcuggaauccuggaaggagcuggauuugggguucacagcuggaauucuaguucaggcucugccgagcagcagcugugugguugggcucaccccuuguccuuuucugagucaccuuaucuuggaaaaguagcguuaaagcaagacuguggguaccacgucugcuuggaugguccaugauaacucagagagaagacaaugugguucaaggagaagaagagggggccuuaccuggcugagcgagcccuuggggaaugaagguggcugcuaugagcagcaggcacagaagggcggcagagacuuucaugcuggaggcgagagugcgagcuucaguuugagaauuggauguuucuggguuagucucagccucucgguuccucug

SEQ ID NO: 16730 - RNA, 2030 nt, Homo sapiens
agcagaggggcugagaccaaaccagaaaccuccaauucucauguggaagcccaugcccucacccuccaacaugaaagccucugcagcacuucugugucugcugcucacagcagcugcuuucagcccccaggggcuugcucagccagguaaggucccucucuccuucuccuugaagcacauugcccccucucuggguuauccuggaccaaucaagaagaccugauacccacagucucacuuuaacagcuacuuuuccaagauaagguaacuuagaaaaaggauaaggggugagcccaaccacacagcugcuguuggguagagccugaacuagaauuccagcugugaaccccaaauccagcuccuucuaggauuccagcucugggaacacccucagugcaguuaccacuccagcugcuuccagcagaauuugggaucagggugaucaaagacaggaggcuucuggggaugggugugcgggcuguuuccagauaccgggagacccagaaucuggucuguggaagcccagcuuccagaaacagcagcucugcagaggugguacguaucagggaaacucaugaccaagcauugaaugcucagagccuaaaaggggauccauaguugggguacccuugcucuaaggaauuggauuauuauauuagccccuccuagcaaugcccagaguagccaucaauuccucuuccgucuuucaacuggugauggugcaucccuauuucacaguccauaaaagugaaagggaguuuaugaaaugccucaaagggcagagacauuggguuugggaugggcagcuuuucccuccaccucuuccuuucuuucugauuccuucuucuuaccauucccuguuuuacaaacagaaagacccaggacacacccucaauggacuuuucuucuuguuguuucauugcaguugggauuaauacuucaacuaccugcugcuacagauuuaucaauaagaaaaucccuaagcagaggcuggagagcuacagaaggaccaccaguagccacuguccccgggaagcuguaauguauguggacgaugaccacccaccccucacaccucaguccuagguucuucccugggcagggaauaggacuaguaucagaaugaguuggagucaaauacugugaugcauacagcaucucuaaccuuaucccagacauuugccagugagaaacaauacaaguaaagaaaguggcuucucacucucagcucccuuuccagcuaucauuuuacaucucaguucguuccuucauccuggaaccaagagagauucacuugggcuaccaaaaagagcugcuucucugaguccccuuccuuuguuuuaucuucuuccuucaucccugaggcauccccaucagcuaggcugaugggcuagacagauuucccauagacuuggucacacucccaggcugaacccucaagguguuccaucugacugucuccuuucugcuccacagcuucaagaccaaacuggacaaggagaucugugcugaccccacacagaaguggguccaggacuuuaugaagcaccuggacaagaaaacccaaacuccaaagcuuugaacauucaugacugaacugaaaacaagccaugacuugagaaacaaauaauuuguauacccuguccuuucucagagugguucugagauuauuuuaaucuaauucuaaggaauaugagcuuuauguaauaaugugaaucaugguuuuucuuaguagauuuuaaaaguuauuaauauuuuaauuuaaucuuccauggauuuugguggguuuugaacauaaagccuuggauguauaugucaucucagugcuguaaaaacugugggaugcuccucccuucucuaccucauggggguauuguauaaguccuugcaagaaucagugcaaagauuugcuuuaauuguuaagauaugaugucccuauggaagcauauuguuauuauauaauuacauauuugcauauguaugacucccaaauuuucacauaaaauagauuuuuguauaacagcugccau

SEQ ID NO: 16731 - RNA, 3420 nt, Homo sapiens
cuucuaagggaucuuaucacuuccagaguuuuauucauucauuccauucacucaugaguuucauucauuauucacagauauuuguugaguaucuacuaugugcccagcacuguucuaggcacugagcauauagcacagaugccacccucuacauguagguuugaaaucuaaggcaguguacucuaacagaaauguaguguaagccaaacgugcaguuuuauauuuucuagucaccacauuuucaaaaaaguaaaaauaaacaggugagaugaacuuuacuauauuuuauuugacauaacauauccaaaaaaaucauuucaauaaauaauuaacauaaagauaggauagucgugaguuguuuaacaacaggauaccuucugagaaaugcaucguaaagugauuuugugaugggaauaucauaguguacuuacaaaaccuaaaugauauggcugacuauauaccuaagcuauaugguauaggcuauugcuccuaggcuauaaacccauacagcauguacuauacugaauacuguaggaaacuauaacacaaugguaaguauuugugucucuaaacauaggcaaagcacagcacacacacacacacacacacacacacacacacacacacacacacacacaaagguauaaaagaaaaugguccaagguggguggaucaccugagguugggaguuugagaccagccugaccaacauggagaaaccccgucucuacuaacaauauaaaaaaauuauccaggcgugguggugggcaccugucaucccagcuacuugugaggcugaggcaggaggaucacuugaaccugggaggcagaggaugcaguggacugagauugugccauugcacuccagccugggugacaagagcgaaacuccaucucaaaaaaauaaauuaauaaaaccacacacauaaacagcacaguuguauaaaaauauuuuucuuuuuuuaaauaaauauuuuuauuucuuauaaauauguugccuaggcugguuuugaacuccuucugccucagccucccaaagugcuaggauuagagaugugagccacugugcccagccaauauuuuugcuuuauauccuuauucuauaagcuuuuuccuauuaaaaaaaauuccuuuuacuuuuaaaacuuuuuuguuaacaagacagaaacacacacauuagccuaguaagccuacagagggucaggaucaucaauaucaccauccuccaccucuacaucuuguccuacuggaaggccuucaggggcaaugucacacguggagcugucaucuccucugauaacaaugccuucuucuggaauaccuccuaaaggaccuaccugaugcuguuuuacaguuagcuuuuuuuuuuucaauaaguaguaguauacucuaaaauaacaauaaggcugggcauaguguuucaugccugucaucucagcacuuugggaggccgaggcaggcggaucacuugaggucaagaguuugagaccagccuggccaacaucgugaaaccccgucucuacuaaaaauacaaaaauuagccaggcgugguggcgggugccuguaauuccagcuacucaggaggcugagggaggagaauugcuugaaccuaggaggcagagguugcagugagccaaaauccugccacugcacuccagccugggcgacaagaacaaaacucugucgcaaaaaaaaaaaaaaaaaauuauuagcccauugugguggcaagggccuguaaucccagcuacuugggaggcugaggcaggagaaucacuugaaccugggaggcagagguugcagugagccaagaucguggcacugcacuccagccugggcgacacagcgagacucugucucaaaaauaacuaaauuaauuaauuuaauuuaaugacaauaaaagguauaguauacuaaauauauaaaccagcaacaucguccuuuauuaucauuauaaaguuuuauauacuguacauaauagugugugcuaugcuuuuauacaacuggcaauggaguagguucguuuccaccagcaucuccacaaacacaugaguaaugugcugucacuauaugauagggauuuuucagcuccauuauaaucuuaugggaccacccucauauauuugguccauuguuggccuaaaugucauuaugugguacauauuauuaaugagauauuuuacuuuuuuuaguaugaauuuuuugguguguauuuucuucacuuauagcacaucucaauuccaugcaacauucaagugcucaauagucacguguggcuagugauuacagcauuggaaaaagacagauacgguugaggaaacuuaaaaaaauguagcaaauguaguuguagagacgugcucaagaucacucaauuaucauagcuaggacgugagucuccagcgaccuuccaauugccugguugaaccaaagcccugguucauucugcugcgcauuaaaagcaggcuuuacuccccuccaaacaguagaaucgcaguuaaacuuagucaaacaaacuuaauguauccaauacaaaacucaucuuucuaacccuaacaccuccucuuccucucuauuuucuauuucaguugaugguaccauuauguuucugcucacucaaauuauuauuauuuuauccauaaacgagcacuuuaucuagaagaucauuuaaauucuaaaugaucuucaaaaacgcacuuuacucuccacccuaacuagcugaaucaucucccacaugggucacuaugagagccuucugauuuguucccuugccucagucucuccccacccagcuucagcaguauucccuaagacucuucauggcucuccguccucuacagaguaaagacgacacucuucaucacacagcacagaauucucucgggaaccuguucuuugcuuaccuaacaaggcccaguuguuugcucuuccuagacucugaagaggucacuuacccucaggcugcuacauuuguaaaaaucgccaucccaacucucaaagagcuggcuucagauuugagauaauacacuuugaaugauauacaaucaaggaguuucuccuccaucacuccuuuacauuuuauaucuaucugcuguuuagugccucgucucaauuccaugaaagcuacugaauacaaacuauuuacuagggagucugcgggacacaaacagagggauuauauuuaaaaaauagauugacgcgaucuuugccuuccccgaccucauuacaauauaguuucuccaccaauaucuuuaaaaacagauccucucuaacaguaugagaaaaucaaggggagccucggaaguucaggccaggcugcguuccgaggagccgccacguccccccaccuccgcuucccgggccgcgauugcagguugaaaacuacucccaaacaucacagggcaggcagaaugcaacuacgaccca

SEQ ID NO: 16732 - RNA, 3420 nt, Homo sapiens
ugggucguaguugcauucugccugcccugugauguuugggaguaguuuucaaccugcaaucgcggcccgggaagcggagguggggggacguggcggcuccucggaacgcagccuggccugaacuuccgaggcuccccuugauuuucucauacuguuagagaggaucuguuuuuaaagauauugguggagaaacuauauuguaaugaggucggggaaggcaaagaucgcgucaaucuauuuuuuaaauauaaucccucuguuugugucccgcagacucccuaguaaauaguuuguauucaguagcuuucauggaauugagacgaggcacuaaacagcagauagauauaaaauguaaaggagugauggaggagaaacuccuugauuguauaucauucaaaguguauuaucucaaaucugaagccagcucuuugagaguugggauggcgauuuuuacaaauguagcagccugaggguaagugaccucuucagagucuaggaagagcaaacaacugggccuuguuagguaagcaaagaacagguucccgagagaauucugugcugugugaugaagagugucgucuuuacucuguagaggacggagagccaugaagagucuuagggaauacugcugaagcuggguggggagagacugaggcaagggaacaaaucagaaggcucucauagugacccaugugggagaugauucagcuaguuaggguggagaguaaagugcguuuuugaagaucauuuagaauuuaaaugaucuucuagauaaagugcucguuuauggauaaaauaauaauaauuugagugagcagaaacauaaugguaccaucaacugaaauagaaaauagagaggaagaggagguguuaggguuagaaagaugaguuuuguauuggauacauuaaguuuguuugacuaaguuuaacugcgauucuacuguuuggaggggaguaaagccugcuuuuaaugcgcagcagaaugaaccagggcuuugguucaaccaggcaauuggaaggucgcuggagacucacguccuagcuaugauaauugagugaucuugagcacgucucuacaacuacauuugcuacauuuuuuuaaguuuccucaaccguaucugucuuuuuccaaugcuguaaucacuagccacacgugacuauugagcacuugaauguugcauggaauugagaugugcuauaagugaagaaaauacacaccaaaaaauucauacuaaaaaaaguaaaauaucucauuaauaauauguaccacauaaugacauuuaggccaacaauggaccaaauauaugaggguggucccauaagauuauaauggagcugaaaaaucccuaucauauagugacagcacauuacucauguguuuguggagaugcugguggaaacgaaccuacuccauugccaguuguauaaaagcauagcacacacuauuauguacaguauauaaaacuuuauaaugauaauaaaggacgauguugcugguuuauauauuuaguauacuauaccuuuuauugucauuaaauuaaauuaauuaauuuaguuauuuuugagacagagucucgcugugucgcccaggcuggagugcagugccacgaucuuggcucacugcaaccucugccucccagguucaagugauucuccugccucagccucccaaguagcugggauuacaggcccuugccaccacaaugggcuaauaauuuuuuuuuuuuuuuuuugcgacagaguuuuguucuugucgcccaggcuggagugcaguggcaggauuuuggcucacugcaaccucugccuccuagguucaagcaauucuccucccucagccuccugaguagcuggaauuacaggcacccgccaccacgccuggcuaauuuuuguauuuuuaguagagacgggguuucacgauguuggccaggcuggucucaaacucuugaccucaagugauccgccugccucggccucccaaagugcugagaugacaggcaugaaacacuaugcccagccuuauuguuauuuuagaguauacuacuacuuauugaaaaaaaaaaagcuaacuguaaaacagcaucagguagguccuuuaggagguauuccagaagaaggcauuguuaucagaggagaugacagcuccacgugugacauugccccugaaggccuuccaguaggacaagauguagagguggaggauggugauauugaugauccugacccucuguaggcuuacuaggcuaauguguguguuucugucuuguuaacaaaaaaguuuuaaaaguaaaaggaauuuuuuuuaauaggaaaaagcuuauagaauaaggauauaaagcaaaaauauuggcugggcacaguggcucacaucucuaauccuagcacuuugggaggcugaggcagaaggaguucaaaaccagccuaggcaacauauuuauaagaaauaaaaauauuuauuuaaaaaaagaaaaauauuuuuauacaacugugcuguuuaugugugugguuuuauuaauuuauuuuuuugagauggaguuucgcucuugucacccaggcuggagugcaauggcacaaucucaguccacugcauccucugccucccagguucaagugauccuccugccucagccucacaaguagcugggaugacaggugcccaccaccacgccuggauaauuuuuuuauauuguuaguagagacgggguuucuccauguuggucaggcuggucucaaacucccaaccucaggugauccacccaccuuggaccauuuucuuuuauaccuuugugugugugugugugugugugugugugugugugugugugugugugugugcugugcuuugccuauguuuagagacacaaauacuuaccauuguguuauaguuuccuacaguauucaguauaguacaugcuguauggguuuauagccuaggagcaauagccuauaccauauagcuuagguauauagucagccauaucauuuagguuuuguaaguacacuaugauauucccaucacaaaaucacuuuacgaugcauuucucagaagguauccuguuguuaaacaacucacgacuauccuaucuuuauguuaauuauuuauugaaaugauuuuuuuggauauguuaugucaaauaaaauauaguaaaguucaucucaccuguuuauuuuuacuuuuuugaaaauguggugacuagaaaauauaaaacugcacguuuggcuuacacuacauuucuguuagaguacacugccuuagauuucaaaccuacauguagaggguggcaucugugcuauaugcucagugccuagaacagugcugggcacauaguagauacucaacaaauaucugugaauaaugaaugaaacucaugagugaauggaaugaaugaauaaaacucuggaagugauaagaucccuuagaag

SEQ ID NO: 16733 - RNA, 33119 nt, Homo sapiens
uuuaauaguccagaaaagagaaaguauagaugcaauaagggagaauuccucuauggguuggccaacccccagaugguagaggugacuucugugagaucaguuccuuuuuauggguaccuacuucaggcuacaauuuaagacauauuggagauggcugggcuuuugaacauuauuuuuucuguuugggucagcucuacuaggauacuggucaugcccacuauauucugcuagugacacaagccaguuagcauuuauugagaacccugugcacucagcaguugauacugucuggauaguuucuacucuuagggcaguuaggcagaaggccauucuagagcaggagcuguggggccagccugccuggguuugaauccuggcuccucgacuuagcagcuuugugcccuugggcaagccacuuaacuuuuuugccccaguuggccucaucuauaaaaugaaaauaacaagagguccuacuuuauaguuuuugugaggcuucagugaguuaacacaugcaaagcuuucaggacccugccuggcacacgguaagcauucaguaaaugugggauguugucauucccuugggaagauguucauucaucagacauuuagaguaccuaccauauaacuggcauugggggcuucaaagaugaauaucuaaccuuggagcauggaauaaaugcuaagcauauaauuguaaaaauugauugaauauguugaauuaaagagcucauagucuacucugggaguaaguaggcaaacucaaaauuuuaauccaaugugauaagcagucauggggguauaaaaaaguuuuguggggguagaaagagggagcaguaaucucugccaaguuucuccaccaggaaguuuccucaggaaaccugggaguaguuugugagauagcagaggggucccccaugaucccugacuuuauuaaauggaggauauguuuauagauaaagccuugugauccuuaaugaaccauucaucacaguuccauuucuaucuaaacuuuucugaaccaguuuuaucuuuuuagccuguucugccucaggggauaaugagucccuacgugccacucacacacucacuauauuacagccccaacagucugaaaauuauuucuuuuaagcuuugagaacuuugccuuaguucucauguucugggaugugucugauccacaagugcuguguacuuuucaaaucuuuaccuguuggaggggaugaaguguggauuaaacaaguaaccagaguugguuauugaggaaauguuuccucggaggagcucuauuugagggaagcaugugcacugagacuuuguuuacaauguaccuguuaucucccaccucccucccccagucaccccuauacacuuaagacauucuccucacuccucugccccuuuuuuucugcccuguguguuuguacagggggagcaguaccaucaggcuuggaggagaaccuguguaagaucugcauggacucacccauugacuguguucuucuggaguguggccacaugguaaccuguaccaaguguggcaagcgcaugaaugaaugucccaucugccggcaguauguaauccgagcugugcaugucuuccgguccugagagcuugcaucgguuucuucagugccuuacagggaaauagccuggggugucugggcucaggguuggccagcuugcagaggagcaagcuaguagaaauauugcaggguucccaaaaccaggucaagcaagaugccaugucaccccugagcaugccugucuucccagggguguaccucuuggcuggcaaagcccaaggccagugggaacuuguauaaaucacauggguauguucuugguucagugaucuuggagugaugaugguaacugaugaacagagaacuuuccagaacuuggguccugucuuccucccugaaccuagacaguuucaccccuccuccuguacccaacccauccccaccccauaugggagaugcuugcccauguguuucaucaaucagaaguccuccuccccagcacauucggauuuaaauuucuggucucuccggcuuucugugcuuuaacuaucuuugcuaaagucucuugcuacauugccuaaauccauuuguuucuuuggaccaaaaauguuaguuuaccagaccgauagugguccuuaggacagauuuuagaccaguaaacuuaucuuuggugagaaaugaaauacaaaugcuauagaaaaauuucaaaguuguuaaaagccacuucauuaaaugcugggauuggaagcuguuggucuccugaccugacucugggagccaacaaaacaucaggcucccaaacugcugggaaauuuguuucugucugcaagggauagugcgugcauaaucccugcugcugcuucucuugggaccugauuugcaccauccuuaguuuaugcggaaaggggaagcaauggguggaggcaguggccuucuccuuaauuuuggcuuggcuucugauccuuuucccaacuagaagucuuaagccacuuuucgcugaaaaugaaaucccucccuuauccaugguaguuuuaaauuugguuucauugaagaaauagauuuaggcaaagagccugugcucuucucuggccagacugcuguugaaguuccuggagagcaaauguuaagacagagcacuuaagagcuuucaggagguacugaaugagacuggauucuguuguaagccgacaguucaagucuuuauuucccagguugguggggagugaggagacccuacuuucauucccuuuccuagcccacugauuuuugggggcaggucagggagaaagcauuuuuuuuuuuuuuuugagucucacucuguugcccaggcuggagugcagugguacagucuuggcuuacugcaaccuccaccucccagguucaagcuauucuccugccuuagccuccagaguagcugggauuauaggcgcccaccaccacaccaggcuaauuuuuguauuuuuaguagagacgggguuuuaccauguucaccaggcuggucuugaacucuugaccuuaugauccgcccgccucagcuucccaaagugcugggauuacaggcgugagccaccacacccagcaggagaaaccauuuucuaggcucuuuaggaaggaccaugcaaugaguaggugauguauuugagcccucacagucuuuacaccccuagaggagcuggaggacuuaagaguuugcugcagaagcguggccaagcacaaaacacaugaucaggaaagcagaguguuuucccauuaccaauggaugaacuaugcaaacccuaaacgccuuggcagacaccucccaccccuuaccccucccaugcagcugaaaaaucugagacuagaaccaaucaugacucuggauggcagagggaaaccucuaaagggacuuauuacauugguacagacauauuuaugcuuucuuccaucaccaaccacuaaaccccuuuggaggaaugaaauaacugcauaaacuagucaacugaacacugggccacuuaccucaauguuauacaaaguccuggaugauuugauucugaaccacagccuuugcaggaguugggggaaucagauuugcucaugaagacaucccuuuccacuuuugucaugggcaguaaauacuauaguuuacaaugccuaccaauuagcaaaggaucauucauucagcuacucaguuccucuguaaaacaggucuauguaugugcaauucagcuaagaucuagcaguaacuuaagggcagaagcuggcucucuacuuacaaccugcuuucucugcugaagccuuaccuccucuucaguuucccuccuagacacaaaucgaaaauaauauacugauagcugguuaguaaccucaguaagaauuaaaacugagguuguuuacucauuuugccuuuaaaucuuuuauccccuuuuggugaagguuucccuuuaggaaaaaaggugucaaacaacccugauuuuuuuuuuuuuugcaucauuuuuauuacaccaaauuaaaguugggaguuccaagaucccauuccaguuaauauuuaaccaaggucuaaaauuugauuuuuuuuaaaucuuugaauccucccuucugccccucauggauccuugguuuuaaugauauggaaacaucuaauucuuagaauuauuccguagcuuuugcugauuacucugagauuucaguuaagacuuguuucaaaagacagauagcugacugguucauaauacauuggaauaguuggauccaaacuaauaagaauaagcuguacaggaacuagugcucaauauacauuguauaaauuuguggaaaucucuuggaugugaauuguuacuucaaguggcuuuuauuaagauuuucucagacuuacuuggagguuaaagcaaacccaaauguguauuauuuuguuacagagcucugcuuuauaauuuuguaauaaaguuucaauacagacaccuguccugucuggugcgaggauguuagagguugauaggacugacaaaagagccugacagugguucaugcuauaauuuccacacuuuaggaggccaaggugggaagacugcuugagcucaggaguuugagaccaaccugggcaauguagugagaccuugucucuacuuaaaaaaacaaacaagggccgggugcgguggcucacgccuguaaucccagcacuuugggaggcugaggcgggcagaucacgaggucaggagaucgagaccacccuggcuaacacggugaaaccccgucucuacuaaaaauacaaaaaauuagccaggcgugguggcgggugccuguagucccagcuacucgggaggcugaggcaggagaauggugugaacccgggaggcggagcuugcagugagccaagauugcgccacugcaguccggccugggcgaaagagcgagacucugucucaaaaaacaaaacaaaaaaaaacacaaacaaaaaacccaaaaaaaccaaaaaauuagccgugcaugguggugcauguggguagucccaacuacuuggaaggcugaggugggaggaucacuugagccaggagauugaagcugcagugagcucugaucgccaccgcacuccagccagggugacagagugagacccuguauuaaaaaaaaaaaaaaauugacaacugauaaaccacaagcuaauccugggaugugcacauggccugggauuagccugugguugggccaagugaccuuggucaagaugcucaguguuguuguaacuaacuaacuugcucaagaccacaaauguaauauauggaagaggccauggaacaaccuagaagagaaugagagcuggguagguaaaggaugaaucccaagaccaauuggguugaagcaccaagugaguucagauauuuacacugaucuagaagagaugggccuuaaagaacugaaaucugaggacaguuaguaugcccaguuaggucuucagguuacccugggagauacaugguaccuuuuggauacagcuguaguacagcuggacuauggcucagaaaagguuggcccaggcugggcgccauggcucacgccuguaaucccagcacuuugggaggcugaggugcguggaugacucgaggccaggaguuugagaccagucuggacaacauggcgaaacguggucucuacuaaaaauacaaaaacuuagcugcgagugauggugugugccuguuuguuaagucuuagccacuugggaggcugaggcaugagaauugcuugugaacccgggaagcagagguugcagugagcugagauugcaccacugcacuccagccugaaugacagagcaagagucuguuuaaaaaaaaaaaaaagguuggcccagccucgugacagacugcugugugugcgcaggcuuguacaaaccucccugaccaggcgcccaaggagcagggaaaagacuacugagaaugcagccccugggagaacaagauuauguguccaucugcugugacugagaagagaaaggaaucuugccaaaagggcauaaaggaucgaggaugagccacaacacuuugcucacauugcccuagggagcugaccuguucagcacccagugaugaccucugcuugaugccagccagcagcauguagagguucagaagagggaggccuccagcauucugcuggagagauuuaugaugaugauguugagggcugcauugaaauacaugaaagaaauacaugaaaggauacaaaauaguauauacagucagaucucagcagcaaagacuggaagaaaauacauaaaaaaccacugacauugaaauggcaauaacacacacuaaggcagagaagggacaagaugaucaccugcagccagcagaggcccuuuccugugagugugcacucuggguguaagcaaccaauaagggcaaguggggcuggguccagguuggagaggacagugccuuuggcaggauccugaggagacagccuuguucugcugcccuguccgguuguuuguuuggccugaggcugaagagagaaauggaaaucuauguaggucaguacucaaaggaggagcagcuuuuugucuccauagaggauggaauaaaaaguaucuuauuccuaauacugaagcaaggcugaauggugccuauucaaaaacaccaaauguccugggcuagagucaggaaaguaaaccccucccccgugcugucccuacucccccaacauacacauuuuaaacaguagguggaagccaaagucaaucagaucaaaguugggggggggcggugggguggccagggggcgcagugguccuugaucuuauagguccagagccuguuaauuuguucauaaggugagaacugacccucaagagcuggaaggauugggacauggcagccaguuuacaaccauaugguguccugaugagccugcacucagaguggaguguuggcuggaacaugcacaccugcaacugaggguucuaaagucauagguuaggcccuucucccggguagggucuggacaugcacaccaggagugacguucccaacucuagauaacuaugugcuaggcucugggcuaagugcuuuacauaauguugcucaggacaacaggacaacccuaugauuuaggugcacccauucuacuuggagggauugaggcuuagauguuaacguaacuugccuaagguuagagccauuaaguuucaggagucugaucugaacuccgucuacaccugcacuguccagugugguagucacuagugacaugugaccauuugaaguugaauuaaaauaagaacuucaguuccuuaguugugccagcuucauuucaauugcucagcagcugucuguggcuaguuugguuggauacugcagauuuauggauauuuccacugcugcaaaaaguucuauugaauagcacuugucuacacuaaauugucucucuuccuuuuguucuucaaauaaaucagccucagguagcacaggagcuguucuuuguaagcagguuguauggaucuguucucagguguggauuuuuauuuuuuucccugcagauauggaguauauuuucuuuaagaaauuaaaaacuaagaagaaaaugccacucaacauuguugguauuaucaauaggucagcaggaaaaaaaaaaauacugugauaaacuugucucucugauaccaagaagaaauucuaguccgagcuucaauaugcuuccuguuuuuuucgcuagguauuucuuuuacugcugcucuucauucuuucccacauuucauauuggaggauugguacagccuuuagaacuucauugacaggagcaaauccaguauccacugauuucuucuuaaaggcgcucuaacccaucagauagcccggcaguuucauucacaugaauacuccagccaugaaaaaacucaguaggacacagacgaauccaaugaauagaagaaaaaaaaucgauugaguuuugggauauuuggugcauucgacugguccagcauuaugaaaccuaaaccucccauuguaaacaggaagcuggaugcaaauccuuccauaauauacuguccauuuacuuuguaggccaagaaagcuacuggccucugaugcccacguucaucagccaauacuuggggguucaacaauaucauauaauuauuccuccagucaugaggaaguaagacaccaccaccagagcauacacagucauggcugauggcaugugcagccaggguggcuucuucaacuucagguuggaacacucgagcacuaagaaugggauaugguacaaagucuccauguugguggcaacaagggcuguucuuggccucaagccccauguggauuuuuauucuuaaagaacagucuuguuuccagguuuuggggaugcagaucuuccuggagcccucuaucccuccagaggaguggcccaaauaaccuccccuuucuucauaaaggccccauuuuccuaccugacccuaguccccucccuucaaacuggggauccucaccauguaauaggagaacacagagaagaaaguaaaaaaauucauuuuguuuucuuucacaugagguuuguuccuggcaaagcgugucaggcugaauacaaguuccgcuaaacagaagcauuuccgagggcaguccuuuaaauacaacuuuaaaaugagccuggaaguacaaaggaacaggcaaggaugggagagaaggcuuuguggacagagcugccauagcccagccuuuacuccuuaaucucuagggaaauuauuggggguguagguggggaaaggacaaagauaacugcaagauauuuuauuuauaaaaaggguaacuaagcugcuuuucaaagaaaacaaaaagauggcaaacccagcacccagcucugaaagaucuauuuaaaccagcaagacaaacugacuucagcuguggcacccacagcaacuaauuccugguccagaagagacaguggagaacugguggguuugggagaagcaagcccauucccccuauacugugucuaucugccuccagccugaguccaguccaguaguaugguaaaggagaguauggccugagggagagggaagacagcaaaccuagcagggagcuaccagucuccguuuccggauacaugcccaaauccacucuggggagaccugcugggccgcaggguucuugucccugcuacccagcacgugcguggcugaagucauaucaaauuccuguaccagguccccgucgaaugccacaaaguagcgucugagacggcugaagucugguguggaggguggcaaguaaagccgcaccccagugaagauguccagcaauaccugcaaaugcagaggggucaggguggggucagaccuacacuggguacagaugggucuucacccaaaugagcacgggacagaaugagggagccuagaguuaggacacaagcagagaaguuuacuggaauaccaugcaucaauacccccaccccuccagucacuccaaauuauacaggacugacacgccccuccaucccugccuaggggaaaaggagaguggacaggccucgacaucugggaccuggagaugggaagaguacauguguauaagagccacccagucauggugggcaggcggagcuggcucugacucagugcccccagacucagugauguccccugagaccaagcagucuacucuguacaaccugcuagacugaggggucaggaguccugcuuacuacucucaauggguucaaggacuucaggcugggaagagagaggggaaagguuucuacaggucuguuggggaccgaguucaggccuugugcugugagacuucuaugcuuacuccuggauggcgguggggagcgugggggcgcaaugacaugggugucaaucauauguuuacuucucuaucuguccuuugaggcaucagcucccccagaguugagccaguacuaaaccuaguucuuggcaucagaaagugcucaaaagaggccggguaugguggcucaggccuguaaucccagcacuuugggagaccaaggcaggcggaucacuugaggucaggacuuugggaccagccugaccaacauggugaaaucccgucucuacuaaaaauacaaaaauuagccgggcaugguggcacaugccuauacucccagcuacucgggaggcugaagccggagaaucgcuugaaccugggaggcggagguugcagugagcggagguugcagugcgcugugauugcaccacuucacuccagccuaggcaacagagcgagacuuaucucaaaaaaaaaaagaauugcucaggagauguugccaaacccaagacugacaagaaaauguaacagggaaaaggcuccucaggugggaggagagucaccaagccagugcccucuccccgacucgcugcuugcuggaccugcuuccacccugaccacaaacucaaugcugcauucccacacccagacuggucuuuucccuuuaauguaaauuuugacuuggggccagcagcugagugagucccugcagucucuccuggcuaggccgggcuguucuaucuccugccugcuggcacaguucuuccucucugcucacuggcuggccgccucugcaaggcaacaagaggacauagggugagcagcagcauugcugacccugcccacgacagaggaguggcugcaggcagggaagagguuuagccgauguuccccaaacaccuuugcucauccucuuucaaacuucuuguacagaagguugggaacacaaccugggcuaaacuggcccacgugguguguugcuguuuuuacccucaccuuuguuuggcacagcgucucaucagcagcuuuccgcuucuccccuacuuucacuggagaagacuuuguggccagcuucucccccaccuucauagcggaaggcuuugcagucugcauguugccugcaggacagagaggaagcugggugugguggugcacaccuauagucccagcuacucgggaggaucaauucaacucaggaguucgaggcugcagugagcuauggucgugccacugcacuccagccuggaugacagagugagacccugucucuaaaaaacauaugauacaaaagaacuaagaggguagggauugcugauaaugcucccugaagucaggggcaguaaugggaaggaccaggggcuuucucugcuaugagcauaggugagaggggagugaagaguuaucagcuaagcccuuuacucaaagguagcuuauucccuggucagacuggcuguccccaggguacugcuccauucagguuugcugagcagauacagggugcccagcagaagggucucuggcccauggcuggacacacaccaggaauguagucuguguccacugcaguggacacagauaaucaugagaucucagggcuggaaugugagacugggucccugcccuuggaucucugccccucacaccgcccucuucaccauaccagcccccucccuauccuuaccaucuuugcuguuggaguuacucagcuucccuucugcuuucuugguacuggcugagggcuugcugggggccuugcgggacacagcagacccugagggacccuuauucucuucacugcuacccccuguaguggagcuccccucaucuccagccacuacagugaagucugccuucuccuuggacaacugguacaguuccugaggcggggagggacaaugucagaggguuucauugccuucccagucuggccucagagguggugugugugguguauuuuaggcgcauaugggaacaaagaugugagaaagauaaagagcaaggaaaaggaguuggcucccuuggcaccauuccaaaguauggcccuauagccugaguaaucaggguacaaaucauuguucucuguacagcaaagcaggcuuugcuggggcaacaggagcaaacucuuauuccccagacuaaaggcugcucaguggggccuugcaaaugcaagguucucuacucagagauggagggagaaggaggucuagugcugugccccuggcccagcagcaguuugucucccucucuaauugcccuccuugcucugccucaggagaaugggggaaaggagaagacagaggacaugugaauggucuagaugcccaaggcuccaaggccuggacagugggguggagaauacauauacagccuaagagcugcuaccuugaguuggggaagguuaguggcagauuuccaguccuuaucaucucggauucgggugcagcgagggaaucggauggagaucccgucagcuguaugagccuccgauuuggagaauucagccccugugaucucccacacggcagcuuucugucaggaguaagccagcaggucaucacugguuaagaagauaguaucaguggccgggcgugguggcucaagccuguaaucccagcacuuaggaaggcugaggugggcagauuacuugaggucaggaguuugagaccagccuggccaacaugacgcaaccccgucucuacaaaaaauaacaaaaauuagccaggcacgguggugcacgccuguagucccagcuacucagaaggcugagguaugagaaucgcuugaacccaggaggcagagguugcagugagcugagaucaugccacugcucuccagaacgagacugucucaaaaaaagggagaagcaaguauuggccaggcgcgguggcuugcaucuguaaucccagcacuuugggaggccaaggcagguggaucaccugaggucaggaguuugagaccagccuggccaacaugguaaaacccuaucucuacuaaaaaugcaaaaauuagcugggggugguggcaccccuguaaucccagcuacuugggagacugaggugagagaacugcuugaacccaggaggcggaggcugcagugagaugagaucaugccacugcacuccagccuggacaacagagugagacccugucucaaaaaaaaaaaaaaaaaaaaaaaaaguaucucccaaccagcuagaagcaauacagaacaauuaaaaccaaaaaggcggcugggugcaguggcucacgccuguaaucccagcacccugggagacugaggcgggcaggucaccugaggucaagaguucaagaccagccugaccaacauggagaaaccacaucucuacuaaaaauacaaaauuagcuggccacgguggcacaugccuguaaucccagcuaccugggaggcugaagcaggagaaucacuugaacccgggaggcggagguuguggugagcugagaucccgcuauugcacuccagccugggcaacaagagugaaacuccgucucaaaaacaaaacaaaacaaaaaccaaaaaagcuuuggcuaacagcugggaaacuuggguccuaguucugcugcugcuguugcugaauaaccuuagggaaguccuguuuguucucuagaucucuuucuuggucgguacaagaagggauugggccagauuacuucuagaacacacccuuugugcugaggggauagguacucucuucuucucucucuuuuuuuaaagcaauuguauugcagaaagaauucuauucaaaauuccucagaguugucugguugucccugugccuaucacucagcuggaaauccagaccccuaucccuggguggacuuucagcgaggugagauggauucucuauggcacuagagaaccugcaagcuaauucuaugagcuggaggcccccaagccacuggguugauaccuuugggucugggacgaugaagucaggauaguagaucuuguugaccuucaaccagcuggguauuuugcugggguccuagaggagaaaagaugcuacuuugggcuguucccaaccuggaacaaggcuuaaaucccuucucuugguaaugagauuauaagaagccacuuaaacagcugauguuugagccaugugauccucccagcccagaguggguaugaccuagaggcaugcaagccauuuuccacaagaaggcauucagagauuauaaggccuaauccugcuccccugagcaagcugcaacccuucuuucuggggagacagaaauaccuguaguccccaaagcacagccucugucucagugauggcggccaguccagaggccauggccaaccaggucccuuccucaccuugcugaucuucaccaugucuaguucauucugcaggcgggcaagcguggcaucaucauggccuccugcacacuuggugacugugcaccacuucuggcugccagggucguagcagcccaugaggaagauugacaucaugccgccugggaggggagugugagaugaguguggguuggaggagccaucucugccagucccaagagcccagggccagggagaggaccuuggguccuggccgucagagugccagaguuuaccucuuggagcuaccucuuacuaacuguguaauuuuaaccuuuauaagccccaauuuccucuucuguaaaugagggauaaucacacccaaccuguugggcucuggggcauugaacuguguuggacacaugauagauugcuuaaaaguauuaguuccucagacuccagcuuccuuuccagucaggaaagagauuuugccugaggagaaagcugucaggcccugacgaaauaauuggugguaagcguccuucugcuaggcuagcauaggguacucuauucugacuucucccuaaccgaguaagcagcucugccugaggugacucaggccagcuuggggcccuagauccuaggacuucggaagucauaacuggccaugcuggcagaucaagccaguaacaaggccagccuguaccucaagcgguaccuucuaaaacaguaccaccccagggggcagaggccacccugaccuuugcucccuugcccauagaaggcuccaaggaccaccaggucagcugugucggccauggcccccucguucaaauagucuuucuucacuuucagccagugccgcuucccaggcucauauguacccugaagggaagcaaaagagagaccacagaauagaaaggcaacuccaugaggauggguucaccccuucacugcuacacaccagaucuagcccagugccccucccucaggguaagagcccucaggcuccaggcacuauaggagacacacaaagcaguccuccagauccaggacacaucugcccacacuuccccagcagccaccccaaccacugcaggcugccaccgccaucuccuggucagggcuggaaaggcucaggggagagggcugcgagugagucgacaggagaagccaagcgaggccacuuuaccuucacauccuucagcaccagccccuccaaucccuccuggaucacccggguuaucaugucagccaaguccaaagcuuucugagggacaagagagaugcugaaguuggugugagaguggagaagguggugagugaguggggguuguuccuuuucacacacuaguuaaguguccacuggaaacacccuuacuugaaauauaagggacaaaggguuagaaagcagguugcuucucaucccaaacagagggcugcuguggcuuugaaacacaggaggcuuaccuaggaaggauuuccaugcccuacccuucugggugaagacuagcaggcaacauaugcaauagucaaaggccaacauuaucaggaggcuccauaagacauuaagauuuauucuuccagucgcaguugacccaaggaguucucugcccugcuuucaaacuucuaggacacugccuagcauagggucuucacuuacugugacucgcuucauuucugagaacaugauccgguuuggaauuucaaccauguugucaugaagaaacuuccgccgcucacacagaggucugaggagaacaggagagcugagguuaggccgggauccucccucccuuauuaggaauucugaggaaggaagggccacaaugauaaaacugcuacuucaagaaaggguuugccauggaucaaagaccucauguguaacaguucugcugucaagggcuacaagggcuccaucgugaccgaagauggaaaauugugagcuguggcauagagccaguucauaguuguaguuccuaguucuacuucaucaagcgagccaagggagaacuggccuguagcccagauuguauaaauucuggucccacuugaaauacgacuccaacucucauuuuuuauccccugcacccugcuuugccccgaucccaaggccaaccccgggguaggcaggcugagacaggccuugggacccaaaccccaaauccuacccccaccaauuccuucccucucuacuuccuucuccuuccccaaucaaggauguggcuguugcaggaggaacagggguagagauacauuucuaagugaggaaagggcugauacugguuucucaggcacaagcauauggaugcagcuaagucaagacugcuaauucucuccaagauggucccacccauggccuccccuauaauccggagcuuccuguugucagucucuucugaaaucaaaaccucugagcugaaaaccaucugccuuaugcccccaggggugccacuggagccccuaggggugccauuggagaaauaaacugaaaccccauaugcucacagucuauuucucugcaauaguccauuuugcuuuaguagagaaacuucuuuggggguuuggguuucuucugugacuuaagcucucagagaagagauggagucaacacaugggcucuuucuuacacugaauggggaacugaucauguagcaauugugcuuccucucagcucccucuugccauugccuuuggcaagcuccugagcacaaacguaugugccagcugguucccuguacccuccuuuccaaccugaagcccccaucuuccucacccaggaaaugaaaacagauuccuggcaguuucuggguuuaaagaugcuagccaacucaccuguccaucaagcugacaucauuaaaguagauacaaucaaaaacaaacaggcagacauuagcauccuggaaggcugcuuucuguaagggaaaaugagguaguagguacacauaggacaaaagucagugugaaaaaauaaggaguaccaguccacuucuggaggcccccugaggcaccggaugaaaaaguacuauuucugcucugaagccccugggccauaagggcacugagcagauagugcuaaauggaaaccaacccaguuauaaacugguucccaauaccagccccuuuuuaggagaaaaacaaaagacaaaaauccaaaccagaaacaggucagaagcgaagaauaagggccacacuaagggauauuuccucccuuuucagaccgcagcgugcacccacauguacauacucacucacacucauucauucuugcacauauggcccugagcuaguaccuuguguacucccagagucccaaagggcagugguuugccugucuuguugucaaucagaagcacuucagaauccaagaucaugcuguggcccccaggaaaagccuggggaauguaguccuuaaagugggccaccugaaagcagaaggggagcuuuggugagggaugacauggcagcagggaccucaaaccaugccauggagggcaaagcccgggcccagacaggauauagaacaacauguggaaggcccagcuaaugugcaaaacauauagcuaggccuugcgagccaccuggacaagagggagaggccaucuguuucaguacuucuguccgggcccaggaagaggucaacccaugcugggucacuuucuaugggcuguagagaagguacaauuuuugaggaaaauggaagaaacagauuaaaccugucgggggaggaggaggaggguaggugggcagagauuagugccuacugcagaagaugugugacuaucaggcuggggacuggauuaggggagaacagacuacuugaaaccagaaagguagaaaugaacucccucaggugcagcaaggaaacuugagcagugucuucucugagugggagcccugaacccacagccaucacuacccaggaugcuuagagcaggaacaggaaaggccagcacauccaugccauuccccuucaaucccuaaccuagcccuuuaagaacccaaaucacaggagaggcaaaggaugagugaauacuggguaagggaaaauuaaggaaaggacuaaaucuggaaaagugugcucagacuucuuccugggucacagauggugucuauuuaacaccaaccucaccagaaacagcuccugagugauuugcagugcuucacagaacacgugaaccugcauuaaagcuccacaaugaggccacugcuuagccuuccucuugaacauaugaaacaaauggccugacugcuuuguucccaaugcuccagcaggaaggcaaggcugagguaagcacaggccacacaacauguuccccugaacccccugaggcucugaaaaacugagucugaguuaggaaagaaaaggauagcaaagauaggaauuccaucugcucacaagcuaccggagccagauguuccagcugcuuuucccugaagacacucccaaaggcucacaguauccuugggaguggagaagggcuaaggaauaagguuccaaaugccaccccugauuagaacaggaaucuaggcuccuagauguccccauaagacuguguuuacaucagaauguaaacuucaugguggccagaacuuuuguccauuuuuuccacugcuauauccccaccagcuguaacaauggguaagcaucugauaaauaauuguugaacaaauuaaugaaugacagcccaauagccccugguauauaagccuuagucuagcucacaggaagcaucugggacauggaaacacaaaagacacacagcaacucaccaacugagcucacugucccaauaucacugugggcaaaagaaguaucacuguuccagggagcucuauccucacgaacccaagucagggcucuuuggcucucccugcugagcagcccuucauuaugggaagacuccaaaaaugaauaaaugaauuaauucauucaacaaauaaaaaacaaacccuuauuguguaccacagcuggaauggcuaugggacucuggcccugagguuguuagaggcagaaaggggaaagacgguccuggcagaaaggaaggcacucauaccuugugaggaaggacgggcuugagacugcggcugaaguagcugaaguggucuccauucuuaugcaccuggacucgcucuccaucguacuugaucucagagaacaugccauugggacauuucuucauugcauacucaacggacuugcaggccuccgccuugggguggggaaagcaaagccuggagacuuucaaugaggggcugcuaagcagcgacagccagagaccuugcaacuggguuagugaggguaguuaccugggucuugggacugacugcccacaauuaacgcucagggaaggcuggugaagaggugaugggaacggaaagggcugggcaauguuguauucugccuaugaaauaaucaccugagcugacauaggagcuugccuuuugaggaauaugaaugcuauucauuguacaacaaguaaaagcccagugaaacaagauuuaauucuuuucucaauaauucaggccuugcaagaccucuggcuuauuauaaaacacaucaguucucccaguaaaagagguaugugaagcuaagguuaaagagugcaggugacagugaggcuggcagggugagugaucgugggucccuacaacaaacaggguuuccagauauuggagcaccuacuuacaugccuaccugugcuagccuaacucaaacaacaauagcuaccauuuugggagcgcuucacauacauaaucucauuucauccccgaugugacauccuaugugacaaauauuguuuucauuuuuggaugauaaaacugaagguuagagagaauaggugcuugcuuaaguuacacuaaaaaauggcaagaaugagauuugaaucuaggcccaccuauaaaaccugugugguuaaccacuaagcuauauaacccaugccagucuuuaaaugacaaacuauagaacagacuccaggaggcauuuuuauaaaagucagaaaggccacuacugcagguggccgcagucccaucucugggauggagaucucacuguuuugaugcuggcuaucccacauuccuagcagggagagaacacuugccuaucucaaacauaaaacccuaaaccaagguuuuaguaugacaaacaagacaguuucaaaaaaagcacuguacaucacucaaaaauccaaagaaucucacaguaggcauggcaccauauguggugggcccugucacacaggaaaaccaacacuggaaaggaaaccccauuucuuacgaaaugagcagaggccuaagaugaugucugucagagucagccuucauuccuuauguguccucccucuucccaagucacccugucacaggaagccuggcucugcuaccaacucucagaucuacuuugcaguaggucacagaaucucagggguuacuuaauacauccgucuucagguaagauaacagauaaaucauucuagggggaugccucaggcagucucagacgucauccacacaggagacugaaggacaagagaggcaagucacucaucuaagauucuacagcaucuugguggcguagcugggccuacaacucaggucuuuccacuagauccucugucuucuccuuugccuucgccuccuacagagaaauacccccuugcaccucccucuuccuucccuaaacuucuccagucaauuugcaagugcucucaacacucauacccuaucugaucucagcccaaaggauguggagcuuggagaggcuggaaagcagaggcaggggagcacuccucaccaacaugggcugcacaggugucaucagcgaggccuggacgcucagagcucgucucuggcccggcuccuucuccaccuccugcgcguugugaaggacccgcuccaccacauccugcagguugcgcgaggcuuugaaggcuucauaggcauuggggucaagggcgucuaaccugccaagggguacaggaacaaggaaacaaaaccacugccuuuguuugacuccauggcuuuggacagcaaucuguccucacagaagaaauccucaucuguagggaagggguuguguucuauugucuaaagacuuucacaagaggagagaaagcucuuggaaaauucagcucuuuugagauacugugccuauguggaugccgccuuagcgaggagggggcuggaguaggcaagagacucauacuauacucacugaacguaugccacacuucaacuguaagaacucugugagaaagguacuguuaucuccauuuuauaugggaaaaaauggaggcagagacaggucaagugacagaucagggucucacagaaaguaagaagguggaagggggauucaaauccugacugggacucaaaaguccugacaccaguugggaacaaacaaagcuaacaaaugacagcucaggcugucagcggagcugcuacuuacacauguuuugcaccugaguucaucuucagaucauguuugaucaaccugaugaugcauuuaaggucauuggcuguacaccuagggggaugaagcacauuuaacuuggucuugaagagcucuggaaccccaagggaaccuucccuucccaagagaguucaucucucuaugggcaugguuugacggaggcagcucccccaccuggaggcaauguccuguagggccuguugcugcucauccuccuuggugagcuuggacagccgcagaaggaacucauccacuuccuggaugguaaggaggcucuuggcagcuggggggaaagacuugcucugcucaaagaagacucugauugucucugacacgucacccugucuccaaaaaccaaaaugccacugcugcaacccuaggguggccaaguguaucccccaagacccaggacugaagaugaaucaagaaauuucaaucauagcuccuaucccaacucaacauaucuagcccacuucuuagagacacuagcccauccacaauuccuagaaggggauggaaacuugccaugguaccagggauagagucacggacaaaccaaagcuugguaaagccaaguuauaggagaaaacaagcaagaaaaaaagaguccagaauaaaagccccaggagagacagagggggcaagucucaaauucugccuuuugagaaccaggccuuugugguucagcaguuguaugguuuccacccucagaaacuuaagaaauuaagagcuauagccucacauucagcucccccuauaacggaagcuugcucaaauggguuucaguuuccuaaaacaguaugugucccaaccagaaaaaaaaaaagaggcugcaggugccuggcuuggcaaaaccccaccuggaauguagccuacccucccucccguuccucugaccugcucuaggucccgugccauaucaucuggguugcaguuaaaaaugcgacugaaaagcuucacaaucugcuuaucguucaaguuguaaacagucuuaaugacuccuggcagcagcagcuucacuguuagguacacaucaccguggaaaccaucuggagacagaaggaacccuucuugagaaauagagcuuaaacaaauaaauauauaaacucaaagaaggcugggcaagguggcucacaccuguaaucucagcacuuugggaggccgaagcaggagaauugcuuaagcucacaaguuugagaccacccuggcaacaaagaaagaccccaucucuacaaaaaauuaaaaaauuagcuggacaugguggcauaugccuaugguuccagcuacuugcaggagaagacaggaggguugcuuuagcucaggaggucgaggcuauagugagcugugaucacaccacuguacuccagccugggcgacagagcaagacacugucucacacacacacacaaaaauaaauaaaaaaauaaacucagaccgcgcaugguggcucacgccugugaucccagcacuuuagcagguugagguaggcagauuaauugaauccaggaguuugagaccaaccugggcaaaacagcaaaaccccgucucuacaaaaaauacaaaaauuagccaggcauagcggcacaugccuauagucccagcuacuugggaggcugaggcagaaggacugcuugagcccaggaggcggagguugcagugagcugagauugcacccaugcgcuccagccugggcaacacagccacauuuuuugucucaauaaauaaacaaacaaacaaacucaaagaagcagagaccaaaagauaucuauauaucgcugcccaugcuccuauaguacccugugcauaucgcuauaguaggagacagcauggaguucagaggcugguggauugugucugccucaccuuuagccuacagaugaacucuuguuggacagagugguuaguuucacuucacgugcccagugacaaggacaucagagaugcucaucgacaauuuguuagauaaaugaaagaaacagaguuggaagauucuauuccaaacuguguauaugguucacaaaaaccuaauuaaauauguaggacaguaaauuuucuaacuagucaaauaggauggguucuucuggccuccuaggagcagaauaaggggagaggaagacagaugccaaagugcucugagaaaaacuggcuacauaauuuguggaguacagugcaaaaugcaaaugcgaggccccuuguucaaaauuauuaagaauuuccagauagcacuacaguacagcauuaaaccaagcaugggaucccgggcaacuauacagcucacaugcccaggaaggcagccauggccuugagcucuccggaggaaaggccuauucaggaugcucaugccacaccuccugcugagccuuuccgaaggaaguccuggaugaucugggucuucguguuguagcuaggauuaucggccaccauggcgcauaacuuucgaaacucccguagcagacaguccuuaugccuggggucacauuugcuugaagacagacuucucuuagggguggggcucgagggggcuuccccagaguuguugggcuuggcuguuggagaaacaacagagaugaauucauucugccuuucugagaagaaagaaagggaaggaaggaaacuaacagauauucugcugguauuuagcuuuauuuaaucuccccgaauagacuuuugggguagaugucauuauauccaucuuacagauaaagaaauggaggccaaguaauuuucccaaaucuuacagcuaauaaauaauguuaaaggaacaauggccuccuuagacccaagcaaaagaccagacugaugugcaucucuuuaugugagcacuuuacugaagaauaaagaccaaagucaugccaagaaugaucaggacuggcugggcacaguggcucacgccuguaacccuaacacuaugcgaggccaacgcgggaggacugcuugagcccaggaguucgagaccagccugggcaacauaguaagauccugccucaaaaaaaaaaaguggucagaaggaucucagagcaauuguaaagcugaucccagaaaagcuggcaugagaaagggguaagaaaucaaguacguguuagacaaugugaaauuacugcuaucacagguugucagagcuggaagaagccuuaaagauuaucuaguucaauguucucuuacugauaaggggacugaggucugagaagagcaaaugacuuccuggcccacuuccuuguugaaagagccaggacaaagacacuacuaagaaagucagauuccauuaguacacucaacaucccuaccccucgcugcuucaacuuuucuuuucuuauugucaaaauaaaacccugcuccccaaggagcaguuauaaaaaaaaaauaauacauuuuuacaaaagguggucaaggggcagggauuuccuccagacacuuaaaaauaauuaugugcaacucaucggugauucccuuucaccuccuugugaccauuuaaaaagcaaauuuuauucggcaaacuuguggcagagccauuacuaagcuaacugcuguuguacacuguuucuugucugggcuuuguaaauuauaaauccauccucaucucugauccggaaucuaaauaugauuuuaggggacaaaaucuccaaagugucaauguucaaccagguugcaagaacuaaaacacucucuuucucucaacuccucccaaauuccauccccaacaccggagcccuuccagaaacaugcuguccuuaucaucaccuggacucuucucuaucuuuggccuaccagcaaacaacaaaccaaccaaccucagaauuuuuuuuuuuuuuuuuuuuuuuuuugagacagagucucgcugucgcccaggcuggagugcaguggcgcgaucuuggcucacugcaggcucugcccccaggguucaugccauucuccugccucagccuccugaguagcugggacuacaggugccugccaccacgcccggcuaauuuuuuuauuuuuaguagagacaggguuucacuguguuagccaggauggucucgaucuccugaccucgugauccgcccgccucggccucccaaagugcugggauuacaagugugagccaccgcgcccggcccagaauuuuuaaauaauaaaaauccuauagagccaggcaccguuuuugcaauguuaucucuuacaguccucaugagaacacuaugggguagaugaggcauggagauaugaugaagcuuaaacaaauaaauacacaaacucacugaagcagaggggaaaguaaucuauauauugcugccugugcuccuauagcacccugugcauagcacuaugguaggagaggccacugcugcuucauagacagaggcuaaagagagguaaggacgugcucagggaucugagcugucaaggaccagaacccaagucuucugaccucaggucuaggcuucuuucaaucacauaaaaugucuuucaaucuccaaaugacuucuaaaauaaggccaagugguuuggcuuuauuuauuuucuucagcugagucaaucacaagaaugucuccaaacaauaaaagcagcaacacaguguaguauaaaagagcacaaguacugaagucagacuucaguacaaauacuaacuccaugauaacccugaacgucaacuuucucagucauaaaaagggccuaauaaaaaguacuuccuaaauaaaaguacugucuaggguuaacugaagaagaaaugaaacuacauauauaaaagccccuaguccaaugcugucuguuuacguaaggccaauaaaugauccugaucuucucaacuccuaucuauaccacaugccccagcaaagucuuccugaaucccugucuaugaaauaguaauucuauauuuuauauaaaagaaacuauauauguguguauacacgugugugcauguguguauuuuagugaagagaacaggaaacuuaacacuuuauuguucaucuguccuacaaauaauagccacaguccuccccuuuaggagaugggauuugaacccagagcucacugauuccaaagucugcaagcuucaucccuaggcuguacugccucccaacaaauagcaauauccuucagaucuuuuuuuccuuccuuuguguuccaugaaguuccaguguuuugaauaaacaguuuuaagaaucaagaagggagauccaugcaugacaucucccuucuuucauacuuucauuucuaggcauauucagggaaacaauuucucaaaauucuuucauuaucaaaacacaaggaaguaaaagacagguucuaauaaucucugucuggcccagguaacuauuucaaggggaaaaagucuugacaaaacaaaucuuuccgcugcgauagagguuaaaguauacaaagaaaugcuauacaaguggaaugcuggccgagcgcaguggcucacgccugcaaucccagcacuuugggaagcuggggcagguggaucaccugaggucaggaguuugagaccagccuggccaacguggcgaaaccccaucucuacuaaaaauacaaaaauuagucaggcaugguggcaggugccuguaaucccagcuacuugggaggcugaggugggagaaucgcuugaacccaggaggcggagguugcagugagcugagaaugcaccacugcacuccagcuuggaugacagagcaagauuucaucucaaaaaaacccccaaaaccaaaaaacaaacaaacaaacaaaaaccaagcggaaggcuuagaauuagccauuaccagucucugcucagacagaagcaaauuauuaaugagaugagauagcacagaauuuucacucuuuagccagaauccuagguagaauacaaaauaaaagcagcacuauaacagcuaaaguagcccuaaccuaucuuaccugaaaagccagaaaauuuccggggauugguacuggugacaaaugaggcgccuuucacuggagaagucaccuggccagugguugucaacuuagccuggacaacagcuuucuucuuugguguaccugcugccuuagaagacagaucuguaggaucccaaaagaguauaaaauauccuucagugaacgaucucugaaaaaaacauccaaagaaucuaucaacugcuccuagggccuugcuuguuaagucacuacccuagcacuagcccaaggcuggcugguggcugguauuuuuugaguggggguaguagguaauaggguauuguggggacagaagggaaggauaugcuggagacaaaagauccaguuaccauuuaucucuauuaguaccuuaaauuuucaucaacauucuccacuucuuaucccauauguaagucuccagaaauaacaauuugggggaaaucagaaaucauaguuugauggauaaaacuuagggaacccccaaccccacagaauuagcuucaauuuagagaugaacaaaaaguaaaugaggaucacagagcaugucaaccuagcauaggaaggaaaauuuccagaugcuuaguuaucugagucaugaacucuaccuguauuucucuuccuccaaaugagagaugggucaagaaguaacaaaggccgaggccaauagcuaaggcagugcaaggugggauggggagccugagaauaaaguauaugggaagcacaguuuucuuucccggaagucuuuuuuccuuucaaagaacaaggacagauacccauuuuuagagccauuguuaacugucuuccuauggugaccagaacuaaguugaagauaugaacauuauuuuacagacacugaaggucaaagaggacuaacuggauuuggggguauuggcauaaaauuucuaaaauaugcauauguaaauaugcauguacaugcaaacauguuauauauagccauauauagguaugaauuuuacaugcauauacacgcacauauuuucuagcucugucugcugaaagggcuuagaaacagacaugccauggcugggcgcucaggccuguaaucccagcacuuugggaggccaagguggguggaucacuugaagucagggguucaacaccagcuggaccaacauggugaaacccugucucuacuaaaaacacaaaaauuagcuggguguggugucaagugccuguagucccagcuacuugggaggcugagacaggacaauugcuugaaccuggaaggcagagguugcagugagcuaagacagugccacugcacuccagccugggucacagagugagacucugucucaaaaaaaaaaaaaagaagaaacagauaccccaugacaauguguucacauaguauccggguuuuacucuuuaauaccauuucccacuaacaggauagugccacuacacuccagccugggucagagugagacucucaaaaaaaaaaaaaagaagaaacagauaccccaugacaauguggacacauaguauccagguuuuacucuuuaacaggggcauuucccacuaacaggaauccccagagaaauuaccaauuucagggcuggggaaggauacauacgggauaagacuaaaagcaucuugcuaugcucaagaguaaagaaguacauuaaaaaaaguuaaugaagguauacaggacacagaggacaguguaaagggguuccuaauuggccaaauaugggacaauuaaguaucaaauuaguuaaguacaguaaugaauuauaugcuacaagaaaaaaaguaaaagaggauaguaaucaguacucuauucuuccaaaauaucaaugucauaaaagagagacuauggaaauauuucagauuaaaggaggccaaagaaacaugacaacuaaaugcaacaccugauaugauccuagacugggauccuauacugcaggaaaaggcuacugaagguaugacucaauccauugacaaaauaguauacagaugguagauuuaaguauuacaucaaggacaaauuuucugaagaugauagcuauauuauagucgcauaagggucauauauccuauucuuaagguauauacacugaagaauuuuaaagggccaugauguaugcaacuuauucucaaaugguuuaaagugagugcacgcacacguguguauguauguagagagagacagcacaugaacaaauaugauaaagcaaauagaguaaaauguuaauagguaaauauggguaaaaggaauaugaauguucuuuguacuauuuuuaaucuuccaacacuucagugaguuuaaaauuauuuccaaauaaaacguuaaaggcugggcaugguggcaugcgccuguaaucccaacuacuugggaggcugagucaggaugaccugaguccagcagugcaaagcugcagugagcuacgaaugcaacauuaaacacuggccuaggcaacagagugagaccccaucucuaaaagagcaaaguuaaaaaaaagagaaagaaagcaguugaacuccuuaucccuuuuucucucagcaccaguaagaugagaaagcaguguucucuaccuuaccugcaaugugcuggguuaucuguuccuucucauuaucuuccagcucuucccagccuuccagcucugugagguccucgauuuuuuuugugguggcccgggcccgcucuaguuucucaaacaugcauuuaaugugguaccacucuuucauaucacccccagacucugagaagggauugggcaccacuuugccaauucggcauacgcccuucacaaucuuuuccuugcauuuuuugcagccagcugugccacgcuuggcauaguccacacagaaccguugcucagccaucucacaggggccacugcagagucccacaugcaacccuggcaagaaaacaagguagguggcacgugaucuuagauggcuucccuggaaugauagaacaggcuuucuucucaggaagaggggauguccaugaagcagaucuguuucugaccacuggcugaauugucuuacaucacgccagugauguuuucggaauaggcacaguucuuuucggcugagugcacggaggguuuguggaaagaagaucuugaaagccaaagacauauagcuguacgaaagaguaggaggccaaaaaaaaaaaaaaaagauauaaacaaggagauaggcuuccaauuuuccaaaggccagcgucuuauauaguccaugaugacuaaucaaacacuuuccaaaguauuacauucauagucuacucuacagcaugaaagaguucugauacaggaaaagccagcucgcagcaggauguucaauuaucuaaugcacacauguacaucuaguacaucacaaugaagaaaauccaaauaacauaaaagcucuuuuuaggccaucagcaacauaugauacucauaauggaugaugaccuuuaaguauuacaagauccugaacuuucuuuuuuuuuuuuuuugaggcggaguuucacuuuaauugcccaggcuggaguacauuggcgcgaucuuggcucaccgcaaccuccuccucucggguucaagcgauucuccugccucagccucccuaguagcugggauuacaggcaugcgccaccacgcccggcuaacuuuuuuguauuuuuaauggagacgggguuucuucuuguuggucaggcuagucuccaacucccgaccucaggugauucgcccgccucggccucccaaagugcugggauuacagacaugagccaccgugccuggcccugaaguuucguuuuaaucaccaguaaaaauuacauuauguucaugaaguuuuuauugugaaguuuaacacauaugccauccucagaaaucaagccacuauauagauuuggaauugaguuagaaucccuauauugagagacaacuaagcagagccuggaaucagacugccugaguucaaauccuaacucagccacuuaccagcuguauaaccuugauggguuucuuaccucuguuccugagcuuccuuaucuguaaaauguggcuaauuauggggccuaacuuaaagagcuguucuaagaguaaaacccuuaaaacaguugggcacacagcaagagcucucauuaacgucagcuccuauuaugaucggugacgucguuaucuuucaagaagaggcuuccgaugugcaauuaaccuguuuaucauucagcaacuugaaucagagaaugcugaagucacugggcagcaagacucacaggaacucauaaaucaauccaaauggaaaaagauuauaucagcaucuucuuauauucauguuuucuaaagcauuuuauaguccuaguuuuaaguauacuggaauuauguucagucugcacacgcugugaagcaaaauugcugucacguuauaauaaaaagcaggcuuugcuuacuguagugcaacaugaugugaaggaaagcugguggaccuggaauaagggaugggagugcaagucugacuguacaguuuacugacuguuaccucggagaaaacucuuaauuuaucugcaucuguuuucuuauuucuaaagcaggguaaauaauaccuaccucacaggguaguugggaaaauuacaaggaauccaugaaugcgcugguugugggggagggaggcuguucugagcucucuaaaaauguauacaaaauguacauucgauaaaaaugcacgguuuuuuggaggaggucuaucacuuucgugauauucacaaagggcuauauaacucccaaaguuuaagaaccacagaggugagguaaguggaaguacggcagacccauaaaaggaggucagaacaagugaguuucaacacuuuuccuagaagaucaauuuacagagcaaccucuagggccccaauaaugaaaggaguggacuugagggaggcucgggaggcgcugggccacgaggaggcacaaugcagcuuugaggaaacccgucugucccucguuccgcacccucacaacugccgcagcccaggggcccgagaaggaaaucgcugaggccuggccgccgccgcuuuucucgaagggcuucccgcgccgcugucggagaguggcggggacaguggggucggcggcguaggccgcgacccccggcgaggcagaaaggagcgcuccuccaccggguccgggacgcaggcgggaagugaucaaggcucccugagucccacccgagcgcucccgguucagcgcaggaggacgcacgccgggccaggguacgagaaggccccguggguuccacagggaacacagcccgggcgccggccuccccgccucacgcggccccgugggggucccggggagccgcgagccucccccugggcucccgggagggccgccacgucacggagggugugccccggggcuccgcaggcgggcgggggaggagccggggggcuggcuccccggccgcgccgagcuccucgccccgggcccgcugccuuccccacgccgggccccgccgcgccgugccgcgccgcguagccccucaccugccucuccggcuccggcgcucaccguaggccucggaacuugcucauuacaggccgcgggcagcccacgacgguuggagcgccugucucuuuaaauccggguccuagagcgggaggcagcgcgcaggcgcaagagccaaggccgcggccacgcgaccgguccccg

SEQ ID NO: 16734 - RNA, 10276 nt, Homo sapiens
ccacggagacggcgcucugucugccgggcucuuucuccuccacguggggacgcaggauggcggcagcagugccggugggugugcguggaugggggcggggggcgucgccgcggggcgcuagggcccgggucccugaggccugagagaggcgaaguggggcccuucugggcgggcgaccagacugacucccgccccacuugcucgcgcaggacgaggcgguggcgcgcgaugugcagcgguugcuagugcaguuccaggaugagggcgggcagcugcuggguuccccguucgacgugcccguggacaucaccccggacaggcugcagcucgugugcaacgcgcuacuggcccagguaaguggcuggccagggcggccucgcaucuccacccccgggcggaugcggugggggaaucauauuaccgagggucugcgguucauggucccccgcuaacggacuguggugacccaccuggcgugagcucccaccuaugucagagauggaaucaguggcauagcgcuuuacacgccaaccaaagggguccaccugcggagaggggccuagcuuugaacgcaccggaugcuguauuucauugauucuuugucacagucccccagucugggacacguuaauauccccauuuuacagcguggcccggagggacucaguauuuugcacgaugcuauguaguagguagcagauuuggaauuggaacccaaaacuauccgaauacccaugcuuuuauuuauuuauuuauuuaccuuuuuuuuuuuuuuuuuugagacggagucucacuuugucgccaggcuggcaagcuggaguguaguggcgugaucucugcucacugcaaucucugccucccagguucaagcgauucuccugccucagccucccgaguagcugggacuacaggcgcgcgccaccacacccagcuaauuuuuguauuuuuaguggggacuggguuucaccacguuggccaggauggucucgaucucuugaccucgugauccucccgccuuggccuccaaagugcuggggauuacuggcgugagccaccgcacccggccuuugcuuuuaaccuuuaagccaguguguuuacugaagagcugcccuggggacaggggagguccuuaaaauugcaguuccuggaccccaucccagccuuacuaaaccaaacucugggaugaagcagaaagucuacauuuuuuaacaggcguuuugggagcuuuuuacacaaauauaguguagugugguaguuugggaaacacugcauaaugcuauaugcuaauccuaucuuggacguaaagaaccugaauuaaucauuggcaauaggacauugaacuaauuacuuaguuguucugagccucugcuuuugaaaacugucagugggaauauuaguaucuacuucccacgguuguuaugagaugcagauaaagaauuucaggccgggugcaguggcuuaugccuguaaucccaguacuuugggaggcugaggugggcagaucacuagaggucaggaguucgagaccagcuuagccaauauggcgaaaacagucucuacugaaaauacaaaaauuagccaggcgugguggcaggcgccuguagucccagcuccucgggaggcugaagcaggagaauugcuugaacccaggaggcagagguugcagugagcugagaucucaccacugcacuccagccugaguaacagaacgagacuccaucucaaaaaaaaaagaaaaaagaauuuccaagugcuguguaaguguccugcaacugcuguucagugacuuaaaaggucuugcuaggcugggcacaguggcucacgccuguaaucccagcacuuugggaggccgaggcagguggaucaccugaggucaggagcuugagaccagccuggccaauguggcgaaaccccguaucuacuaaaaauauaaaacuuagccaggcguggugaugggugccuguaaucccagcuacucgggaggcugaggcaggagaaucucuugaacccaggacgcggagguugcagugagcagagauugcuccacugcacuccagccugggugacagagcgagacucuugucucaaaaauaaauaaauaaauaaauaaaaggucuugcucaaugggcaaugauggggguaucccuagcacgauggcugaaaagaagaagcuucaccucccacagcucaguggggagcaucccuggcagagggugccccugcacauccauuguugcggguuuguccuuuaccauuguccuucaggaggauccccugccacuggcuuucuuuguccacgaugcugagaucgucuccucacuggggaagacguuggagucccaggcaguggagacagagaagguccuagacaucaucuaccagccacaggcuaucuucagaguccgggcugugacucgcugcaccagcuccuuggagggucacagugaggcagucauuucuguggccuucagcccuacgggaaaguaaggacagcugcagacucauggaggggguaugugggggugcagucuuugccugguuuggggagggucucccagaguuauaauugauggggccucagggcugccuaccauagacccaagcucuggacucagcuugcaauuaagggacuuccucaguagggcaugguccccaaaggcugcuuaaggaccccugccuuggacaaaccucuccuagacuugauuuuucaagaucugagcugugugacuuguauaaaucacuuaaccuuuccgaguuaauuuuucaucugugaaacugggauuaguugcuucucucaaacuuagaaagguaaugagaagcuucaaaagcugguuauagcuguggagaggaaagaaauggccuccugauguauucucccagaggacagcaucaguauugucuuucucccuuccaggggcgaggaaagaguccaguuccauauucuauucacagaaagugauugaauagguggcacaaaugcacaugugcagugucaagcauccucucuucuuccccagguaccuggccaguggcucuggagacaccaccgugcgcuucugggaucucagcacagagacaccacauuucacaugcaagggucaguaugcaauuagccauuuagggggucuucuuuuuuuuugagacaaggucuugcucuguugaccaggauggaguacaguggugcagucacagcucacuugaacuccugggcucaagccuugaacuccuggguucaagcagucccccuacuucagccuccagaguagcugggaugacaggcacuugccaucacaccuggcucguuuuuuguuuucauacagaugagggucucacuuugcagauuacaaccccuuaauauccaguuggcggcugucuguuccuagguagagaccauguccuugagcccagccagccacuuagacacaagcagaaacugcaccaaggagucaauaugggacauggugagaggcugacugacugcuaccaaggagaaccugguuuaaauccugccucugccacagugguuuucaaacuugagcacaaaucagaauugccccgccucaggggcuuguuaaaaugcagauugcuggccaggcgugguggcccacaccuguaaucccagcacuucgggaggccaaggcaggcagaucacuugaggucaggaguuugagaccagccucgccaacacagugaaaccccaucucuacuaaaacuacaaaaauuagccgggcaugguggcgugugcuuguaaucccagccacuggggaggcugaggcagaagaauugcucgaaucuaggaggcggagguugcagugagccgagauggcaccacugcacuccagccugggugauggagugugacuccaugaaagaaagagagagagagaaaagagaagagagaaaaaaauacagauugcugggccccacccccagagguuuaguucuauugggccugggguagggccugggaaucugcauuucuaacaaguucccaggagaugcugaugcugcugcucugacgaccacacuugaagaaccacugcuauaccacagauuaguuaagugaccuuguguguguagggcauguucccuuucuaagcuucaauuuucucaucuggaaaauggggaugauaauucuugcuuugcuccauagcuuagagcucuugugagaaauaacaagggaugacauguacaaaaacacuucauagcaugugucacauaaggagucauuagagagugaugguguuauccaugcagcaagaugcagagcucuaacacuuggggugcauucuauccauccccagaaagccucaucgcuccuuuuguucaaucauucauuuauucaaaugguuaaggaguaccuggcaccugacaggcacugcugggcacuugggauaaagacagauguagucccuuauuucucccuccucugcuuucuuaggacacagacacuggguccuuaguauauccuggucuccagauggcaggaagcuggccucaggcugcaagaauggccagguagguaguucucaggguaacuaggcagagacucaagggggccuuccuaggagacaguucagaaucagguucaggagucuuuggggaggguugggugggaagugguaggcagggauuuugguggagccagagaccuguuggggaggauuauucagugagcuucuguccuucagauucuccucugggacccaagcacagggaagcaggugggcaggacccucgcuggccacagcaaguggaucacaggccugagcugggagccccuccaugcguaagugacacugacggagcugggacaaaugagccaggggaucaaagccauccccuuucccugcccaaugcauagaaguuuuacgugaggggacaagaugggcagccugaaugaccgugauggcuuggcaggcaugggagaagggucucgggcagaccugcauugcugcuugggagaggcucucaucacagggucugcugguugcagucaccuugcagugcagccgggucuuggugucagaaaagcugucaaaagauuguccauggccuuuaaguugggaauggggaggugccaugggcacacagauguugccaggucacagaugaggucacaucucccuucucuccaggaacccugagugccgcuauguggccagcagcuccaaggauggcagugugcggaucugggacacaacugcaggccgcugugagcgcauccucaccgggcacacccagucggucaccugucuccgguggggaggggacgggcuucucuacucugccucccaggaccgcaccaucaaagucuggagagcucaugacguaagugcugggaggguucagaaaccaguccagaaaaucgcaagucacaagaugcuggcacucagaaugaccuugacaucagcgaguccaguguuucccagaugugugcugggagcccuggucuagggagguguuuugggaaugaggaguucugugguuggugcugcaccauaguggagauugcagaguccccaugagaucgucacacucuggaaauuccuccuguaggacagcuguugggcuuuaucagaucuaccauaucccaaauguauuggacaggagccguuuacucugacaucccuaacuccucuuccaugaaacauuuucaugaucuggacuccauuuuacaaguggggagagacuugaccccagagggguaguuugauuaagaucacaaugcaugagugaugaugauuauuagucuuguaccaccugucuccuggggcuaaucgcccaggcguggggaggagugugugugucugaccugacucgcucucccguagggugugcugugccggacucugcaaggccacggccacugggugaacaccauggcccucagcacugacuaugcccugcgcacuggggccuuugaaccugcugaggccucaguuaauccccaagaccuccaaggauccugugagugauugggagaaggaagagcgggggcugauugggaaggagccaguucucaagcuuaauggggaguguuugcucuuuguguuggauuuucuuaucggccuucuuccucaucuccuuuucuccccuccgguaccuggucacagugcaggaguugaaggagagggcucugagccgauacaaccucgugcgggugagugugugccagccacgugcaccccuagcucuguaccaguccuuagccaaucacuaaaacccucucagacccuucucccuucuagacccagcucagaauguaccuauuccaaaaaguuguucuucauaauccuaguuugcaauccuaaaauacuaaugugcuagagaucauuuuauuucguuuuuuguuuaguuuauuugcuugucuauuuauuacauuuccaacaugcuucuuuuuuacuuuaauuuguuguuuaagauuguucacacauucacguucaaaaaauacaaaagguagaucgcggagucucccgucucuauuguagcauccagugccaccaguauccugaaucaccuuccagagauuuaauauacagacacgugucuauauacaguauauauguauaagcacacacacacaugcauacauacauaaaauccuucuuuuaacacauuauuuugugccuuuuucuguaauuauguaucuuaaaauuuuuuucuacaugcauguagaguuucuuuuuccuuuuggaugaagugacuugccuggggucacaugcgagugaguggccaagccaguccucauugcuccuagcgcuggccucucucugucccuggcauugaguaaucaggguguaugcuugcugccaaagucgggcccuccuccuucuuucugagaccacacccaacacagugugcuuucugccuccccuagggccaggguccagagaggcuggugucuggcuccgacgacuucaccuuauuccugugguccccagcagaggacaaaaagccucucacucggaugacaggacaccaagcucucaucaaccaggugcucuucucuccugacucccgcaucguggcuagugccuccuuugacaaguccaucaagcugugggauggcaggacgggcaagugaguagggguggguacugcuucucuguaaggagugaauggugggaggggcuuggcacugccacuuacuagcuguauggccuuggcagguguuuggauuuucuaagccacuguuuccucuuugguaauaugcagacccccuaccucucagcuuuguuacaagguguuuguuuguuuguuuguuuuuagagaugacuuucacucugucaccugguguucaaguggcucgagugcagcggcacgaucuuggcucauuacaaccucugcuuccuggguucaagugauucuccugccucagccucccagguagcugggauuacaggccuccgccaccgugccuggcuaauuuuuguauuuuuaguugagacgggguuucaccauguugacuaggcuggucuugaacuccugagcucaagugauccaacugccucggccucccaaagugcugggauuacaggugugagccgccaugcccagccuaguuacacggauuuaaugagacaguauguuuaggacccgcacuaaguggucacuaaaaaugcuaguucaggcugggcgugguggcucaugcccauaaucccaggaguuugggaggccaaggcaggcagaucaccugaguucaggaguucgagacuagccuggccaacauggcaaaacccugucucuacuaaaaauacaaaaauuagccaggcauaguggcacgugccuauaaucccaguuaccccggaggcugaggcaggagaaucauuugaacuugggaggcaaagguugcagugagucgaguucacaccacuguacuccagccugggcaacagagugauacugugucucaaaaaaaaaaaaaugcuaguuuaugucuuaggagagaagugaucuuagagcuagcugcugaagagguagggcuguagcccuggagaaggugaaguggugguagguaggcuugugguacaauuguuacuuggcccuccucaaagugugggccacagaccagcggcaucagcaucaccugggagcuugauagaaaugcagaguccuggccccaacucagaccuuguggaucugauucuucauuuuaacaaaguuaccaggugacucugcuacccacucaaguaugggaacccuuggugugaugaggcacagugcucuugggguuaaucggauuagaggagaggcaaaggcacaggcaagggggagaaaaagagccagggaaaccuuguuagggcugaaggggggaccucugcguuagugacgucacuguguuuucacacagcaacccuuuaagauagguaauuggguuccuuuuuaaaauaaggaaaaugagucucagagaggccugaugguuuguccaaagagaaacagcuagacuguguugacgugaaaguucagugggcccacuguuacuccaugccaccugucagcaggcacuugcuguuuggggggaugacaggcagaugggcuaagcagauggccacguuggagucuaaggcaugcaaaguugugcagguauggagggcaagcaagaggcaugcuagaagcuacucauuuggagaaguuuuacaaauuguaaugacugguaaugauuaaaaauggucugggauggggaccaggcagugugauuuuguaaagguucccagguauuucuaacagacagccgagguugagaaccacugccaugagcguaggggacccuucagacguguugaaagauguaacucagacuaaaauccaucaucgucuucuccuggaccagguaccuggcuucccuacgcggccacguggcugccguguaccagauugcguggucagcugacagucggcuccuggucagcggcagcagugacagcacacugaaggugugggaugugaaggcccagaagcuggccauggaccugcccggccacgcggaugagguagggccaacccucaggcaaaggagggacugggauuggagccuggcuggcugucucccucucaccaccccaccugccuuccucugccucccuuuagguauaugcuguugacuggaguccagauggccagagaguggcaaguggugggaaggacaaaugccuccggaugugagugugggggaaguggugguuggcauacacagcccuccuaccccuaagguccuucugugcacacuuucccuuacagcauagaauuccgcagggccguccaggugcucagacugucuugaggaggcguguggagccagauucucagugggcaagugggagggccacaagugggagggccaccggaacaacagaggccacaggacaccucguagagggcgcguccaggucuuucugucagugggcaagugggagggccaccggaacaacaggggccacaggacaccuuguagagggcgcauccaggucuuucugucacuagacuucagagucgcaagaccugaguucaaauccugguucugccauggaguaaucacagagaacuugguuaaucagucucuugggaauuaucaaaccuucacagacaggaucaaaaauaggagggucaacacucuggaagacaaaguguugugugcuuauaagggauugugacuguuugcuggugggcaucccgagggccaggcccuggguggagguccugguggcagcaggcagugagugggcagccugaguuugggugggcagagcagggacggucaccuggcucuuggugacucugaggguggaccacaggccguccgucuguugacacugggauuauaugacggccucccuuuccuaagguggaauccccauccugacacccuucccuucuccacagauggaggagaugagacggcccgaaguucucucugacccccaccucgacucggccucugccagcugccuucccugccagagaacaaaggcugagauggcagugcacacacccuccccaccaguggggaccugagaaugcguguggccugcuguccucgauagaccggaaugggguuuucccacagauccccgccuguggcacaccccagagccagaaaucgaaggucacaggaaguugucacugaacuuggcccgugucugcuacucuguaccuugcugguacagacagggguggugggcagccaggcucuaugagugggccccuagugucagcucuguacagggucagaucccagguucuaugaccaaauaaguaacuuaaguuuuguguguug

SEQ ID NO: 16735 - RNA, 598 nt, Homo sapiens
uauaauuugauucuuuuuuuuuuuuuuuucaguugucaaaugauccuuuauugaaauauuuuccuuugugcuuaacuggcugggcauuccacagcaccacuguugaugucaucgaugaugucaugaggauggcggccaucaacauuacagcccacagacugggcaguccccaggaucucuuuaaugguuccagagaguucucuggcuaaggaucggugccgcaucugucgaacaauguugacgaucucaucaaaagugauauucccacuguguuuaauguuuuucuguuucuuucugucucuuggugguuccuugagggcuuugaugaucagggcagaggcagaaggcaccaccucaaucugggccugucuguucugaauggucaguuucacuguaauccucaggcccuuccagucacccguugccuuggcaaugucaucaccaaccuuuuuuggagacagacccagggggccgaucuugggggccagggcagaaguggcaccgacuucaccuccggugcaccucagguauacgacuuugaucucguuggggucgaacuucggcggcaugguggaggcggcugguguuggaugaaccc

SEQ ID NO: 16736 - RNA, 8871 nt, Homo sapiens
ccugcagaggaucaagacagcacguggaccucgcacagccucucccacagguaccaugaaggucuccgcggcagcccucgcugucauccucauugcuacugcccucugcgcuccugcaucugccuccccauguaaguccuggucuugaccaccacagccccuggagucagacucugccuagaaugccuaccccaucccaaugacugucccacaccuugcccucuuuucaacuguagcaugaauacugucugaaccccauuauuuacauucuuaugaauugucuuacccauauguccuguuguccuugagagaucucuaugcugcuucauggcagggaucuccugaucaguuuuucugucuuuaaggucuacacccucaaggccuacagguguucacugaguguggacucauguuggggagauuaguagucaugaguagcucacacugacuuugaaacacgucugacucaugccugucagcagcaggguuucuaagaaauuuaacuaaacuaaaacuuccugagacccugagacagccauauucucucucauuucauaaauguaaaaaaaauuggcuuaugagaggguauguggcuuuauuagagugaauacauuuaaaaaacaaauaaaaacaaggagaggauaauaaaagcuaauuaaaugguuacuauggaucaggcauugugcugauuuuggcacaucuuuuuuuuuuuuuuuuuuuuuuuugagauggagucuucgcucugucgcccaggcuggagugcagcggcacgaucucggcuuacugcaagcuccgucucccggguucaugccauucuccugccucagccuccggaguagcggggacuacaggcacccgccaccacacccugcuaauguuuuguauuuuuuaguagagacgggguuucaccauguuagccaggauggucucgaucucuugaccucgugauccgcccgccucggccucccaaagugcugggauuacaggcgugagccaccgugcccagccgauuuuuguacaucuuauuuaauacccacaacccuucuuugaguagcuguccuugauguacagaugggaaaacagagagguuaaguaacuuguccauggaggcacacagcuaggaaauggggagacugguauucaaaccugguuccaucuugcugggaaaauaaaaacuacuccucugcugggaaguggcaacugaugcuucccaacgucaucuugaauuaacugaccaacaagaaguucucuguugagagcccuucucacugaagcucaaccagagcucccaagauacaauaugcaucuccaggcccuucuuaggauccuggcugagucauggagccugagcuuuggaagccuccccacaaccugcccuaggucucaaagaaaccaaguuccaaauccauugaggaugcuggaagggcaagaaugaagccagaggacccaggacaagccaggaggaggcccugaaagcccagggcagaagguuaugguguagagggauggauacaagcuuggcucaaggauuagaugaggcauuggaauccccacucugccacuguuuauccauggccaagugacuuuaccucucugagccucaguuucugucaaggaagauaacaguucuuucuaaauaaaucauauaaaguguccagcacaaugucaagugugcaguagcaaugaauaaaagggucucccuccuuccuuuccucuuccagauuccucggacaccacacccugcugcuuugccuacauugcccgcccacugccccgugcccacaucaaggaguauuucuacaccaguggcaagugcuccaacccagcagucgugugagucucagccccauggagcccucccagagccuguucccugaggaguccucugagaggaugcccuacccacuuccaccuauccuccagcugcaagcagccacagcuccuccaucucuagccucagaguccccugcuaucauguaaaaagacuagacaagcuguccuuagagaaucgugcccacuccaauggacuauguucccaggacuccaaucuuuuuuuuuuuuuuuuuuuuuuuuuuuuugagacagagucucacucugucgcccaggcuggagugcaccggcacgaucucggcucacugcaagcuccaccuccuggguucaugccauucuccugccucagccucccgaguagcugggacuacaggugcccacaccaugccuggcuaauuuuuuguauuuuuaguagagacgggguuucaccguguuagccaggauggucucgaucuccugcccucgugaucuacccgccucagccucccaaagugcugggauuauaggcaugagccacugugccuggccuaggacuccaaucuuuacuaguguggccuuuacuugaaacauggucuggaaugcuccuauguggggaagaucaagucagucauccccuucagugaagaaccccauauuucacacagucccccauauuucacacccaaucaaauccaccuaaaccucagaggaacuagggagaagaggucagaggucagggaucuauaacuguagucaaauaaaaaaacaaaaagccauccaucagagaagaaauaaggaaaugagauucaccuuuaaauaugcaagcuaguauauuuggaaaaauauaauaaacccuacuauauaggaaaugccuacuaugugucaaaugucuuaugugccugaucuuuaaauuacacuuagcucugacaaguaugcauaauucucuccauguuucagguauugaaacuaagauucagagagguuuauugauuuagccaaggcugcacaguaaaugagggaugaaguccaucucuagagccuccucuuucuacuauagcaaagucauuagugacaauugcuuaagaaauuuaugguagagacuuaaaaaaugaaaauggugcaauucugaaguuucuuauauaagagugaaguuuuuguuuuuguuuuuguuuugagacagagucucacucacucuguugcccaggcuggaguacaauggugcaaucucagcucacugcauccuuugccucccggguucaagcaauucucuugccucagccuccuaaagugcugggauuacaggugugagcuacuguacccagccagggugaaguuuuuuaauccaaaaauuuaugacacuggcaaaguuagagguacucaaagacagacuuuggaucugaugaauccuuuuaaguauaaugguaauauuuaacaauuacuaauuuuauuucugaaaacaaauauuuuucaaaagaagaaaauccuucccugagcacauacuauuggcagacacagauuacuaaagccacugucccagcccaaccuuaugggacucauagucuaauaagaggggcaagacagacacagcaaugacuagaguacacagcaaaaaaaaacaugacaagggaaagagagaggaaacacauucagcuucagggauuuacagguuugcugcaaauggugcugucugaggagagauuuggccuggcagagaaaagccuagggaaugggauauaucaggaaaagggacugucccccaggauucuacuuugguuuauguacagucuccauguaggaaagcacggagugucaggaaaaugcagcaaaagugcuaaaugcagcugucaaguguaaaaugagcuagaacagggaaagcugagaaaacaggaguccaguuuagcggcuacuguuguuauccacgugaguaguauuggaggcugaacagugccugaaggaaaggagagacaggagguuucaaagacagacacuuuugaaaccuucaaagguggaauuugcaagcccuagcaggugauuugagcucaagagcaagggagaaaaauggggguuaaggaugacacugagguuuccaccucuggcuggagaaguguagaaccaucuuaagccuugugaaagagcuguuuaaagaggaaagagcuaaggugccagcaagauaacccuguggauauguccaguggugauggugaaaugaaggguugguagcugaggaaaggguguuagggcugaaaauaugacauucuuuugugggaaaaagggguaucccaauuuuaaaaaggcaaugcagccugccuuggugaguacuggcucuagagcuaguuugcuuuguuaggacuccagcuaugacacuuggugaguguaggcccuucaauuaaccucucguaaccccaauuaccuccucuacaaaauaggguaauagaaguacuucccccacugggucacaguaagaugaaaauacuuagaauaugcucugguacacaguaggugcauaaauguuagcuuauuauuaucauuaucaucuaaaugcauuauugcguacacaaaaauaacaggugaaacuuaaggaaugaaugagugaauugcauucauucacuuaaucauucaauaaacauccauuaagcaucaacuaugugccaggcccagggccagagacuuaggaaaaaacgcaaagaagagaaaagggcagcagcuuugagaacauccgcucuuaagggguaggcagaaggaggaagucaggcaagcagagggugccaaaaauggagguaaggagggaagacuuggcaaggaggggcuguucuuugguaucacagucugcggggagguugggggcaggaaauggaggccugagcuacccucaucucagguauuguuuuccuggccuuuugacuuccuagccacaggucaaggaugccaaagagagagggacagcaagucuggcaggauuuccuguaugacucccggcugaacaagggcaaggucugugucugaaacucucacaccacccuaaauaagaacacaaacucuagaaaguaugagaggccagaauauugcuuccguucccuuuucaucucugcacaccggggugggagaaaaagagauggucaaguggcucugagugaggcugggaaagggaaacacaaagagaaaccaagaaauccucauucucaccagacaaucuaaggcuucacuuugucugaaaauauuuaggcucaagaaugugcaggauacauccaaaaaugguuacgaugguaaauuuuauguuaugaauauuuuaccacaauuaaaaaaaaauuuaaugcuguuaggcacagaaucaggagaaccacaagagcuuaaugacuuugacagacacaccaauacaugcauagagaaagaaugaaaauauuaaaccaaagaaugaaugagugaugaaauauuuaaauaagguggguacauagcacaucagaacauauuugggaauaauacuuccaucuagggaauacauuucuuuuuuuuuuuaaugugauaguaaucacaaaagcaaaggcggaauuucuguguuguuugagacauauaauuccuuuguuaugcuauguaaucauguggcauacugcaugggucaauaagauuuaaaaaauaaacuucuaucugggugcgguggcucacgucugugaucccuguacuuugggaggcugaggcggguggucaucugaggucaggaguucaagaacagccuggccaacaugaugaaacccuguaucuacuaaaaauacaaaaacauuagcugggcgugguggcgcacaccuguaaucccagcuacucaggaggcugaggcaggagaaucgcuugaacccgggaggcgaagguugcagugagccaagauugugccacugcacuccagccugggcaauaagagcaaaacaccaucucaaaaauaaaaaauaaaauaaacuucuggccaggcaugguggcuuaccccuguaauaccagcauuuuagggagauugaggcaggaggauggcuugagcccaggaauuugagaccaaccugggcaacgugguaagagcuugucucuacaaaaauaaauuuuuaaaaauuagccaaguguggugguauacaccuguggucccagcuacucaggaggcuaaggugggaggaucacuugagcccaggagguugaggcugcagugaguuguguucaugucacuacacuucagccugggugacagugagacccugucucaaaaauaaaaauaaauaaauaaacuucuggauggcugcacaauaaauaguugauuuucuuccuaugagaaucucuaaaauaacauauccaguauuugaacuuaaguaaaaucaguguucaaauuucaaauaauaauaagaauaaugugcaggaaaaaauccuaaaggaaaagccaaaaugggaaaggguaaguaggcaggacugacccugaaguaauguguuaauuggcagcgcugcuagcaaggcccaaggucucgcacagguagaaucaguuucccagcagacaggugaggcaggcagcuggacugacccucaugacccccaacuuuuacauuuccagcuuuaucaucaaugacuauagagauaaggccucugauucucauaggccuccacauucuggcugguuacuuggugcaagugcuuugacauugccauuaucucauggcccucaacuccccugagccacagugucuaguaccaggacuuuuagucucauguugcucucauccacccuaaaggagaaguuucagagcauucuaguaacaacacaugaaugguauuuuuccaaacuuauucauacauauuauccuuugagcuucacaguaauugugcaaagaauuauuucuaucuacauuucagagcuuagcaaauagaagcagaggcuuuaagugauuugcacaaaaugaucaaacuaauaaauggugaaaugaagacucaaggucaugcccaucuuucguucacccacccaugcacagauguauucacuuguugagugugccaggcacugcguugucuaaagccaaaucagauguucuuuuaagaacuucucggccaggcgcgguggcucaugccuguaaucccagcacuuugggaggccaaggugggugaaucacgaggucaggagaucgagaccauccuggcuaacacagugaaacucugucucuacuaaaaauacaaaaaauuagccaggcgugguggggggcgccuauagucccaacuacucaggaggcugaagcaggagaauggcgugaacccgggagguggaacuugcagugagcugagaucgugccacugcacuccagccugggugacagugagacuccgucucaaaggaaaaaaaaaaagaggccaggcgccguggcucacgccuguaaucccaacacuuugggaggccaagguggguggaucaccugagguuaggaguuugagaccauccuggccaacaugguaaaaccccaucuuuacuaaaaauacaaaaauuagcugggcaugguggcgggcgccaguagucucaacuacuugggagacuaaggcaggagaaccgcuugaacccgggaggcgaaaguugcagugagcugagaucgugccacuugcacuccagccugggugacagagcaagacuccaucucaaaaaauaaaaaaaaaaagaacuucuugucucccacuuauucaaucaugacucaguucuugagggacaccuuauucucucugcaucuuaagcacccagcacaaggccuggagcagaggaagugcugagaaaagucuagugauuggcaggcucagcccugggcuucaaggcuccguauccucuuagcuuuucaggcuacaugcauuugugugaaggcgauuaaaaugcacacaaauuuguuucuggcuuggagcccuuugauccaacagaugaggaaauguucucuccuuaaaagccacaaauaaaaucuuauggagcuccaaauaugcccuaccccgauaucaucauaauuucccuuuauaccuuaauccacuucaucccccaaacuggcugucccgguacugacaaggucucauccucccucuucuucuccucucccacagcuuugucacccgaaagaaccgccaagugugugccaacccagagaagaaauggguucgggaguacaucaacucuuuggagaugagcuaggauggagaguccuugaaccugaacuuacacaaauuugccuguuucugcuugcucuuguccuagcuugggaggcuuccccucacuauccuaccccacccgcuccuugaagggcccagauucuaccacacagcagcaguuacaaaaaccuuccccaggcuggacgugguggcucacgccuguaaucccagcacuuugggaggccaagguggguggaucacuugaggucaggaguucgagaccagccuggccaacaugaugaaaccccaucucuacuaaaaauacaaaaaauuagccgggcgugguagcgggcgccuguagucccagcuacucgggaggcugaggcaggagaauggcgugaacccgggaggcggagcuugcagugagccgagaucgcgccacugcacuccagccugggcgacagagcgagacuccgucucaaaaaaaaaaaaaaaaaaaaaaauacaaaaauuagccgggcgugguggcccacgccuguaaucccagcuacucgggaggcuaaggcaggaaaauuguuugaacccaggagguggaggcugcagugagcugagauugugccacuucacuccagccugggugacaaagugagacuccgucacaacaacaacaacaaaaagcuuccccaacuaaagccuagaagagcuucugaggcgcugcuuugucaaaaggaagucucuagguucugagcucuggcuuugccuuggcuuugccagggcucugugaccaggaaggaagucagcaugccucuagaggcaaggaggggaggaacacugcacucuuaagcuuccgccgucucaaccccucacaggagcuuacuggcaaacaugaaaaaucggcuuaccauuaaaguucucaaugcaaccauaaag

SEQ ID NO: 16737 - RNA, 4974 nt, Homo sapiens
gaaagagccuguuaacuaucauaagucaaaaaacagcauucugaccucugcccuguaacuuccucuucuucuuauaaauacaagggcagaacuggcaucccgagaagccaggaagcagugagcccaggaguccucggccagcccugccugcccaccaggaggaugaaggucuccguggcugcccucuccugccucaugcuuguuacugcccuuggaucccaggcccgggucacaaaaggugaguccagugagcuuucucucagaugaccagguucaugguaacucaagcucuguggcagagacacauugcccuccuguaacuacucuccaucccagacguggucaugguacucauuuaaaagcagcaccagaguauagaccugguucugucugcaggcuuuggacccugggaggggaauauacacauauggcugguccaauguggggccaaucauuucccuuuucacagcaaaaauuauuugauaccuucccuuagcagacauaggacuauuaagugcuagauuaaaagaaguguaguaaaauuacaaauuuguagaaagaagcauagaauuguaugaugcuaaaacuguuacauaccaucuaguaguaucuaucauaucauuuuggagaagaaauggaacaagccacacaaaugacucaaccaaggucaccuaaccaucguauuuuuuuguuuaacaaaugcacuucuaguacuuccuauguacagggcaggcacuguucuaagugucuuacagauauuaacacaucaguuccaccuaacaacccugugggauauguauuagauuuuaaaaaaugcaaauuuuuuacuuuuguagggaagaaacaaaacaucaauuuuuauaugguuuuucauauuauuauuauugacauuuuacaaaugagaaaacugaggcacagaaccuuagauaacuugguagaucacacaacuauuaagcgguggaauuaaaauaugagcuaauuaggaaguaguuauggaacgacaaggccauuuaagaucuuuuuuuuaccuuacccaaaccauauugagcauauuaaaauauacccacaugucucauuacauauaauucauuuaauguaaccauauaagaaauaaguugaaaacacuggaaagcaauugggggacuaauucggcagcugaaucguuauugccaagucuuuauguuucaaaauguuaaguaaauaucaacuuuaaagccagcuuuaaaauuauuaauaguauauuuaauauaauuguuaaauuauauuaaaugcauagucauuaaauuauauuaaaaguauauuuaauauccuuauuaaauuauauuuaaagauauuuaauauagucauuaaauuauauuaaaaguauauuuauuuuuaaauauaugaaaaguacacauauauuauauuaaaagacacaugcacauguaucuuuauugcagcacuaaucacaauagcaaagacuugaaaccaacccaaaugcccaucaaugauagacuggauaaagacaauguggcacauauacaccauggaauacuaugcagccauaaaaagaaaugaauucauguccuuugcagggacauggauaaagccggaaaccaucauccucagcaaacuaacacagaaacagaaagccaaacaccacauguucucacucguaagugggaguugaacacugagaaugcauggacacagggaggggaacaucacacacuggggccuaucggggaguggaggguaaaaggagggagagcauuaggacaaauaccuggugcaugcagcagcccuagaugauggguugauagguacagcaaaccaccauggcacauguauaccuauguaaugaaccugcgcguucagcacagguauaccagaacuuaaagucaaauaaaauuuaauuuaauuuaacuuuaaaaaaagaaaaagucuauuuaauaguuauuacauuauauuuaaaauauauuuaauaguuauuaaauuauauuaaaaguaaauauuuauuauauuuuauuuuauuuugagauggagucucauucuguggcccaggcuggaguacaguggcaccaucuuggcucacugccaccucuaccuccuggguucaaacgauucuccugccucagccucccuaguagcugcgauuacaggcacaugccaccaugccuagcuaauuuuuguaucuuuuuuuuuuaguagagacgggauuucaacauguuggccaggcuggucucaaacuccugaccucaagugauccgcccgccuuggccucccaaagugcugggauuacaggcgugagccaccgcacccggccaaauuuuaaggcuagcuuuauucugugagacagucaauuguggaaauaaacuaacuuuaaggauuaaaauuuaaaagaaaggaaaaauguuuaaagcuuaguuucauuugccuaacaagcauaaggcagcuccacaaucccauuuccaaagcacuuggcgcuagaugaauuuuggaaugcagaauuucucagguuuuaaaaaguuaauaugauaugaugcagcaauucuauuucuggguauauauccaaaauaauucaaagcagguacaugaauugauuuuuauacacccauauucauagcagcauuauugaugacgguagccaaaaaguagaagcaaacuaagugcccaucaaaagguuaguagauaaacaaagugugguucauacauacaauggaaucuauuuggccucaaaaaguaaggagauucccuugaauguugaaguaagaaaaaauaaaaauuuaaguaaggagauucugacacaugcuacaacauggauaaacaucaaggacauuaugcuaagugaaauaaaccagucacaaaaggacaaauagcguaugauuccacucacaugagguacuuagucaaauccacagagacacgacacagauagugauugucagggauuaaggggaggaagcaugaggaguuguuguuuaaugaauacagaguuucaguuucacaaaaugaaugaacggccgugaaaacugcauaguuauuugaguguauuugaugcuauugaacuguauacuuaaaauaguucaaauggcaaauuuuacguuauauauauauauauaaccacgauuuaaaaaugauuuaguaaaaaacuuaaacauauauugaugguacuuaucccugaugaggccugggaacaguauuuuaaucaaacacagcaaccuccuguaacaaacacaugaauauuucuacuaacugggauaaauaaugaccauaauagcugcacuucacuuaaagggauacugugccaccauaugagcugaugaacaccucucuguuuccagagcccuguggauuccagaaauguguagagagacuuguagacugugucacaucauguagacauuccauuaacugaaccauguuagauuuugagguuucuuuuaguauuucagagucaacacguguuuucaugucuacauuuucaaaaggucccugaaaaaucucagggcccuaaaggaauaaaugggccaggagucaggccuagagcccagacaggugguggugguccagcuucagggaccuuucugccucaggaggaggaugagcaaugggguggguggagaugcugaaacaaugcugccgcccagugauuuccuucccuguccugucugcuucuuccagaugcagagacagaguucaugaugucaaagcuuccauuggaaaauccaguacuucuggacaguaagugaucagauacggcauauauuuaaaagcagccagcaggugcaggucugcacuaugggauccauugucccuguuuacagaaugggaggagaaugagaggguccugaggguggugaacaucuccaaggaagaucaggacgggcuaugggaacccccuccauagaugccuucucuguuccccucuggcugccccaagagucugcuccuuuggggcagaaggugcucucugaugccugcaggugucugcagaugccuuccccuucuaggggaaauuuuccugguccugcuguggcccacccugagugcccucagacacacagcucaacucugaugagggucugaagcagggagaugccagcaagugcuggucacggaggaggaaacaucucuucugagccaugugccuucucacccuccacagugcucuggaggagaaagauugguccucagaugacccuuucucaugcugcaggauuccaugcuacuagugcugacugcugcaucuccuacaccccacgaagcaucccguguucacuccuggagaguuacuuugaaacgaacagcgagugcuccaagccgggugucauguaggugccaagcucaccaaacauguguugagggagaaggacucuguagcaucuugcagggaggaccugauagacugguguccaucagggcccacccucuggauccugccagguauggggcagcuguguccuuaggaagauccugcagggcaucggggaugagacacucccagggggaaaaggguggggaaggaagaagaaagcaggcacaagucugcccaaggaugcucccaugagucacuagggagucccacaggcugagggggucucaagagcacaauggcccugagcugccaucagcagagaaugaaaaaaaaaagaaaaaaaaacuggcuauauugacugggaaaucugaggggcagggagaauggggcccccuguccccaugugcuggacacaccucaguuuguaacuuuucucccccuuguucccuagcuuccucaccaagaaggggcgacguuucugugccaaccccagugauaagcaaguucagguuugcgugagaaugcugaagcuggacacacggaucaagaccaggaagaauugaacuugucaaggugaagggacacaaguugccagccaccaacuuucuugccucaacuaccuuccugaauuauuuuuuaaagaagcauuuauucuuguguucuggauuuagagcaau

SEQ ID NO: 16738 - RNA, 993 nt, Homo sapiens
agggguggggccggggccggggccagcagggcgcgccgccuaccuccggggccacgccacugcccucgcuguaguucucggagaugagcugaucgaagagcagguggaucucggugcgggcggagcugcugucauccgggcgcagggcgcagagccuggcagacaagaggcgaaacccauugccucgcucagggauugcuucccgcggugccucccgcggcugcacggaaggccacgaaccgacaacuugcacagcagccaucuuuucuacgggcgggggggguggguggggugaucccagggaaauacuuccgggacauccucccguuccgcgcgcucuaguuccgaaaguaccuuuuuuagaccggacuggggcucagagggguuuccaugacuacgggacuccuccgaccgguacccugcagaugcuugucagaaauuggcuuggaggccgggcucgguggcugacgccuguaaucccagcacuuugggaggccgaggcgggcggaucacgaggucagaagaucgagaccauccuagcuaacacggugaaaccccgucucuacuaaaaauacaaaaaaaaaaaaaaaaaaaaaauuagccgggagugguggcgggcgccuguugucccagcuacucgggaggcugaggcaggagaauggcgugaacccgggaggcagggcuugcaaugagccaagaucgcgccacugcacuccagccugggcgacagagcgagacuccgucucagaaaaaaaaaaaaagaaagaaauuggcuuggagauuuuucgccggccacuccuucuugagcccugacugaaaagugaguucucaauuugugcuuccagaaaguuuguccucccagaguuuguuccuggacagggcugaagguacucuguuccguacuagaguuucagauucgggcuggaguuggagaggguaugcuguggauggcaguagcagaaaccgcuaguucuaaggcacccuucuacucuu

SEQ ID NO: 16739 - RNA, 989 nt, Homo sapiens
gaagaccugggccgggagcggggcuuugccaggguccauuguacucacgcuggggggcuagagaccuucuuuuacugguucugcuuaucagccaaacuucaccuaaccuuuggacuuguuaagccagugccuugcagccuaggcgcggggcuuuuccaccgguucucaguuccgcuuuaguccagagagaagacacuacgcuucgggguucaggugagagccagaggaagcuggggugcucguggaagaaggggacgcaggaggaagcgaagaguagagacccuggaugcgucccggccgacgcagguggugggccaggagagcccgcagggcggaagagaaacugaccacuuaggaaggggcgccgaggccacgggggaggugaggcagcguuagguguggugagcaugcccuggagggacuccauuuauuucuaccucgguuacuaccuccaggccccagaaccucccuggccuggucuggcgguuuggguuugcagaacugcccgccagagagcguaggcgagggugaaggaguccgggagaacucuuggaaagagacuacuuuauggguagagggaguagccaaagugaagcucccccagcagcugggcugcaccggcgcccagccuggccacgccacuggggagcuggaccccuggggcuccucacucuccuguuuaaacccggaugucaaggcgccuccaccuugggggaggauggugaggcagaauggugaggcacuaggauggugaggcacuaggauggugaggcacuaggauggugaggcagugaaagcaaagcuugaccugcagcuggguggacacuugcagccgaggguccccccggcccacucauuucugguuuauucguaguuccagaacaucugugguucccugggccggggacgagcucuguagacgaggucacugcagcaguggcagaagucuugcacuccuaguacagaaggugucgacagagcuacugagg

SEQ ID NO: 16740 - RNA, 3082 nt, Homo sapiens
gcuuuauaaugucuaaacacaucaauuagagcaguuguuuauuaaaauacaaacaagggagaaaccacaccaucuuuuaaaauacaggcgcgaauuccacaucacgcagaagacaacgcauuucgcuaagggccacagcauucacugguuaauaaagccacagcuacaaaguaaugagaugucccacaugaauacuuuuuaaccacuuacauucacgucaacauauaaauaauggaauuaaguaaaaacuucauuauaaugcuauuuuguuagaaaaguauuuguaaaguggcauuuuucccccaagagcuguuucacuuaagcuuuauuuccucggccuggcaaggggagggcuuuucaguauuguuauuugguacacacuuaccugaagaaauaaguaaguaacuuaaacauaaaaaacauagucgacacacaucuugcccugcauucugacauuugcuggaauggucuacagcaggcuacaaugcucccuucugaauggcaaaugucugaaaaugucaguuuauuaacuguucacaaaggcaggcauuugaccuugaagguguuaaagggaauuuuuuauuuuugagacagaguuucgcucuuguugcccaggcuggagugcaguggcgcgaucucggcucacugcaaccuccgccucucugguucaagcaauucuccugccucagccucccgaguagcucggauuacaggcaccugccaccaugcccagcuaauuuuuguauuuuuaguagagacagggucucgccauguuggccaggcuggucuugaacuccugaccucgggugauccacccggcucggccucccaaagugcuggggauuacaggcgugagccaccacgcccggcuaaagggaauuuuuguagugguccccaguacagggccagcauuuccuauuucuguaacauacagcccuauaaucuuugcaaagcugaaguacacuugaaauaggcaaacagaagacaccuuuaaacaaauaagacccccccaaaacccuucaaauauguauauguacacaaaauauucaaauaauuaaaaauucacaaccccuauggaaugcuaacuaguagccacaggaaaaauaaagcauggaaaauauccucauauauccaguaccucuucuaucucaagcauguccagacaaaaauuaaauuacacacuaagccauaaaaauuuuaaaggcaaaacaucccaccaaaaaaagaaaagugcuuauuaauggccauucaagcaguggggugaagcgggcugacacaaugcacaguauggaaauaaguaaccuuggcuacaguuuccaaggacacggggcuccuggcugacaagaagagcugaggugaagcugaaugcagcguugagccauuuuaauaaacguuuauaaagaaaagcagcgcaaccgugucccacacuccuuggaucccuauugguggcaucuaauuaaacauuucaaguauucaagagauaugaaagguagugaauacuuuucauagcaaaggcuuuuuuucuguugacaucugcugaauuuuccuguggcaccucccaaggagugacuaagccuaccauccuugguaaggaaaauggggauuauacuaaggaauuuuaucugaggcauucuggaauuucucaggaauagaaaccagcccagcuaccaagugagcuuuuuaaaauguugauacugggccacugugacaugacaggcaucuauauagcauuucaaaaaaaugcuucagcaauacaaauucaaacugggaaacuuuuuuuuuuuuuuuuuuaagagacagugucucgcucugucaucaccuacgcugucacgugcagccucaaacuccuggacuugugaucucccgccucagcuuaccuaguagcugggaccacgaauguccacagaugcacuccaccuacccggcuaauuauuuuuuguauaauuagcuggggucuuuaccaucaugcccagggcuggucucuaacuccugggaaacauucuuauugcaaagguagauucugcugucaugguucuguuaugaaauuuaggccaggcgcaguggcucacgccuguaaucccgguacuuugggaggcugaggcgggcggaucgccugagguccggaguucaagccuggccaacauggagaaaccuugccucuacuaaaaauacaaaauuagcugggcgugguggugcacgccuguaaucccagcuacucacgaggcugaggcaggagaaucgcuugaacccgggaggcggagguugcacugagcugagauugugccauugcacucaagccugggcaacaagagugaaacuccaucucaaaaaaaaacaaagaauuuuuaaggccaauuagcagccugcuugcauuccagcuccauguggaaguggugcuguccaggauggaagcgccgaggccucaggaaaagccugccaaaagcugucccacuuguguuguuagaaacaccccacuagccuuguggugggcaaaagcuccaaaggugcccauucagagugagcugccucagucaggaauggccagagacgguaucaucgggagcgagugagaaaagccuuucucuccucggugccucucugugcauucgggcacgcagaaggucaagcagaagccucagcaacagcuguuuaaugaaaauguuccacaccuuucuuggagaacauggaaaagcuguaagauggagcaagacagaauuuguccugagaggggaaaauaaauuauguaaaagcagcaauuauauagacaagaccaacuuuuucaguuuaaaaauaaaagucuaggucagagggucuaaaccacacaaaguaaagcacacgagauugaaaaaucucuucauaaagcgcauaaucaacaauucagagagacgugugcccuagauugguaguucuucccaggaauaacacagcucuuagccacuuggguuuuuccccuaauuuuaugcauucacauuaaauggcaaagacaauucccuacuccaggaagcaugagccuuuucuaucuaaaauucaguacuguuucuggacaauuuucuucuacuucuucuaagucauguaucuaucc

SEQ ID NO: 16741 - RNA, 8311 nt, Homo sapiens
uccucccccuccaaagaugugcgcugcgcuugggacaaacuuccaggucaagaaaguacggggggacaauggcaacagccgcugaauugcaaagcccagcagugcaggggagccgccugggauuccggacccggcugcaccccaaccuuccacaaggcucggucuuggacuacccccacucuacagcagaacucuggccuccgccugcgccuauucccgcucucucucugucccucccaucgaaacccacgccuuaccggagcaggagggggcccaggcacggugcugcccgccguccgcgccgcgcggggccgcgggugccgccgccacugauccucuaaacgcggucuccccgcacucucccgggccgggggaugcagaaugguuuacagagggaccgcgaggcgcugauuggucgcaggccgcagugacgucggcgggcgcugcauuaaggcgagggggcuuccagagcucagccaacagccaggagcagugaccaagccgccggagcuggggagagacgcaccggggcggcgacugggccaggagaccagggacugagggacgcgcccggggagggccagcaacaagccgcggcccgggcgcgacagcggcgguccgcgccgagccguuccagccgccggccuacuguagccgcugcgccaggacauuuuuuuuuaaagcucuccaagcugccccccuccuccccgacuccucccgcugcaaaagaaaaacaaaaaaaaaaaaggaaggaggcuagaaaggaaacccagauuugccaccacaacgaaaaaaagaaggggaaaaggaaaaggagagaaagucgagcgacugugggguuagacggaggcagacagagcgugggccgagcgaugcggggcugugcgcccaggcggccgcgaguugugacuggagccacgaugcacggccaggcgcggugagaagccagcccguagugccucccgaaggagcccgggcgcagggagggucgcccugaggacacggaggccgccaggcaggccaagggccgaggugacugggcuggggcgguagggaaggagcgagugcgccuggcugccuccgcacggaguugucccucucuguuuucgauugacacaaacacuucuccaaaagcggggaaaccuaagcaacaacagcaaucaacaccaagaucuuccuccuacccuccccucuuucccuucucccgcggucggcccucgcccccucccccaggcccagcgcgggcgcucggcgcguccagacccgcggcgcgaugccggcaguuuaggauccaaagcuucucugcuccuuuuguucuuuccuucccuuuuuuaaaaaaagaggggggaaaucccaguggugggcagccuggcacgcacacagucgcccucauaccccgacaaaagcagaugcacuuugacuucugacagcucuaccucaagccccggagaacucagcggcgcuuuccucgcaacccgagcucggcgagucgucgucuucuucuucuccguuuuuauuuauuuauuuccguucccgccgccguucucgcugaccuucacuccuccgcgggcucugagcagaagggucgcauucucucccgccugagacuucuuuuccucgccccgggagcucaggcggcgccgcuccagcccggggccccgggacuccccggcugcacacuucacugagacgcccccccaggccccgaucagccucguuuccuccacccuacuuugauuuccuggugcgaguuuuggcuugcacggccgaguguguguccucuuuuuggagagacuggggagcucgugccgauugucuucaggagucauccccugggcucuacuuugccccucucucucucugggccucaucagaccaaaccaaagaccaugguucacugugccggcugcaaaaggcccauccuggaccgcuuucucuugaacgugcuggacagggccuggcacgucaagugcguccagugcugugaauguaaaugcaaccugaccgagaagugcuucuccagggaaggcaaacucuacugcaagaacgacuucuuccggugaguacuuuccucccacgccucugcugcuaccuccccgcgggcccuucccggccagcuucggaucagagguuagcguggccucgcugcccaguuaggaacugcuucuagagagggcagccaagucccgcgggcgcccgccucuccgccagcuggcgcgcugggagcccgggacgcggcccugcuugcauccuggaaacuaugggucuggguuuggcugcaugugccugggaagaaagggucugagccugacucggcccagaagccccuucaagcuuggaagagacagggcagccucgggcguuguagcccggacugcugucuuucccggagccaagcucugcagcaacugcauucuccaggccuucgggguuguuugcccuccaggcagagcccaggcucccucccggccacuaccuuuuccgaccccgagcggucuuggcgguaagcuccgagccuuuugcguagagugucugggccaacugcccugucagcggcaggaaagaacucggccuuaaagccgauccugcacgcccgggggucuuccccaaacccggacaugccuccgagugcagaccuggacaaacugcugcacuguagccugcgaagugcccggagcuuuuuccugcuucccuggcugccgaaguugucuggugguucggcuucagccccaggugacuccgacucccacgggcuccgcucaguaguccuccuaggaaacugccagccacagccagcaaccuccuugaugaaaccugggggaaagccgagaccuccagcuugcugguggggagacuucucccuaccccccuuauucguuuagcauuuuaauuauauuaucguacacucacaauuuugccgcuccauucacacaaacacacaagucaacagagaagaacgggcacaaaugcgaauuguaauuccacccuacggaugugaaauaucgcaauuuacucggcugacuuggucucugcuuuucugaguuuguggucauaguucaaaccagggagcaggaggaagagggauucaaagccacucagagggccaagacgcgcuguccccagugccgcuccaggacucguggcugggguuggguugcguggaaccaugaagcaaagcuccgugcucgcugguauuucgggagaacgcgcaggcugagccucugagccuccgcgggcugcccgguuuuccucaaggacuggaucauagcgggaggguggcaaaccguacucguacccgcugccagugggucccugagccuggcuuccacaacccgcggcagagcgcccagagccagcucccgcagcucccgcuuuugccaaccugucccgcuuuaggcaagagcguggcggcggccccgcuaaggcuacggaggggggcucuccgcggcuauguuuguuuaccaacagcggggcuagacaucgccaaccccaugccuaugugcggguccuuuugcgaugaaggagagaaaagcggcgcuccgcgcacguuuauauagaguucuaauuguaauucgacuuuucugaaucuaaucggaaaauaagugccccguuccccccgcccacacaggucacugccuugccaccuucuuuagacgaugcaucuuuccucugggauaacgcugggagugaggcuggggcuuggcggguagcuugggccccuggcucuaaccgcguguauccccucccuaacucuucccuggugccgcgcucucucuccugcugccuccucaccugcuuaaccggaauucugccucucuuuaucucucucuucccuucuuucugugcuccauuccuccucuccuacuuccuccacuuuuuacaucuucccucuuucucgcugucaucuuucucuccgccugucuccccuugccccuggcugacccauccccgcccccgccccccacccccacccccccgcagguguuucgguaccaaaugcgcaggcugcgcucagggcaucuccccuagcgaccuggugcggagagcgcggagcaaaguguuucaccugaacugcuucaccugcaugauguguaacaagcagcucuccacuggcgaggaacucuacaucaucgacgagaauaaguucgucugcaaagaggauuaccuaaguaacagcaguguugccaaagagaacagccuucacucgggugaggccccaauuccuggcuggcuaggugcaagcggguccugggggaggaaggcucgccaaggccccggcucaucuguccuuucccucuuagccaccacgggcagugaccccaguuugucuccggauucccaagacccgucgcaggacgacgccaaggacucggagagcgccaacgugucggacaaggaagcggguagcaacgagaaugacgaccagaaccugggcgccaagcggcggggaccgcgcaccaccaucaaagccaagcagcuggagacgcugaaggccgccuucgcugcuacacccaagcccacccgccacauccgcgagcagcuggcgcaggagaccggccucaacaugcgcgucauucaggucaggccccggcgcgccucuccaucccacagaggcccacacugccacuuugggcacccaggccgagccaggagagcccagaauccagagagaagugagagauggaguccagagguggggugccuagacacaucccgagccugcgggaccuaugaaaugccugaugccuucgagcaucuagaaaguccucuucccagcccaacagaggugaucguggcaguggagggggagggacgggaguucagccagaggcuggaggaggagaacuguugaacacucuggagagaguggggagcccucuuucugcacauaccccaccccaccucggguucggaagggucagagaagucucagugucccccagagucaaucagucccucugccuucugcacaaagugaacucuuccuaagucugcaacuccaacuuugugaucgcuugcuccaauuagacaagccccagaucagggacuuccccuccaaagagaggugguuccgccgggagucagcucugcuuccagcggguuggagugaaauuuggguaugggagccuaccuggaggcagcugggccugugggcggaaaggaggugagacugcugaagcuccaggccagggggagucucuggcucagugcuagguguccgguucaccgggccugaugcccugcguggcuguggguggauguaccugccugggaggcuggcugugcaugugcacaugugugcaacacggaaggcccugaggccuacaggagacugugagaaccuguguacaugaaugagaagucgugugucugugucacuauuggcaagaggcuguggauaaguauguuuggcacugugagauuguacaugggugugaaaaggagauuguagguuuugguaucauaggcuguuucugugucucugucaugguuggggggaggguugcugcaagagaccgugaaauggaaacgcggugugugucugacauuauuuuggagaggcguagucucuauguguguacagccccagagaagcgguaacugugauagugugacuguuagaaaaacuccagcuauaccacaacucucccccuccagacacggcggccuguccagguccuccugugggauuccugcucaccauuggcucaggguccgcccugagugguccuagucagagaucgcaccgucaccacuacccuacacacacacacaagcgcgcgcgcgcggugucggcuagccaggcggugaaggggugcuggcuaggcccggagcaccccggggucggggguggagucucgguggccucaccccgccgccaugugcugcaggucugguuccagaaccggcgcuccaaggagcggaggaugaagcagcugagcgcccugggcgcccggcgccacgccuucuuccgcaguccgcgccggaugcggccgcugguggaccgccuggagccgggcgagcucauccccaauggucccuucuccuucuacggaggugggugcgcgccgaauggcggggcacggccaggucggggcgggcuucguuggaagcggguggcagcgcgggggggcacgccucgcucucuguaagccacuggagaguuggggcgaguagggagaaggcugggaguaaaucaaggggaggcggcgagaccgaggacccaauucacggcccugaauaacggggguagcugguaaggggcagcucccgggcuugcgcccagccuccucccugcacccaggcccgcgagggcuccccgcgauccgcgaguuccccgcguggccuuccucagcccgccgaggucgcgucuucccucccuuucggucccgccggcccccggccgggcccugacguccugcgcccuccccgccgcuccgcagauuaccagagcgaguacuacgggcccgggggcaacuacgacuucuucccgcaaggccccccguccucgcaggcccagacaccaguggaccuacccuucgugccgucaucugggccguccgggacgccccuggguggccuggagcacccgcugccgggccaccacccgucgagcgaggcgcagcgguuuaccgacauccuggcgcacccacccggggacucgcccagccccgagcccagccugcccgggccucugcacuccaugucggccgaggucuucggacccagcccgcccuucucgucgcugucggucaacgguggggcgagcuacggaaaccaccugucccacccccccgaaaugaacgaggcggccgugugguagcggggucucgcacggucugcggaguucgugguuguacagaaaugaaccuuuauuuaagaaaaauagaaaaaaaaaaaaacauaaaaagcaaguccccacccccuuccuccagccucgagaaccauucuccuucuggggagaccggauggaaaagggggacacgaaauaggauccaaaucggccucgaggugggacugggauccgcgcacuggcugucgacgugcagaacuggggcuccccaaaggaaacgcagaccucuccccaacucccaccuggacccggauccguagacagaccccgcgggcgugugcgccuggcaggcgggcggcgaaaagacguccagggcagccgcgggugcgcacagccguuggcgaugccaggagccguggggagggaggccgugagcacagccgggugaaggaagugaagcggcccagggcgcucccgggccagccaggaggguucuagcucugggauaucccuuauuaguguugucucagaguucaacaacagcgacaaaaaacucuuauagcuucagaaacgccgaccugccgugcaucaggugggacuauauauauauuuuuugucuaucuggauuuuugguuuuuguuuuugccaaaauugcaaaauucuaaauguaaagcccuccguaucaacucuucuaccuucgcaaaacuacacauacacacauacacacguacacggacacacucgguaagauggucuccagccagaccgcucaguaaaaugacuugaacaucagcuguacaagaaaaguauucuaccuucacacacaaaaaguuaaaaaaaaaaaaaaaagacuauugaacuaaaaacagucaacuguuuacguauaauguuaaauucaggaguucaguguuuuacuaauauauccuguuuugaaaccucuuguucgaaaacaaaauguuuugagcaaucaaccaaaauuguuccuuuucuuuuccuguagauguucugacagauuugcagggcuuucggcucacugugcuaguauguaaaaagguguuguuuacacgaggcaaagagaaaacaugcuauucagacaguugccaaauagaauaauuauagcacaaauacuguaaaggugccuggcaccagcaaccugagaaaguguuaaaaaaaaaaaaaaaaaaguguuacaagauuuaaaaaaaaacaucuuugcuaauuuuuuuguccuguugaacauucauggaauuguuaauaugacuuauauagacccacacagguuuuauuuuugugucuuuaaaauaaaaguccaaaauauuuaaauuuuauggucaaauaugcagucaacagcugcuacuuuuucuuuauauauuaaauuucucauaugucuuuuauuguucuaauaaaccuaagcuugugugaccuccagugcauauuagaccauucacuguaugaaagaaaacauguugaauaaauuugugaguuuuuaauaaaaauagaaaaucugauguuuagaua

SEQ ID NO: 16742 - RNA, 17936 nt, Homo sapiens
auuccagagaaaaguggaguacuauuuauugagcaccuaauacaugugaguuccuauugcccuccauauucucccaacaauccaggaagguaggauuauuccccuuucgcccaggagggcaccgaggcccagguggguaaggagcgcccccccaaggucacauagcagucaggauugcaaguucgggguugcuauccuccaaagccaugcuccaggaggggagauuuuugucucuuagaagccaucuggcaacgucuggagacauuucugguuucauaaugaggggucaugcuacaggcaucuagugcguauaggucggggauucugcuaaacauccuacagugcacaggauggcucucacaacaaaaaauuaucuggcccaaaaugucaaggguguggaauuugaguccaccugcccuaguggugauucucagccuuggcugcacauuagaccaaugguggcgcuuucgaaagccggaugccagguggcgccacacccaucaugucagacucucuggugucaguguuggguuuuuuaaagcaugccaggugguuccaaugugccaccaggacagaaacacuucuaugcuccucacacugcuggcuccugcugcuuuccugggacccgaggggaggagugccaaaucugucucgguuguacaaucaacggcaagccugcucccaguuccuccccuugaggggaacugacucagucacccguggggggcccccguggggugggagguguuugcuaauuucccgucgccucucauggggcugcagccaggagucuccccgcaaggaggcuguggaagcugccugaagacuggaccgaagagcgaggcugccaccuaacggaggaauuggccagaaucucccacgugcugagugauguuuuauuugagccucacaacaacccugugagguaggugcagagucccgcggcacagaaagaugaggccugcgcucaaggccccagggcggggccgugugugggccugaggugcgcacugucuacuccacaucagggccccgcccuccaccccccacauucucauacacacauuugccacaggcaaugacugguucaagaggaacggguccccugggcugggcugccugccucucugcagaugucuaaacuuucccucaacuuccaggcagggccugggaacagauucccuccaugcuaggccaucauggcuucccauggaaauuaacaaaucaccauguccuacuacagguccaacaucacaacaggaaacagcuuccucugguguccaccgcaguccccuucccccccccucagacuguggucaauaaacaugggccuggugcacacucaggcagaggcuccccgcacacuggagccggcggaggcaggugcggccgucccugacuccagcacaugaacacuguggacaguccacgucagcccucauuuugccucucuuucucugggccugaagacagcccugggugcugagccaugcugagcccuucagaccuggcugaggguucuugggggucuuggagaagcugccuucucucccccucuguggggaaacccuuccucuggcugcaaauggagugaagaagaauuccugcacagacacaaggacaagggaagagaggacggaggagaaggaugauguuuagagaccuagacauucaggcagccccucaucucaucaacgggauguaauuuccccauuuuguacauaaagcaacugaggcacacaaacagccagcaaaugggauuagagggcaucaaaucccaccugcgugauuagagggauagaggaaagggaaaggggaguagacucaccugcagccacagagacguucaaggacucaaguccaggaggcagcuggcgccggggcaggauggugaggagaagcuggcaggaggccugcaccuccugggauagaccugagcccucauucccugcagggcguggggcugaggguuaggguugcccagcuggacacccaguugcucgggaaauguaaucugggcacaaacgcagggacauccaccuacccagcacaaggagaguaggccguucccagaggaacuccaagcaacucaugauggggaucucggaggacuggggauccucugugcuugggcagcccaccgugccggccacgagccagcccugcugggcuuuggucugaaagggggaagaagauauguucuaauucuuuuuuuauuuuaauuuugagauagggucuuacucucgcucaggcuggagugcaguggcacgaucacagcucaccgcagccucaaccgccuggguucuggugauccucccaccucagccucccaaguagcugggacuacaggcacucgccaccccacccggcuaguuuuugcauuuuuuuuuuuugagaugagguuuugccauguugcccugguuggucuggaacuccuggcuucaagcgauccucccaccuuggccucccagagugcuaggauuacaagcgucagccaccaugccugccucuccuauucuaauucaucaaaucuucaucagaggcuguaugcaguggcucaagccuguaauuccagcacuuugggaggcugaagcaggcagauuaccugaggucaggaguucaaaacuagccuggcccaggcacgguggcucacgccuguaauccccagcacuuugggaggccaaggcagggggaucaccugagguugggaguucgagaccagucugaacaacauggagaaaccccgucucuacuaaaaauacaaaauuagccgggcaugguggugcaugccuguaaucccagcuacucaggaggcugaggcaggagaaucgcuugaacucgggaggcagaggcugcagucaaccgagauugcgccauuguacuccagccugggcagcaagagugaaacuccaucucaaauuaaaaaaaaaaaaaaaaaaaaaaccaggcucaguagcucacgccuguaaucccagcacuuugggaggccgaggcgggcggaucaccugaggucaggaguuugagaccacccuggcuaacauggugaaacuccgucucuacuaaaaacacacaaaaaauuagcugggugugguggcacaugccuguagucccagcuauuugggagucugagggaggagaaucgcuugaacccgggaggcggagguugcagugagcugagagcacaccacugccuccagccugggcaacaaagcgagacuccacucugucucaaaaaaaaaaaaaaagacuagccugagcaucauggugaaacucugucucuacuaaaaauacaaaaaucagccuguaaucccagcuacucaggagacacgaggaucucuugagaccaggaggcagacauugcagcgagcuaagauugcgccacugcacuccugcuugggugacagagugagacccccaucucaaaaaaaaaaaaaaaaaauuauccaucagagcccuggccaaggaagagcccagccuugcccauacauucauuuaucugcugauccagucaauuagucaauaguuauuaagcaccuagcaugggcucuguucuaggcacugaggacagggcacugaacaaaacaaaacagaccaaaaucccagccuuguggaagggcagguggggauggacucacugaggugacauuugagugcagaccugaaggagaaggaggagcaccgugcagacaucuggggcaagaacauucuaggcagagagaucagcaagcacagaggcaggugccucccuggcauguuugagaacaguaagguggccagugggaagagaggcgucaagacagaagaaggaacaagagccacaugagguauggucuccagggcuacuggaaggacucugccuuugaaucugagcgguacagaggcuuugaaagguuuugagcagagaaguaacaugguaugacuucaacagaaucacucugccugcugugcugagagccaagagcagaagaaaggaggccaggugggaaguuucugcaauaacggucaacagaugauggugacuugcuugggccagagugguagcaguggaaacaggcagaaauggugauaauacggaaauaacuuuaguuaaggaugaugccaagguuuuugaccuaaacaaccaaagggauggaguugcuccagaaggaacaagcgcucaguuuuagaaauguuagguuugaaaugcccgccugacagcaaaacaacaacaacaauaacaacaacugugcaguaggcaacuagaugagugaaucuggaauucagaaccaagguccaggcuggaguauacacuugggcgggaauuugaauucagauaguauuuaaagccaugagacuagaugagaccaacaagaaaugaacauauacagaaaagagauccaggaccaggugagguggcucacgccuguaaucccagcauuuugggaggcuaaggcaggaggacuucuugaagccaggaguuugagaccagccugggcaacaaagugagaccucaucucuacaaaaaaaaaaagaaaaagaaaaaagaaagaaaaaaauuaggugagauggugugcaccuguaucuccaacuacucaggaggcugaggugggaggauggcuugagcccaggaauucggaggcuauacugagcugugauugugccacuggacuccaggcugggcaacacagcaagaccccaucucucucucucucucucucucuuuuuuuuuuuuuugagauagaguuucacucuuauugcccaggcuggagugcaacgcugugaucucggcucacugcaaccuccgccuccuggauucaagcaacucuucugccucagccucccgagcagcugggauuacaagugcccgccaccaugcccagguaauuuuuguauuuuuaguagagacaggguuucaccauuuuggccagguuggucucgaacuccugaccucaggugauccaccugccucagccucccaaaguucuaggauuauaggcgugagccaccgugccuggccaagaccccaucucuuaacaaccgcucccggccaagaccucaucucuuuuuuuuuuuugacacgucacucugucacucaggcuggagugcaguggcacaaucucggcucacuaccaccuccaccucccggguucaagcgauucuccuaccuccgccucccgaguagcugggacuacaggcacgaaccaccacacccagcuaauuuuuuguauuuuuaguagagaugguguuucaccguguuagccaggauggucuugaucuccugaccucaugaucugccugccucagccucccaaagugcugggauuacaugcgugagccauugugcccagcugaccccaucucuuaacaacaacaacaaaagagauccgaggacuaaaaucugggaaaugcuaaugcucggaagucaggggguugaggaagaaccacuaaaaaugucucucagagaggacauggugaagcagaaggaaagcagguauaguguuucaaggaggaaggaguggucaacugugccagcugcugcagaugggucaagucagaaaagaauugagaacagacccuggaaugcagcaacauggaggccacuggugaccuugaugaagccuuugauucagugugagaggaagagcugacuggugugagaucaagagcgugagaggggaauguuugcuugcaugcugaagagaguguaagagaaaaguggaugcugcaggaagaggaggaaaauugcuacagcagugucucugaguacgcaggaagggauggggccccagcacaggccccugcuuggggcaccuccagcucuuccacagcaacaggcggaugacacucuccaggucagaugcugaugacaguagggagaugugaugccuggagcuuaaguggauguucugcaguguuucuguguuuucagaagcuaccuguucaggggcuggaagugaugagugggaaccucaucuccuaucaggcuuggagaaaggggcucucuacaaaaaagugaagccaaaaaaugcuucuagauaugugcuguucaauauaguagccacuagcuacauguggcuauuaagcaauugaaagguggcuaauucaaaucgagguguguuguauguaaaacauuuuuuaaaggaauguaaaauauuucauuaauaauauuuuuuaaaggccaggugcgguggcucaugccuauaaucccagcacuuugggaggccgaggcgaguggaucgcuuaaggucacgaguucaagaacagccggaccaacauagugaaaccccaucuaaauacaaaaaaaaaaaauuagcugggcauggugugugccuauaaucccaguuacuuggaaggcugaagcaggagaaucacuugaacccaggaggcagagguugcagugagccaauauugcaccacugcacuccagcuugggcaauaagaaugaaacucucucaaaaaauuaauaauauuaauaauaauuaaaaugauuacauguuaaauugauauuauuuuggauauacuggacacaauuuauuuaaaaugucaucucuuuacuuuucaauguggcuacuagaaaagcuaaaacuaccuauguuucucacaccauauuuuuauuggacagcguuguucuagacaggucccagagcucucccccuucuuaagagggaaauuucucacccugcaguugggguggggguugggggggguauggucagaggggauuccauaugcagagcaauacugccuccuuguguccagcaagggaagcacagcugaagacaaacggaugggagagggguuuccaagguuugucucuugcuagauacuaauggcauaaagaucuucuuguucaaacauccuuucaagcugugcccuauucgaggaacucaggucuccuguacgcagcuccccacagcugaacaaaaugcauuuacugaagcccgaccuaguaggcaaauagacacugaggcugacuuacagaagaggcaaaguggugcauaccuggggaaggggugcaggaaaggguauaacgcuaggaagaauucagcuaaugcuccauuugccguuuuaaaaacuccaggacccuuccauccccagagggauuuagaaggccaaaggaagcggugccaacaugccccuuucucucccucgccaggggcuagcuucguccccuugaagaggcugagcugggcucacaucuguuccuuccccucuugccccucauuaccuguaaaaauccggugaggucaucaguggagaacacguccaucaccuccauagcccccgcgcuggacuugcugacuacuggagugagcgggcagcugcaagguuuccccguuccccgcauuaggcugggccaucucaagcccggcucccuacccucccagggcucccaagggcuagggggaugagaguucugggacagguaagucuggcuaagggaucacccaagggccaaggugcuuaggaacucggcugcgucuccaaguuggggcacauagagaaugagggacguccgugccuguuucuccggcuggugaugaccuuauccacuccgaggaagugugcggaacgcagcacagccccaaaauuccggggauccuggaucccaucgaggacgagccacaacugcugggggucgucgccugggcucgccuccccggccucucuccaaggccggggccgcagcgggcucaccuccaugcagacacccugguggaccugguagcggcacauuguguccaguuucugccgucugggccgcagaacuggaaugucccgcgccucggccauccggagcagcucggcccgcuuccccugcagcccagcuuuacccgccuggagcaggagccgggccacagagcggcgggcggccugcagagccaggagacacggggucaugccaaacagaagcuccagccgagaggucggcaccaggucauccagcagcaagcggcuuagcuccuccccaccaggccgcuccccaugccgcgcugcaugggagaaaugacgggugacgaggcgaccccaggucgcgccccggacggucgagagcaaugccauggcgcagcucccgccagggacucgaugccccuugcugcguccccgggagcgguaacccgcgccgcaguucgcucccaggcucccaacaccgaggugaaggguacucgacagccgucuccgccgagcucucucggacaggaacaaacagccccgauuacccacaacuggacuaccgagcuacgaccacccgcucccaggcucccacgugggucccucgcuuccggguucgggagcccgccccuccccggccccuuccugacgguguuuugcgcaugcguggcugccaggcugucccccacagcgccucccucaaggcuagaggagcggcgagcugagcuggccguacuaccggcugcguccuguguuccucgaggucccaggaggccggggaccgcauucacccacgcaccagugaagggcccuuuaaggagauggguuggccuuccuggucaaccaauucagucuuguugccucccuccccacaucccggcgcuggugauuuuucccagaacuucucacuagcccaucaccagccagcaggaccccaacagucacuuccuaucccgggccgcugauucucuuccuaagugacucugagccugucguguuccugcugacaagcucacuaacgcccccgucccacagguaauggcgagacucuugcgcagcacucagccccccagcgauccaggaaggcaggaaggagcugccucuucagccccaucuggcuccuugcuccugugcuuaaguucugagcuguucgcacagcacugcaugcucuuccagaccucucagccuugcacaccugucuucgcuuugucaaacuccuacauguuuucaaggcccaaacaaacccauuccugcuaccuaagguaauccauacucccaugagugaggcccccaauccacccaccugggaccuaccuggaagaaauucugagacacaagcaccccugaucacagagaaggggaaagaauggaaagacacuccugaagccaaggcagauugguugcgauuuuucuuuuuuaaugaucaccaugaaauccacugggccaggcccugguguucugcugccauagucagagucagaguggagggaugaccccaggaggggacaagaagccaagacugggcuggggagccgagaaggagauagauaagggggagagggugcaguggggcaggcagaggaggaagucuggagcccuggauaacaacacagauauaaggugaaggccucccucugccaccccagcccugagccacagacguugaggugcaagaagauggggauuuuggccacaacuccuuucccaugucaaagggaagacacugagagcagacaaaggccaagugcccaggggcacaagaacaaguuaacaaguaaaacaauuagggacaccaccuccuuuccccagcccauuuuucacauuuacaacugaagcaauuugacaagaugauauaaaaaucucaaacaaauuuucuagccccuggucgggguguggacaggaagugguaucccgugauccagaaaucaacaccuaaaauccagaggcaggaggcaagccaugaaggguggggagggaaggaggagcucccacagucacuaggucaccugcuccgugggccucaucuggaugucuccaaucuguggaagguacaaggcaugaggcagcugugacacucuccccuggcccugcagggcucccugcuccccuccucuggggcugguuggguuccuccagugaguagacagucagggccagacucaccuggaugugugcgggggugcugaggacguagauaacagccucggccacauccucggguuugagacacugagagcaccaggggaauggguugagacaaggacagaauggacucaaauucccucccaccacugagcuucucuguggcauccacacauccaccccaacccuccaggaggagccacaaaggcuggaagaguggagucugaaggccgagcuucccucugccuucauuuagggagucaguggcuucaccaggcucagagggaggccccaccuucauuugcucauagguggcagcugccuucucaggguccuugucguggaguuugaaggcgaauugugucuccaccacaccuggagagaugcacugggccaacagagagggccuucucaggggcugagcuuugccaggucuuggggaggucgaggggagaggauggaggccacagaaccccagcuucacagugauggcugccugauauccggcagcggccuccucccuccgaagcugccacuggcagugaccacaaugauaccuaccaucuacagagccuuuccuauaugucagguaaacguuuuacaaaaaagugucccugaaaagcucaucaucuccuuuucacaagugagaaggccgaggcuuagggagguucagugacucgcucacgaucaugcggccuucaagagaagagcccagagucccgguuuccagccacugugcaccugguuucccacagucccuugcuuucccucaggucagcccccucccagcucaaagucuaagucuggucguuggcuccuggaucagugaaaugaggaaaugaagggcugcauagggccaugccuggagcagcagcacccaguucugugcccaguccacucccaggagcucugagcggcacauucugaacaugggcuuccugaacgguguguguggguggggagggccugcgccacccugugcccaccagggcuaggccacagccucaccguggcucggaugugggucugggccucccgaagcucuugccucagucccucugucagcgcagugacggcauacuugguggcacuauagaagugggucacagacagggguaacacucgguggccagacaugcuggguggggagaggaaggggaaagaggagagaaugaaguuccagggagaccaguggugcuccugccguacccggucagccccaccacccagaugcccaucgggaagacuucuaaaggggaccucuacuggccauccuacagcucacuaaucuaauuuugguuauucaaacagcuuuggaaaacccuccuuuuccuggaacucaucccuaagcugacgacagaaugcacucuccugguggugcagaaugucagaauucucuccaucuaaucuguauguucacugauacgguucuauugggacaucucaaggcagguagaggccauguccccccucagacuggggcuccccaguggcagacacuguacauaguacucuuugugccaugaggugggguucauccccaggccugaggaaucgaggcacuuagucccaggagaggccccaggcuucagcuguagagggaaggggcuaagcugcccauuccagccaaccaggggcugguacuugacaacauuauucuuucccucaccauaauugugccauucagguauuaaaucuguauuuucccaccaaggaaacugagguccaaagaggucaggugagcugcagcacauuacccagccuggugggugagugguacccauuggccaccugcccucaccuauugauguuaaugaugugcccaucguccacauuccgcuccuucauggacugguaggcuucccgugugcagaugcugagggccagcacguucaccugcaggccagggagggcaaugaggugucuccacuccggcccaacugagcaagugauggagccacagaaugcuaggggggaagggggcaguguggcauuccaaaacaguguccagguccccccggagaccagccacaggcacagagcaucuugucuucuacacgagaugccccucucccuaaagccgcaacccccaguugauaacagagguagcuccucaccuggcugaccccccaaguuccugcaaacaagaauggaaacccuucaaacccacuccugacccaggagacucugucuuggccaucuccucuaugaacaguagcacagacccucuaauuccauagggaaucauuuccauuucuucccccaaauacccuacucuucucuucucugugacagucucuggcccugcucccuccuaaacugcucaaaauccuuaccaaaauggcuuacaaaucucucuccuccggcacacagccuagccucucccuaccuuccucagcuacucucugcuccuuccccauccccucccuugagaugaguggagaagagaaggccugacccuccuuucuaugccuuccuuuaacguggguuccaucuacaagacuaggcacggagacucuagagggucagguaacuugccacuccuacucccucuggcagaggugacccccacauccccacccuucagggaacagaggucugaaggcgugucugcuguaaagcgccuacacugccccacccguuggccccacucauuagccucacccggaggacaagcagagauaaagcuuucagcagguccucaggccucuccucuuaagaagagagggaaccagcaggagauuagauguuucucuuaaucagguggcagagccugccaugaggaacagaacaccuuuggugugaaccugucuugguguucauggcaguaggaagagaugggugccaggacagggagguuuccagccguguuucucaucuucuuggcaaugugggcuugugaggcagagaacucagccccuggcagguagagugggagaaauagauccccugggaccaggugaguaaaucucccaggucuaggguaucaggggcagggaaagagaagaugccucauaggaugauccuaauagacucagauaauguucaagcugaaaggagcuguaggaauuuaauguaagucccucauuuuacagaugggcgaguugagguccagguuuagagacccaugugcugugggugaggaccauggcucugaucuccaagaaggcugagggcuucauuuucauggcuucauuuccaggcccaagcaucugugaggugcuaagucuacugucagcagaugggaaaggauuguggggagaaaagaacaccccauucacacacugcuuucaacuucucaggauacuuuuauacccuacuaucaccccaucauaccauccagaaguugaaaacccauguccugaaaguuggguuuggccugugcacaguuucaaaacauuuuaaaaacccuuccaacauguacuggaaaguuucauuuauucaauaacuaucuuuucagugcuuaugggaucaagccauaccagagaauaaaacagauaaaauacuugcccucauggagcugucauuuuagugaaugggagugggggggugucacauaaaaucagacuccccacuucucucaaagaaaucauaagaucagcugggcgugguggcucacaccuguaaucccagcacucugggagaccaaggcaggcggaucacgagguuaggcgauacagaccauccuggccaacaugaugaaaccccaucucuacuaaauacaaaaaaaauuagcugggcaugguggugcccgccuguagucccagcuacucaggaggcugaggcaggagaauagcuugaacccagaaggcggagguugcagugagccaagaucacgccacugcacuccagccugguaacuacagagcaagacuucgccucaaaaaaaaaaaaaauuucaucaaaucaggccacacugggcccacaccaccauagagcaacuaugcaggauuugagcaguggcugugugcuuccucacacaccacagaccccuccuaaccucccucacuccuuuauguaccuaccuggccccaggggacauuggagcugugaccccagauauugaugauagagguguguucaucccaauuaauugugacaagacugaagcucaaggaagguaaccaaccugccuaaagucacauaguuacuagugaggcuagguaagaauaucaucacuugucucucucuuccuuuucuucccauaacaucacguucccaagcacccaggcacaggacugacaagugggaaacauucaacaggcagcaguucucuccccuaacaaucuuucuucuaacacaaggaaaucacucuagacuuuaagaacuaccuucaggucgggcgugguggcucaugccuguaaucccagcacguugggaggccaacaugggcagaucaccugagaucaggaguuugagaccagccuggccaacaaggugaaacccugucucuacuaaaaauacaaaaaaauuagaugggcauugaugaugggugccuguaauuccagcuacucaggaggcucaagcaggagaaucguuugaaccugggaagcggaaguugcagugagcagagaucaugccacugcacuccagccugggugacaaagcaagacucuaucucaaaaaaaaaaaaaaaaaaaaaaaaaagaacuaccuccaggggcucaaagaagagaagagcugauauggccauucauccacucucuaucccucugguagggcaagaagccaagagagagucaagaugccccaggugggaacccgaagcucccucuuccuagaugucccguccccagcagcacucugguucacaaaccccuggcuccccucucuccuccccacccuccaccuggaagauggaggcuuggagcucuuacauugaacauguccuuccaaccacuggugcugccugagagcagggugucaggccgggccaagccagcauuguugaugcagaugucuacaccgcugugcugagaacggauagcugagaacauggagaggauguccucuucauuugauaggucacaucuguaggggaucaaagucccgggguagccugcacucuuacauucagcagccagcuccuaugaaacccaacaggggucugacuggggugagcagcucacucccacggcucccuagccagccucagaccccgacccccgucacacucauaaaacaugcuccuuuggcagcugacuuucagccacgaagauguuggacugcccauccccuaagucuguccucuuuggucaaagucuaagggaugacagugcuccccgagugaugaagggaaaaggcuguuaucaauggagaaaccucacuauaaacucaaguccuggcugggcgugguggcucaugccuguaaucccaacacuuuggaaggccaaggcggguggaccaguugaggucaggaguuugagaccagccuuggcuaacuugguggaacccuaucucuacugaaaauacaaaaauuagcugggugugguggcuacuugggaggcugaggcacaagaaucacuugaacccaggaggcggagguugcaggagcugagaucacgccacugcacuccagccugggugacagagcaagacugugucucaaauaaauaaauaaauaaauaaauaaacucaaguccuggguggaacaggggccagggaccuagagaauggagugcucucucuuuucugccucuuccucaacaggaacaccucuucugcccauagguaauaugcgccucuccaccacuucaugcuucuacaccagucccgagagucacugggcugguuaacccagcuucuucugcauugugucagccagucccucaucucugaacuauuccccuccccucgcaaacugcagccaacuggcucagaguucucagacaugccuuucaaccaagcccagcugccaaucuucucucccuaccuaaaggaggggucagaaagucaggacagauucuuucucucugagcccuggugcaccacccuccccucugagguuucucaggagacuaugaggcaauucagguggcaggugccauugaacacccccugugcaucuccaggcccucagcaugccaagaaagaccugagaaggcagagccacugagaggcagcccagggggaagcugacauucagaggcaagaagaaaauacguucuguggccuucuuuggaagccagugacugggcacuugagccuugugauggugacuguguagacgugggcgagggggaaggggcgugcggugcccuagaggaaggccagcuuggccagcugcccuggccuggagccccuuccuccucccaagcugagccaggaauaaaggacaggaucgggugucuugggacauucuuuucugcuuugacuuucugugaguucaaaagguauaguccucugagaaucagaaaccccccuucaccagauuuuacccacauuugaucacuucaggaaacaggaguuuucucuguaggaagcuagaacccaaauucugcuuuaacaucaaugacugaaucaaucaaagcagacugugggcaaggaagacugcagcuuuccccuccccugguguacaucuucccgcuuccuccucuagacucaaaauuccugccacaagaaaaccagaagggaugagcucagaauguauuucucccugucacugccuuccuguugccccaccugugccaccugaucucccuaccuccccucaguaaugaucuacaacaucaugucacccccucacaacaggggcauucuccucucagacauggagucacccugggacugagugaucagccuggggauccccuuggggcucaggcccccccuuccuggcuagcuugcgguaggggaguaggugagaaggcaagaguggcuucagaauuacagaauccaguuguuuaaucccuggccugauccucugggcuccaaggcuggggcuggguccugagcuccucagaauaggauaaagggaggaaagaguggggcagugauggagccaggugaccuugggauuaucuggguuauaaagcauaccuuuggucagcagcaggggaggggacaguccuccuuccuguauaccuucucccucugcccccacccaaggccuccuuacccuuucccugccugaggacuuugagcacgguggagauaaagcccugcagcuaagcacuagcccgacacugagaaugagcuuacagggcacauccagagagagccuagcacagaaauuccucccugcuccaaaauggccaucuugauuuuucucugagcucugagggcucccaaccccacgucaagagcagaguaaggaguuccagguugcuuuauccucucaagguuuccgcccgauuucacccacucuguucgccccaggagaguggaggagggcccacuaaugaauauuccauucauuccucaugccacugggcaugaguuacccccgaggugagggggcggggcugaggcucuucaguaaagcucccaccccaaccccaaccucaguccuggcuccugcccaucugguuggccagccaccuugcccugcguggugggugacuucuggagauuagaggcacuuggccgccgggggcgagaaggccacaggggcgagaccaccacccccgaccuccggcuuccccuuccucgggccaauacccuggggagacccgaggggcggguggggagaugccggggucggagauucgguaacucgagcaggggcugucagggcaaacggcuccuucaaagaugagacuuaaggggaagggagaagccugccuuaagggauccgagaggccgccccgacuagagcaaagggccccggcguggcgggcaggugaacccgacuccggggaaacgacccgcccgcgacguccccgcccucggcccggccucaccucgauguugcccacagugcgggcgcagcccaccaccuucagucccugcuggaccagggcccgggccacggccgcgccgaugccccccgaggcccccgucaccagcgccagccggucgcgccaccgcuccaugccgggccuggccaugggcccacgccgcccguccgccucgcuggacuagcccgacacgggggucgaggagcugacgcccggccgcucuccugccgccgccgccgaccu

SEQ ID NO: 16743 - RNA, 1911 nt, Homo sapiens
auaaagauuuuuucuauuuuuauuucuugugccaacuguauguacauuccccccauucccguuuccauacuguuuuuaggccauuugaaaaucucaaagguuuuacaggaaaguacagauugaugaagaaauggccaaaaacgggaaaagugaacuuuaaagugauucaacuacaaaacguaugcuacugagcaaauacuaguguauuccucgcucugcggcuuaacuccaugaaaauccgugcaaagguuuuagcguugggauugugaccgacucggugaagagaggggacgaucaccaaaccguuagagcacuggggcucuuggcaguguuugucaguuauuuucaagugauaacuugaagugauaccgcaggaauaaaaugcuguauccagagcuggucggaacgagcacuaccuuuaacaaaagcugaaaagaucugccuaggaauucguuagaauacagcccucuuacgucucugacauaccuaguuaugugaaccgagacugugcagcugacgguggaaauuuccuaagugcuuuuuaaacaacagaacuggacucccucccuccuccauucccagucgaauacgucccacccagauccagcucaagggugcagcacuuguuccggccagcucacaaucgcccuuuggaagggagguuucccgccauuucgcuuaggaggagggugaacucuucucccuucauucuccacucgcugggggcccgagcccacaccaccuuccuagcaaagcaagcagcgggacgccaaggccagcaggccgcauuaagaacgcuggacugagccaaaagccuacacagaccaagccgcucgggaaaggaucaacaacugccgacaacccggagggcgaaaacgcccgcggcguaggggaagcaaacuaggagaugcgcgggcccagcgccagcggcgggaggaggcagcgcggccgucgcaggcgggagcgaaggcggggacggagggcgggcucgcuccacucgacuccggauuggucgagcuuagagagccgagugacgucagcgggggagaacgccugauuuguguggugggcgcgggcgguggggggaagcgcagugcgcaggcgcaacugccuggcucugcucgcuccggcgcuccggcccagcucucgcggacaaguccagacaucgcgcgcccccccuucuccggguccgcccccucccccuucucggcgucgucgaagauaaacaauaguuggccggcgagcgccuagugugucucccgccgccggauucggcgggcugcgugggaccggcgggaucccggccagccggccauggcggggcuguacucgcugggagugagcgucuucuccgaccagggcgggaggaaguacauggaggacguuacucaaaucguuguggagcccgaaccgacggcugaagaaaagcccucgccgcggcggucgcugucucagccguugccuccgcggccgucgccggccgcccuucccggcggcgaagucucggggaaaggcccagcgguggcagcccgagaggcucgcgacccucucccggacgccggggccucgccggcaccuagccgcugcugccgccgccguuccuccguggccuuuuucgccgugugcgacgggcacggcgggcgggaggcggcacaguuugcccgggagcacuugugggguuucaucaagaagcagaaggguuucaccucguccgagccggcuaagguuugcgcugccauccgcaaaggcuuucucgcuugucaccuugccauguggaagaaacuggguaaguucccuggcuuguuuggcgcccgccccuuuuucaggcaguucagggcuuuuauggcaccagccccgcgugggcccccggcacccagagcgcaaccaaaguauacacugauggaagugacu

SEQ ID NO: 16744 - RNA, 17125 nt, Homo sapiens
aggguaaucaccauuauccugauuuucaggacuuucauucacuuccuucauguagcacaguucccugccagaaauauccaucauggacgaagugacugcuagagacuucagggaaaauaauaacuuauaacuauuuuauguaguugagggaugaguguuuugguucuuuccuaaagaguuggaaucugcucugucaaccaggcuggagugcgcugguaugaccauaggucucugcagccucaaacuccuaggcucaagcagcccucccaccugggccucccaaguagcugggaauaucagugugcacuaccacaaccugcuaauuuuuuaaguuuuuuuuuucaagagacagagucuugcuauguugccccagcugguccugaacuccuggccucaagugauucucccugucucagccucccaaagggaugaguuuuaauaugcuaauuacuucaaguuuuaaaagaauaauaugucaaauuaaagcauuuuuaaaccucuuuuuuuaacucaaguaauacauauuuauuauuuaaaaagcuuaagaaaaaacagaagaaaaaagaaaacuaaaaucacuuguaauuuccuuaccuacaguuaacaacuauuaacauuaugguauuuauuaagauucuucuaugcauuuguauacacacauauauacgcuauuguuuguaaaaugaaaucacacugagcuuauuuaccauuagguaaugagucuuaccuguccaguaaugaauguguuuuccuuugcuuuuuuacuuagcacuauauugugaauaucaugaacaaagacaguuuggaaacagggugacuagaagucaacaaaaauauguguuacaaaagaauaacaauagguaaaauucagaguauuauuuuaauuuacuguuaaaauuacccaaaucucacauacuuuauucagucuauauuuuuaaaaauuggauauauaggcccggcgcgguggcucaugccuguaaucccagcacuuugggaggccaaagcgggcggaucacgaggucaggagaucgagaccauccuggcuaacacggugaaacuucaucucuacuaaaaauacaaaaaauuagcagggcgugguggugggcaccuguagucccaguuacuugggagaaugaggcaggagaauggcaugaacccaggaggcagagcuugcagugagccgagaucgcgccacuguaccccagccugagcaacagagugagacuccgucucaaaaaaaauaaauaaauaaaaaaggauauauagggaaggagcaauuuuuuaaagauuuaacugcaauugcauaguauuuugugauuucauuauucaucuuucuaaaugugguguaauagacuauaauuuuaguaaguguaucaguccauucucacgcugcuguaaggacauagccgagacuggguaauuuauaaaggaaagagguuuaauggacucacuguucugcauggcuggggaggccucaggaaacuuaaaaucguggcggaaggggaagcaaacacguccuucuucacgugguugcagagagaagaaugagugcccagugaagggggaagccccuuagaaaaccaucagaucucgugagaaccaacucacuaaaacaagaacaggauggggaaacugcccccaugauucaauuaucuccaccuggucccucccaggacacauggggauuaugggaacuacaagucaagaugagauuuggguggagacacagccaaacgauaucaguaaguauuuauuuuuauuuauuuuuuagagacagggucuuguuauguugccaaggcuggauucaacuccugggcucaagugauccucucaccucagccccccgagaagcugguacuacaggcauguacuaccacacucggcuuaauuuuaggaaguauuuaagcaaauauuauugagcuguauaaaacuguucauuuuaaaaagugaaaaguuguuuccaaacaaugugucaauuaguuuuucucuuugguagaaaaauuguauauguucaaaucaaaguuguagaaguaccucccugccuaacauucaagugguuucagaugguaggcuuuaacauaacaagaugagcuauugggcucucagaaaaagcaguuccuaagggagcaccuacauuuaguacuucuuuuucauguuaaugaaguucugucucauugaaagaaaaaaaaagagauuguuguugaguggagguaccuacugccuagugcaaggucaggaaggcuguggagcugaugggcagcucuucagaauccagggguccauuauuggugcacucagcgugaggcugaagcuggaaggucaccuccccuaacgugaauaaaacugaagcugugagagcucaggugauccacccaggguuccacagugauugggagggcugagacuuuagaauucugccuucuaacacccagauuuggccuaccucacacacugacaggaauucucuucuauccugggagagucuuacaacuaucacgaccucauaacugaucuaagauggcuuucuggagauggucaagucaggaauagcuuuuaaauagguugcuauggccggguacaguggcucacgcuuguaaucccagcacuuugggaggcugaggcaggcagauggcuugaguccaggaguucaagaccagccugggcaacaugacgaaaccccaucucuacaaaaaauacaaaaauuagccagucaugguggcaugugccuguagucccagcuauugaggaggcugaggcgagaggaccacagaagcagagguugcuaagacucgagauggugccacugcacaccagccuggguaacagagcaagacugucucagaaaaaaaaaaaaaaaaaaaaaaaaaagauuuauguuguuucccccaguccccuaggucucuccuuuuacuuccgcaaccaaccagaagucaauguaggagccuugguguuagguguaggcuagggguggcaccugacacggcaucacuggagccuguguacuggaauuagaccaguugcuacaaguuagcucuguugguugucaagagaauuuccuuuucuuuauuaaaaugcaagucaugcuuuuguuuuaauacaauaucaaccauucagccuugacaugauuuaaaaugaauauggguaguuuugccuuugagugagaguguguguguguguguguguguguguguguguguguguaugugugugauaaccuaauugacaaagcaaucaugauguuuuccaugagccugauguuaucccaucauucggagacccauuuuguuuaauuuguuuuuucauauaguuucuggugggaaaaaugcauugcuuuaguaccgaaauuaacuugauugaaaugucuuagacuuuaucauuuuccaguggcucaaaggguuauuucccaaguguuuaauuuuuuaaguacaguguauauuaauuucacugcuacuuucugacauucaucauuccaugagaaauuaucacagaugaauacaucagacuuuuauuuacacuccaauuccuacucaauguaaaguuauuuaacuuugacgauagcaugcaaauuugauaaagaugagguuuuuaaaaaccugaaccauuuauugauuugcuaaguauaauuuucacauuuuucuuauaguauucuauaauacaucuuucagaaggaaaacacuugaaaacuaguauaaucuucaggaaccguucaaucagaaauaaugaguggagaggucacuuaucaaaaauauauuguuuaaaauacuuauauuuaaguauuucuagucuuugagguaaaaaguucugccacaaaaaguauggauucauugggcuucugaauucuguacaugucacgauuuuugcucuugggcuaaagauagaaaguaaaauaaaauguucuuuguccauuuaguuauccuugacuccaugaaauucuccaaaguaauuacuggugaccacaauaccaccuaccagcaagagcagcauugaccaugugccaagucccuuauugccgaccacagcugcucuugacuacagcagauguuucuucuuuugacuuggcaguaaaauuuuauuaagcaguuuugcaaguagagagcagcauacucuaccugaugaguggcuggagaucuuagcccuuuugugcaaucagcuuaguuuucuccuaucuaccaucaggcccccgccucuagguuccuuggaucucaccaaccaggccucaggccuuguaaacugcaguccucuuggguuugcuucccuacccacccauguaauuuucccaaagaaaauaauguuagaagagcagccgcacuugugguuacaacuugcggcauugaaaggcugucacauuggaacuuuguuccuaccaguuguggguuuacaaaaaggaguugggguacuuuguugggauguuuuguuaggaugcuuuucugaauuuuuccacaucucuuugguuuggauguugacuuggaaaucucuuuugaauuagcuucuuuuggagagcuuucugcuuuucugagcacuucuuggauccuuuccccaacaaagccaccaagggaacuucuucugauccuaucucuuuuguaggugguacccuauuugaguccuucugaagacuggagcacauaaaggccugauuuuuucuucugaguuggauuggaugguuuaacauaauuugucucuauguuuucugucuuggguaaaggaauauauuugugaauuguggcugauacuacuuuaaaaaauuccaaaaagaaaaucuaaaggaccauuccuaugauuauugcaacccauuucucaggucuuucaaagaaaacaacucguaaagauacuggcaguugaaggucuaagucccagccuggcaugaauucccagagagccuugggccuugggaggagggguaauauacaagauuagagugcaaaguccaucuggugagaauuugucugguuugugcuuccucagcagggaggaaguagcagugaccucaguccugaaugguuauuucagaaguguaucauggugggaauuuagccagcuuuguggcagaugaccaacccugauagccugauuuuuaaggccccuaacacaaaugauaccaggacuucuuugaauauucuauuuagucuguacuaggacacauaggacaagaugagcgacuauuuuagaccuguaggucaagagguuugaagcaguauauucaccuuuuacacuucaaaccacuuggaguaucuuaaagaaguaguauacugucaaauacuuauaaaacuuccuucuucuuugcucuuaaagauaagacguuguuuagaugaauauauauucuuuuccuguguauucuacuauuccugcaaaaauuuguuuuuaaaauaagaaacuuggcugggcuugguggcucacgccuguaaucccagaacuuugggaggccgaggcagguagauccccugaggugaggaguuugagaccagccuggccaacauggugaaaccccaucucuacuaaaaauacaaaaaauuagccgggaaugguggcgggugccuguaaucccagcuacucgggaggcugaggcaggagaaucacuugaacccaggaggcagaggcugcagugagccgagaucacaccacugcacuccagccugggcaacaagagugaaacuccaucucaaaaauaaauaaauaaaauaaaauagaaacuugaaaauaauaccagcacugcuagaguggguauuuggcucaguucaggccugugccuuuuuuugauguucccagagcagagcacuccuuaaacuaggaugagaaaaguuaauuuuaauccuccaaaggcuuauuugcuagcacaaaaggucaugaaacacacccaaaacuauauugcuaaaaucugaaggagagagaucucaacagcagagauggacucuagugucccaacauagaauugugucucuggcugaagaaauaguuuguuuuaggaacgccaauacaaaagcuacagaauggaagaguuuucccuuaacugaucuaagggaaaauucuuuuucucguguuguuuuaggaagcucagaauuauuuagaaauacuugugaaaucauggucacaggaguuauuuccaaggauguuuaaguagcugcucucugcccauuauuuugauaauuacuacaccuuaaucuguuaucugucaaaagggaaaaaacuuucuguuaucuaccugauagacccauggaauacaaaaaaaaugugaugacccaaucacauuuaaagcuuuuaaagcucccuuuugagaugauuucuuaggguacuaaaauaucaccugccccagaguuuacaaaucagaaauugaaugaggcaggcuuaaagaggaucagaaaacaagauaccaaauaagagcagccauuguaaaacuagagaagguuacgaaauggcccugcuuuucuauaaggaaggucgaagacaccaggccccuugcccuggguuugucugguggaaguuuaaggaaaguucauacccugggcccaguagagagcuuugccuucauaauugucugcauaugauuugacaaacauaagaccucaguguuccuagaucguuuaucccccucagcaaugugcuaaauaugaaguaaaagguuaccaaagggaggauagggaagaaaaccuaauuaccaauccugguaauuuuaaacaugagaagauuuauaaacaacggcuucuucauacacuugugaguucugacauguugugaaaauaggaccugcuaagccauugaaaggauuuucaauauauuguacgagauggaaagaggacccagagaaggcuuguuuuucauuuuaaagaguugcuuuagaaaccaagguuguaacugagcacugcucugugcuguaucaagccguaauauccagugagucaugaaggcauuagggaagcacuggagacaucauaagaaacauuugaguuaauguuugagauaaggaagaugauuaucucuaaaaagaaacugaaauuaaggggcacagucucccguuuucggacagcuaaaaggcauucuuuucagugaucucuccuuuacuaacccauguacaugcugugaguaugugaccuagaaaccaggcuuuuuuaagcugagcucuggauacuuguagacugagaccuugggcgaguuacugcccaccuuggcuucagcuuccucaccugaaaacgagugaucaaccagguaaucuuuauggggcccuucuggcccaaggacucuaucagucugguuuuugaacauuauccuacauuagacaaucucagaaagguuuuaugacuugugggugccuuugugguacuucacaugagcgggaggucuuaagacuauggaccccuugggagaccagugucuaauucuacuacuuccuccuccccaagaauucagauggugaaacacccucaucccuccagcccugcccccaggaaacccuucauucagaaaggucauuucauuuccugugagccagucuuacaucacuggugcaagaauugggcagugcuugcccagcuggaaggugagacauuggaggccucagccuggugucccagacaguauuugucaggcugaugauaagcugguggagagucuguuaacucaaggccugauucuaaugaauuugggauuccuugcugaaaaaaagacugggcugggugugguggcucaugccuguaaucccagcacucugggaggcugaggcgggcggaucaccugaggucagaguuugagaccauccuggccaauauggcgaaaccccgucucuacuaaaaauacaaaaaauuagccgggccugguggcgggcgccuauaaucccaacuacuagggaggcugaggcaggagaaucacuugaacgcgggaugcagagguugcagugagccgagauugcgccauuccacuccagccugggcaacaagagcgaaacuccaccucaaaaaaaaaaaaaagaaaagaaagacuggauccugguccauccaagaugcugcccuugagaccucuggguugaugacugauauguuggucucuugggacaaggcuguacaguugagaaaaguagcaagaacaucagaucucugcagauaaucuggcccccauaaaaaagcaauagcaacugggaaaaggcuagacugcuagguucccagcuauacuggauuauuagacaaagcuacccacuccaucuuuguuuauagaacucauuuucaggaacaaguguuuuauagugagguggagguuguaaagaagcucuuuauaaugaagaucccaaauaugugagccuucuaucaagcuugaucucaaggaacuuuacacggguggcaguuuagaagaaaaagagagaaaaggauaaagaaaaaaacuaauaaaaauagcugagaucacucaacaguuaucaagaaacagauacuacaguuuuauaacacgaaguacuaaaaguauaugcacucuuaaaaggcaauuaaaacguaugcuccaaaacuauaaaacauuuucuuuucaucugcaacauagagggcagauuacaacacauuaauaacguuuuguuuagaguucaguuucugaugguuuccaaauguagucuguguagauuaaccagaaggaguccaguucucuuuuuuaagagcgcuuguaaaggaaagcaaugugguaagauuguuaugaaaagagaguguauuuaggaaauagcacuuagcagggucucucugaauggcugccaggucaggaagcugaagugcaaggcuuggcccuuguucagcccccccaguuccagcuucuugaccacacaguacgucaagaacaugucacaagccagccaggaagacucagccccgcccaugggccagcuuggcacggcugcuuucacauaacccagggcuccagaggggccggaggcaggcauuccagggccacgggaacaugcaaguuuuuaaaauagaagugaaggacuuaaaaaaaaaaaaagccugggaauuaaacaguugcugaguccuugaguccuuauggaacaugguuccucauguagaguggcagaggugaaaagggccuuaaagguuaucucauccucugcccucugcuuauagacaaggacauugaccugcuuacaaccauagugauagaaccaauuguggaauccauaucugucagcucuuagucugcuaaacacacuggcuucuaccucacugggcuaagcugcccuuucuuccuuggauuuugacucuagaaagcuguccaguaaucuguuccuauacauuuuuuuuuuuuuuuugagauggagucuuacucuguugcccaggcuggagugcaguggugugaucucagcucacugcaaccuccaccuccuggguuccagcuauucuccugccucagccuccuaaguagcugggaucacaggcaugugcuaccaugccuaauuuuguauuuuguaguagggaugggguuccaccauguugaccaggcuggucucgaacuccugaccucaggugauccacuugccucggccucccaaaggccugggauuacaggcaugagccacugagcccggcccguugcuauaccauuuguuccuacuacuugccuaacuguucuaugucucagucucaguuuccuugucuacaaaauggagauaauaucaaugccugggcugggcccgguggcucacgccuguaaucccaacacuuugggaggccgaggcaggcggaucaccugaggucaggaguuggagagaauauauauauauauaaucaaugucugcuucacagaguuacaaggauugauagaauaaacauguguaacauuuacagugccugguauggaauaagggcucaauaauguuaucuauucccauuaauaauaguauuauuagcauuauacuaucaucugucuuauugcuacuacuauuucuacaguugcuacaucagcagucccaggaacuuggccuacggccuaggcauggcguaugagcucuaugguaguagaaggucagacccaggauuggaggaggggcagcugaguagaggggaagaugaaucucggaugccucugggccagugcuucauaaaguccugugcucagauuccagcuguggaacagaggugcagagguggauuuuaauguuauuguuguuuuugcuuuguuuugccuuuccauuuuuguuguauaguuuuaguugaaagagacuuuagagaugauuaaguauacauuacaguucggccuccacgguuuacaugggggaaaacugaagcgcagaaagaaaaagugacuugccuuaugucuugcuagccuuacuugguaauugaguagagcucucuugucuaauuuacauauaaaaggaaaacuggagaagaaagagccuuaggauaauacucauaagaucuaaaauuccuuuagccuuucuucuacaucaggcccacugggacccuacuuaaaacccucauuuugaccugguuccucagucagcauggagacaagcccgaggaaaaaacucaagagagccggccuccuuccuuagguauuauuagagagcaauccccuauaaaaguuaaguggauguuuguuuuuuauuuaaaaccuucaggagauuuaacccugcugggcugcuccugccucacccacagcagugucccuucaggccucacagaacacuucugccguaaagagggcuugcuuucagaaugcuuaaacaacucugacaugcacauuucuuugcuuaauacaaggcucacugauuuagaagguaaaauuacuuucuuaguugaugccucaauuguuuuuuccuuugaguucuuaucucuccuuugcccuagugucaagucaguuuuccuguuuugcuaaaauguuugaucaacuuuaagauuagaaaauuuauggcggggcgcgguggcucacgccuguaauccuggcacuuugggaggccguggcgggcggaucacagggucaagagauggagaccagccuggccaacauggugaaaccccuucucuacuaaaaauacaaaaauuagcugggcgugguggugggcgccuguagucccagcuacucaggaggcugagguaagagaaucacuugaaccugggagguggagguugcagugagccgagauugcgccacugcacuccagccuggugacagagugagacuccgucucagaaaaaaaaaaaaggauuagaaaauuuauacugcuuuaaauacccagugaguauaguauaugauugcuggaaaagucguucauccugaccaagaacaauacaauaacaacaaaaccauuaccuggaaaaaccaacuagaaauucagugagaacauuuuagcuuuuuccuuuuaaauuuuuaaaauucugacauugccugguuacauugaaacagcccuguugugucauccuacuuucuuuuuccugguauuuuccucuuugggacuuugguuucauuaaucucaauuuguucugaaggcacuaaggcagauuuucaaagagcuguaauugucacagggagagcacaaugacuuauugaaguuucacauguugcucuuuuuggaacuaccagagauuggaaccaauucuccauccacaucucuauccgagaguuaaguuuucucuucucuggugcuugucaaaaguauuucucccagcuaaucucauucccaguugccaaagaaaagaucucaagcauaacuccucaucuccaggucacccgacaagguaagaagagagauuaaaugaaugugcccaaguuucuuucccuuacagccuccagaucuccagaauauaccuucuuuaguuuccacaucacacuuuccuacauuucuucuuaauuugaugaugucuugagaguaucucaggaaacugguaugacuaccaaggggacagaggcuuuuguagcgcaucaauaccccuaagucuauccauccuucuccagaaacacagugggcacaucuuugcacccuguggaaucaauguuagugcugaaaucagaguagacuuggcuuuguacuuuugucuggguaguuggcuuaagugccgugucuguauugagugacacuucuccaucagaauucuuauucuuuuggaagccuagacuauuucuucauuugaccacacugugcaggguuuuagugcuaaaggguuccggauguagcugcucuuguggagaaccuuaucacagcuuucuuuucccuaaguuauuugugguaaaguccuggcaguuuguuuagauguucagugagugacaccuaauugaagaaguggcuggggcuggacuucaagguggaugguuuucuuaccaaguacuaugaagagauuugcuccuagacuuuagagaugggaaaugcugcucucuuuuccccugaaaauugagucucgucaaacugacaaguuauuuucugaaacuccgagucauaauuguaccauauuuauuuucugauuuuuuuuaaccuuucaguuaauaaauguuuuccagccuccaucagccucuacugguaaucaggagaaaugggccaauggcuuuauguaacugagguuucuguuuuaacaugaaaguacuauauuuaccuucaaaaugacccucacuuagaucagacuaccugggguugucaagccuuccaucuucaagccaagagguaguuugguuuuuguuuguuuguuuguuuguuuguuuguuuuucauuuauuuuuauuuauuuuauuuuauuuuuauuuuuugaggcagaguuucacucucucgcccaggcuggagugcagcggugugaucaaggcucacugcaaccuccgccucugggguucaagugauucuccugucucagccuccugaguagcugggauuacaggcgugggccaccauaccuggcuaauuuuuguauuuuuaguagagacaggguuuugccauguuugccaggccggucucaaacuccuggccucaagugauccacccaccugggccucccaaagugcugggauuacaggcgugagccaccgcgccuggccguuugguuuuguuuaggugucuuuguccauggagugcuauguguccaggguuguugcccacuuccugccuuugaaaccagugaauugugucaccagagagccuuggauacagagauaaacuggagacagaguaacacaaaaauaaucauuucaaaagaaaccugaggcuuucaggguuguugguaugccauggcacaaggacccaaagugaucuucucaggccucaaccccagcccaugcagaugguauuugagccacuuacaagaaaaggugaaccuuaguacugcauauaaauaagucucugaguaauuccuuggaggugaaccuagguucucuuugagguauuuucucuaccaaaaucaagauuuuuggauuuaaaaaaaaauuuacauuaugcuuuuuauuuacacagcauuuccgcucacaugauuuccauuuagaucucaaucuuugcgaucgguguugucauguccauuuugcugauaaggcuuagggaaagaaacucuaaaaucacauugcuaauaaagggcagaacuggccaggcgugguggcucacgccuguaaccccagcacuuugggaggccgaggcaggcagaucacgaggucaggaguuugagaccagccuggccaauauggugaaaccccaucucuacuaauaauacaaaaauuagcugggugugguggccacacgccuguagucccagcuacgcaggaggcuaaggcagaagaaucgcgugaaccugggaggcggagguugcagugagccuugaucacaccacugcacuccaaccugggagacagagcgagacuccaucucaaaaaaaaaaaaaaaaaaaaaaaggcagaauucuggcauuccacccaugucuucagucguuucuucaagaauacuuuuaccaagccaccuuccuuugaauggaauacuuuagcggucccaagaaagucuuccuuuauaucaaaauagcaaauauuuuggucauguuaaaauacuuuucuucucaagaacuuugaugugcugcaucuucaaauaauagaaaucuuaauucauuauugucuuguuuaagguaacauuauguagagggaggaacacggaauuugggaucaaucaaauaauucaaaauaugauucuucucugugauaaaugugugacuuacacuuagcuuguuucuucaucuagacaaaugugaaugguaaaccagcucaaaggggucuugcaaguauuaaaugcagugacacaaacacagugcuuaauaguaguaggaauccauaaacagacauuucccuucccauuuucacucugguucaaacugaucuuuucuuucuuaccucccacuucuuucuuagaucaauucuuugcucaugggaaauguaauuguuaauccucucuugagcauagauuuucucuucccaccuuauuauuuuugugcacacuguuccuuccucugaagagcccugcucuucucaguguccuucauacacuccugguuaaccaccuacaggauuucuacucaccuuucaagguuuagagaaaauagcgcucuuccuugcaaccuuucugauuauuccagucaaaaauugucuucuuuucucugaauaucuuugucuuuaauagucauugcccucuuaugggacuuaccauguuucgccugauguugucuuuaaguauguaacuuuauuuucuuuccuaucagacuuuaaauucauuguggaaagggguuguuacuucgugccuuuagauauccaccauaauguguagcguaguuccuaggaggcugcaugguaugaucaaaagaacacagguuuuuagaggcagguuuaucuagguuugaguugugggucugccacuucuucacuagcuguugaccuuagaaaaguugcuucacccucugagccucuguaaaaugugaauaaucauaccuacuucaugguaucguuguguggauuaaaugaaauugcauguaaagugccuggcacaaaacaggcgcuuaauaaauguuagacuguuccccuugaucauaauacaacauugauuaaguaaguagacugauguucacuccuuauugcaugauuuucuaaaguggagaauuuuggauaauaaauuuuaguagacucauuugauauaacagggacugguauacacccucuguaguugauuugggaagccaggcaucacucuguggaagaaccacagaacacuagcuaaauauugacaacugacuaugccgucuuauuccagcauauggauuuguauucguaauuccccaagauaagauuuuaccgucccucuuaauuuuauuaauccauucuaaacugacagauguugcagugagcuuugagcucuuggggauucuuguuuuguuucugauuaaaagaugaguuuccuucuuaaacccaagggucuaaguaucagugcccuucucuccuaaacaucuugcuuaaaugccagaaguaaacuuguuauucucuauuggaugcuaaagaagcuuuucacugucuaagccccuucuaaacauguuuccuucuaggaggcagaagagugggaauuguuuagcauaguaccugguacuugguagcugcuuaguaaacaguaguuaguaucaucauuacuuguauuuacauuuuuauuuugaaagagcauggggaguguaagcagagcucacagaacuaaucuguguugaucugucuucuucuugagggcacacagaauuugagaacacugaaauucagccagauagugacccaggguuauggucaggguuccaguaugguuugugcuuuuguuccuucuuggaguccagcucugacuuuaauagcacaguaacugccaguuccuguccauagggguugagaacaucguuggaugauauguuuaaugcugcagaugcugagguugucuaagucguggucucuucuuagguuacuggcugguaugugaacugcuacuccagaaagcaaguuggucaacagaagaauuuuaaugaagccauuuaaguguuccagccacuggagcugguucucuuuguuguucuuuuuuuccccuuccaucaaccuacuuucaagaagaggcucauguucugguuccagggcaccagccuuagagugggcagucguucauuacuggccuaggacaaucauauuggagaucucccuggacaucagacacuugcuaucauuucuguucucuuguuggcugauccuccuagugcuuuuaggggcaccugaggucacuuuuugccauaaggcaugucacucuguggcaucuuacugaauaggauaugcuuuuuauuacuuuggacugaccuagugauaauaauacuaauagccacuauuuauugaauugcugugugagguaggcguuguacaggcugccuaacauaguuuuuuauuaauccucacaacaguccuuuaagguaggcauuaagguagguauucuuaugcccauguuacagauaaguacuggauaaguuaaauaacuugccgaagguuuaaacagcuacuaaaugccgaagucaagacuuaacuucaaagcccuguuuccacuuuauuuacagaaagcucaaaaugccccugaaacucugaaaucacugugguauuucacacuaacuuaccagaaauucccaggacauuaauucagggaucugaguuuaguguguagagcauuacccaauaugaaaacaguggaguuccacaguuuuaugagaaaacccagagaaacccauaguacguuagacaaauuggaauugaaacgcuuaaguaaaaaaauauucauuuuaaggucaucuguuuauacugacacaaggucuauagaaaaugagagaguuggcaucauguuucugaaauaugcaauuuuacaaugggaacguguuauaaaaugcccugccacuguuguuuuccuugggauuuagagugagagacaugaaggcugacaacucucuuccuguuguaggucagagcuucaaggaacucuguaaucuucccaccagcuuuauucucuccugaaacucacggguaaaauuagaugcuggcuggacgucaguaguugaguuugaaagcuuucagaggccaagucagacaacugcagcagacugcuuucucacaguaccaguuugagagacacuuuguaccgacuaacauaguuuaguaaaccgaug

SEQ ID NO: 16745 - RNA, 9849 nt, Homo sapiens
guucacuucgcuuucuagcguuuuauuguuuucuugcguuuuugucguuucguucucgcuccggagcgaaaagugaaaaccugagguggagcccgcgggccgggcgagccaaacccgggcggaggggccgaggggccgaggggucgaggggccggcggggugguggcuccuccagggcucugggccuucucccgcagccaagggcccccccagcccuguacaauauagaugcucacguaaaaugaaaaaaacuuuaaauguaugaguuaaucucuaaauauauguacacagcaauguacaccuuugaauaaauuaauaccaauuugcauauucugggaaccuuaaagcuuauuuacacaaauuaccauuuauuucauaaauaucuuuuuuuuuuuuccccuggggacucaaggcagaagugccacucccuccguugaccacggcugggaggggugccugucucuucagggaagagguggggagacuaacagguucccucccagcucaggucuacacugacuucagucguaacugguuccagcaucccucaacccaguuuuaucacgcggucuaggcccaagguccagggcucugggacucccuccgaugcucccaccccuggccccugcaccuucuggcuucugcagggaccgcugggcccuggaugaggccucucccaccucgcuggaagaccagagacaccuucggaugccaccuugacgcuggagcggaucuggaccuagcccagcagcucccaagugacuguguuuccagcagccugauccuuguugaggcccagggaagugucccaggccccgacuugccagacgaggcucuauuccggcugcugcagcccacuuuucuccuuuauuuaaauaaauacucauucugugcuguacacgucccaagcagcaggggcaggcagcccggguggccugcguggcaggggagcagcugggcagccccucacuugggcgacucccggccuggggagagggcucgcuggcucuccagcccacucaccagucucuggaugcucugcaguucauuggccgccuccuuggccgagccacugggcgacagggcaccgcgggauggggccccuacuuugcggagagccagcucgggcagggggcuaggcucccggcuguuuccaccagcggccuuggagcccucagaggccagcccgguggugaggaggcuagugcuaggcgggauggugaccgggaucugauaggggcugaaacgcagucggggccgggcacugcccaggaaggggcuccgggagagggagccggcggcugcggcggcggcagcugcagcacuaguggcgggcaaagccgaggcggcugcggcugcugcugccauguagguguagggguaggggaagaggccuccgaaagugggcauuggaauucccuggaagaaacagaacaagacgaggguuagacaucuugccugaagucuuucugaaguugggcugggugcuauccccuggacaccgugcccuucuguuuuagggauguaaaaccacaauucgcauaacuauaaccacaggcagcacagguaagcaugagccagugugccuguggccaaacccaguuagaagggugagaucgcuucaggcuaccaugcaaaggccugccaucaaguucugugcugggcauuacagcagggguaauggaaaggacauuccaggugacugcccuagcacgggugaaggccuugagggagaaaacggggcaggcauagggccagguggcaaacaggcagcuuugggugucuuggagguucugcucauugagaacaguguccucgccaccccuccuaucugcaggcucugaagggcagagggcacacaugcuggggaaggcacuuugcaaagucuccuucugccugcucaugguucuccugccugggccaggaggaggacacgggugccaaccaguucauaaacuggccugaaaguucuacagggaaugccuggcagcaccucacuggcagcugaggaaggaaugcagucuuugccugugaagggcacagcagccaggaacuccuggacaagcaccuuccugaguucaugaggucuggcuggugcacggccugaccuuugagauaauggcuuacuccccagagcuaguggguauggggaggagggcagggggcugaugauugcacugggcucccagggagccucaggccuggcucuagcaggaagaagaaaagaggcagcuucaucaggccugagaaaauacccccuccugagacagucagguccuacugggcauuucagaccuggcaucccagguugggaggaaggagggaggcuucaguucucuugggauuuggcucuaccugaugucugggaugggcugcacuggccugggaauguaaccaccagcagcccuaccaacggaugccucccaggugcugguauucucacccgggucaugcaccuguuggccaggcugugucuagaagcccugacuuccucaugaccucugugaugcuggugauuauuaccaguuugucuggggaggaggcauucauauacacaaauaaucaggggugcagauuaaaccucugggcccugaacuuucuccagaggcuucccuuccagcccagagccccagaugagugauggugauaccucaaacacuccacacacccuaacacugagcuguguguaaaacucauuucagaaucgccugccucccaaccccccacccccccacccaccaacccaacuuuuaaaauauuugcugcugaagcaaaggagcuuucucagaccugaacugcuauuuuccuucccuugagauaagaucucagggguucaauuugccagaaaccucagagggaagaaaaugaaugaagagauuccaaaucuuuccacagggaauauuccacccaagcaaccaaagaggccacuguccccaucggaucuccuuacugugccccagccacauuuucgucaacacuccccugggagcuuggaauuucaauggggccugaagagcugaguucucaucccugacauguggcugggggugcugggaacucaagguaggggaaagaccagccuuguccuucaccaggacagaggacuucguagaaggccugggaggggccagagaccucugggagggcugguggucaacuguccagaaaauaaugcaaauguuccuucucccuuugucugucuggccaccuuagccuuucagaauggacagggagccaagggucuuuguucucaagaaaaauguccugaggccaggagagaagacuucacaagccagggguggcccuggucugugagggugagaagagucucgaugggcaccgcacuccucgcuggggcuauagggaaggaagcaggcccagagagggucagggacuugccaaaggucacacgggagucagaagcggcgcccuggccagccccuggacuuacaacacaguccucgucucucagaacccagguguccuaaagggcaucccggggccuccccuggauggaguucuugccugccagaggaucccagcgacccuggcaccccucaggcccuccgcuggccucgccgccagcucccugggccuucucccucgcuggcgcugccgcggggucacaggccuuaccugagaugccagcaugugcugggagagguggaacgggaagggcgcggcggugcuugcugcgcuggccgcgggacccagcccgccugcguccagccccgcggcggucccaggcccgccaccuccgccguugccgccgccugccaccgaggccaguaggugacccaugcccauggcggagaaggcgccagggcccauggugaacuguccagggugcaggaagagcggcuggccggcucccagcggcccaaagaacugcugcccgugcaaguggcuggaaaaggccaggccgggcagguguccggcgcccaggggggacgcacugucugucugcaccaccagcggcgccaggcccugcuccuugcccucggccgccuccuugcgccccucguccuuccuccgagcuucggcgcgcuccuucuccaggcuccucaggccgaacgggccguccccgccgcucucggccggcuccuugccccucucgggacuacgccgcucccgggcgcgcucggguucggucaagcgaguggggcuggcgcugucuggagccgggcugcggccuagcggcgcccccgcacgcuccucgcucaaccgcucaggcuccgggucgcuguccgcggcgcacgacuucuccucagcugcggggagagggcgcgcggauuacaggggccugggcggaggccgacgagcaggaucagggacacucgggaagggcugcucucggggaggccgagucggaggagcugcuggagucgggcaaagggcagcugcaggucaccuaauccaagaccccagauuuacaguggaaggaacccagcccuggagaggaaacccuacagcuauagaauuacacggcgcccaaggggccaggcucggaguccggccggaucuucuggcuaccggggaccgcccucguaggggagucccgggacggaaaccccaucccagacacucgccgacguuuccuuccuggccuuucagguuagcggguggcucagcaaaagaccagcccagcgaccugaggaccccccgccgccaccucccugucccuccuccgguccgacccucaccucgggcccggugcaggcgcagcggacugggcgcugcgcccggggaggugggugguucccgcgcggggggagggucgcacgacgaggcgucugacuccgcgccaucgcgcucggguuugcagugcuccucguacaagcguagagacggcagcgucagcugcuuccuggggaugagcggaugaaccaggucagcggggagcccaucccuccaucccuccugcucgcugcucccgcgggcacccgccacagggcugcuguccucggccucucaccuuuucucccgccggccguucccggugucccggaagcccuuggcaaacggguuguugucgaucuucagcugugugaucugcggggaccaagggggcggcgcuaagucaggccguggcucuuccagcguggucgguggcaccccgaggucagcgggugcuggccgcagagggaagacccggggagcguccacuugguacccacccgccugggaugggacgccccgagcugaggccggugggagggccucgcggaaagcgacggggucuguccuccaaaagcuucauucgaggaauuaucccuagacaggccuagacagccccacacaggccuaaagcagugccacagugucggaaccagcccaagcaugcacacccgcccgcgggcuugcgcaaguuaaacgacuccgcacccgagcaggcgcgaacagagacugcaguucacacgcaaggcugcagguacacacaaagccaaaucacacucacgggcucgcacacacgcaagugugcacagacauaacaaacgccuacggaaccaaacgaauucacaugccuccacagguauccaacacaccccaaacggggcacgcacagcccagcguacaccuugguucacaaagccacaacgaccggcacggacacucguacccucucuuucacucgacaguggcgcacaagggcacaggccuagaggggugaugcucugccccacuagaacaaggguggagaagccgcaagcagaaaaagcccuuugauuggaagguaauucucuaagcgccucccaaggggucuggggccuagacugacccagagcaguagccaggagugcuuuggggggcugugucaccugucccacccucuggcuccccccgagagagugaaaacugggccccggguucugagcaucgguagagccugggcagauugccucgggcgcccucucuucacuuacauucucauuccugagccaagaaauaaacgaauaaaauguaaaaaugucagcgcgggcccggagucucagcuaauuguuaaguaaacaucuccaucagaacgacggcccagcuguucgcucgccccaggggagccugugugugcgcgcggugggauugagagggcgccuugaggacuuccgugagugcugcgcguauggaugcgaggcucggugcucgggggcgggccgcaagagcgcggaucccgugcagggggcuucgaggggcgaugaacggacgguugggccugcacguguugaggggcgucagugcaggggcuuagcccaccgcccgccgcgcgcaccuugucauucugguaggcagugacggcgaugaagucggucuccgggaacacguaggugcggaaggugcuguaaggcagcuucaggaugucguuggcucgcacuauguggaagcgcggcugguacuugugcauggaguuuaggauggucugcggggagggugggggucagccggcagccaccagccccggcccgagcuuuucuauucuuuggguaccugaccucuuccucuccacuuucucucucucucucucucucucucucucucucucucucucuaucgguucuuccucuuccccauuuucuccugucucugcucuuuucucacccuuauuucuuuuucuucuacuuuuccucucgcuuuucucuuuucacagcuucuuuuucucuugccauuaaaaaaaauuucccaguuggaaacagaaaugagacagagcaaaaacaaaacaaaacaaaaaacaaaacaaaaaaaccaaccaaaaaacaaccccuccccacaaaagaaacccaaacaaaauaaaacaaaacagagcccuacaauuccacucuuaacacucucuuccuuucuggcacugguaaacccccuaaccccacaaagaggagauuccaaccuucgggggcucaccaacugcccuaccucagaaugggcaguuccuuuuacccuaugaaacaccacccccguucgcuggggccuugcucaggcauaaauggagagaacccccaaacccucuccuccuaguugggcaucugccugugggaggagggaaaggucuuagggaggcuggggggguggguggggagggugguuuaacuuuuaaauccccuagucuugggggagggccagggacgcgggucuuggcagaagggugauggacaaguugaggucaugggcaggucuuccaagcucggcaccuacaggccaagagcagggugaccuccgugguccagcacugcagacccaguccuggcagcaccugccucccuauugacgguacaagggacccuccacggccugaggaacugagauugugagcugccagccacugaccccaccauuucccaggcuugcaaaggagagcgcuggggcccaggcccaggcccagcccacguagaccacagggcagugacccgggcaggggcacucuggggguuugcccagcgcuucccccugggagauccugccgcccugcucuccugcucagcugcagugcugggucaacaagcuccugcaccguccccacccugccccaacacucacgaagccgugcuugucagagauguuguuggucagcuucagcuuguggaaggccacaggcuuagccauccacugcucccccguggcugggcugucuggguggauguacaugcguuugggcaucucagggucggccuugcccgccaccauccagcgcgaguuguggaacuuauagcggcaaucgucagcggcuacaauguccaucagcaggauauacuuggccuucuuguccaggccgcugacucgcaccuugaagggggggaacauccgccugggagggagggaagggaggagaucccauuggaaccggcuguucuagguuccaggaccccacuccuccuuuauuuaucccuccucguugcgcacaccgcugccgccuggcuguuuccccuguggucggcugcucugcccucucaucacugcccggacgaccccaccugugguuguugcucccaggagaucccauuucugccugucagacccucuccuaaacagccuccuuuaggccuugugcucagaucuggggacccucuuucucccugaucugagaugaaagcugaugcccaggagagaagucuaggcccucuagaaauauucucgcuucuccuuaaucuccccgaaauucguucaggggaaauacccacuugggacggaagcucccagaaauaaaucuggaggguguuuguauugggaacugggcuacagagccugauaagacauccuggccgugcaguucgggggaagagggugaacccgaggccuggauucucgguggcugagucgaaggguggaggggccggggcuguggcuuucuucaggcuuuaaggccuggggcggcggaugcguccagggcucggaugcccgcgguggagaaagggcucccagcccggugaggcggagggcucggcugacccggggcucgcugccaggaaccgagcaaccagcgugggguuagcugggcccaggucccacuaggggcuucggggucggagcagagucugagagaggcugaauuucccccgagcucggagacggacccggacgcagaagagcgagagcgcggggcggaggagaccgccagggccaagccgcggggccuccucugcgcugggacucagaacgguuggggcuauucuuuagcaguauguuuucguuuuauuucauucggaggauuuuagcguuuuuguuuuaaaaaaaaaucgcuccggugccaaacgagaaaagucaacuugguuguccgugggagcgaagcguggcgucagggccagaaccuggagccgggagccgggagccgggaguccccagcucugcucugauccgugcagucccgugccccagcccgcccgcccgcccgcgcgccuuccagccggccggcagcccuaccucccggacuuggugaugaccaucuccgugccuagcuuguggaacuggucccacagcuccuuggccuccagcgucaccuuggggucguccuccaccucguccucgggcuccaggcucuugagggagcgcagaugcgcggcgggcgggugcgggcccagugccgagacgugcagccccgccucggccgcugcugccgccgccgccgccgcggccgccgcccccgccaggcccgggucgggcagcggcuuggccagcgcgccgggcggcagcgcgagugccgggaagaaggagggcugcgccgccgccagaaaggcggacauggggaagucggcgggccguggcgcguggaacgggugguaagccauggcgcuggccgccagcgccggcucucucaucgggacauccggcccaggcgcccgggggccggggccggggccgggggcgcgcggcucggacccccggcccgggcggcggcgcgcgcgguggacggacgacccggguggcgggcgcagcagcugcuccucggggcuucccguccggcgcaccgcaaggggcacccggcucugugcgcgggggcggcgggggcucugcgcggggccgggcugggccgggcugagcuggcccgcuccggcgccggggaccacgcgcgacugguuagaucuugucgugaucucuggaaaacugugacuaucucacauguccugcccagcucggauccccugcgcuaacgagccaggccccccuugauugcugauuuuacgcuuuuuggaccaauugugggucuccgggggcgggguuuugacagcucaggccaagcuccggccgggagggggggccugggagaaggugucggaagccucagcaguaagaaaacaugucaacagaauaaaauauuaaccaaugacgggccgccgggccccgagaccccuccuccugccccggccccca

SEQ ID NO: 16746 - RNA, 427 nt, Homo sapiens
cauuggcccaauuuuuccguaaccuuguggaaaagacccuggugcuggugaacgcugcugugacuuacucaaagccuugauuggccacauuuugguacuacgccaaguuugagcugguuccucccaccccugcugagaucccuagagcuauucagagucugaaaaaaauagucaauagugcucagacugguagcuucaaacaacucacaguuaaggaagcugugcugaaugguuugguggccacugagguguuaugugguuuuaugucggagagaucauaggcaagcguggcaucauuggcuaugauguuugaagaccaguauuuaacaucugauuauauuugauuuauuauuugaauguuguuggaccaugugugaucagacugcuaucugaauuaaauaagauuugucaaaauuaaaaaaaaaaa

SEQ ID NO: 16747 - RNA, 124019 nt, Homo sapiens
ggucccuguggccgccauuaaagcgaagggaaaacccgugaauucggauuaaagggggaaaaacaccgcccgcugggcccacaaaaugggggagacuacggcguccagccggugaggccacaggagggcaaacuuuaggccggcuuggcccaggaacgacacgaagacagagccagagaauggucugagcccgcagacgccgccaccaccuccgccgcugaggagacucugggcuuaaggacaucgccgcugccgcgccgggggccugggcuucucucccgguucucgcccuucccgcuccugugcgggcgccucuccgcccgggagaaccguccugggcuugggcucugccgucucggacuugauuuugauuauuuauuguguaauuuauuauuuuucuugugguaggggcacacauccccuccgucccccagagagggacgagcgucugcgggauccgcaguccggcccgccaggcgagcgcggcgcggcccucccgccuccggcccucggccccgggcggcugggugccggccgggcggcgggggcugcucgcggcggcggcggcggcggcggcggcggggggguggguggggagggcgggcgcccggcggccuccucuuccaccgcccccccaaccacuaccccccccccggcccuccccggugucuguguuucucucucuggucggaggcggcgguaauggcggaugguggguuguggcgccggcggcggcugcugugagggacgaugagugccuccuucgugccgaacggggccagccuggaagauugucacuguaaccucuucugccuggugagugccggggccggcgggcgccgagggaggggggccgcgaggugcgcccuugggccgugggggagggggccgggucugguccagaugcccgaguucccgggcgaggcccagccggagccggcgcccugcgaagcuccgcggccagccccgggaggcggcguucgcucuccuacggucccgggcucuguuuaggggaguguuggcauuuuuucucgucuuguuucggacucuccuucucaccguagucucguccucaacuugagcuccuuaucuggcaggacaguaaccuuucccucuugucuugcuuaacuguugcuuuucuccuuauuggcccuguaucccugcuucacacuuuacauuauugccccugcuccccaccgccuuuaugucuuacccuuuuaauuugguuuccccauguaaacaggaccccagaacuuaagcccuagaaaccugucuugguuuuacauuuuuuuuguaugagucaaacuaacgccagguuaguuucuuucuugggugacuuaagaucucucuguaaaagccaguaggugccauuucauauguuuucuuuuuaaacuuugaaaacaguuugccauuuuugacaauuucuagccaucuugcuuuuauuagaacaugauguuuuugugagagugaagggggcuaguggacgaggugcugugguuuugcacuguuucuauauuuauuguguuuugguugcuuuuucagaauguuuugagcaggcugcucccuuguuugauugaaauggaaagucgagagaagcgggauguagggaugaucauuguguagguuagcccaggucugguaacauccaacaguuaaggcuuucagaaguaccaacuguugcaaauaacuuguccuguaugggacaguagcugagcuucaucaaugacuuuaaguuugggugacuuuacuuuuucauuuucuccuuugugcuaugagaaauauuaagaguauaugauagguaagugaguuaagugggaggagcacaacuaguuggcaaguguaaacugccagucauguaucagcaguuucauuuuuggcaccuuaugcuuugcuccuuuaaguuagauuaaauuacugaauuccucuugucgaauuucuuaacgcccaugcuaaauugagaucuuuaauacucuauccucgucuacaguauguuuuucuuuucaauguccauuaaucagcaucucuucacauguaauaagacauacaccagguuuuauauuucuaucuuauccaacucagucuauuuuugguacuuuuaggaucaguucuuugaagauagacuagcacaaaucugacaguucuuugugaguagcuauuugacuuuuccgacaggggugugugugaagaauuaacauagauuuuuucagaacuuguucagaugucuuuucauuagagacguuacuucuguaaauguggaauaaaaacccaugauagggucuuuaauaauugauuuucaguuaaaaguuugacaccagugaacaaaugugaccaguuaggacagagaaaaauguacucuguuugcauauugaagugugugucuauauuuaacaucauucaguuucuucuguuucuacuuggaguacauauuugcuugcuauucagugacaugguggugguaauuuuuaacuguauucuucucccuaaaauucuugguuguugaauuauaaagucuuuuuuuguucuaauuugcagucaauaucucaagcauacauugaaaaauuguaaugucuuaaugaaauaagagacaucauauugaguacuuuugacuuugagugaauaugcaguaauaaaacuuaaugcuuucuuuccuucaggcugacuugacaggaauuaaguggaaaaaauauguauggcaaggcccaacuucugccccuauucuguuuccugugacagaagaagaccccauuuugagcaguuuuagucgcugccuuaaggcagauguacuugguguuuggcggcgagaucaaagaccuggaagaagagaauuguggauauuuugguggggugaagaccccaguuuugcugaccuuauucaccaugacuuaucaggugaaagaaacuuuccauuucuaacuaaugauauagcaacauuguauacuucucccagaaugucauauguauuacaaauuaaguuuguuuuugugggagacuuaggaggccagauaaaaauucagcuucauuguuuuauuucaccaugauuauuuuauuuuacuuaaauuauccauguuguuauagcuggguuuuuaaggcgugaaugacuuucuccuuccaccaccucucuucuuaauuucucacagguaguuagggcccgaagaaggcauguuacauuaaucuaaaaaaauggaaucaggaaacagaguuccuaacaaagucguguaauaguuuagaagccagauguaacuuuugagucacuucagccacugcugaaguugagucuuuugcauugaauaggcagaugauucuaaaaguacuggaaauguaacuauccgugugugugugugugugugugugugugguguguguguguguguguguguuuuaaggcauguauuuuguuauugucauuugugcuauuugauuaacuuaugaaggcauauguuaauuuaguuauuuuuggaaagugacucauauacuguucugucaaacauaauaagagaaaagugccaacuuguuuagcuuuuaugggacaugggaucauaaucuaaaagguuacacaaacaauuuuauugugagcaaaucaaugugauuacuuccuuauuuucuugacuuuuaggaccaaaugcuacuuuagaaagagaaacuauagcuuuucauauaauuacugaagcuuuaaauugugaaagucaguauuaacugaaucuuagauaauaggaauauaaaugauugguuguaugcuauaagguuccaaagacuucaguaagauaguuugauaaugauuuuugacagauaaacuuaggauuucuagauaauuuuuuuuaaguucuuauuugaaauugaguacucugaaguuuuuguuauuguaucucugaccuauaggaucuauuuuauuuuuggauagaauguauucuaggugucuguaucuugaacugguacuuaguaagaccaacauuuauguaggaauguacguguuacauuuguauguuuugauaauugcuuuucacauucuaaugaacauacucuccaguguuaauuguuauuuuugagagugacugcaauucuucaagaaagcuuuccagcuuuuguaguuuuucuaauaagaugccugcugcagaguccaguccuuaguuguguguauuuaauguaguucuaaauguguaaagugauguguauauguauauacauauauguacauauacaugauguauguauauaugguaguuuuagcgagacaauacuuucuaauuaugccaaaagcuaaguccgccagccuccuuuuucuuucauuguuuuggauauaguauuugaguuauuuuaaucguuaaguggucauaaaaaucaccuuacuagaauguuuggagacuguauaacauuguugaaaaacuauaaacuauugauaaaauauauuuguugauaaaacauaauuauugauaaaacuauaauggugacuuaggggcuuuggucuucuuaauaaaguuggcagagcaucuaaacagacuaaacagaucuuuuuuuaagauuccaugaaauacacuuuguagaaucaaagauaauuuuaagagauacauaauguuuaauuuuuuuuuucuuuuuuucuuuuuaaguagagauggggucuugcuguguugaccaggcuggucuugaacuccugaacucuagugauccuuccaucuuaaccucccaaagugcugggauuacaagugugagccccugcaccuggccuaguuuuaccguaauagaaaaaauauugugaaaguuaaaagacuauuaaaguuagaugugagcugcuuugauggauauuguuaaaagucaguuuugucuucuagguuucauguuaccagucagauauguuuucuccacugaaacuagguuacagucuuaaacauuuuucucuagcuuugauuuuuagcauaauuuucaaaaaugguaguuacuuguaccuuuaaaauagugaucagcugggugccauggcucacucacgccuguaaucccagcacuuuugggaggcugaggcaggcagaucgcagggucaggagauagagaccauccuggccaacauggugaaaccccaucucuacugaagacacaaaaauuagcugggcaugguggcacgcaccuguaguuccagcuacucaguaggcugaggcaggagaauugcuugaucccaggaggcggagguugcagugagccgagaucuugccacugcacuccagccugggcgacagagugagacucugucucaaaaaaaaaaauagauagugaucuugaacgugaaugaaaauaauuuugggagguugguuuuuuuuuuuuuuuugagacggagucucauucugucccgcgggcuggagugcaguggcgugaucucgcucucugagugcaguggagcuugcuugcugcaagcucugccuccuggguucaugccauacuccuacuaccucagccuccugaguaccugggacuacaggcgcccaccaccacgcccggcuaauuuuuuguauuuuuaauagagacgggguuucacuguuagacaggauggucucgaucuccugagcuugugauccgccagccuuggccucccaaacugcugggauuacaggcaggagguaggguuuuaacugcugucagacuuuacugaaugcuaaugaaugguaaauagcuuuuuuuuugagauggagucuugcuuugucgcccaggcuggagugcaguggcgcaaucucagcucacugcaaccuccaccuccuggguucaagcgauucuccugucucagccucccgaguagcugggauuacaggcacaugcugccacacucggcuaauuuuuuguauuuuuaguagagaugggguuucaccguguucgccaggcuggucucgaacuccugagcgcagacaguccacccgccucggccucccaaagugcuaggauuacaggcgugagucacugcaccuggccguaaauaacuuaaaaauuuaucaaagugaagugauugaaauaauaaacugaaauacaauuaggagugguauaugaucauauuuauuguuccaaagcuuguccuguacuguuuuaguuugcauagucaguguuauuuauauaauauuuuagcuuuucuuaaaaauaaaaccuguuauuuacuuaagaauguuguuacuuaaaucagacguaucuuaaagcauaauaagguuuuuucagauggaauauauuugucuugcccuuuucuuugcucuagggacagcgucuaccucccucuugggguaauuagucugccucugucucucuagcuaaccccuuuuucauuucuuccaucuguggcacucuauuuccuucuucuaagcuccccugagaagagagcagcuggacaguacaggguagcaucagcugcuggaggcaguccugaguuccaaguggagguguagcacugaggaaugggguaccggaaggacccaggugguaacuaaaaagcugguuaauuuagcuugagccugcucuucacaggcaguguccuucuguuugguucagcacacaccacaucuuguuacugaaguguuuuuuauuauggugauaauauugcccuuguuuuucuugguagugagggaagagggaaagcauuucuuuuuucaaagauuagaauucucaguuuuucuuaacuggaauauucaguaacagaaauacagaauugccuuuguuuaacccccuuagcuccuuugugucaugcaguguauuuuuaaaaauuaacuaaugaaccaauauugauacuuuauuauuaacuaaaguauauauuuggauuuccuuuauuuuuuugccuaauauguuuuucuuuucuaggaucucauuuaagauaccccuauuacauuuaauugucaugucuccuuaggcuuuguuagacugugacaguuucucagacuuucuuugguuuugaugauuucgacaguucugaagaaucuguucagauuccauagugcauuuuaaauuucauuuucucuuaugucacuuagcauuuguuuggguuaccuuccuuucaaguuuagcugauguguagaaauagaauguaaacuuauuuuauugcuaacuggcaaagaucaguuacagcaaaucacgucugauuuaauacauacuuuaaacccucaguuacucauuuuguagcaguaagucaauaccguugagcaaaguaauuugcaaaggcuggaugauuuuuggaucaggauuugugcuaacuaguauuagccaaacuauaacauuccagaagguuauuuguucaaaaaaucucuugaauuccaaagccaaacauagaugauuuucuuacuuuuugcuuuauccucuauaggauaaugauuaguugaaucggggucgauauguuuugauacaaaaaggauuagggaauaaaacuccuuugggguuacagcuuuuuucuuucuuucuuucuuuuuuuuuuuuuuuuuuuuuugagaugaagucucgcucugucucccaggcuggaguguaguggggcgaucuuggcucacugcgaccuccgccucccagguucaagcgauccuucugccucagccucccgaguaguugggacuacaggcaugugucaucacgccuggcuaauuuuuguauuuuugguagagauuuuaauaggaguuucgccauguuggccaggcuggucuggaacuccuggccucaggugaucugcccgccucagccuccccaagugcugggauuacaggcaugagccaccaugccuggccccuuuuuuuuaaaaauuguauuuuguagcuuuguuuagugguugugugauagugggugaaagagguauaaaaugggugaugggaaaaucuuagcucagucccucuggucaagaaucucugugguggguaggacugguacuuuuaaguguacuguuaauuugcuucagagcaagauuguaucauuuucauuaauguggucuugaaggagaguuuucuguguauuuuuauucuguguucuaacauuuuuggaauucaauugcugucaucauuggcuuuuauucuuucccuuuaaauaaaaauaaaagcaaacacugcguccucucccauuugucaucuuaaaaaaaucauagcaaguuagacugugaugagacucuuugagaaaacugauaccuugugaacuaaaaaaacucagggcuaaaaauauuuguucuuuuuccuggcuccugaggucuguaaaguagauuuuaguaacauguucagauaguuuuauuauaccagaauuuuaucauaaugaauagugcucaaacuaaguggacuauuguucugaauuuaauuuuggauguuuuaauugaaggauauuaacuguaguggacuuuaaccuuaaaugacagcuguuaauaggauugacagauagauaaacagccaggcauaggaaucuagucccagccaaacuaaaacauuguugugugccccacauagucuaaagagaguaauuuauuucuacuauuguaaaauuuacuugugauguggcccgacucuuuaaauuggcuagucuccuaggugacaacuucauuugcuguauuucuucugcauacuguuuuuuugaucaaguguaucuucuaaguuuucaagccaaacauaacauacuaggcuguuuuuaaaucaguuuucaaguuuugccauagauaaugaugcggccaacuuaaggcucucgguauauuuguugaauguauagguuauuaaugauuauucaggagaaacacugaucuagcauuuaaacauuucucuuuauuucaggaaauacaugguauuuucuaccauguuaauuuuugagccauuauucauuagcauauguuacauuuuaauaguuuugcaaaauuguauuggagaagauucauuuuuuaccaccguggagauauuuaaagaugccauuuuuuugagaaaaauguugagugcagggugugucugcuuuuuugguugugauuuuuuuuccccauugauagagaauuauuuugaugacuuaucacauacuuuggcacuacuguaaucugcaucuucaggaaaaaaauaugguaaucaaauuuagcauuuguguuuucuuccaauaaauaguccauaaaaauuucaagaaacacugaugauuaagaacuguaaugcuaauaguaacagaaaaguacuaagaaugcagaguugaacuuuauuuucucuggacauagagcuacaagagaaggaauuuuuuuuucuuuuuuuuguagggauggaggucacacuuugucucacucagccugcagugcuuaaucauagcucacugcagccuccgacuccuggacucaagcaauccucccaccucagcuuccccagcagcugggccuacaggcauugccacuaugcccuacuaacuaaaaaaaguuuuuuggagucagggucuuccuguauugccaggcuagucuugaacuccuagcuucaagugauccuucugucuuagcuucccaaguagcugggauuacaggcaugagucauugcaccuggcuagaggaggaaaauaguuauauagauuaagcagacuuuuucuauuaggcucugguuaaguucaaaagagauagguaaagauuugccauauguucccuucuccuuccccucccuauuauaaugcugguguugagauucaagaacuuguuucaauuaguguaaauagugcauaucacuaugccuugaguggguugguuguaccauuucacuuuucguaucugaauacaacguguagaaaguacuuuuauuacaguuauuagauugucaggauauuagaaacuuggcucaguaggcuucuuguuucuaagugauucccaacaaaaccaaaaaccuucagacuuuauugagcguuauuaggacuuacucucguuuuucucagcaacaaaauaugaaauuauauuacuuuaguguaaugguugcuuaguugcuugccauauagaugaggacauacuucagagauacguuggauuuagaaaaccucaacagguggucucuacuuguuuguuuuaugcauagcuccuauuuaguguuaaugagaauugugggcacuggggacauaagaugcccacccccucugaaagcauuagaauaaugagggagaaaugcuucaagauuaauacugauuacuuuucuaaaccacauucaauauucuuuuuuuuuuugagauggagucuugcucugucaccaggcuggagugcaguggcgugaucucgguuuacugcagccucugccacccaguucaagugauucuccugccucagccucccggauagcugggacuacaggugcaugccaucucgcccagcuaaguuuuguauuuuuaguagagaugggguuucacuauguuggccaggcuggucuugaacuccugaccucagaugauccaccugccucgaccucccaaagugcugggauuauaggcaugagccaccgcacauggccucacauuaaauauucuuaaaucauuugacugcaaguuuaacuaaaauagauuuuacaaaauaaaaccauaaaauuuucagaauuucaugugaaaauuuauaaauugugcuuuagcuuuuacuauugcaaagguuuuuuuuuuuguuuuuuugagucagagucucgcuaugucgcccacaguggagugcaguggugugaucucagcucacugcaacucccaucucuugggcucaggugauucucaugccucagccuccugaguagcugggacuacagccgugccaugcauggcuaauuuuuauauuuuuaguagaaaugggguuuugccauguuggccaggcuggucucgaacuccuggccucaagugguccacuugccuuggccuccugaagugcugggauuacaggcaugagccaccacaccuggccucagccucccggauagcaggcgugagccaccacaccuggcuucagccucccagaaagcagauuuuuuuauuuacuauuuuugcgaaggagacaaagucauuuucuaguuuuaaaugacuaauuuauuugaaguuuauaacaacuguacaaccuugauacuuacaaaugguaacugugucuugggucuuugaugcuuuaaaacuuaggagaaauauguugguagugguuucuuauguagaacaaguguuacaaccaucagaagguagggauuuuugaaauaaaagguaauaaaaauaaaagauacuaaauugauuguaaagaggugaagaauuggaagauauuccuaacauaauucuguuggaauuaagaacauguauauucuaguagucauaagucucauaauuugagguaaaagucuuaauguagcuauuuaauuuugaaaugguaggaccucauuaaauugaaagcagaucaauugagauucuuuucucuuuuuuugucaucaacucacaaauaugcuugugaucuagaccuuuaauuaauuaaagugaagucacuuugugcugcuucucuauucuccuagccuaauacuuucuuuaaugaagugaaacccauaaacguuuugguuuuaaauggaaguagauaacggugucuuugauauaauagaaugugaauuuuuccuauuuaauauuuaugauuaauauuagacuuaaaaaauuauucuauaccaauucugaaauauugucauuuucucaagcuuauucuacuuuuuuuucccuaagcuuaccuuuuuuuuuguuuguuuguuuuuuuggagacugaaucucacucugucccaggcuggagugcaguggcacgaucuuggcucacuguaaucucucccucuugggugauucucccaccucagccucccgaguagcugggauuacagggcugcacuaugacgccuggcuaauuuuuguauuuuuaguagagaugggcuuucaucauguuggcgaggcuggucuugaacuccugaccucaggugauccgcccaccucagccucccaaagugcuaggauuacaggcgugaguaacugcgcccagccuaaagcuuauuuaaaauaaaauuuaaaaaaaaauuaguugcuuugaaagacuugacuaucauuuaggagaaaauauaaaaccaacauuaaucuuuguaguggcacagaauuucuagugcaguuaaaguccacuaucauacuuuuuaguuaauguuuauucuacccauuuguuguauaaauugugcauauaaaccauguguaacucuuaauacaugucuuugcuuuuauucagaagcucauauugugucuguuuuucuguggguauaguguaugcauuuuugguguugaauugagaaacguuugucuuuuauuuuuacuuaaacauugaacacagaugacccauauuuacaaaauguuuauaaagguauauaggcuauagaaggagaguuaauuauauuuagacuaagcaauuuaaaaucuuguaaugaaaguuagagugcugaagugguaucauuauuuguagcacgauuuguuggaugcuuugugacagauaugaaauggauagaguacacaaaaaaauuuuucugaccuacauccagacuuaucucaaaaugacuguguuaauguuuuuuugguaaauuaacuuggagugauuaauagauuuguuggcaaaauugaagcuauauaguuagugaagauagcuauaauuuuauuugacagaagugccauuuacaauuuaagucuuuaaauuuuuaaauuucucccccaaguaaaggguccuguacugaauaauaaucaugggaauaauuuguuugaaaugagaccuaagguggcugauagugcaccgcuuguuaggcucugugccaacagcuuccuuuuuauucaucacuuaguguuguaguggagucguggauuagaaugcugauggacaugaaauguuuugacuuuaauuauuaacuggcuaguuuuuuuggcagguugaaugacuaggggaauuaggacaaaguaacaagugagccagcuuagaaauuggcaucauagguguagaguguguuuaauauuuuccagguuauacaaacaaguguccuuuucauuaauacaggaaccaauucaguauguucaugaugucauugaauuuuauaagguggaaaaauacuuuucagguaauuuaauagaauauguggcacuuagaccuuuuauuccuuguggaguaacuuugaaaccugauaaugucuagagauacauugaagugauuguagcuuaauauucugggguaagcuaguguugaugaauauagaguuuaaacuguaaccuuuuuuacuuggcucugaauagauuauagugucacuauuuuauuauuuccuucauuucucuuuuagaagaagaagauggagugugggagaauggacuuuccuaugaaugccguacucugcuuuucaaagcaguucacaaucuauuggaacgguguuuaaugaacaggaauuuuguacguauuggcaagugguuuguaaagccuuaugaaaaagaugaaaaaccuauaaauaaaagguaagcuaucuuaaauucugacgugauauuucuuuagauuuguuccuuuuugugucuuaacagagaaugugggauaaaacaagcuaauauacagacauauuccagagguugucagugacagaguacuagauacagucagguuuuuuuuuuuuuuaaaccacuuuacaaacuucccuuuauacacuuuaagcauuuucuuacuguaggaauaggcuguauuuuaauacaguggccuaaauuuugauuugugaugauagacuuaaugugggaugaaagcagagacuuaggcuuggaaguaucuuuuuuuuaguauuuguggaaauauaugcacagcacucugauauuaaaauuaaguaacaacaccuguuaaggauagugaucugugaguauguuuuggaucaaguuaacccuucuuauucccaaucucucaauucccuuuaauuaaaguaauuuaaauuuguguuuucuauauaagaccauuuacucuuugagagcuuauaauuuucuugagcaaugaauuaagcaaauuuaugacacuacuuauuagacuaguugcagauagaggcacagaagacuuaugauagauaccuccuucuccuaugcaauuaaaaccuucagguuacucgcuucuccgugauuuagauaauauaaggcauagucucucaaaagauuuaaguucccagcagucauugaguuagugagacuucaagagagaugaaccaguggcaaguaaguugggauguggggaagagaaaacuaaagggaacuuacuaauuuuuccugaaagaugugagaggaugugaagugaacauuugguugagauuguaaucauuuugaggucuuugaugucauauaugcacaucuuuuuucaugugcaccuggaguuuuuguuuguuuguuuuuucaaacuuuuuaguuuuaguaagacuggaugaguagauaagccuggauaaauaaaggugcuuucauuuuuuuuccucuuugaaaauuaacguaaaccuuuauuguuaacaaaauacuuguguaaguucagaaugcauucagcuggaaaugacagaacaacauuaacuacuuggcuuauguagggauugauuuuucucaguagcaagcaguauggaggucgauaguuuaguacugguauagcuguucaauaaugucaucaaggauucaaaguuccccagaguuuucucugugccauuuuuacaucuucaugguccucccguguguugcaccuccagaccucacaguggauuccaggcaggaagagaaaggaagggaggaaguaaggaagguguggcaccugagucagaaaguaaauuauuuucuggaaacuuuaguugacauaucuuuggccauacuaagagaaacaaauaucuuuuauuuggaaacagcugcucugaacaaaugaaguuuuuguuaguaagaagaaagggcugauagauauuagauagauaccaaagaucaaagaaguggaaauggauauuggguaggcaguuaacaauaucugccauauacauuuauuuauuuauuuugagacaaagucucacucuguugcccaggcuggagugcaguggugcaaucucagcucacugcaaccucugcuucccagguucaagugauucuccugccucagucucccaaguagcugggauuauaggcgugugccaccacaccuggcuaauuuuguguauuuuuaguagaaacgggguuuugccauguugcccaggcuugucuugaacuccugagcucaggcaauccacccgccucggccuccuaaagugcugggauuacaggcgugagccacugcucccagccaggcauauagauuuauguaguuuuaagaagucaaacagauuaccaagauuuaaaaugaaaggcugcaauccugagccccaaugaauagauuugcuccucagaagcagcccuuuuuaauucuucuguuucuuuuaaguuaccuguuuaaaaauuuugaaagacauaacaugcuuauucuugaguuaucauuuaggauuaaucuaguggacuuuuuuuuuuuuuggucacaacagccuaccauugaaauucuauugacuuucuauugagagguuagcuaucuuacuucccccgacucaacacuuggauauuggcacuuuugcacacacuucuuuucccucuccuuuuccuuuuuuuuuuuuuucugauacggaguuucacucuuguugcccaggcuggagcgcaaugguaugaucucggcucacugcaaccucugccucccagguucaagugauucuccugccucagccuccugaguagcugggauuacaggcgucugccaucauacccagcuaauuuuuguguuuuuaguagagacagguuucgccauguuggcuaggcuggucuugaacucuugaccucaagugauccacucaccuugaccucccaaagugcugggauuacaggcaugagccgcugcaccuggcuuccucucccuuuccuuaucuugccaauauaguuauaaguuuugguaaaaacaauauuuguuuauacucuuauaauuuuauaaauauuauuuguaacugagccauaguauauugaaacacauuucauuucauucuuuuuuuuuuuuuggagacagagccucacucugucacccaggcuggagugcaguggcgcgaucucagcucacugcaagcucugccucccugguucacgccauucuccugccucagccucccgaguagcugggacuacaggugcccgccaccacgcccagcuaauuuuuuguauuuuuaguagagaugggguuucaccauguagccaggauggucucgaucuccugaccuugugauccgcccaccucggccuccccaagugcugggauuacaggcgugagccacggcgcccagccuucacauuucauuucuuguacaucguuuuguuuucccagguguuaaugauuaucccuuuuuuucacuuaauuauuaauguuaugaguuaguaaacaccugccuguacucugccacuuuuuuuguaaauaaaguuuuguuguaacacagccaugcucauucauugauagauuguuuuaugccugcuuucacacuagagcagaguuaaauaguuaugauagagacagauggcuugcaaagcugaaaauacuuagccugaaauauuuucuagcugacuuuuuguaguuugcugacuccugaucuguguaccuguugguaguucaucaguagacuaucuauuagaaguauaaaucacuucucccuaccuucaaggacuuuguauaaucuuaugaguuucccuuuuuuucuccucuuguuaauuaauaucccuguuguuacccuucauucuucuuuuccgauuuggauuaguaguucuguaguccuguuucacaguagucaucuuggggauucucuuugcuuuucccuucuuguuggaucccucauuucucauuucuccuuuuuuuuuuuuuuuuugucuuauuuacuguuaugguggugcccaaccugagaguaguuuccugagagugcaaggauggugauacuuuugagauccucuguguuggaauucugagucaaaccgcagaauugcaggcucuuaaguuucuuucuuuucuauccuuauaauugauaguuuugacuggguauagaaucuuugauuagcaacccucuuagacuucuggguacuaaaaugcuaacuggagguucuguguaugugaguagcuuaugacauugcaggcuuuacuagagugaaugaucuggggacuugacucuuuuuauugggugccugucacccaccugccaguauuuguacgcucugucaccugcuuaaguaguuuucccagaggagacuuucaguacucugacuagaggguauaagcugggcugccaguguuuagugaaccuauuggggaaaggagguuuggagguggggcucacuuacauagugguuaaauuuucacuuaaucuuuuaaauacaucaucucagcuguaucugaauaucucuaauucugagucccucuguuucaaccauuucaaagaguggaccucuuaaguuuuucacugaucuggaagaaaguggagaggcucuaauaucuuugaacuuucauuccuucugcuuucuuuuucuuuccuuuuuuuuuuuuuuuuuuuuuuuugaaacagucucacucugucaggcuggaguacaguggugcaaucuuggcucacuucaaccuccaccucccagguucaagcgguucucaugccucagccucccaaguagcugggaccacagacacuagccaccacgacuggcuaauuuuuguauuuuuaaggagacgggguuucgccauguuggcuaggcuggucuugaucuccuggccucaaguguucugcccaccucagccucccaaagugcugggauuacaggugugagccacuguguccagccccuucucuuuucaguuacaccuauauauccaccuucagggauauauauauacauauauacauauauauauauauauauauguauauguauauguauauguauauauguauauauaccaguaccuucaacuucugagccuuucugggauucugugguuugacucaguuuauaacuuuguaaguuuaaccacugcacccggcuuucuuuaugaaaaacucuuaaaaggcuauugauaauugaaaauauaggcucacaccuguaauccaccacuaaggggccgaggugggaggauggcuugagaccaggaguuugagagcagccugggaaacauagcuagacccccgucucucucucucucucucuuuuuuaaugaucuuauuuuauuuauuuauuuguuuguuuauuuuuacuuuaaguucugcaauacaugugcagaacgugcagguuuguuaauagauacauaagugccguggugguuugcugcaccuaucagcccgucaucuggguuuuaagccccauaugcauuagguauuuguccuuaugcucucccucuccaugcucccuauccccuaacaggccccagucugugauguuccccucccuguguccauguguucucacuguucaacucccacuuuugagugagaacauacaguguuugguuuucuguucuuguguuaguuugcugaggaugaugguuuccagcuucauccaugucccugcaaaggacauaaacucauucuuuuuguuuuugagaugaagucuugcucuaucgcccaggguggaguacaguggcaugauuucagcucacugcaaccuccaccuccuggauucaagcaauucuccugccuuagccucccgaguagcugggauuauaggcacccaccagcacgcccggcuaauuuuuguauuuuuaguagagacgggguuucaccauguuagccagacuggucucgaacuccugaccucagguaauccgcccaugucggccucccaaaggccugggauuacaggcgugagccaccaugcccagccgaacucauucuuuuuuuauggcugcagacccccgucucuuuaaaaaaaaaaaaaagcugggcacaguggcacacacucugaagugggacuucagagucccagcuacucugaagacugaggugggaggaucacuugagcucagaagauugaggcugcauugaguuaggauugugcuguuguacuccagccugggcaacagagcaagacccugucuuaaaaaaaaaaaauugaaauuauaacuuuuuuuuuuugagauaaggucucuuauuuugucacccaggcuggagugcaguggcacaaucauggcucauugcagcccaaacugccaggcucaaguaguccucacaccucagccucccauguagcugggaccacaggugcacgcuaccaaggcugguuaauuuuuguagauuuuguagagacaagauaucaccauguugccuaggcuggucuugaacugagcucaagcuacccaccaucuuuggccucgcaaagugcuaggauuacaggcaugagccaguguaccuggccaaaaauacaacuuuuaauuggauauuuucaugaauccaacagaugcugcuuguuauuuaaccauguaauugagcacuaguguuuuuccaugggcugacccauuuaggaggggaacuaaauuaagauuguauuuuauuagugaaguguuaccagaaauaguauaugcucuuucgaguuacucuugaaccauaguugugguauaauaacugacuuuauucuggaaagauaaaugcugcuccucaaaucucuuuuuuacaggaacuuucuuacccuuuuuccuucuuuggaaaagcaaguaggacaaaaaucaagcagcuaagucuaucuuuaaguuauuacuucggacuucuuuucuguugaauucaguggaaugauauagggaagguagauaaagauugauuauaaauuaaugcauuucuagaccauucugaaacauaaguauuauauagacuguuuuuguugacuaaucaauucacuuuugguauaaguauucugaaaaaagaacaagaguuguaaagaaagaaaauuuaugaugugaaacuacuuugaccugaacaaaggagaaaauaauauugcuuaccuuuuuaucuucuuuuuccuuucuuuaaaauuuuuaaagaaaaaaaucucauuuucugauaaucuggaccuacauguaguuguguguuuaacagucuuuagggacugaaagagaggaaauagaaucaaauucuagggauacagcuagguuaccuguaaagaaucccgcaaguguaagaguaaccacaggaacaaaccagucuucagauaauugguuuaaagaaugaugaccaguguuuucuugaauaguuuagguguuuuccuacauugcuggggacuggaucacaugacaggcauugaguuuucuagugagcccacaagcaaauggguuguaguaaguaccacugacuuaauguagguuuuagucucuucuauaaaagauauucugaacuugccauguuugagagugcauuugaaaaagauuaucuugaauaagaacuuuuuuuuuuuuuaaauagagacagggucuugcucugugcccaagauggauggcaguagcgcaaucauaacucauugcagccacaaacuucugggccuaauugguucucccaccucagccuccagaguagcugggacuacaggcacacaccaaccacgccuggccaagaacuuucuuaagauuguguuugguuaagcuuuuugucauguugaaucuguuguagccauuuagcugagugugcgguaaaguuuguguauuuagcaaaaguuuuaaaugcuucuaggaggguauacagaauagaaacauacuaguaaagaauucuuuuuuuagacagcuaguucaguaucuuacguauauagugacauaggagguuuuguuaaguggcagaugagauuguguauaggagggaaauaguuaauagggaacauguuugauuuuaauacauacuuuaaucuuaccccauucccucaacuauauauaauugauuucuauggaaaaaauauguuguuaaaucuuuuuugauauauuuacuguauguaaaauaguuaucuuuaauuccaauuuuaaaaggcaauauaggccagaugugguggcucaugccuguaaucccagcacuuugggaggccaaggcaggcagaucacuugaggucaggaguucgagacuagccuggccaacauggugaaacccugucucuacuaaaaguacaaaaaugagccagguaugguggcaugugccuguaauuccagcuacuugggaggcugaggcaggagaaucacuuaacccgggagguggagguugcagugagcagagaucgugccacugcacuccagccugggugacaagagugaaacuccaucucaaaaaaggcaauauagaguauuacauguuauauauguguguuuguaugucuauauuacauuauguguauacauauagacauguacauauaggauauaauaaauccuugcuggauauaacauaaagaaaauaggauuaaauauuugguucaauauguucuaagccuuuguauuagaauaauuagagcccuggaauuaguaguaaaaaacuuaguccauagagagugauaaauuuuugauuuugugggauaaagcaguaaaaguucacaggaaggaaaggauggcuguuguuaauggccauuguauugggcaguguagauguagaacauuuucaucauugcagaaaguuauuuuuuugggugguauugcuuacacaagaaccuuuauauuuauaauuaaaacaguacuuuuggugcuucaauaaagaaauucaucgauuuuuuuuuuuuaaggaaguaaaugaaagaauaugcuuuaaauuucacccauaaagcuguguuuauuuucugccauauguauggcuuuuacauuaucucgugcucuccaaaacugauuaaaaauaggcaccaugagauguaagucuccccugaaaauguauuauuaaccauuaguagcguuaggauguccuuugguuagguuucucacugucuccgaaaaggcaaauuucuagagaagcuaggagcuauugcuguuagguuuuuuauggacucauuuccucucuuccugucaucuaauguacuguccaguagaaguauaaugugagccacauagguaauuuaaaauuuucuacuaggcacauuuaaaaagcuaaaaaaaaacuaaauguauaggcaaaauuaauuguaauauauuuuuuaauucaguaaguccaaaauaauaucaugucagcauauaauuaacuaugcagaagguuuuaaugaaauaguuuacuuuuuguacugcuuuugaaauuaggugugugugcugugcuuagaguauaucucaguuuggauuggccacauuuuaagucaccaauaguuauauguguguauuggcuauuguauuuacaacacaguucuagggguuuaagcccaguugaacuugguaguguuuauuagugaaagguaccuucucugguggucagugaacccuucuggaauuguaugcuaaauugugaguaugcuuuagaaucucaaaggcaagaagaaucccguaccuuguaucagucaggguaugaacucucugcuaaauuagguguaguuacuucagcagacuggaugugccuuuuuauuguuuucccuguagccugucuauaauguuuuguccuuaaugucugucaucaagauuauuauguaucauuucugaaaucuuaaaugaugaugucacuagaauuugcauggucaauuuucuacauuuucaugcuuucuagaacguuuaugagaaaaaugcuaagacuucuccuauuuuuccuccuuguugagguuuucuuacaauaauuuuucuuucuuucuuucuuucuuuuuuuuuuuuuuuuuuuuuuuuuuuuggagacagggucuugcuuugucuccuaggccagaguacagugguguaaucuugacucacuccaaccucugccuccugggcgcaaacaauucuccugccucagccucccaaauacucaggacuuaggaguacaccaccacaccugacuaaguuuuguaauuuagguagagaugggguuucucugcuggccauguugaccaggcuggucucuaacuccuagccucaagugauccuccagccucagccucucaaaguacugggauuacaggugugagccaccaugcccagccuuucuuaccguaauuucuuucuauaauucuuacuguagacucuuacaaaucuguccaagcucauacagcuaucaaguguuggagcugcauuuuaggcaugaaaaauaugagguagauuauggaccccuauagaccgauaugucuccuacacauguauuuuuuuuaaguuacaggaaauaguaaaaaccauaauacuuaaaaacaacaauaaaaagcagcauuuugcagaacacuugaagugguaaaccagaauaauguuguugcuaaguuuugugggguuuuuuugguuuuuuuuuuuuuuuuuuuugagaugaaaccuugcucugucaccaggcuggagugcaguggcgcaaucucggcucauugcaacugccaccucccagguucaagcgauucuccugccucagccucccgaguagcugggacuacaggcgugugccaccaugcccagcuaauuuuuauguuuuuaguagagucgggguuucaccguguuagccaggauggucuugauuucuugaccucaugauccacccgccuuggccucccaaaguguugggauuacaggcaucagcccccgugccuggccacuuucuaaguauuauuuacuguauaauguaaguaauauguucacugagugagcagaaauauguacaggauucacagguaagauguuaacuucuggauuuuaguauagaucuuuuguucauggagcuauguuaauaauaccugauacugguauuauaccuguaaauuuaaaaauuuaaaaguuacucugaaggcuguagaaauacagauuaaugauucccaaacuugucuggaugugggaaucaccuggagagcuuacaaaaaauuauugaugccugugucuuaaccugggacuguaaucugggcuuuggaaauuuuagaagauccuaauguaagacaaguuuggaaacuuuugaauucacggaauaaaaauaaucucagaauuaagauggcuaggggaggcugggcacaguggcucaugcuuguaaucccugcacuuugggaggccaagacaggaggauugcuuaagcucaggaguucaagaccagccuggacaacauagugagaccucaucucuacaaaaaauaaauucuaaaaauuaucuggacauaguggcucacaccuguagucccaccuaacuucguuggcugaggcaggaaaaucgcuugagcucaggagguggaagcugcagugaauucugaucaugccacugcacuccagccugagugacagagcaaggcccugucucaaaggaaaaaaaaaaagaugacuacaguuucuuuuuauugugguaaaauguacguaacaaaacuuaauaauuuuucaguguacaguucaguggcauuaaguacauucacauuguuaaccaucaccacuaucuaucugcagaacuuuuucaucaucccaaacugaauguguacucauaaaauuuuaugaguggcagcucuucaauuuuucuuuucuuuucuucugcuucagauaaccaccauucuacuuugucugucuagaaacuugacuauugcagguaccucauaugaguggaaucauguaguauuuguccuuuuuugucuggguuauuucaguaagcauaaaaucuucaagauucauuuaugaagcaugugauagaauuccccuuauuuuuaaggcugaauaguauuccguuguauguauauacuacauuuuguuuauguauuaaucuguaaaugguauuuggguuguuuucaccuuuuggcuauugugaauaaugcugcuaugaacauuggucugcauaucucucaucaagucccugcuuuaaguuccuuugggugucuacccagaaguggaauugcuggaucauaugguaauuugaaguacaauuuuuggaggaauuuccauacugcuuuccaugguggcugcacuauuuuacauucccaaaggcaaugcagaggagugccauuuucuccacauccucaucaacacuuguuauuuccuguuuuuuuuaaagcuauuuuuaugggugugaggugguaucuuacuguguuuuugguuugcauuucccuaaugauuagugauguguugagcauguuauguguuuaucggccauuuuuauaucauuuuuggagaaacgacuuuugaagucuuuugcccauuuuuuuaauugguugauaggguguuuagaguuugaagucagcauucucuuuacuaguauuaugauuuuaacacaagccauuuaaccucuuugugccucggauucucuacuggcaaaugggauaucauuuuucuguagcugcuuaauacaaaugcuagaaauagguuugauguggcacugccuaaucuagcauacauauggaauuguugcuguuagagcagccagcuuuaaucuauaagcacgucuucauuuucuguuuuagaaauaaucuuuugauuaauuucaguacuuaauuugaggaacuuuuuuuuccacgauggaagauuguucaaguuucauuuauaaaauucugccucauucauaacuuuuuguuuuagauauuguagugugagcucauggagagcaacaguauucucugcaauccuuuauaguaacuaauaauacuucgaauuguuauuguggugacauguuuuuguuuuaacucacuuuucugaguguuaaauaccaaaaauguuugaugggaugauacaaauaacauuucuccuuggaaaaaaagcaagucugaauuuacuauguuaguauuuucuaauuguuuuauaauauucucugacuagaauauugccuuuaauauaaggauuucggagauuugggugugguggugcacaccuguaguucaagcuacuuaagaggcugcggcaggaggaucacuugagguugggaguuugaggcuguagugcuccgcgacugugccugugaauagccacugcacuccauccuggguaacauagggagacugccaucucuuaaaaaaaauuucaggccggcacaguggcucacgccuguaauuccagcacuuugggaugccaaggugggcggaucaccugagguuagguguucaagaccagucuggccaauacauggcaaaaccccgucucuacuaaaagaauacaaaaaaaacuagccggacgcaguggcaggcgccugucaucccagcuacuugggaggcugaggcaagagaauugcuugaacccgggaggcggaguuugcagugagccaagaucacgccauugcacuccaaccuuggugacaagagugaaacugucucaaaaaaaaaaaaaaaaaaaaaaaucuuggcugggugcggugguucaugccuguaauuuauagcacuuugggaggccgagguaggcagaucacuugaggucaggaguuugagaccagccuggccaacaugguaaaacccugucucuacuaaaaauacaaaaauuagcugggcauggucaugggugccuguaaucccagcuacucaggaggcagaggaagaagaaucgcuuuaaccugggaaguggaggcugcagugagccaaggucgcaccacugcacuccaucuugggcaacagagcaagaaacuuguaucacauauuuagaauauuguuucccuccaguaucacauacaaacuugguuuauuuuaaaccacugaauguuacaauaagaucagacuauuguauauugggauuacaugcuagcaguauaggagguagugauucuuugaucauagacugcugggauugaguguuguuaguaaauaggguaguggcagauaaacagugggagcugagaccauugguuacauguuuuguacuuuggaauacuggauugcuacaaagacuccuuggagaccaauuuaucccuuuauaucaagaagccaaauuuuauuuucuuauuuaacagauaaaauggggccagaugagguuagcuuaugcuuguaaucucagcacuuugggaggccaagguggagggauugcuugaggccaagaguuugaggccagccugggcaacauagugagcccccccgccccugccaucccuagggggaaaaaaaaaauuagcugggugugguagcgcacaccuguagucccagcuacucaagagggugagaugggaggauuucuugaguccaguaguuugaggcugcagcaagcuacgauuguaucacugcacuccagugagaaccugucucuaaaccauaaaauuaaaaaaugaaguggguaagugcucauuggaaagacuguuagggaacuugaaagaugacuuuuaugauuuuauacauacuagaguaaacuuauuuuccuaaauaauauuuaagauaggucaaauuaauguauauuuaaacauuucccauauuauaauauuuucaggaaaauagauuuuuaaaauguuaaaaaugcuuuuaaaauaauuuuuaaaaucuuuuaaaauguuuuuaaaauaauuuuuaaaauuauuuuaaaaugcuuugucaugagaaaaauccauuuuaaauaucuuuuuuuguuuggagacuggagggcaguggugucaucauagcucacugcacccucaaccucucaggcucagauguuccuucuaccucagccucagccucucgaguagcugggaccacaggcaugcaccacaccccaccuagcuaauuuuuaauuuuuuuguggagauggggucuuaugcugccuaggcuggucccaaaccccugggcucaagcccaacuccucuugccucagccucccaagugcugagauaacaggcaugacuggcuguuuuuaaauucucuuauuuaauauuucauguaugaaaugaaacaguugaaaacuguguuuuuaagaacuauacuccacugauuaaaggaacaguagauaaaagguuauaaaauucaggucuccuagccgcugugucuuuuuuuuuuuuuuuuuuuuuuuuuuuuuugagaugaagucucacucuguugcccaggcugaagugcaguggcaagaucucaacccacugcaaucucugccucccuggguucaagugauucuccugccucagccuccuuaguaacugggauuacaggugugugccaccacacccagcuaauuuuuguauuuuuaguagaaacagaauuucaccuuguuggccaggcuggucucaaauugcugggcucaaacgauccaccugccuugcccucccgaagugcugggauuacaggccucuuugucuuuuuuuuuuuuuuuuugagauggagucuugcucugucacccaggcuggagugcaguggugugaucuuggcucacugcaaccugcgucuccuggguucaagcgauucucaugccucagccuccugaguagcugggauuacaggcgcauaccacugcaccuccggcuaauuuuuguauuuuuaguagagaugggguuuugccaaguuggccaggcuggucucaaacuccugaccucaggugauccacccaccucagccucccaaagugcugggauuacaggcaugagccaccacucccagccauugucacugcuuucuuaacaagaaugauaagguuuuuguuuguuuuuuguuuuaguuauauuauuuuuaguuuuucugucaguuacauuaauuuuuauuuuauuuuauuuuuauuuacuuauauguuuuuugagacagucuuacucugucgcccaugcuguaaugcaguggugugaucuuggcucacugcagccuccacaucguggauucaagcgauucgcaugccucagccucccaaguagcugggauuacaggcaccugccacugcgccuggcuaauuuuuuguauuuuuagggagauggagguuucaccauguuggccaugcuggucuugaacucuuggccuuaagugaucugccugccuuccaagugcugggauuacagaugugagccacugugccuggccuaaaaaaaauuuauuucgauuaaaagcauuuuuuagacuagucacauaugcaguaguggaaagaggggaaagaguagaacaaggaguuugaucugcaacuaacugaacagucaacugagguaacucacuaccuucagacuagccucugucaguuacauuuguaacuugaauaacaugcuuaaauuucuauuucuuguucuaucaaguuuagacauuuuguauugacuccauauguauaagauacagaaauucuuagcucuguauugcuuuuugccucuuuucuaccaucuauuuucccacuucuguuaacucuagcauuacuuuuacuauaauuuaauuuuaauucacuauguucugcuuauccagaagaaauucaagagggcuuauacauauauaaaacagguucugaguugauuaauaucauaguuuaaaaaacuuuuaaggaugaauucuuaagauaaauguguggagaaggaauaaaaagaguuuauuuucuuaguguacacucuuauccuccucugcgcaacuugacccuucuaaauuguaucuugaagauaccucugauguccuugggaacuuuuauuuuccaaccuguauacccagccauaccugaauuucauuaagguguacuguuuugcauauauucuugauucuaggaugccuucaacuguaagacccauuauugcuuuaaaauaauguuauugguugggaggggauugcauuaaaugauuaguccaauuaauuaauaaagugagaaaacauuuauaguuucuuauauagaggggaaaauaggcaaaaauaaaaauuaagucacuguuaauucuguuguccgccuuuauuuucuuuauccaaauaaaacuuuuuuuuucuuuaaaaaaaaaaaaaagagcuggguacaguggcccacaucuguagucccagcugcuuuggaggcugaggucagaggaucccuugagcccaggaguuacaagccacccugggcaacauacugagacccucucucuuucuuuaaaaaagaaaaagaaaaaaaaaauugacccuacuauuuugguagccuaucccuuuccaauaaaccuacucuucuauuuuaacuuauuuuuguggcuauauaauaauucuaugugugaauguaccuaacucguuuaacugguuccuguauuugcagccuuuccuacuauaaacaguguuguaaagaacauuucuuauagcuaagucuuugcucauauccaugauuuuuuuucuucugaugaaguagaauuuuugggcaaaauaggguaugcauuuuugcauacuuccuaauaaagaaaagcaaguuaacauuuuuggccacuagucaucacuaagauaaaacuuuuucuucuuuuuuagugaacacuuguccugcuccuucaccuuuuucuugcauggagacagcaauguuuguaccaguguggaaauuaaccaacaucaaccuguauaccuucucagugaagagcauaucacccuugcucaacagucuaauagcccauuucaagguagauuauuuuauuauauuagguauuugaucuuuuauugaaagauccuuauuugacuucauaauuuuacauuuggggauugauggaauucccccugaucuuuagccuaaugaugauuuugaugucauuuacuuuuuccuuccccauuacaguguuaagucagugaaauaaauuuuuaaauacagguauuaccaaaaaauucuugaccgugaauggugaaguaguuuaaaguguucuuuuagauagcauaauggauuuauauguguuaauguuuucaagguuaucuuguaugucaggucauauaagccauauuuuguuuguuuguuuuuguuuuuguuuuuugagacggaguuucgcucugucgcccaggcuggugugcaguggcaugaucuugguucacugcaaccuccaccucccggauucaagcaauucuccuaccucagccuccugaguagcugggguuacaggcgcguuccaccaagccuggccaauuuuuguauuuuuuuuaguagaacuggguuucaucuuguuggccaggcuggucuugaacaccugaccucaagugguccaccugccucggccucccaaagugcugggauuauaggugugagugagccaccauguccggccagagccauguguaacauagcuacaaagggacuuuugauacuauuuauacuaugaaaaaaguugaauucuagaagaaauauuuuauaagauugcugaauugccucuaaggcuuggcaguguguucuuauuuuaacuuuaaaccuaauauuugcuuuuuaaaguuuacauggcaguacauuauaaauauuuagauuuauauaucuauauuguuuuuccucagauugcuuuuucuuagaaugcuuuuucuuagugggagucaaaguaaauugaaggauacacaaauauucccagcuucuguuaaaaaucuuaagaguuugggcagacaauuuuuuuuuuuuuuuuuuuugagaugaagucucccucuguugcccaggcuagagugcaguggugccaucuuggcucacugcagccucugccucccggguucaagcaguucuccagccucagccucccgaguagcugggauugcaggcgugugcaaccacacccagcuaauuuuuuuuguauuuuauuagagacaggguuucaccauguugaccaggcuggucuugaacuccugaccucaggugauccacccgccucagccucccaaaaugcugggauuacaggcgugaaccacuaugcccagccugggcagacaaauuuuuaacaguuuauauaauaaacucagugucauacuuuaucuucacaguaacgaaguauaauaaguugauuuuucucuggaaugguuauuacugguuuccuuuucuuuuuuauaauugcacgauuauuugccacauuuuucacuguguucuuauuugguaaaacagucuuuuguuacuuauuugaugucugcuuuggguuucuaguuaucuuaugcccauuuggacuaaauggcacucucacaggacaggcauucaagaugucugauucagcuacaaaaaaauuaauuggugaauggaaacaguucuauccuaucucauguugcuugaaggagaugucugaagaaaaacaggaagauauggauugggaagaugauucuuuagcugcaguagaaguucuuguugguauggauccugaguauuauuccuaaggggaaaaugcaugauuguauguguuaguuauauuuugcugaauaacaaacaagucuaauaacucaguggcuuucaacaccaaagauuuauuccuuaauuuccugcccacauuacuuaagggcugcaucuuagcugguuuggcuccauguaucugcucauucuguaaccuagguuaaaugaauaucccaguagcuaggacaugcuguucuuaugagaacagaagaauaauagggacugaaccuaaccauguaaguguacucagagcuucugcugggauaugguguauguuacaucugcucacauugcauuagacaaagcuaguuaaauggccaagccaaagucauuggggcagggaaauauauucugucuagagggaagcaugcuuaggaugggacaguuaauugugaaugaauuaauauuuggaggcugaaaaguugacaaccuguguuguaugauguuuuaacauuugguaaaacuaccacuuccaauaacuuaagagacagaaaauguaacuaaagaauuuaugacuuuggcaugcucugccugccaaaagggucagauuuuuuuauauuuuuuuauuauuuauuuaauuuauuuuuauuuuuuugagguggagucucgcucuguugcccaggcuggagugcaauggcgcgaucuuggcucacugcaaccuccuccgccucccagguucaagcgcuuuucgugccucagucuugagaguagcugggauuacaggcgcaugccaccaugcccaccuaauuuuuguaaugcuaguagagaugggguuuugccguguuggccaggcuggucucaaauuccugaccucaagugauccaccuaccuuggccucccagagugcugggauuacuggcgugagccaccgugcccagccuaaaagggucagauuuuuucagauuggcuguauucucuauguccucucauucagggacccagguuaacaaaguacccacaucugggacauguuaaucucauagcagaagacagaagugagagaagcugcacugacccugcaggcacauuuaaagcuucuguuaggauguggcuuauaucacaugcuuacauuccagagcaagucacacagccugacaauggagugaagacauauacucuaccucagagaggcaugagaggaggcauggagaaaguauaauuuaggagauaauuggaauuagaaucuaccauauuguauuuaagggaaucuaaugguaauguuagacgugaagaucaccuuauuucaucuuuuuuuuuuuuuuuuuuuuccugagacggaaucucgcucugucgcugcucaggcuggagugcaauggcgugaucucugcucacugcaaccuccaccucccgggcucaagcaguucuccugccucacccucccaaguagcugggauuacaggugccugccaccacgcccagcuaaauuuuguauuuuuaguagagaugggguuuagccauguuggccagguugcucuugaacuccugacuucaaaugacccaccugccucggccucccaaagugcuaggauuacaggugugagcuaccacuccuggccuguuuuuuuuguuguuguuugucuguuuuuuuuuuaagaaaaagauuaccagugcucacuuuaaauaaacccauuacuacuagagcaguugugacagaaacagaaaaaacacacauuuuuuaggcuuuuaaaauagaggcauauagaaaaguaaguagaaaaugguucauaauucuaguguccagauuaccuuuguuaaacuuaaacaauaaaauugaaaaaguaauacacauuaaguuggucagaagugcacauaaagauuuaaaaaacacauuucuagaaaucuaaaaaaaggaaagcugccuuuuuccaaaucucucucagcaaagauaaccaccacugacagcuuauugugguuuauugugguuucuucuaaaaaagagaaaaaaaaaaaagaaaagaaaaacuuaugccaaagaagcuuauauuuauaaaaauguauuuuuauuuguauaaaugugauaccuacuuuuccauuauaguacuuuugagugaaacuaauucacuagucacaaagguaauugguuuuccugucccauuuuuuuccuuucagcugguguccgaaugaucuacccagcaugcuuuguucuagucccucagucagacauuccuacuccuagcccugugggauccacucacuguucaucuucuugcuuggguguccaccaagugccugcuuccacaagagauccugcuaugucuucgguuacgcuuacaccaccuacgucuccugaggaaguccaaacagguauagcaguaauuugucucaucagcucugguaauuuguuauuuuguguacaguaaguacuuaagaaauaauuuauuuugaaauaguuucaaacuucuugagaauuuacaaguguaguacaaguaauuuccuuagccauauuuccaaacuguuauuauuuacuccaucacccugucuguaugauguacauucauuaucauuggucuuuuucugaaccauuugagaacaaccuacagacaugaugucccaucacuccuguguacucaguguguuucccagaauuaaggacacucuccuauacaacuauuacucgauccucuuagucagaaaaucagcauugauacacugccauccaguuugcauucccuguuuuagauauuuugcuuucuguauuuaaaaguagcgugcuuuuauuuuuaaagguuuauguguuuaucuauaauuaaaauuacuccaacagagcagcccauugcuguguucuaauucuuagcccuuaaguccuacaaaaauaaacccaagcuuuuacaguaacugucaauacagaacuaaagcguuuuagcuauuaaaagggguuuaguuaccaaggugcuuauuuucagcaaaacgcccuguuacucagaagaacauacgcauauacuaaaguucugacccaucgauucaugcaacaguuuauaucucugcccucccuccaucuaccuuuaaaacaaaaacacagaagaacuuuuuacaauggaggagaaacguauaaaaacacagaagagcuuuuuacaauggaggggaaauaugcucaugcucagcugaccuuacaaaaaagacugucuaauuuccaacuaaaugagaacacuaaaguguuuggcuaaaauccagcaaugauugacugacccaggucagaggcuggcagggacagaagggccagagugcugccgcugcaggggcucauccuggccuccaaaccccaccuugauguggaagccaggcucugugcagcagcuccauggcugguguccagggccccuucgcacuacuccgaaguccuuccagucuccccaccucuggccagccucugaccuugaugaugucacucugggcaucaggauagucugguuugcuuauacagcaugauccaugggacaccuccuuccuugcccucagcccaccucccccgacacgccaccgugugcuggcccugccuggcuccugagaaccccacucuugguacugagagugguagguuacagagauguacuugauugccacauuugccuaaugagaucugguuccaaaaaguagcaugcuuuuuaucucaaaauauaaauaauuuuaccagauagcuggagcagcuuguaucacaaauuaauaaaaaacccaaauaauguuacuuuaaaccuaccuuuauucuccuacagccuguuuuuuuguuuuguuuucaguugauccucagucuguccagaagugggucaaauuuucuucaguaucugauggcuucaacuccgauaguacuagccaccauggugggaaaauacccagaaaauuagcaaaucaugugguggauagaguuuggcaagaaugcaauaugaacagagcacagaacaaguguguauuuucauuuauaaguucaaaaauugcauguugauaauuacuuauaauuagaagauaucuaaaguauaaacagucauuuguuugauuuuucuuuaacucauaauguugaucuuuaaaauuaauuucaaugcuacauugagguuugauagaaaauuuuaugaauuuuaaagaauuuuguaacuuuaaaucuuaggaggaaguauucugcuucaucagguggucuaugcgaagaagcgacagcugcuaaaguggcauccugggauuuuguugaagccacacaaagaacaaauugcaguuguuugagguagauuauuucccgaucgauugaugccuaugugugauaguuuguuacgccacugaaugcuuaugcccacuuuauuugaaacagcuuacaugaacauaugucaggauuuuuuuucaaaagaaaauucaggaaaaauauuucaggaauuugaagcugauuauagaaguacauguaaauauaagcuuucaguucauucacuguuaccagaggcagacucugaaaguuuuguuuccuaguagcuaaauaaaagacaauuuuauauggagcuaugguauauauaguaucuauaagcuauacagccauauaaaucucuugagaaaagcauuccuuccucaauggcacuaccugagaaauuuaucccaagaguucuuucuuuuuuuaaaaaaugaagagacagggucuugcuuuguuacccaggcuggagugaucauggcucacugcaaccucaaacuucuggccucagucgauccuccugccccagccucccaaguagcuaggguuauaggcaugugccaccacaccuggcuaauuaaaagaaaaaaaaauucguagagaggggaucuugguauguuguccaggcuuauuucgaacuccuaaccucaaacaguccuccccuuggcuuuccaaagugcuaugauuacaggugugagccaccauaucuggccuacaguaaucuuuuuuuauuuuuuauuuuuugagauggagucuugcucuguccccuggucuggagugcaguggcgugaucucggcucacugcaagcuccaccucccggguucacgccauucuccugccucagccucccaaguagcugggacuacaggcgcccgccaccaugcccagcuaauuuuuuuuuuuuuuuuaaaguagagacaggguuucacuguguuagccaggauggucucaaucuccugaccucaugauacaaucuuuuuuuaauaguaaauacaguguuggguuuugaagaguaauuucauuucuuuuuuuuuaagcuuuuauuuuugguucaggguuacaugugcagguuugugaaauagguaaagucaugucacaaggguuugcuguauagauuauuuugucacucagauacuaagccuaguacccaguaguuacuuuuucugcuccuguugcuccugccagccuccacccucaaguagaccccagugucuguuggacccuucuuuguguccaugaguucucaucauuuagcuaccacuuauaggugagaacaggcaguaauuggcuuucuguuccugugcuaaggauaaugaccuccagcucauccauguuccugcagaugacaugaucucauucuuuuuuuauggcugcacaguauuccaugguguauauguaccacauuuucuuuauccagucugucauugaugggcauuuagguugauuccaugucuuugcuauugugaauagugcugcaguggacauuugcguauaugugucuuuaugguagaaugauuuauauucccuggguauauaaccaguaaugggguugcugggucggaugguaguuguagcucuuugaggaaucaccacugcuuuccacagugguugaacuauuuucacuuccaucaacaguguauaaauguuuccuucucaaccucgccagcaucuguuauuuuuugacuuuuuaauaauagccauucugacuggugugagauguuaucucauuaugguuuugauuugcauuucucuaaugaucagugauguugagcuuuuuuacauaugcauguuggcugcacauaugucuucuuuugaaaaguuuucauguccuuugcccacuuuuuaacaggauuuuuuuuauauauaaauuuaaguuuuuuuagauacuggauauuagacauuugucagcauaguuugcaaaacuuuucucccauuauguagguuaucuguuuagucuguugauaauuucuguggcugugcaaaugcucuuuaguuuaauuagaucccaucugucaguuuuugcuuuuguugugauugcuuuugacaucuucgucaugaaauuuuugcccauuucuguguccagagugguauugucuagguugucuuccaggguuuuuauaguuuuggguuuuacauuucagucuuuaauccaucuugaguugauguuuauguauuaaggaagggguccgauuucagucaucugcauaugacuagccacuuauaccagcaccauuuauugaauagggaguccuuuccccauugcuuguuuuugugagcuuugucaaagaucagaugguuguggcagugcagccuuauuucugggcucucuauucuguuucauuggucuaugugucuguuuuaguaccaguaccaugcuguuuugguaacuguaguccuauaguauuguuuaagccagguaacaugaugccuccagcauuguucuuuuugcuuaggauugccuuggcuauuugggcucuuuuugaauuucauagaaauuuaaaaauaguuuuuccuaguucugugaagaaugucauugguaguuugauaagaauagcauugaauccaaauugcuuugggcaguauggccauuuuaaggauauugauucuuccuauccaugagcauggaauguuuuucuguuuuuuugcaucaucucugauuucuuugagcaguguuuuguaauucuuauuguagagaucuuuaaccuuucugguaagcuguauucccaguuauuuuacucuuuuuguggcagaugugacugggauugcauuucugauuuggcucucaucuuggcuguuguugguauauagggaugcuagugauuuuuguacagugauuuuguauccugaaauuuuacugaaguuguuuaucagcugaaggagcuuuugggcugagacugugagguuuuccaggucuagaaucauguugucugccaacaggguuacuuuuguuuccuuucuuccuauuugaaugcccuuuauuuuuuucucccugauucuucuggccaggacuccccauacuauuuugaauaggagugagaggaggcauucuuaucuugugccacuuuucaaggggagugcuuccagcuacagucuuuuuuuuuuuuuuuuuaaugauaaauacagugauggauuuuguggaguaauuucuuauaacauucuuugggcagcuguaggugaaauguugaaauaagauucagaaaauaggauucuguaagggaagaacugucacaagggagcaaaacucaaagcaugacaaaacugucacgcuuucuaauggauuauauugguugaaugauugguagaagaauagaugaacguggaauucuuuagaaauuuauuuaguuuauaaaggccuuuugauaagguuugguuaugagaaguuuuaaaauuauguugccuagaguuuauuauuuuauccugcagauuaaacauagaucauaggcuuuugcauucaaguaaacaguaauggccuugacaucccuagucagaacuugugauggaauagauggucaccugucuuucucauggaagugaaccaaacaaauggagugccugcagguuagggccaagguuuuucuuacauuugcucuguugguuugaauauauaauaacagacucucucaagugugcuguuauguuuuugcauaaauugaauauucuuauggaggcucuuuggauuaaagaauacguaauuuuuaaaagucuggcaacuuuguugaaaauuuaccucuguuagagagauuggaauaaaaacaaggauauauuuagcuauuguuuagcaguuuaaaauagcuaaaaaaaccacaccuaaucugaacauaauuuguauaagaaugggggucagcaaacagugaugaauucgccauauuuggcccacugccuguuuuguauggccuguaagcugaaaaugauuuuuuuuaauuuguuugagacgauaucucgcagacaggagugcaauggugugaucucggcucacugcaaccuccgccucccagguucaagcaguucuccugccucagccuucagaauagccaggacuauaggcacgcgccaccauaccuggcuaauuuuuuguauuauuuaguagagacgggguuucaccauguuggucagucuguucucaaacuccugaccucaggugauccaucugccuuggccucccaaaguguugggauuauaggugugagccaccaugcccagccaacugaaaaugauuuuuacguuuuuuaaaaguugaaaaaaauaaagaauguuuuaugguaugugaaaguugugugaaauucggauuucaguauugauaaauaaggauuuauuagaacacagccacauucauuuauuuacauauugucuguggucacuuuuaccccacaauggcagaguugaauaguugugacacagucuggcccccaggggauaaaauauuuacucucugguucacuacagaaaaaguuugcuaaucccuggucuaagacuaaaagaaugcuuaaauguaaguaagcuuuucccaaacuaccauuugaccgagcaauccuauuacuggauauauauacccagaggaauauaaaacauucugucauaaagacacaugcacgggaauguucauagcagcacuauucacaauaacaaagacauggaaucaaccuaagugcucaucacugacagccuggauaaagaaaaugugcauguacaccauggaauacugugcagccauaaaaaaaaaugagaucaugucuucugcaggaacaugaauggagcuggaggucauuuuccuuagcaaacuaaugcaggaacugaaaauuaaauauugccuguucucacuuauaagugggagcuaaaugaugagaacucauggacacaaagaagggaacaacagacacuggguccaguggaggcugggaggagggagaggagcagaaaaaauaacuauuggauacuaguccuuuaauaccugugugaugaaauaaucuguaaacaaacccccaugacaugaguuuaccuauauaacaaaccugcgaauuuaccccugaaccuaaaauaaaaguugagaaaaaaauaaauuaggauuuucuuucccacuaguggaauuuuuaucaaauaguucuguuuuaguuccuaaacuagacuuuuuuauucuuuuugaaaagguggauuuuaaguauuuugucuaaaaugguuuuagaggaaggcauuaaaauaugcauguuggcaacacagguuuaaauucuuggucuuuaagcugaacuuuuauuuuuaaaaaguuguuuucucuuguccaggcgcaguggcuuaugccuguaaucccagcacuuuggguugcugaggcagguggaucacgugaggucaggaguucaagaccagccuggccaacauggugaaauaccaucucuauuaaaaauacaaaaauuagccaggcaugguggcacacgccuguaaucccagcuacucaggaggcugaggcaggagaaucgcuugaacccggaaggcagagguugcagugagccaagauggcguuacugcacuuugguguugguggcagagcgagacuccgucucaaaaaaaaaaaagucauuuuuaaaaguauuuucagaaauuucucagaggcauauagagauuuaauaugcuaaaauuuuacauaaucgauacgugugacuugcuuugguuaguuugcuccuuuaguaaauacagcauuucuaauaauuuacuuaaaaaaauuaguauuacauuuuguacuuuaggucuucugcccaccacaaaucuagcuuauuucuuaagugaagguaagacagauagacagugagcuacuacauguguauccucuuugccauagaauauauaggagguuggggggcauacauugauaacugacucuguuaaaucggccucuagcucgcucucaaauccauuucugcuuuuucucuguucuguucuguauugcagggaauuaaauuuccuagacucguuugcuuucuggaguuggcuaauaggaggcacuaacagaagauuggagggugagaggagggaagaagccagggucuuuccccagucccuuuuugagccaacuccagcagcagcucccuuguguccuauuaacacagccccuuccucauggucccaguuacuacugagcagauccugcuaugguucuagcaccauccugagcuucugggauauggugagacuacaucaucuuauuguccuuucagugcuagaagucauagaagcucccugcuauuacuagucucuggguuuccucacuuuccucuguuuuguauaaccgguucucuauagugaauuucuucugugugaaagauaggucuggacccugccugauaacauuggcuucucuuaaaaauugauuugggaagaaaaaaaauucauaacuguaacagacaauuuacaugaauagaaauuauuuuaagaaauuuaaaguauaugaauaaagccuaaguuccccuugaccauccuuucucucccccaagccuacucacucucccuagaaguggcuaguugccaauuagauacuauuucuccauacuuaauuuuauguauucuccucucaacacauaaauauuauuauuuuuuuagagacuagcugugucgcccaggcuggagugcagugaugaaaucauggcucauuauagccucaaacuccugggcugaaacgauccuccugccucagucucccaacuagcuagaacuacaggugugugccucaaugcucggauaauuuuuaaauauuuuguagagacggggucaugcuauguugcccaggcuggucuugaacuccugggcucaagcgaucuuccugccucagccucccaaagugcugagauuacaggcaugagccaccaugccuggccucacauaaguauuauucugauuuauuuuucacagcuaauuuuuuucacuuaaugugccucagaucuuuccauauuaguuacuuauauagcucugcuucauuguuuaaaaauuuuccuguggcugggugugguggcucauuccuguaaucccagcaguuugggaggccaagggagaaggauugcuuggggccaggaguucaagacuagccuggacaauguagugauaacucucuuuuuuaaaagaaaaaugaaaaaaauguuauuaauauuccacugaauggaaguaucauaguuuauguaaucauucuggauuugauggacauacaguuuguuuccauagguguuuuuugcuugugcuugcuuuaaaaaaaaaguaauacugcuguaacuaucaauuauuuaguagguuuuuuugaauccuuacucugugacagaagguguccuaggcucagaauacacuagcuaacaaagcuccugcuauuaugaagucugcauucucuuggaagugaggcagauaauuuguuuuuaagaauauauauauauauauauauauuuuuuuuuugagacagucuugcucuguugcccaggcugaagugcagugaugccaucucagcucacugcaaccuccgucuccuggguugaggggauucuugugccucagccuccugaguagcuggugcuacagguauauaccaccacauccagauuaauuguuguauuuuuaguagagaugggguuuuaccauguuggucaggcuggucucaaacuccugaccucaaaugauccacguaccuuggccucccaaagugcaggaauuacagacgugagccacugugcccaggcuuuagaaggauuuuaaauccuuuuuaaauuugaaugagugcugggaaggaaauaaacuaggugggugaugugauaaagaguuguaggcgagagggcuauuuaaguacgugugacaucaaaaaagguucuaccgauuuuacucacacuuuuugcauauagaaaauguugguuuuucuugugauuucacugaucugagaacuauccucaaaauuauuuuuugccauuauaauaagugagaagcauaaaauuguuugucgcauuuuucauuagcgagauugaauagcgcacauuuacugauauuagacuuuagugugguggaauguucauaggaaaacugcacauagaaagcaggcugcucgccccguccgggaggugaggggcgccucugcccggccgccccuacugggaagugaggagccccucugcccggccagccgccccguccgggagggaggugggggggucagcccccugcccggccagccgccccguccgggagggagguggggaggggucagccccccgcccggccagccacccuguccgggagggaggugggggggucagccccccgcccggccagccgccccguccgggaggugaggggcgccucugcccggccgccccuacugggaagugaggagccccucugcccggccaccaccccgucugggagguguacccaacagcucauugagaacgggccaugaugacaauggcgguuuuguggaauagaaagaggggaaaggcggggaaaagauugagaaaucggaugguugccgugucuguguagaaagagguagacaugggagacuuuucauuuuguucuguacuaagaaaaauucuucugccuugugauccuguugaucugugaccuuacccccaacccugugcccucugaaacaugugcuguguccacucaggguuaaauggauuaagggcagugcaagaugugcuuuguuaaacagaugcuugaaggcagcaugcucauuaagagucaucaccacucccuaaucucaaguacccagggacacaaacacugaggaaggccgcaggguccucugccuaggaaaaccagagaccuuuguucacuuguuuaucugcugaccuucccuccacuauuguccuaugacccugccaaauaccccucugcgagaaacacccaagaaugaucaauuaaaaaaaaaaaaaaaaaaaaagaaagcaggccaggugcagugacucacgccugaaaucccagcacuuuggaaggccaaggcgggaggaucacgaggucaaaagaucgagaccauccuggccaccauggugaaaccccaucucuacuaaaaguacaaaaaaaaauuagccgggcguggugaugcacaccuguagucccagcuacuugggaggcugaggcaggagacucgcuugaaccugggaggcagagguugcagugagccgagaucgugccacugcacuccagccuggcaaaagagcgagacugucuaaaaaaagaaaaauaaaaagcaaacuacaguauaaaguggguuacagaaagucucaaugauguauucauauguaaaaaauuaaaggagcugcacacuuaaaugugcacuauuuauuguaaguuauaccucaauaaaagguuuucuuuaaucuucauaaaaaaaaaaagaaaggcugcuaaguaaaaagcaauacauuaaauuucucauguuaacauuaaaguacugcauaccuaacaucaauaggaaaaaauaaucuaaaaggauuacucuguugguuugugcuuugaggacaauuucuuuuuuuuacaaagauugcucaaugugguuguguucuagcaugaaguucaguuguuuggccuugcgcagugguucacaccuguaaucccagcacuuugggaggccgaggcgggcggaucacagggucaggagaucgagaccauccuggcuaacgcagugaaaccguguuucuacuaaaaauacaaaaaaauuagccaggcuugguggugggcgccuauagucccagcuacucgggaggcuaaggcaggagaauggcgugaaccuggcaggcagagcuugcaguaagccgagauugugccacugcacuccagccugggugacaagagcgaggcuccgucucaaaaaaaaaaaaaagaaaaaaagaaauucaauuguacucucuaaagaaacuagcuuuuagaaagaggucuguauagaagaaaagggcugauuuaauguugucaaaaauuuagagaacugcugcuauuaguauguagccccaguuaauaguuucuuacucuuaauagcuggguaagugaauguauggccauuuacuuuucacaucccuuguacacuugggacauaacuaaauaguucaccucagaugaauggagauccuauuucuccuacugccuugcauaaaauagacuaauucucaaacuuuuuugucucagaacuuauuuacagucuuaaaaaauuaccgaagacugcaaaguacguuuauuacaucuauuuauauuuuagagaaauuuuaaagcaccacuuauuaaaaacaauaauuucagugcauauuaacaugaauaaaauagacauccacuauauuuuccaaaacaguagccaaaaagcuaauugaguggcauuguuuuacaguugugcaagucucuuuaauauugaguguaguaagauaguugaauucuuauaucugcuucugcauucggccuauugcuggauauugucuugguugaaguauaugaagaaaauccagccucauguagcuaugcaauuggagaagggaagagaguauuuuaauaacuuuuucagauaauuguggauauucuucuuugauacuacaccaaaaauugacaagugguaguuucuuaaggguugguuggaauguggaaucuaaagcccugucagugguuguacuucacuaauaacugaauggaucuuucgauuuuguaacaucaugcauuggucauuugaaaaauaucaguucacuggguuauauagaucugaauguuggcacauuuuguuauauauacucaucucuaaauauccguguaggaucgauauucuagaacccucacagauaacaaaaucuacggaugcucaaguccuucauauaaaaugaguuaguauucauauaacccguaugcauccuucaguauacuuuuuuuuuuuuuuuugagauagggucuuugccucuguugcccaggcaggagugcaguggugucaucuuggcuuacugcaaccugccccucccuggcucgagcgauuuucgugccucagccucccaaguagcugggacuacaggcaugcgccaccacgcccagcuaacuuuuuguguguguguauuuguaauagagauuggguuucaccauguuggccagccuggucuugaacuccuggccucaaguaauccacccaccucagccucccaaaguguugggguuacaggcaugagccacuguaccuggcccuucaguguaaacaaucuguaguuuguuuauaauaccuaauacaauguguuacguaaauaguuguuauaccguauuguuuuuacaauuuauauuauuuuuuauucuuguacuguuaacuuuucauuuuugaaaaauaauauuuuucaucucugguugguugaauuugaggauguggaauucagccaaugcagaguaucaaaauauuucauucauuaauauugccagugaucucaccugaaaaguauuuaaguauuagaaagcucaagcacugugucagauaguuuuccaaaauucuaaauauugcagugguaccaacuguauuagcaguaguagucauuguuuagcagucaagcucaaaaugauuaguucuuccuuaaaugacaaacucauuuuguucauguuugauaaccuaauaaacaaaucugccaaaugaccaaauauggauaaucuuaguuuaucuaccaguccuuuguucuucaaaugguguuucaugaaaaaagcuaguuucagcuuguaacucagucguacaagcgcuuuuccucaaaauagccauuguacuucaaaucuauagcagaaaugcuuuauaugcacuaccuauuucuuuauacagaguguaaaaagauuguauaaggauugagauuaauaaaaauuauuuuugcugucuucaugaaggacauucuuaagugauacuaucauaaaaaacaacaaacugaauguguggugguggagaaagcagugacuacuacugcuaguacaguugguaccacucccuuugauucauguucaguugcuagaaguuuugcugccuauuguuuuugcaccaucuuuguaaauuucaacauaauaaaaaagucagauacuguuuugaugcuauuaugaaaauaguuuugaaccccuguagccccugaaaaggaggguucauagaccauacuuugaauuuaguagacaaauauuugaauaauugaugaguuaaugauacuguuauuuuuuccuuuuuauauucuuuuuuucaguuucuucucuugauuuagaaguuugguguucuauuuuuguucuuuuguuaauugaauuaaucauuuauuaugccugcuuuccuuaaagucuaaaguuagagucuacgcucuuuuuauggaaugaacaaagaccuuggaauacuuuaaucuugcuccucaaaucuuucaugcuuuuuuuuuuuuuuuuuuagcauuuuaguucuacucuguuuuguuauuagaaacuucaaacauggacaaaaguaagcgaauugggcaaugaauuccuguuuaucaaccauucguauucacuuacuguguuugcuucaacuagaccuuuucucuugcugaagaucuuuaaaauuuguuuaauuuacuuuauuuauuuauuuauuuauuauuauuauuauauauuuuuugagguggagucucauucugucacccaggcuggagugcagugacgugaucuuggcucacuugcaaccuccaccuccuggguucaagugauucuccugccucagccuccugaguaguugggauuacaggcgccugccaccacacccggcuaauuuuuuguaguuuuaguagagacgggguuucacuguguuggcuaggcuggucuagaacccccgaccucagguguuccguccgccuuggccucccaaagugcugggauuacaggcaugagccaccaugcccagcccaauauauuuuauugaacuugauuuaucuaaaauauuauuuugacauacaguaauugugaugaaacauuagugauauuuggcauuucuuuauuuuauaacaugucuuggaaaauugguauuuuacaucuauagcacaucucaauuuggacuagccacuugucaagugucuaauagcuacauguaacuuguggcuaccauuauuggauagugcagcuuuauaaauuagguagaaauaggacugaagggcuggaagauacagaaaagaugaauuucuauucaauauuaagaauuuaccuucuagcaguuggagcuauuugaugagggggaugcaucuccuuauacaguaguaugguccuugucauugaaaguauucaaaaagaacccauucaagccaaugagguggcucuugccuguaaucccagcuaccugggaggcuguagugagcgcuaaucgcggcacuguguuccagccugggcaacagcaugaggaaaaaaaaagagaagggauuauucauacguuggguaggaccugcuggguuuuuuuuuuuguuguuguucuugguuuuuuguguuuuugaacaaauuucuguguuuaaaaaaaaaaaugcucuuuuacaaaguucaggcugggugaguggcucaugccuguaaucccagcacuuugggaggcugaaguggguagaucacuugagaucaggaguuugagaccagccugggcaacauggcaaaaaccggucucuacuaaaaaaaaaaaaaaaaaaaaaaaaaaaaauauauauauauauauauauauauauauauauauauauauguguauaguguguauguguguguguguguauauauauacacacacacauacacacuauacacauauauauaguguguguguauauauauaguguguauguauauauauagauauauauaguguguguguauauauauauaguguguguauaucuauauuauauauauauauaaaauuagacugaugugguggcaggugccuguaaucccagcuacucgggaggcugaggugggagaaucauuugaaccugagaggcagagguuacagugagcggagaucacgccacugcacuccagccugggcaacagagcgagacugucucaaaaguuaaauaaauaaaauuaaaaguucaaacaguacacaagaauauaaaauuaaaaauuaacagguuccccucuuauguauguaggucugccuguugcuuucuuucacacaaauggaaucaugcuguauuucugcaacuuauuguuuuuuugauaaacagccuggguguuuauccauguuagcacuuacagauucauucuuuuuaaaaaguucauaauacugcauuuuauagauauguaauacuuuauuuggcaaauccuuaugcuaugcucuugauaaagguuuuuaaagcaaaucuuaaauauuacacuucugcaguacuucaguaugcggcucuaaaaaauacgaauaucuucuuacaugaauauaauucuaccgucauaccuaauauuaugauaccuuguccagauuuucucagaaaugucuuuuuguagauaguuuauuugacuaggauucaaacaaggaguaaacauuugguuguuauguuuucuaaaucucuccuuuuaguugucuccugcucccuuuucaugacauugacucgguugguaaaacuaggucaguuccuccuauagagugccccacauucuggauuuuucguuuuacuugucauguaauuuuacuucuuucaguguaauuuaauuucuuccuuuuuccuuugcauuucuauaaauggaagguagcuguagagcugagcuauccaauacuagcuguguuaguaacuacuauuggcuauuuaaauuuacaguaauuggauuuaaauacaauuaaaaauucaguuccucagcuggguacagugguucaugccuguaaucucagcacuuugggaggcucucuugaguccaggaauuugagguuacagugugcuaugauuguacugcauuccagccuuuuaagagacagagcaagacuugucucuuaaaaaauuaguuccucaauuggacuagccacaauucaaguacucaagagccauauacaggcugggugcaguggcuaaugccuguaaucccagcauuuugggaggccgagguggguagaucuuuugaggucaagaguucaagaccagccugaccaacauggugaaaccccaccucuacugaaaauacaaaaaucagcccagugugguggcgggcaccuguaaucccagcuacuugggaggcugaggugggagaaucgcuugaacgcaggagccagagguuguggugagcugagaucgugccacugcacuccagccugggugacagagugaaacugugucucaaaauauauauauauauauauauaaaaacauauacagaacuucccaucaucauagaaaguucuagacagugcucagugcugaucugggggcuugauuacuugauuagacucaacuucaauauuuuuggcaagaguacuucauagaugguggcuguguugcuuuguauuauguuacgucagagagagacaguaucugguugucccauaucuaguaauguuaagauugauuagguggggaucagccugacccuuucauuguauacuuuuuuuguuuguuuguguuuuugguggggggugggacagagucucgcuaugucgcccaggcuggagugcaguggugugaucucagcuugcugcaaccuccaccuccuggguugaagcgauucuucugccucagccuccugaguagcugggauuacaggugcccaccaccacgcccagcuaauuuuuguguuuuuaguggagacgggguuucaccauguuggccaggcuggucuugaacuccugacuucaugauccaccuaccucggccucccaaagugcugggauuacaggugugagccacugcaucuggccuuauuguauaguuuguaauaauguugacaaugaauaaagacaauuuaucuucuuccuccgaaaucucugaccucuuucuugccuuauugcauuggguaaaacguucaguaaaauguuaaauguugagagcuaauauucuugcuuuguucuuaaucuugagaaauuauucaugcuuaaacaucaaguaagauauuaguuguaguuuuucauagauauccaucagaucaagcaaauuuucuuuuauuccuugcuugccgaguguauauaaauagggguugaauauauuaauaguauuaauaggguuuuuucuauaguuauugagauaauaugguuuucuuuuauucuguuaaugugaugcaugauauuuuuuucuuuugaaugcuacaccauacauucccagaauuaacuucauuuggucaugauguguuauucuuuuauauuuugcugguuugaguugcugauauuuuguuaauuauuuacaucuguguucuuaagagauaauggucuaugguuuucuuuuuguguaauaucuuugauuuuaauauuaggauaaugguggauuucuccuauguccuuuugaaacgaguuugguuuuuuuugauaacuuugguucuuuuuuuucucuaugcacaauaagauaucucaggcucuguacaaaaaggugucucggccgggcgcaguggcucacgccuguaaucccagcacuuugggaggccaaggugggcggaucacgaggucaagagaucgagacuauccuggccaacauggugaaaccccgucucuacuaaaaauacaaaaauuagcuaggugugguggugcacgccuguaguuccagcuacuugggaggcugaggcaggaaaacugcuugaaccugggaggcggagguugccgugagccaagauugcaccacugcacuacagccuggcaacagagugagacucggucucaaaaaaaaaaaagugucucaguaugucuucucaacagaguuuuucaaauaagugccugucacugcuuuuuaauacucuuucuggauagcucugauucagcaaaaaaguaaaauuuaaaaaguaaaaccuaaugaauacugaauguguaaacuccauaucuuaccacauuuuaaaaguuucuuggccaggcacgguggcucaugccuguaaucccagcacuuugggaggccgaggugggcagaucuccugaggucgggaguucaggaccagccugaccaacauggaaaaaccccgucucuacuaaaaaugcaaaauuagccgggcaugguggccacaugccuguagucccaucugcuagggaggcugaggcaggagaaucgcuugaaccccggagguggagguugcggugagcugagaucaugccauugcacuccagccugggcaacaagagcgaaacucccucucaaaaaaaaaaaaaaaaaaaguuucuuaguguaaaaauaauguuauguguauauauaucucucauugaguggaaaucucagugcgcacugaaagaaaucuuuuuuuuguuuguuuuuguuuuuguuuuuuuugagauggagucuugcucugucacccaggcuggagugcaguggcgugaucucggcucacugcaaccucugccuccuggguucaagcuauucuccugccucagccucucgaguaggugggacuacaggcgcgugccaccacaccuggcuaauuuuuuauuuuuuguaaggacgggguuuuaccauguuggccaagcuggucucgaacuccucaccucaggugauccgcccaccucauccucccaaagugcugggauugcaggugucagccaccaugcccagccuagaaaucuuaaacuuaacaaaauuguuugauuuuuagguguaucauuuaaguucuucguuuuagaauugcuucaaauuaugaggaagaaauuauuuuaggcauuuucuuucccuuuucuagucaguuuauucuuuuuguagugcuaaguauuuggagaagguagguauggugugaggcccaucaaucagucaauucuagcacuuuccagacugauguaacuucuauuuaguagaguagaauacgcuuucuggccaguugcuguaggauuguaggugaugacuaagcuuagccaagccauuaauuuauaauaauuacuaacaggaaauaucagguacauuuaaaaaugaguaaauuucaagccuuguuauaccuuuuaaccuuaacuagaaucuuaccucuauauuuaaauuagauacuaaaauauuuaaaucauguaagacauaaucuuuggcugucugaucacauggcuauuaaaugagcaugagauaauuggcuuuuaugaauguuucugcaugcccuuauauuuuauuuaggucacgagcaaaguauuuuuuuccccuuucaaauucaaauuauuuuacuuuuaguauuacaugugaaaaagaaaugauaaccgaagugucuaauacuauuaacugguauuauacuucgccauaauagugauacuguaaauaugaaaccuuuauuuucacuuuucaggcacaaaaaucucaagucaagaaaugcuggacaacaaggacaggcaccaucuuuaggucagcaacaacaaauacuuccuaagcacaagaccaaugagaagcaagaaaagagugaaaagccacagaaacgccccuugacuccuuuucaccaucgugugucuguuagugaugauguuggcauggacgcagauucagccagccaaagacuugugaucucugcuccagacagucaagugagauuuucaaauauccgaacuaaugauguagcaaagacuccucagaugcauggcaccgaaauggcaaauucaccucaaccacccccacuuaguccucacccuugugaugugguugaugaaggagugacuaaaacaccuucaacuccucagagucaacauuuuuaucaaaugccaacaccagaucccuugguuccuucuaaaccaauggaagauaggauagacaguuugucccagucuuucccaccucaauaucaggaagcuguagaaccuacaguauauguugguacagcaguaaacuuggaagaagaugaagccaauauagccuggaaguauuacaaguucccaaagaaaaaagauguagaguuuuuaccaccucaacuuccaagugauaaauucaaggaugauccaguuggaccuuuuggacaggaaaguguaacaucaguuacagaguauguauuuuuuuuaauagucaccauuauaauuuaaggguggaagugaugcaaguucuuaauacuaggacucaguauuggauucaagguaggauuuacaagaauaaauucauugaguauuaacuuugcauuauuccuuuacuguguuuuuuccucagggaacuucuucauuaugaaauaacuuuagccacaaaaaguggagaaaauaauguguaaacacuuguacaucagccaacuuaaggauuuuacauacaguuagaauucccauguacuguuuuucuucuuccagucuuccuuccacuguccugaauuugguaccuuuuuuuuuuuuuugagacagagucucugucacccaggcuagaguguagaggcacgaucuaggcccacugaaauuuccgccucuggguucaagcgacccuccugccucagccucccgaguagcugggauuacaggugugagccaccacacccagcuaauuuuuguauuuuuaguagagaugggguuucaccaugcuggcuaggcuggucucgaacuccugaccucaagugauccacccaccucggccuccugaaguguugggauuacaggcaugagccaccgcaccuggccucaauuugguacuuauuauuucaguacauguuuuuauacguguagcucuaguuauucauuuuaauugcuuuaugguauuuccuuaugaauauauaguaaauaccuaaacucuuaaagauggauauguugguuauuuucaguuuuucacccuaacauuuuccauuuuguuugguacacauuuccuuguuuacuuguauaagaauuuuuuuaggaaauacaucuaaaagccauuuucaacauggcuauguccauuuucaacauuaaggguuguugcccaguugcaguucagcaacugguauauaguuuaaacccucaugaaccagcaguguaugagaauggcuguugcacuauauuuuccucuauaguuggucuuacaagauuuaauuucaguaauuuacagcaugcaaaaugucaucucauugucuaaauaugugucuuccagauuucuagugagauugagcaucauuuaaaauguuuuggguguauuuagguuuccuguucugugacuugccuagucaucguauuuuuuaguccauuuuucuuuuuuuucugauguauuauuugcaugcucuggguauuaauccugcauuaguuuuaugugcuauagguuucuuccuccauuggugguuugccuucuuuguccacuguauuaauguuauacuuugggcagaagaaggcuuuuuuccagguaucccuugacuuucuauguuguuauuaauacauuuauagucugucuaauaagccuuuuacauauaaauuuuucuaaaaggugaaaaucaaccaguaaaauaccauuaugcucaauagaacugucuaccuauuuauuaguacaaggccaaggaauguacaaagauuacgauuccuuccuuaucagaucauugucagugaauuaccuuuuuuuuagugaauuacuugcuuauugcuuaaaugcuacuaauagguuaaauaaugucuuagacuuuauuugcuuaaaaugucacauuuucauuaucgauuuauguuuauuuuuuaauguagcuuuuuuucucaacaucagauugcuccagauaauguaacuauuauauggaguuuaauacuuucuuauuucuguuauaaugugaaccaguugcuuucuagacuuguuuucagcucucuaggauuucauuuugauuagacucaaguuaauaccacaauuuuuuauaacuaguggcuucuuuuugguuuugccuuuauuuucuuggugaauaucuuuagcucccucggggggagggggcggcggggggaagagugggagauaaauuuggcauccuuuguauuucugaaaaugaccugauuuuuuugcccucaugcuuggauugauaauuuggcuacauguugguuucauaauugaaaauaauuucccccuugaacucauaggcauugcuuuacugucuucugguaucuucagaagaaauguguaauaaugaguuucauucuugcucauuuaaaaaaacgcgaucucuucugugaggcuuuuaaggucuucucuuagcuuuagaaaugucacaagaaucuguguagcagguauaaugaucuuuuuuccaguccuugugcugggcacuugaaaggcuaacucaauuuuuuuuuuuuuuuuuuuuuuuuuugagacagagccucgcucuguggcccaggcuggaguacaguugcgcgaucccugcucacugcaagcuccgccuccugguucacaccauucuccugccucagccuccugaguagcugggacuacaggcgcccaccaccacuccuggcuaauuuuuuauauuuuuuaguagagacggggguuucaccguguuagccaggauggucucgaucuccugaccucaugauccgcccgccccggccucccaaagugcugggauuacaggcgugagccacugcgcacagcuuuuuuuuuuuuuuuuuuuugagacagucucgcucuuuccuccaggcuggagugcaguggcgugaucucggcucacuggaagcucugccuuccggguucaggccauuuuccugucucagccucccgaguagcugggacuauaggugcgcaccagcacacucugcuaauuuuuuauguuuuuuauuuuuugagacguagucucguucucucgcccaggcuggagugaaguggcgcgaucuuggcucacugcaaguuccgccucccggguucacgccauuuuccugccucagccucccaaguagcuggggcuacaggcgccugccaccaugcccggcuaauuuuuuguauuuuuaguagagacgggguuucaccguguuagccaggauggucuggaucucccgaccucgugauccgcccgccucggccuccuaaagugcugggauuacaggcgugaaccaccacgcccggccaaggucuaacucaguuugaaggccuuuguucugccauuuggaaauucucuauuucuuagguaauaccaucuccuaaaaaauucuuuuuaaaacuuccaugauucagauggugcucuguuuucucaggggauucucaacuuucuugaauucugaauuuuucuuucucauguuuuaaaaacauucucaacugauuuuuuuuaaaaauaacauuccguuguuugauguucugugauuuuauuuuucucuagaauuacuuuauuuuggucuuguucuuuacucggauucuucuugucguauuucugguuguuuuuuguuuuuuuguuuuugagauggagucuugcucucuuguccaggcuggagugcaguggcgcuaucucggcucacugcaaccuccgccucccagguccaagcagcccuucugccucagccuccagaggaacugggacuauaggcacgugccaccacgccugucugauuuuuuguauuuuuagcagagacgggguuucaccuuguuagccaggauggucuugaucuccugaccucgugaucugccugccuugaccucccaaagugcugggauuacaggcaugagccaccacgcccgacuugauuguuacuauuauuuuaauuuuauuuuuuugagauggagucucauucugucuccuaagcuggagugcaauggugugaucugagcucacugcaaccuccaccucccggguucaagcguuucuccugccucagccucccaaguagcugggacuauaagugcgugccaccaugcccggcuaauuuuuguauuuuuaauagagacgggguuucaccauguuggucaggcuggucucgaacuccuuaccucaagugauccacuggccucggccucccaaagugcugggauuacagacaggcaugagccaccacaccuggccugucuagacguauuuuaaugugagagaauagauagacugauuggaaauguuguauauagguagagcuuguugacuggugguccuugcucauucaauaaauacuuuaguauguaauguguauaggugucagauaauucgcuuuaugauaacuggauggggaauuuuuggaagggaaggcaaccauuccuaaaauuccagaaugaaaaggauguuauacuuauuuugacagguaguuuauucauuuuccuuaaaaaggaaucuuucuuguugucccauuuucagcucuuuuucucacuuuuguuuuucuucuccuuccugucuccccuucuccuuuuucuuuuucccuccccccccccuuuuuuuuuuuuuuacugcuccuugcagagcagggcuacacccauaggcagugugaccaaaguaaccccuucuucucauuucuguccggauuuuuucucacuuuuccaggcaguuagacucuccuguuguuuauguaguugggcuauaaucccuucuuuugcauauuguaggcugugaacuuuuucugcuguauuuuaucuuauuuugagcuucccugagacuuagugaaacaucugguccauuuauagccucucucucauuuuuccuacuguuagagauuuauucucuguuaaaauaccuagccgagugcucugguugugucaggaggauugcuugaucccaggaguuccgggcugcugugcacuaugccgauuaagugucugcaucaaguucagcaucaguauggugaccuccagguugccugacgacuggugaaccagccuaggauggaaaugggcaggucaaaacuccuaugcugauaguggugggauugcaccugugaauagccacuguacuccagccugggcagcagugagacccugucucuuaaaaaauaauaguaaauuaaaaugcuuuuaucgucauuuuagcagauaaguccugugcuucaucuggcccuuugaaucuaaaaguauuuuaguaugauuuuauuuuguuuuauuuuauuuuauuuauuuugagacagagucuuacugugucauucaggcuggagcgcauuggcgcagucucggcucacugcaacuuccaccucccagguucacgcgauucuugugccucaaccuccagaauagcugggauuacaggcgugcaccaccacgaucagauaauuuuuguauuuuuaguagagaucagguuucaccauguuggcgaggcuggucuugaacuccugaucucaagugaucagucugugucagccuccccaagugcugggauuacagacacgagccacucugcccaucuaugauuuuauuuuuaauuaaaauuaaucuggauuguuaauuaagagauaucaguauacucuuagggauuguggaagacagugagcuuauuuaauagucagcaggucucuugaaaguaaaugauaucuuagggcugggcguggugggucacgccuguaaucccagcacuuugggaggccacgcggguggaucaccugaagucaggaguuccagaccagccuggccaacauggugaaacccugucucuacuaaaaauacaaaaauuagcugggugugguggcgugcgccuguaaucccagauacuuggaggcuaaggagaaucguuugaacaaggaggcggaaguuaacagugagcagagaucacuccacugcacuccagccugggcgacagagcgagacuccgucucaaaaaaaaaaaaaaaaaaaaguaaaugaugucuuagaaacaagccuuaaaagaucuuaaucuuacucuugcuaaauguaguauaagucuaagccagccucagcucuuggccugagauuacuagucuccuuguuucuauucuacauguauucucuacacagcagugaggguaaucauugcaaguaaaauauugucuuacuuauuugcuuaaaucucucccauaguuucccuuuacacuuagaguaaaauccagacccuuucuccugaucuguaagauuguaugcagucucuugccucccuaguucuucacccauguuaccuacugguauccuacuugucuccugauuuagcuacaccagcauccuugauaaauuauucaaaaagccaagcucauuccucauggccuuuuagaauuggauuauaaagagggugaacugcuuaucccuucuuaucauucagugcugcucaaaaguuaucuucucagggaagauuuuccucaccauuuuaucuaaacuauggucuuucucucccaaaucacugccuauccuguaugcugcuuuuaauuucuucuuagcauauaucugaaauuauauuauguauuugcuaauggucuuuucccuauuagaauguaagcucuaugagggcaaggacucuugucuuguuuacugcuguauucuucuagcauaaacacacacacccccuuagaacaauucuggauacacaauagaaauucagcaaauguuugggugaaugaaauggcccuaaaauacuauuuuaaaacuuguuuucuuuccagguuauauuuucuuauuuaauguguguaaaaauguggugguaugaaguuuuuugguuuuaaaaccuucaauagugaguuuuugugggcacauuguauucauaagagcuguuaauucuagccauaacuuuaaauaaauguauugguugcuuguguacaugacuaucuguaaguaaaaugaaggucucuuagaaguuaauacaguuuaaccuuaaaaucuguucuaaaauuauuugacauuuuucucacugaauaagaaugagaaggaggaagcauaguguagaaaaguagcgugcaggguagagugguacuggauuguaauuauguaaguuaaggaaauaacaugcuuugccuauuccuugucacccuuuuuuucugccuuauagacaagggaaaaaaaagauugaauaaaagaguuuuaauuuuaaucauaugucuuaugugaauauuguuuugguuauacuaguuacugaaauguguaucaugucacaguucacuuuuugcuuuuuuuuuuuuuuuuuuuuuugaguuuugcuguuguugcucaggcuggagugcaauggcacaaucuuggcucacugcaaccucugccuccuggcuucaagcaauucuccugccucacccucccaaguagcugggauuacaggcaugcaccaucacgccugacuaauuuuuuguauuuaguagagacgaggugucaccauguuggucaggcuggucucgaacuccugaccucaggugauccaccugccucagccucacaaagugcugggauuacaggugugaggcacugcaccuggccacaauuugcuuuuagauauaagccuuguuuuuguaguaugauaauagauuagaugauaagguaaauauccagaaggugaaccaucaaaggcuuagcugcuauguuaacuaagaagcauuuauggaauauaaauuguucuauaguugguagguuaaaaguuugcuuuuaaaaauaaucaucuggaugauucuauccuuuuccuggaauuauuguucuguguaguauuucucaacuggggcaauuuuauaucccuccagccccauccccagguaacauuugccaauguguagagacauuuuugguuaucaccuuggggugugcuacuggcaccuaguagguagaaauuagagaugcugcuaaauaucuuacagugcacaggauaaucucccauaacaaaaaauuauccagcucgaaguguuagaaguguuaagguacuuuaauauaaugaauaacuuguaacagaaaauugaauucuaaaguaauaguuauuagaaagaucagcguguuuacugauugacuucauuggggagauuccccauacuauuucagucacuccaaacuagagugagauacuugacauggucuuuuauaugcugaaacaaaaaugcuuuuuuuucuuauagugaaaaggauuuuguuggaauaauuggauaauuuauuaccugcuguuaauauugcuucagauaugaugugacaaggaucaaaauaauaguugucuccuuguagaaagugguacagccaauugacaaaguuagaugauguucccugucauuaaaauaaauuccaugaauuacuguuauucucuuuugauggcuuuuuuuuuuuuuuuuuuuugagauggaguuuugcuuuuguugcccgggcuggagugcaguggcgcaaucucggcucacugcaaccuccgccucccagguucaagugauucuccugccuuggccucccgaguagcugggauuacaggcgugugccaccacaccuggcaaauuuuuguauuuucaguagagacggguuucgccauguuggccaggcuggucuugaacucccuaccucaggugauccgcccaccucagccucccaaagugcugggauuacaggagugagccaccgugcccagcccucuuuugauggcauuuaaacaacccucuuaaauucuuucuggaagcacuuacaauuuuaaagauguaauaugaucaaacaccucuuuagucauagaguaauucauucagaagccugguuuguuuauauuaguaaauuggugaauuucugucaccuagucauuguaaauaucuauuauuauuuuuccauucuuugaguuuugaaagugcauuuaaauguuuagcaguuaauuuuaauaaaguuaauuacagggcuguugcaaguccucugcauuuuguaucucuucuuaggaguauuauuuuucuuuuuaaauucauauucuuaaaagguauuuuuaaaaucaguuucaauaaaacugaaguuucucuuacgcaggaugcuguggggcacuguuaguguauaaaauaaauuuacucuugaccauaaaugaaauuguagucuaauggaaaauagcauauuaucugauagagguauaaauaaaauauaguacagacacagaguggggaauaauuuaauuccauuuaugaagcuccagaagcuuuauguaguuugguaugguuagauuauaggggugcuccuuaguaguuuggugugucaugaugagaaaugagaccugaaaagcguaggacuauagaauggaauagcagaauaguauucauaaguuuguauauuauccuugagaugauggagggacuauugcaaguauugagugagauaaaaugacaaguuuuagaaaauaaggauuuuggaaaaacucaccaaguaauguuauugaaagguugcuugaaaugaaaagauaugucugugugaaaggagaucaguuuggacaacucauauagaaagugaugugaggccgacacugggaaauuagaaguagcagggauguaugaauguuauagaugcuguggaauauauuuugaagaacuuugcagccaguuaaacaguaaaguaggagaauaacaggagaguuuaaggccaagcguauuuaguucaugagguagaaagaugagaaagaauagguuugaaggugucuguaccauuguuuuuacccacuuuaggcuaaaucuuaccaaacuuaauuuuucugauuuuuuuaaaguagcguuucuaaguagaaguaccuuggaauaacuauugaaauaccuaggcugggcgcagugacucacgccuguaaucccagcacuuugggaggccgagguggguggaucacgaggucaggaguuugagaccagcuuggccaacauggugaaacccugucucuacuaaaaauacaaaaaauuagcugggcgugguggcaggcgccuguaaucccagcuauucaggaggcugagguaggagaaucgcuuaaaccugggagccagagguugcagugagccaagaccacgccacugcacuccauccugagcaacagagcaagacuccaucuccaaaaaauaaaacaacaaaaaacaaaacuauugauacaccuuaugaaaguaaggucuugcuaaauaaugaaggucuggcuaaauaauaauggcauauccacuuaaauaagcaaaggaaaucuguauaggcugauaugagaagcucuguauguagaugaggaaccaaaguacauaugugcauacauauaugcuggcauauaccuagguuuuuuuccaccuuaauuagaugauagaaauaguacuuguuaucuugaaggagagagauugauacuuaggcuuuucaucuuuuuguacuacaugacuuuagcuauguacauguaaugugaguacaucguaaacaugugaaugcaguuugaggugccugcugagagauuccaucaggcgguugggaucaugucugaaacuuaauagaggggauugcugauaacccaguuagaguagauauacaaugcaaaaggacaagaaugcaucaguagaaacagagaacuaguggauuuauaauaguggaacuuuuacagguaugugacuucauagaaaauuacgguaggagaaauucaaagcuuuguuuuauuuguguuaagugaaacuccauuuucuguuugguguaaauaaauguuuccauugauugcuauugaaagguggcacuguccuuccauaguaguggguuagugaaagaaauuaauacucuugauuuuuauuuuuucuuuuuaugagagaggaucuugcucuguuacccaggcuauggugcaguggcaugaucauggcucacugcagccuugaacuccugggcucaagccauccauccuccuuagccucccaagaagcugagacuacagacaugugacaauaccgcuuggcuaauuaaaaacauuuuuuuuuagccaggauuuuagacaggaucucgcuauguuguccaggcuggucuugaacuccuggucuccggugaugcuacuaccuuggccucccaaagcgcugggauuacagaugugagccacugcacccagcccucuugauuuuucugauuagcaguuucagguggugauggcuaccuaacuaguauagcauuauagaauuuaucauuucugaguaccuuuuuuauucuuagacuuucauguguagcaauuuuauguuuaacuuuucauugacuauguuuguaaaaguaaaauuucucuaauuuguuagaauuuacuuguggggaaggagagguuggaguggaacauagcauaacccauauauaagauacacguggcaaauaucuuuuuuucuaauucuuuuuaguuuaucuauuaguuaaugauagcauguauuucagaauagaggcuaagaaccauauagauuuuaaagauagcaaaauuucuggcaagaaacauuauaucuuuuuuucauggguuuagcacuuaguuuuagaagaauuugugauuguuuagucugugauucugauucagagggaaaccugucuaaacccugagcaaagaaagaacuguauuugagcauaguucuuuacauguuuuauucuguagccaaaguauaucaggauaucuuagccaugauauucaucaauagaauuaacuccuauguuguguuagugguauaccagauuuguauguauauaguuguagaauacauuauuugaucucuaaaacauaguucugaaugccuuugauucacagaaagaagucugugaugaaauaaacuuguuuugauuuuucuguacucuaaaucuuuuaaguaagucuucuauauuugcuguuuuauuuuaaugcaaauaaagcuuuccuuugacagugaccuuggcucaguuuagggauugauucugaauauaggagacgguaaaaaaaaaaaaaaaaaaaaaaaaguaccauuuaaaaagugggagauuuuaggcugggcucaguagcucacaccuguaaucccagcacuuugggaggcaaacaugggaggaucacuugagcccaggaguucaagaccagccugggcaauauagugagauccugucucuacaaaaaauaaaaaacuagccaaguguggugguacacaccuguagucccagcuacucaggaggccgaagagggaggauacuuugaacucuggagguggagguuguagugagcugagaccgcaccacugcauuccagccugggugacagcaagaccuugucucaaaaaaaaaaaaaaaaaaaaaaaggcggugggaagauuuugacauuauugcauucauuuguuucuuaacuuuccgucuguagcuuaucugcuucuauaauugucaucuuaaaaacugucauaccucaucuggaagaauuuuuauugaauaaaggcauaacagcauaugcuaccauaagcuauguuaaauucuauaugaguacauuucaggauaguauguuauugucauaguaaaaggaaagaguugcaauuaaugaauaauauaaugcuuugggccuugcagcacuuccuguucauggcuguaccugaucuuuuugcaguuugucuguauuuagcuuuaugucuaauugaaacugugucuguaguuaauuauuuggcuguaugugaaaguucguuugaggaaaggagaggguuauucguauucuaaaaguguauguguacuauauaauugauguugacaguaugguaauuagaguuuuuuuaucuggcaucucuuaaaaguaacaauuuuuaauucuauuaucagcuuuaaauauagaauguauaauguaaaugaauuuauauuuuaaaauuuauugugucuugauacucuugaaauugacuacauuuaaauucuuugcacaugcuaaugucugugagaaugauucaauaaaauaacaaacagucauauuuagguaaugcauuugguuuacucauuuuuuauuuuaauagagcccugugcaguagaguugguuuuuuuaauaauguuacugcacaguagucuagcaacuacuuauguaaacagugugaagguuuuuauacuucugccagaggacaacguaauaugaaacaccgaguuuuauuugucucuacagagaguaguagugucuuucaggcugggggaagggagauuucuuauacuuuauucccuaaggauaguuauuugaauauaaauacuuaaaaucuuuucauuucugacuuugccacuaugugaccucagcaaagcccuugauuuuacauaauuuccacaucaaagucagggauaauacccuuugcuucuuaucuuaaaauauuauuuuaaguauuaaauaagaaaaguacauaucaaaguaguuagaauuacuauuuuaaaaagauuugcauuagugaauauuugguagacaauucagcuaaccguuauuuagagucuaauguggugagguaaaaaacuacacuugauacucagcuguuuauagaacagaacuauccugaugauuaauuauaaaacauauccccaaugacagugugcuagcauuauauucccacagcagaaaguuuuuguaugcuugggauuuuaguuuuugcaauaaaucuggggcguauuuggaauaauaaugauauguauuugagcauuugauagcauguuuagaaaucaguuuuuguuuugauggccuacuuugccccgaguuuguaagagaucaagugcuacuaguguuaggcauuagugaauagaugaaugagauaagauuugccugugagucaaagaauguacgaucugcaaauaccuucauugcuaccagaccuuacauaucuuacaauuuuugucuuaguacucagaguagauaagcaguggcauugguaccuucuaguguguaaaaauuguuuauuucaaaguacaagauaguguauuuuaguaguacuaaugcaaaaacaucucagucugugauuuuuagauuucauuuauucacuagcaaguauugacaccuauuauguaccagguacucuaggcaucugugcuaaauuagugaacaaagguuagaccccuguccuuguggagcuuuuauguucuagugugagugacagucaacuaugaauauaauaaauuauguaauauguuaaaagauaaaugcuaugcaggaaaauagagcaggguaagggggauuauuauugaggcaagugggcaugggcauauugcuauuuaaaauaaaguaguuaugggcucauaggugacauuuaagcaaagacuugaaggaagugagcgaguuggccaugcagauauuuggaaggagaauguuccccauaaaagaaauagccaggaaugggucuggaacccauugaggaacauaaaggaagcccuuggaagcaguauaagagaggacuagaauaguaaaagaugaagaggagaagaacaagaugaugggaaguuuucauaggaugguauaaggacuuugguuuuuuucucagagugaaauagucauugcaagauucuggccaugaucugacugcaagcuuggcugcuagcuacuguuaggacaaccugagaaccuuagcuuuguaaacccgagagaauaggaauuugagagucuaaacaugucuuaugcaaaccagaagcuaaugauucuguguucacacucaccgagcagucgggucuucagagagaaaaaacuccugaugcuuuccaggguucuuugguauagaucagcuugcuucuuguuguggcaucccucuuuuauccuuagauuucagcuuucuguggucugucaguuuccacuagcucaucuuuccaacuuccuuguugucuucucuuuuauucugucaucuccugucauuuuauugguuauuuuaggagaauaaagagaaacaauuucuuaguugcuguguugaaccagaagacuaauaacuuaaaaauugaugugccaaugugauuagaaaacucagauacuugcacugaaacuucacuuuccauugugaaacaucuugccagaauuaauaguaauaaugcuauuuucaugaaacacaaaucaggccuucaaaaauuuaaaacuuaaaguauaucuacucauggcaguaaaaaaaaaauacauaaucacuuuccuuguauaaauguauaaauuguuuaaaaguauuuuacucacuuuuauaaagcucccacuuugagucacuguacuggagcaguuuagauuuaagagccccuuucagggaauggauuuguacaaaauagugugcuugaggacuugagaaccgugaguuaccuaaaccgugaauuaccuaaagacaacauauuuugguagaaagaucauauaguuaggaaacuuggauuuuggccccauuucucuauggcuaaauuuuagacuucaauaaauuauuuaauauuuucaugccuccucauuucugaaauaagggauuguagguuagauaaucuuuaaguaauucuaaaaacauuaugauacuuaacgucauuuuggaaauuuuuaaugcuuauguggauaauuaauuuuuuuuaauuuuuuuaugcagguuaauggugcaauguaagaaaccuuuaaaaguuucugaugaauuagugcagcaauaucaaauuaaaaaccagugucuuucagcaauagcaucugaugcagaacaagaaccuaaaauugauccauaugcauuuguugaaggagaugaggaauuccuuuuuccugauaaaaaagauagacaaaauagugagagagaagcuggaaaaaaacacaagguaagagaaaucacaguacaccaaagggucacuguugauuuuguagcacugcauauaguaacacucuuacuaccacaguuaucucacuucuuuugucuuagaauagaaagaguaaucauuuauuuagaaaaacuuauuuuugcccggcugcgguggcucaugccuguaauaccagcacuuggggaggccgaggcaggcagaucaccugaggacaggaguuugagaccagcuuggccaacauggugaaacccugucucuaauaaaaauacaaaaaguagcugggugugguggugugcgccuuguaaucccagcuauucgggaggcugaggcaggagaaucccuugaacccaggaggcagagguugcagugagccaagaucaggcuacugcacuccagcuugggugacagagcgagacuccgucucaaaaagaaaaaaagaaaaauguauuuuuuugaauggguaaaucaagcacaugguaccaauuauagcugaccucugauaaugaaaauauuuuguuguuuaaaaguuucuggguuggauaaagggcauauuaaacuugucauaauugaaaucaggacauuuagguaggcuauuuugacagugauuuuaaaauauguuguaagugaauuaccaguuuucaaagauacaauaaaauauacaucacugaguuuaaaaaauaugugcuauuuuugaauaugugauucaggaacuuacagugcaccuagaaguaaaaaugaagugcaagauauauaguuauuagaauaaaauuuaaaaaucaaauauaugagaauuuguuaagauuaagauaacuuugcuacacaggaauuaugucuuauauacaaaauaugaaaauaggcuagacacaguggcccacgcuuguaaucccagcacuuugggaggcugagguggguggaucacuaggucuggaguucgagagcagccuggccaagauggugaaaccccaucucuacuaaaaucacaaaaauuagcugggugcgauggcgggcgccuguagucccagcuacucaggaggcugacacaggagaaucgcuugaacccaggaggcagaaguugcagugagcugagaucaugccagugaacuucugccuggugacagagcaauacuccguuuaaaaaaaaaaaaaauugaaaucuguaaaguuaugaaaaggauccaauaauacgugugaguuuuuuuuuuuguuuguuuguuuguuuugagacggaguuucgcucuuguugcccaggcuggagugcaaaguuaugaucuuaggucacugcaaccuucgccucccugauucaagugauucuccugccucagccucccuaguagcugagauuacaggcaugcgccacuacgcucggcuaauuuuguguauuuucaguagagacgagauuucuccauguuggucaggcuggucuugaacugcugaccucaagugauccgcccgccucggccucccaaagugcugggauuacaggcgugagccaccgugccuggcccccaauaauauguuuaauacaaaauuaguuucacaaaguuuuacuuagcccuacuauaugccagguacuugaaauuuugucuuuuuggaaguaugagaguagugguaguugggaaggcugcagguauaauagaaagaacgugaaccggcugggugcugugucucacgccuguaaucccagcacuuugggaggcugaggcgggcagaucaccugagaucaggagagcgagaucagccuggccaacauggcgaaaccccaucucugcuaaaaauacaaaaauuagccaggugugguggugcaugccuguaaucucagcugcuugggaggcugaggcgggagaaucucuugaacccaggagggggagguugcagugagccaagaucaugccacugcacucuagcgugggugacagagugagacucugucucaaaaaaaaaaaaaaaaaaagaaagaaagaaagaaagaacauggacuuuggaauuugacagauuuaggauaaaauuucagcucucacuguuuaucagccauauuuucuggggcacauuagagucucuacuuuugucuauaagauaaacauaccacaggccaggcgugguggcucauacuuauaaucccagcacuuugggaggcugaggugggcggaucacaaggucaagagauugagaccauccuggccaauguggugaaaccacaucucuacuaaaaauacaaaaauuagcugggcgugguggcaugugucuguaguccuagcuacuugggaagcugaggcaggagaucacuugaccuaggaggcagaggugcaagugagccgagaucgugccacuguacuacagccuggugauagagcgagaguccaucucaaaaaaaaguaauaauaagcauacuacuuacuuguuacuguaagaaucagugauaauguauguuaaacacuuagcuggaugccugacacacagcuccucaauaauugguagauuuuauuguugguaaauuauauauuucagccuaacaugaaauauuuguuugcagguagaagaugggacaucuaguguaacaguguuaucacaugaagaagaugcuaugucauuauuuagucccucuaucaagcaagguaaaaucuuuauuuccuaaugaaaauauugcauuccaggauuguuacuacagacugaucugauauuguuggacuucuaauguuccuuuuuguauaauucauuauguuucauagaaaggaaucuuucuuaaaugauggguuuauugguuaucuuuuauuggaagaagcaaguucaggugauagaauuuguguuuuuaauuguugcagccucuuuccuguuuuuacauauaaaaauaguuuucuauuaaaaacucaguuuuauguaauagauuucucacccccuucuacugggaauuacgugaaaggaaguaaaagaaugaaggcacauauugacuggaaagugauugagaaaaggccauuguuauacuaugccaaggcuaugguuauacucuccaggaaaaacacacuugaaaaaaaugggagaaagauacugauguccaguugguugacaguagaguguuucaucaucauaacuccaaguguuugcucucugaagacacuacuuucaagccuauagcaauggggguuacaauucgaagacuaucaguucucuucauaccugucuccauuguuuaaauuauaauugaaaaauggaucugggcaccguggcucacgcccguaaucccagcacuuugggaggccaagguggguggaucacuugaggucaggaguucaagaccagccuguccaacauggugaaacaccaucccuacuaaaaaaauacaaaaauuaggccgggcacaguggcucacaccuguaaucucagcacuuugggaggccguggcgggcggaucacgaggucaagagauugagaccauccuggccaacauggugaaaccccgucucuacuaaaaaaauagaaaaauuagcugggcauggaggcacgcgccuaugguuccagcuacucgggaggcugaggcaggagaaugcuugaaccugggaggcagagguugcagugugccgagaucaugucacuguacuccagccuggcgacagagcgagacucugucucaaacaaacaaacaaacaaaaauuagcugggcgugguggugcaugcauguagucccagcaacuugggaggcugaggcagcagaaucgcaugaacccaggaggcagagguuguggugagccaaguugggcugggcacaauggcuuacaccuguaaggccgaggcagguggaucaccugaggucaggaggugaagaccagccuggccaacaaggugaaacccugucucuacuaaaaauacaaaaauaaagcauguguggugccaggugccuguaaucccagcuacuugggaggcugaggcaggagaaucgcuugaacccaagaggcagagauugcagugagccgagauugugccacugcacugcagccugggugacagagcgagacucugucucaaaaaauaaauaaauaaauaaaaauugaaaaaugauuuagaauaagcucaacuaugauuguguugugacauagaauaaauaggaguaaaauguuuuaaaguuuucaccuguaaaaugaggagauaaggucauugccuaagguccuucagaucuaaaaccacaauuucuaaauuaaacuuuacuggaauuuugcugucauuuucuucccacacacacaaguuaagagagcuguucugaggccacuaauucaacaaauacuuaguuagcaccuguuauguguagguacuguuuggguauuggggacacaguggucaagacuccacuuugaauaugucugacuuaaacuccuugugaauggaauagagagacauaguauaguaauucauuuacaaaacccauuuaacuuguaaaauaauuuuuuuaauugacaaguaaaaauuauauauauuuaugguauacaacaugauguuuugggggggaguguguauauauauauauauauauauauacacagugcgccaaguguguguguguauauauauauauagugagacccuauacauauauacacacauacuaaaaaauauauauauauuuacauuuuuuuaacauuuuacucauauucugugucacaacacaguuacaguuuaucuuauucuaaaucauuuuucaguuauaauuuaaacaauggagacugguaugaggagaauuguuagucuccuauuguaaccccacaacuauaagcuugaaaguacugucaagucuucagugagcaaacacuuggaauuauuuuacauauauaugugugaguguguauauauauguguguguguauauguguguguauguauauauaguggaauggguagaucaagcuguuuaacauaugcauuaccuuacauaccuuuuuugugcgugugggugagaauacuuaaaaucuacuuucagcaauuugcaaguauacaauauguuauuauucacuaugauguacagcaaaauccauuuaacuuuugaugugggcaaaguaagucaucuucugguguguguuuucgaugacaaaguuuuaauauuuggaauaaauagagggucagucuguggauaaccaaaaauaagaaaaaaaucuaucugaacaaugaacaaauggucuagguagcuugaaaauucaacaguuuggauucuuugccggagugaucuacagauucagagcaaucccuaucaaaauuccaaugacacuuuucacaguaauagaaaaaacaauccuaaaauguguauagggucacaaaaggcccugaauggcuaaagcagucuugagcaaaaagaacaaaguugguggcaucacacuaccugauuugaaagucugcugcaaggccaagugucauggcccaugccuauaaucucaguauuuugggaggccacaguaggagaauugcuugaggccaggaguucaagaccaccuuggccaacguagugagacccuaucuguguaaaaacaauaaauaggccaggugcaguggcucaugccuguaauccgagcacuuugggaggccaaggugggcagaucaccugaggucaggaguuugagaccagccuggucaacauggcaaaacuccguuucuacuaaaaauacaaaauuagccaggugugguggcgugcaccuguaaucccaucuauuugggaggcugaggcagaauugcuugaaucuaggagucggagguugcagugagccaggaucgcuccauugcacuccagccugggugacaagagugaaacuccaucuccaaucaaucaaucaaucaaauguuaaauauuuuaaaaauuaaaauauauggcugggcgugguggcucacgccuguaaucccaacacuuugggaggccaaggcagguggaucaugaggucaggagauugagaccauccuggcuaacacagugaaaccccgucucuacuaauaauacaaaaaaucagccgggugugguggcacacaccuguagucccagcuacuugggagcugaggcaggagaaucgcuugaauccgggagacagagguugcagugagccgagaucacgccacugcacuccagccugggcgacagagcgagacucugucucaaaaaaaaaaaaaaagcuggauucauggaaguagaaaguaaaguggugauuaccagagacuggggguaggggaauggggauggccaggggacacaaaauuucaguugggaggaauaaguucaagagaucuauuguaaauugugguuacuacaauuaauaauagauuguauauuugaaaauucagaguagauuuuaaguguucccaacauaaaaaaaaguaccuguauaugagguaaugaauauguucaguagcuugauuuagucauuucacaauacauacauuaaaaaaaaaaacgaaaaaacucggaaacaaauuggguuguuugggcuacuuaccuaugcuaggauguucccugggauauaggaaacauguaagccccuucuugugccuguaguucagcuuucucaaaaugugagacauaugcuacauucuggaguaucuccaagguggagcuucaaaaucuugguuuuuaguaaguaucuuagaugauuuuuacuuuuaaaauuucaaaggcacaacucuagugaaucuuuagaacugacacaccagagacacuggggaagugacuuuuaucuuucugaaaacgaggacucucaagucaguuaacagagaaugauuuggaagguuauguaucaaauuguuuuucuugugcaggaauauauugggaguuuaauuuucauuguaauugguaucauguuuuuguuacccuaaaacagggcgagaggguaggaaaauaaaauuguaguacgguaacuaagcgguaauauuuaucuaguacuuaagcaccuaguacugggcgaagcacauuaccaacauucuauuacauuuuauucuugguauugaggcacagagacauuaaguaauuugucgagggucauacuguuagugguggagcugggauucagauuaaagucugucuggcccaagagucagcucuugaucauuguucuguucuucguuuacauuucagaaagauagaaaaauacaggccaggugagguggcucacaccuguaaucccagcacuucagaaacagaggugggcagauugcuugagcccagaagcucaagaccagucugggcaauauggcaaaaccccaacucgaggaaaaaaaaaaaaauuaacugggcauagggucacgugccuguagucccagcuacuggggugggaggauugcuugaacccgagaggucaaggcuacagugaggugugauugcaccacugcauuucagccugguggugacagagcgagaccccgucucaaaaaaaagaaaaaaaaauuacaaguauguguauguguauuuaauuguuuuucuaauaguauuuauauuuuuauuugaugcauuaauuauucauguagaguacuuagcuauuuuauggauuaccugaccuuauagugagcuuccugggaaagauauaaucauuuauuuauaacuuuuuuuucuauaaaaacacuuucucgauuuuaaacaauaaaguacaauuucuuguugcauaauccccuuaugaccuuaaaguuauaugucuaauuuaaaaagaauaguacuuauguggucauuaguagcagguuuuuuuuuguuuuuuguuuuuguuuuuaagauggagucucgcucugucucccaggcuggagugcaauggugcuaucucggcucacugcaaccucugccuccuggguucaagcaguucuccgucucauccucccaaguagcugggauuacaugcgccugccaccacacucagcugauuuuuguaguuuuaguagagacgggguuucaccaucuuggccaggcugguccugaacuccugaccucgugauccacccuccucggccucccaaagugcugggauuacaggcauaguaguagcaguuuuaauuuuauuuuucugauugacuuuuguagaugcuccacgcccuacuagucaugcccguccuccaucaacaaguuugauuuaugacucagaccuggcugucucuuauacugaccuugauaaucucuucaauucugaugaagaugaacuaacagugaguaucucauuaaugaauaggauuauaauuuguuuuccuugauuuuauuauuuuuuuauuuuuuagaagugauuugugaguuuaauacuauguuuuagcccugaacaauaggaaauauaguaaaaccucauucauugauuucuuuuuuaaaucucauguuugaguagucuugccauagugucaucuauaaacuuugaggguuuuguuucuccuuuuguuuuuacauuugggggacacaugauuaaccuuaauuugagcucugccguauguucuguuuuguaguuuuaggaagcagaauuauuuuccuauuugauucuguaguuugagaaaugacucuggaauuuacucauucagagaacacauacauaauugacauuaaaguuauuugcuuugucaauuuauuaaggaauaccagcucuuuugaauuuguuuugcaucacagcuauuauaagacagauacaugauauaacaauaaaagaggaaaaaaauaauauuuaaucuuuaacacccauuugcagagaaaggugaagauaaaagaaauuaaagcuuaaaaugagauucccuagaaugucaagucucugucaaauuaaugaauugggugcugcauuaucauaaaagggaauuccuuuucaucugcauaaagguagcuuggaaacuucuaugguacauuugaucuuuccuuuccuauauaauaugcauuuaguccucucucaacauauauaucucuauauguguguauauguguguguguacauauacauauauauauauugcagauacauaaacuuuuacuguguaucccauaauguaguacauuuuagggcacccuuuacuaggcaacuauauccuugaaugcuuuggcacauucauacuuucucucuacuaccauuccuguaucagcugugguuccucugaaauaaaagauuguagucagaacguggucuacauauuaauauuuaucacagacugucuaacagaagacauggaacaaauguuagcucugaaaacacugguaagagcuuggagauaguaaaacuuguuuguucaaucuacuaaaaguuaggaacucuauugcuuugucauuagaucuucugaaguuuguacuuaguuuuaccuguuaacaguauuuuugcaggaauagggagacuauuaaaacaaggugaaaguauaaauaagaauuuagauaggugagugauugauuauauaggaaacuuuaauguguucaacuuaaggagacaaaugcuuucucugcaaguaucuuuuaccaagaagcauuucuaauguuaauuacaaccccuucuuauugcagguuuucuuauuuuuauuuauuuuaagacaagagucucauuguauugcccaugcuggagugcaguggugcaguccuggcucacugcaaccucugccucccaggcucaagcaauucuugugccucagccucccgaguagcuggaauuacaggcaugccccacccagcuaauuuuuuguauuuuuaguagagaugagguuucaccauguuggccaggcuggucucaaacuccuggccucaaauugaucugccugccucagccucccaaagugcugggauuacaggugugagcuaccauguccggccucuuauuacuggguuuuaaguuaagguuaaccuuacuucuguguauuuugaaaguauuggucauuuucuuuggaggaacuuuuuccuuuuaauuuggaggcuuaccaaauaaauuaaucuggagucagugauuaagaaauauuuuauaucuuucaacacuaguauguauuuggcuguaucacagauucaaaauacuacuuuuaaugaaugggcuuuacuguuaaguuauaucugaaugauuacuauuuugagaucacauuggauguaaaauuuuagauaaauaugugcuuuuuuuaaauagccuggaucuaaaaaaucagcaaauggaucagaugauaaagccagcugcaaggaaucaaagacaggaaaucuggacccguuaucuugcauaaguaagcuucccucaucugugcucgagauaaauuugcgaacuuuuaaucucaacaaagcuccccacuccuuuugguuuaaacacagauucgccuauuuuuagucauguuaaaauguauguuuuuauuaaauauaggcacugcagaucuucauaaaauguauccuacaccaccaucauuggaacaacauauuaugggauuuuccccaaugaauaugaauaauaaagaauaugguaguauggauacaacaccuggaggaacuguucuagaaggaaauaguucuaguauaggagcgcaguucaaaauugagguugaugagggauucuguagccccaaaccuucugaaauuaaaguaaguauguuuuuucuagaaaaauaauucacuuccuauauuuucuuauagaauuaauuuguugcuauagucaaaaauuauuuuauagugguugcgguuuuguagcuaaguugaggacugaauuauuguugucacuauuaagaaugcauuuaagaaaauaauagaauuguauuuagauuuuauucuguuuaaagaaaggaaaaaagguccagagccuguuuguuuauuuauuuuuuccuccuagaagauaagauacugaaaaccuaccaucuuuauauuguaggauuuuucuuaugucuauaagccugaaaauugucaaauucuagugggauguuccauguuugcaccucuaaaaacucuaccaagccaauaucugcccccuaucaaauugccagaagaguguauuuaccgucagaguuggacuguuggaaaauuggaauugcuuucuucagggccuucaaugccauucaucaaagagggguaugauuuauguuguuacaauaguaugugacugcuuauacagcuuuaauuuuuuuuucauagauuuaccugguaugcuggaaaaauaaaauugguuuuugaaaauucuaaaaauuauuucugguuaaucaauuauagugauuggcugggagcagugaaucacgccuguaauucccauacuuugggaggccaaggcaggcguaucccuugaggucaggaguuugagaucagccuggccaacauacgaaaccucgucucuacuaaaaauacaaaaauuagccaagcgugguggcgcaugcuuguagucccagcuacuugggaggcugaggcacaagaauggcuugaaccugggagucaggcauugcagggagccgagaucgcaccagugcacuccagccugggcaagagugagacuuugucucaaaaaaaaaaaaaaaaagguuaauuggguauggauaaacuauuaggaaacuuaagacuauuaugcuugauuuguauuccgaagcaccuuuucuuuugggcugcaauuuuaaauugcucccauuuuuacauuugccaucuuuuccacacuuuucacauuuuaacaucucugacuuggucaguuucaacucaaggcuaaaagaaaucugaaucugagaugucuuauaagugguagcauuuuaaaauuaccauuuuucccuuuuuacacaugagcaucucuaaaaucauuuuucuuuuuuuauagucaguagcaucuuagaaucaaggaaauauaaguauuucuaguaaacaaaauuuauagauaguaaauauggaugucuagguaugcauuaguguauagagugcuuauuaaugauuuuugaacuuguuaauugauccuuagucaacaacaaucacuuagaguagauauguuaaccagaaauaagaauugacugugcuuguaauucuugcaauacuuguccuuucauaauuuucuauguaauugaaaaacauuugggacguuuuuaguuguauuucacauuacuaauauguuccuuuauauauauauuugaucuucuuuuacccuggugaugauagugauggaaguaauauggaucaagaauauggcacugcuuauacaccucaaacucauacuucuuuugggaugccuccuagcagugcaccuccuaguaacagcggagcaggaauucuuccuucuccauccaccccucgguuuccaacuccaaggacuccaaggacuccucggacuccucguggagcugguggaccugcuagugcucaagguucagucaaauaugaaaauucagacuuguauucaccagcuucuaccccaucuacaugcagaccccuuaauucuguugaaccugcaacugucccuuccaucccugaagcacacagucuuuauguaaaccucauccuuucagaaucaguuaugaauuuguuuaaagacuguaacuuugauaguuguugcaucuguguuugcaacaugaacaucaagggugccgauguuggaguuuacauuccagauccaacgcaggaagcacaauauagguguaccuguggcuucagugcugucaugaacagaaaauuuggaaacaauucaggauuauuucuugaagaugaacuagauaucauaggacgcaauacagacuguggcaaagaagcagaaaaacguuuugaagcucucagggcuaccucugcugaacauguuaauggaggacuaaaggaaucugaaaaauuaucugaugauuugauauuauugcuacaagaucagugcacuaauuuauuuucacccuuuggagcagcagaccaagauccuuuuccuaaaagugguguaauuagcaauuggguacguguugaagagcgugacuguugcaaugacugcuaccuugcauuagaacaugggcgucaguucauggauaacaugucaggaggaaaaguugaugaagcacuugugaaaaguucaugcuuacaccccugguccaaaagaaacgguaaaguaugccaauaaaauacuuuuuuguuugcuuauuucccuuuaguuacauucuuaggaaaaaguaauaaaggcaguuucccauguggcaaauacauuuaaaguuggacuuaaaacucuuuauggaugauguuuuuaaagggagaauuucuuagcaguuuaguuuaauuucaccaauaaaaguaugguuauuauaaaucuguaauuauauacuuauguaggaauaugaaaggcacauuccauauauuuauuagcauaacauugcuaguggucugcuuuauucaacauucuuucacucauuaaguauuuacugggcaccuuguaugugccagguauuagccuagauucacuguugaacaaagcacacauauucuuugcccuuuuugaaucuauaauuuaguggagaaaauaggaaauaaacaaaaaagcauauaauagauaguaagaaguaauuuggaggaaaagcagaguaaaacagaacaagacaccacauauguacuauuuuagauguauggucagauaagauacuacugaggagauagcauaugggaaaacuccuacauaacauagaauaugagcuauguaguuaaaugagggaagaguguuucaggcagugcaaagacccugagggaguauuuugcuuuuacauguuugaggaacauuaaggugacugaugcugcuggaaugcuuugugugauagggagacuggaaggagaugaaauuuaggagguagccauucaccagcaucauuuagagucuuauagaccauguaaggccuuugugguuuauacuaaaugugaugggaagcuauugaacaguuuugacaaggaaaguaacaugauccuuauucugauuguuuuuuaagagaucucucagucuggcacaguggcucaugccuguaaucccagcacuuugggaggcugagguaggcaggucaccugaggucaggaguucgagaccugccugaccaacauagugaaaucccgucuuuacuaaaaauuuaaaauuagcugggcuugguggugggcgccuauaaucccagcuacucgggaggcuaaggcaggauaauuacuugaaccugggaggcggaaguugcagugagccaagaucgcacuacugcacuccagccugggcaacaggagugaaacucccaucuaaaagaaaaaaaaaauggcugggugcgguggcucaugcgucuaaucccagcacuuugggagacugaggugggcagaucaugaggccaggaguuugagaccagccugcccaauauggugaaaaauacaaaaauuagccagcaugguggggcgugccuguggucccagcugcucaggaggccaaggcagaggaguugcuugaaccuggggggcggagguuguguugagcugagauaaugccacugcacuccagccugggcaacagagcaagacacucuguugcuauuguguggaaaauagcguugggguuuggaaguagugaaagugagaacagaagcaggauaaaucaguuggaaggcaguuucaguagcuuaggugaaagaugaugguagcuuagacaagauaagaggccagcgagauguaaguaauagguuuuagguuauuugggaaauagaaccuacaggguuugccaaaagacguguaaggaaagaugaggcaucaauaauagcuugagcaccugggugaaugguaguacuaacuacagaggagggaaacacgggggaguaaaucagauacacauuuggagauaauauguuuuaaauucagaggaaugauugggucuggagauagaaaaauuuugugugugaguuauuaugaaaagcuguggaucuggaugaaauaaacuguagaguaauuguagauagaguaguacaaggauggagcugacauuuauaaguggggagggagaaaaggcaccaggaaaggaaauugagaaggagguuggaggaaaaccaagggagcaugguauccuagaaaucagguauagggaauuuuuguuuguuuguuuuuguuuugagacagagucucgcucugucaccaggcuggagugcaguggcgugaucucggcccacugcaaccuccaccucccggguucaagcaauucuccugccucagccucccaaguggcugggacuacaggugcacgccaccacacccggcuaauuuuuuguauuuuaguagagacgagguuucacuguguugcccaggcuggucucgaacuccugagcucaggcaauccaccugccucggccucccaaagugcugggauuacaggugugagccaccgugccuggcccgggaauauuuagaagagagugaucaucucuaucaaauacuucgauacauuaaggugaaaacugagacaggcuauuggaugugaccaaauagaaguugguggucaccuugauaggcaguuucagucaaucugauuggaguggguucacaaaagaacgggaugagaagcaaacuuagacaauuuucuggggacuuuugcuguaaauagcagagaaauugcauaauaggguuaaaagagagguuuauuauuauuuuauuaaaggugcauugggagugauccuauagaaaggaauuuuuuuuaauugacagauauggcuuauggcuguaaucccagcauuugggaggcugaggcaggcagaucauuugagcccaggaguucaagaccagccuggugaacauggcaaaacccaucucuacuaaaaauacaaaaauuagcugggugugguagcaugcaccuguagucucagcuacuugggaggcugaggugggaguauagcuugaaccuaggagguggaggauucggugaaccaugauuguaccacugcacuccagccuauuugacagagugagauuuuucucaaaaagaaaaaaauggccauguuugcaggguugaguaaucaugauaguacagauggaauguuauauggcuucugaaaaugaauuacaguuauguauaacaaauagaugaaucuuagugauacuauugaggagaggaagagggaacaagucccagaagauuacauauagucagauacccuuuaaaaauaccucuuuaauguauuaccguuaauaaaguuuugaaacaagcacaacuaaauguauuauuuacaugcacauaaaauugagaauauugguuaauucuugaaauuucacauguguccaaaaaugaccaagagauagggauagggagaaacauuuaauaagaucguuuuugguaauguucuaguucuugggcagugagauuacaguuguucauuuuauuauuaaagaaaauuuuugaaauguaagaggacaacacauggaccagugauuaaguucauguauaugacaguaucagcauuuauccaauuauucauucucagggaccaaauuuaaaaagggaaagacacaaauaaauaucauagguauucaaaaaaaaggaaagauuauuuuaagccauauagaguaguuaagaucauaggcuguggacucagacugccuggguuugaaacaugacucuagcacuauauacuaccaugacucuagcacuauauacuaccugcuaccuugggccaaguuaguuaaccuuucugugccuugauuucuuaaaauagggucaauaauagauuuacuuuacaggguauugagagaaucaaaugaaauacagagcaguugauccgcccaccuuggccccccacaaagugcugggauuccaggcaugagccacccaggaguuugagaccagccugaccaaccuagugaaaccccaucucuacuaaaaauacaaaaauuagcugggcaugguggcgcaugccuauaaucccagcuacucgggaggcuaaggcaggagaauugcuugaccccaugagguggauauugcagugagcccgagauccugccauuguacuccagcccaggcgacaagagugaaacucggucugaaaaaaaauaaaaaaaauaaaaagcaguuuuggagguugcaaugagccugagauccugccauuucgcuccagcccggcaacaagagugaaacucggucugaagaaaaaaaaaaaaaggcaguuuuuggcacauaguaagaacucagauguuaguagugguaaugacagcagcaggaggauuaguggcacucuuuauaauuauuuuguuuuuaagaaccaacuuauuugccaaauaauggaaaauauugagcuuuaccugguauauguuuuuugaauaacaguaagcacugauguaaacagaaagcugcagacuugaaaaugaauuucuuaacaacuuguccaaagaaaauaauuuaguacaagaaagagagaaauggggcugggcaccauggcucaccucuguaaucccagcauuuugggaggcugaggcgggaguauugcuugagaccaggaguuugagagaagaaagaaaagccuuuauauuucaauuaaaaauuuucaguauuaaaaacaaauaaugggccgggcacgguggcucaugccuguaaucccagcacuuugggaggccgaggcaaguggaucacaaggucagaucaagaacauccuggcuaacacgguaaaaccccgucucuacuaaaacuacaaaaaauuagccaggcgugguggcgggcaccuguagucccagcuacucgggaggcugaggcaggagaauggugugaacccgggagggggagcuuacagugagcagagauggugccaccgcacuccagccugggcgacagagagagacuccgucucaagaaaaauaauaauguuggaaaacauaaaugugcaauauuagaauacuuugauuaaauuauagcagcaucaugaaaugguggcaagcuccugcauuagagcccuuggcauguuuccucccucuuggauacucguuuuccagauauuuauguggauaacucugucuccuuuaaaucuugucagauaucaucuucucauuauaaaaaugcaaacccuucuucuuguucuccaucuugcuuuuuuuccauaguguggacuauuaccuucuaacauaauaaaauuuauuaauuguuguuucuuacccccauuaaguacacucuuugcaaaguucuguguaaaggcaaagauuuuugucuauaaucuaaacaccuagaauaaugaacacaguagaugaucaggauauuaaaauagauguuuggauuuguuuauuuaguuuuaacaucuugaaagaagguuauguuugaaugaauuuaaaagucuacaaaguauaguuuguauauauauguauuuuuucuguuuuuuuuguuucuuuguuuuugagacggagucucacucuguugcccaggcuggagugcaguggcgcgaucucggcucacugcaagcuccgccuaccgggaucacgccauucuccugccucagccucuccaguagcugggacuacaggugcccgccacaugcccagcuaauuuuuuguauuuuuaguagagacggguuucaacguguuagccagaauggucucgaucuccugaccucgugauccaccugccucggccucccaaagugcugggauuacaagugugagccaccgcacccagccaguauaguuuguauauuuuaaugacaacauuaauuuuguugaagauagacaaagcucuguucuaauuauaaaaaauacauacuugcugaacaaaaauuaagaauaccauacaauucacccauuuaaaauguacaguuggcugcuuuuuaguaugcagaguuggacagucaucaacacaguggguuuuaaaacauuuucauauuaaacccccuacccguuagcagucacucccuuuuuccguccaaccuucuuuccuagcuauagacaaccacuaagucuauuuucugucucucuagauuugccgcuuuuggauauugcauaucaaucgaauuauauacuguauggucuucagugacuggcuuuuuucgcuuuccauaauguuuucaagguucaucuaugcuauagcacauauuaguacuuuauugccaaauaauauuccauuguaugaagauaccguauuuuauuuauccauucauuaguugauggauauuuagauuuuuuccacuuuuuggcuauuaugaauaaagcucccaugaacauuuguguacaaguuuuuauauggacauguuuuuauuacucuuaaguggauucacugagucauauucuguuuaaucuuuauuuauuuauuuuuuuuuugagacggagucucgcucuuguugcccaggcuggggugcaguggcgcaaucuuggcucacugcaaccuccaccucccagguucaagcaauucucccgccucagccucccaaguaacugggauuacaggcuccugccaccauacccagcuaauuuuuguauuuuuaguagaaaugggguuucaccauguuggccaggcuggucucaaacuccugaccucaggugaccugccugccucggccucccaaagugcugggauuacaggcaugagccauugcgcuuggccuuuguuuuguuuugagacagagucucacucugucauccaggcuggagugcagugggguacgaucuuggcucauugcaaccaccaacucccagguucaagugauucuugugccucagccucccugauagcugggauuacaagcaugcaccaccacaccugacugguuuaaucuuuugaggaaccgccagauuguuuuccauagcagcugcaccauuuuacauaacuaccagcaauauaugaggguuucacuuacacuugucacauuguuuuucuuauuauagucaucuuauaaucaaaguaucucauugugauacuuugugugaaguaguaucucauugugguuucaucugcauuucccuaaugacuaauaauguugaagauuguuucaugugcuuguuguccauuuguauaucuucuuuggagaaaugacuuuucagauuuuuugcccguuuuuaaaauuagguuuuuauguauuguugaauccugaguucuuuauauaucuuggauacaaggauauaagcccccuuaucacaugugugauuugcauauauuuucuccuguacucuggauugucuuuucauuuuuuuuuuuuuuaagauacggggucuugcuacuuugcccaggcuggucucaaacucuuggauucaagggauccucccgcugcagccuccccaaguagcuaggacugcaggggccuacuaucacacucagcuucuuuucacuuuccuguuuuucauaucuccauaggaugugaaaucuuuuuacuuucuugaugguauucuuugaagcacaaacauuuuuaauuuugaugaaguccaauuuauuuuuucucuuguugcuugugcuuuugaugucuaggucaggaccuaacccaaggucuugaaaauuuacuccuauuacuuuuuugaaauaacuuuguaguuuuagcucuuauauuuagaucucugauccauucugaauuuuuuguguauaguauauggaaggguucugacuucauucuuuugcauguggauaucuaguugucccagaaucaucuauggaaaaauguuaucuuuaaguugucuugguaccuuugucaaaaaucaauuuaucauaagcaugagguuugauuucuggauuuucaguuuauuucuauugauugauuauccuccaugaucacuccuuuuuuuuuaacuuuuagguuauggguacaugugccagguuuguuauauuaaguaaaagguaaacuuguguccugggggucagcauacagauuauuuugucaugcagguaauaagcauaguacuugauagguauuuuuuugugaucaucuuuauuuauuuauuuuugagaaagggucucgcucuguuguccaggcugaagugcaguguuacgcuaucauggcucacuguaaccuugaccucauggguucaagugauccucccacuucagucuccugaguagcugggaccacaggcguguggcaccauacccagcuaacuuuuuguagagacaggguuuugccauguugcgcaggcugccugugaccuccuaagcucgagcagucugacugccucagucucccaaagugcugcaauuacaggcaugagccaccacccaagcccggcccguuagcauuuucaacuacuaaguaguauucuacuauguauacaaaaguuuauuuaagcauauuacauauuaaguauuguauuuggaacuuaguuuuaucuaguuccguacacuuuuuuuuguuuuuguuuuuguuuuuugagacaacaggcucucacuuugucacccaagcuggagugcaaugccaugaucucggcucacugcaaccccugccuucuggguuuaagcgauucuccugccuuagccucccgaguagcugggauuacaggcaugugccaccaugccuggcuaaguuuuauauuuuuugguagagacaggguuucacuguguuggccaggcuggucucaaacuccugaccucaaacaguccacccgccuuggccucccaaagugcuggaauuacaggugugagccacugggcccagccacuacacuuuuuagguauaggaaauuggggccaauaacgauaaacuaggcaaagguaauaacgaauuaaaauugaauaauuuaauauaacugugcucaaacagguuuagugguacaacuggaccauucugggggccacauuuauuauaucaauaucuuuuagugauuuuuccuuuagccauuugacauuuaugaggagcaccuuucauacccauucugauaguuggucagaaaugcaggucauaauuugauaauuuauaaauauuuaagauguauaagcuuauaaaauauuuauggauaauauacuuuuuagcagugugagcaaguuacuguauaauuucuguauuuuagaauuguuaaagucuacuuuuuuuuucaaauuaaacuuuaauaauuaugaccagucuuuauucacuuuaccauaguagugcuaaugaugggauauaauuucaaugugaggcagacuucuuucugguaaaauaccuacagcaccaaaacagccaacauaaaugcaaaaagaaagaaauuuauuugauuaauuuauaaauugauuaaucagcuaaugaaugacuuuuuauggaaauaaguuacaguaacuuuuuauugugugucuucuugguuguaagaaucuagaagaaccuuuuuacagaucaucuuguagaacuuaaugcaauucucugcacaaguaaggguuuaaucuucuugaugcugaagaccugaacuucccuauauguguuuuguauuaucuuaaaauuuuauuuguguuggcaauagcaauucuuaauuacuuguuuuuuuuaaaaugcuuguagaugugaguaugcagugcucacaggauauacuucgaaugcuccucucucuucagccaguucuucaggaugccauucagaaaaaaagaacaguaagaccuugggguguucaggguccucucacuuggcaacaauuucauaaaauggcuggccgaggcucuuaugguaaguaauuuauagugauauauaaugacuaauuuuauaucaguccucagauuucugugcccaacuagaauaagcacauuaguuuucuuuaaauauauuugugauauauucuuaaggccacugugguccaauccuagcuuuuuuucccaccauuuccaacauucagcuuacucaacucuccaacuccacuucaaaaggaguggcuucucuuaggucuguucuuacacauagggggcuuucccucaagauuuuacaugaagaaagggacauacugcuuagauuuuuuuuuuaaaggcaaaaaaaauacuuuuguuauuuauuuuacaaaauuaaaugaaaaagggagguggagugggaaaugaggguuauacuagugauaaaaggcccccuaaggucuucauuuaaaaagaauuacaacuaagaagaaauuugcugguugugaccagaguagcaaaugaauucucauaauagguaugcagauuuauugucagcugugaugaaaaugccauuccaaauauuugaauuauuuguugaagauugucucugaaaggugggccguaauuggaguuuuucagauauauuuggaaugauacgucuugaaaucuuugacuuuuguguauggauuuggaauguauuacauaugaaaguaguagauuugccuauauuuuccuuuucucccucuuuuaauggcuaaauaauuuaaaucucauuacaaaacuaauauucugugaaaaaugcaggucaaugaaaauauauuuuauuuuauuuuauuuuauuuauuugguuuuuuuuggagacagagucucgcuuugucgcccaggcuggagugcacuggcgccgucuuggcucaccguaaccuccgccuccuggguucacacaauucuccuggcuuagccucccgaacagcugggaguaugggugcacgccaccaugcccggcucauuuuuuuacuuuuaguagagacaggguuucaucacguuggccgggcugguuucaaacuccuggccucaggugaucugccugccucagccucccuaagugcugggauuacaggcaugagccacugugcccggccagaaaauauauuuuaguauaaacuuuuacauuauuuuaaaaacuaagaugguagccggcgugguggcucacgccuguaaucuuagcacuuuugaaggccaaggcaggugcaucaccugaaguugggaguucuucaagaccagccugaccaacguggagaaaccccgucucuacuaaaaauacaaaauaagccgggcaugguggugcgugucuguaaucccagcuacuugagaggcuguggcaggagaagaagaaucacuugaacccgggaggcgcagguugccgccagccgagguugccaugagccgagaucgcgccauuguacuccagccuaggcaacaaaagcgaaacuccaucucaaaaaaaaaaaaaaaaaaguagauauuuauuuauuuauuucuguaccuuaacugauuuuggagaucauuucuaucugcacauauagagauuaucuuuuuuuauggcuauauguauuccauuguuccuuacauaugauaauauauuuuaccagugcaguguuuaugaacauacaaauuguuaccaccauuaucauuacagcuacuuuucaguaaugcacagaucccuggcuuuaaagcauggguguauuuuuauuuuauuuauuauuauuauuuuugagauuuguucugucacccuggcuggaguacaguggcacaaucauggcucacugcagccauaaccuccuggguccaagugauccucucaccucagccugccaaguagcugguacuacaggugcucaccaccacacccagcuaauuuuuguauauuuuguagagaugagguuuugccauguugcccaggcuggucuccaacuccugggcccuagugaucugcccaacucacccucccaaagggcuaggauuauaagcacccagacguguauuucaagaaaaaaaaaaaaaaaaccuaaauaacuaucuguaaugccuuuuuuuuuuuuuuuuuuuuuuuugagacagucucacucucuugcccagacuggagugcaguggcaugaucuuagcucacugcacccucugccucccagguucaagcaguucucaugcaucagccucacgaguagcugggauuacaggcaugcauuaaccacaccuggcuaauuuuuguauuuuuacuagagaugggauuuugccaucuugcccagucuguucuugaacugcuugccucaagugauccaccuaccuaggccucccaaagugcugagauuacaggcgugagccaccaugcccagccccuguaauaucaguuugaauucccaccaguuaaagugccuguuuucccaaagccuugccuaguaggaugcugauucaguggaugaaaaaugguuauuucccauuauaguuugagagauuaaauaguacagacuguggggauagauuucuuggguuuaaauuccuacucugcuacuucuugugaaaugcuagagaaauugcuuaacuuccucauuuauguuuucucaucucuaaaaugaaguuaauaauaguuucugccuuauguuuuuugugaggauuaaaugaguuaguacaugcaaagagcuuugaacaguaccuagcacauagaauuaucauuguuugcuauuauuaauuuuaaauugcuuuuuuaaugagaaagagcaucuuuuuauguguuagagauaguuuuguuuuguaaucuccauguucuuaacccauuuuucuauuagguuguuggucauuuucuuuuaaaaauuuuuuuauuaugguaagaacacucaccaggcaugacgacucacgccuguaaucccagcacuuugggaggccgaggugggcagaucacuugaggucaggaguuugaaaccagccuggccaacauggugaaaccccaucucuaccaaaaauucaaaaauuaucccgguauggugaugugugccuauaaucccagcuacucaggaggcugaggugagauaauugcuugaacccaggagguggagguuggagugaguggagaucgcaccacugcacugcagccuaggcaacagagcaagacugucucaaaaacaaaacaaaaaaaaacuaaaagaaagaacacuuaacaugagaucugcgcucuuaguaagguuuuuucuuuuuucuauuuuuuaaauuauauuauuuuuaaauguauaaauaaggauggugucucacuauguugccuaggccucaaacuccugggcucaaguaauccucccaccucagucucccaaggugcugagauuacaggcaugagccacagcaccuggccuacaguguauuuuuaugccaauuuuuuguuuguuuguuuuugagauggaguuuugcucuuuuugccugggcugacgugcacuggugcaaucucagcucaccgcaaccuccacccccuggguucaagcaauucugcuucagccuccugaguagcugggauuacaggcaugcaccaccaugcccggcuaauuuuguauuuuuaauagagacaggcuuucuccauguuggucaggcuggucuuaaacucccagccucaggugaucugcccaccucggccucccaaagugcugaaauuacaggugugagccacugcacccagccccaugccaaaaauuuaaaugcagaccagacgugguggcuccugcacguaaucccagcacuuugggaggcugaggaaggaggaucacuugagcucaggaguuugaguccacccugggcaacacagcaagaucccaucucuacaaaaacuuuaaaaauuagcuaagcauaguggcacacaccuguagucccagcuauucgggaagcugaggacagaggauugcuugagcccagcagguuaaugcugcaguaaggcgugauuguuccacugcagucuaaucugggcaauagagcaagacccugucucaaaaaaauaaguaaauaaaaagacuuguuuaggaaauuccuuaauguugaaaagucuugaccacuggcauuaaguauuuuugucucuaauaaaauauuuucacuaauaaugacuucauuaacuuuugacauuuaaauaaaaaggaggccgggcaugguggcucacaccuguaaucccagcacuuugggaggccgaggugggcggacacaaggucaggagcucgagaccauccuggcuaacacggugaaaccucgucucuacuaaaaaauacaaaaaauuagccaggcgugguggcaggcacuugcagucccagcuacucaggaggcugaggcaggaaaauggcgugaacgcgggaggcggagcuugcagugagccgagauggcgccacugcacuccagucugggcgacagagcgagacucugucucaaaaaauaaauaaauaaauaaauaaauaaaaaggagacaugucuuguuuuuaaguguuuucuuaaaauacaucuuucuuauuuaggaacugaugaauccccagaaccacugccaauccccacauuuuuguuggguuaugauuaugauuaucuggugcuuucuccauuugcucuuccuuauugggagagacuuaugcuggaacccuauggaucucaaagagauauagccuauguuguacuguguccagaaaaugaagccuuguuaaauggagcaaaaagcuuuuuuagagaucuuacugcaauauaugagguagguguuuaaaaagagaugacauuuuaaaacuaccuuacgauuuguauuguuguauauacagcauacugggcaguucaguugauugggacacagugaugaugucagauuagauguuuauuucucauacuagccaguuacauucuuugcugaguuugacccagucuguuagauguguaugccgugggucagaguggcuaucccccuauaggaggaagaaacauugagggcauauagauauauaucccuuuuaauguggcuuuuucuaaaacaaaggguaacaauguuaaauagccaggaaaaaaguuacauuuacaaaaauucuagucuuuauucucuaggauuucagguagugacacuaggccucacuuuccucauauguaaaauaaaucuaugcuagauaucacuaagguccauuucaggucugaaauucuugccucuucuuuuaaguuauaauucucacauauccaucaccaggcgcaauaauuguaaauuauaaguguuaugggacauaaagucuuacuuuauuauucccuccuuuuuccacaaaggcuucgaaauuuagucuuuaaauuuugauuccuuauacaaucugaauguuaguguauguuaguuuagcuuccuuuuaaaauuuuccacauaauuacaagguauuuguaguguguuuuuaauaaauaaacauuucccaaaggguguuauuuggaauaucaguccgguaaaauccucucagagaaaaaguuccauaguuaaauaggcuuggggaaacauuguauauuauauuaccuuuuagagauuuacaauucauauuagguuuuuaaaggcuuugaaauucuuacaguaaagaacucuucuaaguuugcuuaauccaauguuuuaaauuuauuuaacauugggcuucuaauaacaaaaaucagugacucacagaacuagagggagaagguguauaaauauauuuguauaacaauuuuuauuuugcuuugauuuagggauauuuguauucauaauucaugaauugguguuaauguauaccuaaaaugacugcauuuuuaugcucacuuaugucugcauucugcaagcuuuuauucaaacaaaaugguucuaguacuauuguuaucuagguguuuuuucauuagagauauuuuaauuuugaaaaaaaauuaaugaauuucuaauguaaaaaugaaaaagaccuauggcaccauuucacccuugauauguuuauuuuuuuggccuacuucuaaaaacacccuugauauuuuuaucauaacuguuaauugcaaaugguuaagcuuauuuuaaguagcuuucaugguugguuuuauaauguguaucuaaauacaauaauaaauuuacuaauucugcuuucuguauguauauuuguaguccugucgauuaggucaacauagaccuguuucucgacuguuaacagaugggaucaugagaguuggaucuacugcaucaaagaaacuaucagaaaaguugguagcagaaugguuuucucaggcagcugacgguaacaaugaagcauuuucuaaacucaagcuuuaugcacaagucugcagauaugaccuagguauugaauuuguauuuauuguauaaggcugguguuagcaaaauguggccugcuccaccagcuguuuuuguagauaaaauuuuauuggaacacagccauccucauuuauguauuuucucuggcugcuuuugugcuacaacauuggagcugaguaguuuucauagagacuguguggcugcaaagacaaaaauauuuauuaucugacccuuuacagaacaaguuugcugaucccuaaugagggaucccaucagguaggaagaaauuauggguuauaaauaaauuuucuguugccucuguagggucugauguuuuaauaacuugaagauucuucauuuguuacaguuuagagauaaaauaauuuauaguuaaucucuaccaaaccaagaaauaguucuuuguuguagcuaagaaaacgacagcuguuuaagacuugcuuguuacauacuuuuuuucuuucauucuacccgugccuaacuguauugcuuauaaauacucuugaaaauaaagaucaguggacuuccuuuagacuuaauccaaagagaugcagaaccaaaauauugaaucucauuagacauuccuauaauuugaaccccauaacauuauaccauuuuauauuuuaauuagcugucaauguagucaauauuuauuugauuugugauuuagaaacccuuugaauaguuugaugaauauugcuagauaccuuuuuuacauuuaauuauacuuagaaaauagaauuuuguuacacuuucauaguaaucauuucuuuaauuuugagugaaaauucuggcuuuuucaauuccauuuuaaauauguuucuucagucucuaggggaaaauagaaagcaaguguaggucacaccauuagcaagcaauuucggggcuauaauuaccaagaaaacaucaacuggauuaugauucuguuuacacaguagaauuuaaaaaaaccagucagugaaauaaagaauuaaauuucguaccuguuuuuauucuuuagguccuuaucuugcuucccugccauuggacagcucucuacuuucccagccaaauuuaguugccccuacaagucagucuuugauuacuccaccucagaugacaaauacuggaaaugcuaauacuccaucugccaccuuagcaucugcagcgagcagcacuaugacagugacuucagguguugccauaucuacuucaguugccacagcuaauucaacuuugaccacagcuucaacuucaucuucaucauccuccaacuugaauaguggaguaucaucaaauaaacuaccuucguuuccacccuuuggcaguaugaacaguaaugcugcaggauccaugucuacacaagcaaauacaguucagaguggucagcuaggagggcaacagacaucagcucuacagacagcugggauuucuggagaaucaucuucacuucccacucagccgcauccugaugugucugaaagguaccuuuaaaaauacugauuuuugcagaaauauaaaaacuaugaugcugcuucuuucuuuuuuuuucuugagacacagucucacucuuuugcgcaggcuguacugcaguggugggaucugcacucacugcaaccucugccucccgaguucaagugauucuccucccucagccucccuaguagcuggaauuacaggcaugugccaccacgccuggcuaauuuuuguauuuuuaguagagacaggguuuugccauguugaccaggcuggucucaaacuucugaccucaggugauccacccaccauggcuucccaaagugcugggauuacagacgugagccaccacgcccagccaugcugcuuuuuuucuaaauaagacguuuugaaugagcauaaagugcuuuuuuaucuuagucuugaaauuuuaguuuguaucuuuuuuuaagacaaggucucacucugucacccaggcuggaguauaguggcgugaucacggcucacugcagccucgaccuccugggcucaggugauccucccaccucagccuccugaguagcugggacuuacaggcaugcaccaccaugcccagcuacuuuuuuguagagaugugguuucacccuguugcccuggcuggucuggaacucuuggacucagcaaucugccugccucagccucccaaagugcugggauuacaggcaugagcuaucgcacccggccuaguguugaauauuuuauguauaaaauuauaaugaggacuuuacuucauaaaguaucauagaauucuagaaucugagggugggaauuaagagcuugaaaaccauauaguccagauacccauaugacauuugagucuucuguggcauaauugucaaguagauuugccugugcaaaucacucuggugauugagaagucacuauugacccacucuauuuagaggcuuuagaguuguacugagguuugaaucucagcucugccauuuaccugcuuugugacuucggggaaacucuaacuuucugagcauguuuucuuaucuguaagaugagaguaauaugauauaauauacauuaaguacuuuacacagugauuccaaguuauuuauagugacaagaaugauuaugacagcucucauuccuuuuuugaugaagguuuugaucuucccuuuugauuuauaggccaaguuggccagagcuuaauuauaucugucagcuacccaggaugcaguugugcccaaaauuauacucauauguggguaaaaacaaaccauuaucgagauugauacacucaucuugaacauaugaauagauuugaaguguaaaaaaaucaaaucacccaucaaagaaugaaacuuguacaccauugaagcuguaaaguaugaaauaaauguauauagucuaaaaaugggaccaggugaaguggcucaugccuguaauccuagcacuuugagaggcuaaggcaggaggguugcuugagaccaagaguucaagaccaaccuggucaacauagugagacucccaucucaaaaaaaagauauauauauacacauauauagagagagagagucugaaaauguacuagaacauuaaauaagucuggaaacgugguuucuuucuggccuagcucuaccuguagccaccuuuauaaauuugguaagcuauuugagauagccucagacaaagagaccuaucuuugucucaguuuuaucccuuaaacucuaagccaucuuuuguaucuaauacccuuacccuaugguuuuaagaauuuuuuuucuuuucuuucuuuuuuuuuuuuuuuuuuuuuuuuuuuugguaaauuuaaggcaagaccucuuaaggcaagugucuuuauacacugugaaauuguauguacaauguuuaugguucauuuuggcgagaaagaaauguccuucauuuuuagagaggcuuucugacaccuuucaccaaaaaagagggaggagggggauauuaagaaccugcuuagaugcuaccccaagcauauacaguacaacuuuuugucucauuucuaccuuaaauuuuagcacgauggaucgggauaaagugggaauccccacagauggugauucacaugcagucacguauccaccugcaauuguuguuuauauaauugauccuuuuacauacgaaaauacagacgagagcacuaacucuucuaguguguggacauuggggcuacuucgaugcuuucuagaaaugguccagacucuuccuccucauaucaagaguacuguuucuguacagguaagagugauagauguugugaguuaaaauuauguaaaacaguuuaauguugucagaaguuucagauacuacuuuucuguauucaaauugauuaucuaaaagccaaguucuauuauauugauuuuacuuuaauaucauaauauaaaucuuagagaauuuauaaaagauaaacuuuauagucauaugacaguaauaauacagaauaaaaaaauuccauuaaguacauuaaauguuucuccuguguuacuuuuauaagccaauuuuuaaauucaugagccuaaauagaaaaauguagcauguaccuaaacaagacagguugcaagaaaaggagaaagcaauuaaccauauuaaguuguuagaagaaauuuugaauuuauuuuauagacuucaacaggacuagucaauggcauuauuaauauaauuguuauauagaaaauuuuacaguuuuuuguuguuguuuuuuuucugagacagagucucgcucugucgccagacuggagugcaguggcgugaucucggcucacugcaaccuccagcucccagguucaagagauucuccugccucagccuccugaguagcugggacuacaggcgcaugccaccacacccagcucauuuuuguguuuuuaguagagacaggguuucaccauguuggccaggauggucucuaucucuugaccuggugaucugcccaccucggccucccaaagugcugggauuacaggugugagccaccacaccuggccagaaaguuuuauagguuuuaaauaguccuuuaauucagaacccauugguaaaauuggcuacuuauuaaaagccuacauaauagauaagaaaacaaucguuaaauuuucauuuaaauuagguuuuguguaaauuuucuaguaaaaaguuuuuagaguuuuagacccacaguuccuguuauucucuuuuggaaguuuaacauuuguaauauuugccuauacuucuuagauuauuccuugucaguaccuguugcaaccugugaagcaugaagauagagaaaucuauccccagcauuuaaaaucccuggcuuuuucggccuuuacccagugucggaggccacuuccaacaucaaccaaugugaaaacauugacuggcuuugguccagguuuagccauggaaacugcccuuagaaguccugauguaaguauauguuuuucaugaccgaaguucaaugacuauacauaccuuuuuuuuuuuuuuuuuuuuuugagauggagccuugcuuugucacccaggcuggagugcaguggggcaaucucagcucaccacaaccucugccuccuggguucaagcgauucuccugccucagccuccugaguagcugggauuacaggcaugcgccaccuugcccagcuaauuuugugugugggaggaguuucaccauguuggccagguugguuucgaacuccugaccucaggugaucgcccaccugugcuucccaaagugcugggauuacaggcacgagccaccgugcccugccaacauuuuuaugauacuaugcaaaacuaagugcaauuuuuggcuuagcugucauuuuccaauuaucuuauaauuggguagauaagaauuacauuuuaaaugcaauauuucucuaagauuguauaguaugauaauaccuuaauuuuuuauuuuauagagaccagaguguauucgacuuuaugcaccuccuuuuauucuggcuccagugaaggacaaacagacagagcuaggagaaacauuuggagaagcuggacagaaauauaauguucuuuuugugggauacuguuuaucacaugaucaaagguggauucuugcaucuugcacagaucuauauggagaacuuuuagaaacuuguaucauuaacaucgauguuccaaauagguauuuguauuucccuaaauauaucauaucauuccauuuguaacauuuuguuucauuuuuaaugaauagaaaaccaguuugaagguuuuauauauauuaaaauauuaagaugugggguugugggugcuuuuuacuuuuuucuuuagugaauguuuauauuguauaacuaacauaauuaaaaauaauuuugauuaaucuauuauaugaacaaaaaagauuaaggucacuaacuucugugucauaaagcuugaggcaauuauuuuagcugaacauuuuugaaagauguaaaaaaauggucuaguaaaguaucuauagaacauuuaaacuuuucucauguaccaucuaagauauagccccuaauaaacugaguaaguuaacuucauuuacuaaaauuggcgauuuaaaauuuuaucauuuaaauguuaggauguagccgggugugguggugguugccuauaaucccagcuacucaggaggcugaggcaggagaaucacuugaaucucugggaggcggagguugcagugagccaagaucacgccauugcauuccagccugagugacaagaaugagacucugucucaaaaaaaaaaaaaguuugguugucuucagaauaugaugaccauuuuagaauucuuggcaguaaauaucacgcccaguuauuuacgaaggauauaacuaauaggucacaacaggugagccucauuuugaguuaucacuuaauaaacauuucaagccuuuaguagagacuugaaacauguuuucaaggcuagugaacgcuguacaggagaaccugaaaagcaaauucgugaaaugauuuuuaguuuuaagauuuggguucuggccagacgugguggcuccugcuuguaaucccagcacuuugggaggcugagacaaggcggaucacuugaguccaggaguucgagaccagccugggcaacauggcgaaaccccgucucuacaaaaauacaaauauuagcugggcauaguggcccaccuguagucacagcuacucgggagacugaggcagaaggaucacuugagcccaggaagucgaggcugcagugagcugagauugcaccacugcacuuuaacgugggcgacagaguaagacccugucucaaaaaaaaaaaaaaaaaaaagauuuggguucuaucguuuauuuucuuccuuauuauauaaaagcuuguuuuuuaggugagaaguuaaauauaugcagaaauaucuaaugauuauuaggucuuuaauggugcuggggaagcagaagauagaaacauuaauuuuauauuauugauuauaaacauuaacaaguauguuaagcuuuauauuauaaaccuuagaacagugcuucguaucuuauuuccuugauacaauuuugauuuuuuuaauuggauauuuauacugauuaagugaacucgggaaagaauaugcuaaucugugaaguaugagaaaguagagaaaaaaaauaccacccuuuucauuaucaaaauaguauuaucauuuuacuaccuugauaaaguagaagugagauaaugguuaagaggggcaaugauggggcugggcauggugacucaugccucuaaucucagcacuuuggaggccaaggcagguggaucaccugaggucaggaguucgagaccagccugacugacauggugaaacccugacucuacuaaaaauacuaaaaauacaaaaaaauuagccaggcaugguggcauaugccuuuaaucccagcuacuugggaggcugaggcaggagaaucacuugaacccaggaggcggagguugcagugagccgagauugugcuauugcacucuagccugggcaucaagagcgaaagucugucuuaaagaaaaaaaaaaaagaggggcagugauggagucagagagaccugggcucaaaucccaaaccugccacuacugaccuuggaaaaacuacccuuaugcagcugagauacagcuuacuuaucuguaaagucuagaggauaauuuuauuugucucauagaguuguuaggaugaaaugagguauuacauguaaauugauugggcacaauggaugguacauaguaagugcucaguaagucauagccacuguuggcugggcacgguugcuuaugccuguaaucccaacacuuugggagggcaaggugggcggaucaccugaggucaggaguuugagaccagccuggccaacauaaugaaaccccgucuauacuaaaaauacaaaaauuaggccucgcaugguggcucacgccuguaaucccagcacuuugggaggccaaggugggcaggucacgaggucaagagaucaagaccauccuggccaacaugcugaaacccugucucuacuaaaaauacaaaaauuagcuggguguggucguacacgccuguagucccagcuacuugggaggcugaggcaggagaaucccuugaacccaggaagcgaagguugcagugagccgagaucacaccacugcacuccagccuggcaacagagcgagacucuugucucaaaaauaaccaaaaaacaaaaauuagugggguguggucgcacgcgccuguagucccagcuacucaggaggcugaggcgggagaauagcuugaacccaggagguggaaauugccaugagccgagaccauaccauugcacucuagccugggugauagaguuagacuccgugucaaaaaaauaauaaguaauagccagcugggcgcgguggcucacgccuguaaucccagcacuuugggaggccgaggcgggcggaucacaaggucaggagaucgagaccauccuggcuaacacagugaaaccccaucucuacuaaaaauacaaaacauuagcugggcguaguggcgggcgccuguagucccagcuacucgggaggcugaggcaggagaauggcgugaaaucaggaggcggaacuugcagugagcugagaucgcaccacugcacuccagccugagugacagagugagacuccgucucaaaagaaaaaaaaguaauagccacuguugcucagccaaagagugcuuauguugcauauuuggcuagugaaggacauguaugcagaaaacauguaacaauguuguuuggacugagaagugugguguuuuggucagucuucaacuuauaguauagaacagggauugcuuacugcagcccauggaccaaaucuggcuauuuccauuugaaguauuggcucuuuaaaaaaaguuugcugggucaagcaggguggcucacgccuguaauccuagcacuuugugaggccaaggcgggcggaucacgaggucaggaguucuagaccagccuggccaagauagugaaaccccaucucuacuaaaaauacaaaaauuagccgggugugguggcgggcgccuguaaucccagcuacucgggaagcugaggcaggagaaucacuugaacccaggaggcggagguugcagugagcagagaucaugccacugcacucuagccuaggcgacagagcaagacuccgucucaaaaaaaaaaauaaaaaguuuacugggccaggcgcaguggcucaugucuguaaucucaacacuuugggaugcugagacaggaucaccugaggucgggaguugagaccagccuggccaacauggugaaacccccucucugcuaaaaauacaaaaauuagcuagacgugguggugugugccuguaaucucagcugcucggaaggcugaggcaggagaaucacuugagcccgggaggcagagguugcagugagccgagauugugccacugcacuccagccugggcgacagagugagacuccaucaaaaaaacaaaaaaucccuggcguagagcaguauugcugaugaauugagguguuuuauagacaaauuuuuuuaaaaauuuauauauuauaaugugaaauagaaaagcaaacucagaugccaaaccuaugauuuuaugaauauucucgcuuaggacuuacguaaagguuuugugaagcacuaaaauuaaggagaucuguuuuucacaaauuugagcucucuuaaaaugucgggauggcacgguggcucacaccuguaauccagcacuuugaggggacgaggcaggcagaucacgaggucaggagcucgagaccauccuggcuaacgcggugaaaccccgucucuacuaaaaauacaaaaaauuagcuggguguguuggcacacaccuguaguuguagcuauucaugaggcugaggcaggagaaucacuuaaacccgugaagguggagguugcagugagccgagaucgcaccacugcacuccauccagccugggugacagagugagacuccaucucaaaaaaacaacaacagcaaaaucauauaaauuuuagaaauauuuaugacacucucuuuauucacacaauagggcucgucggaaaaaaaguucugcuagaaaauuuggucuacagaaacuuugggaguggugcuuaggacuuguacaaaugaguucauugccauggagaguuguaauuggucgucuaggaaggauuggucauggagaauugaaagguaaaauugugcuuuuauuaguauuuauauuuccguuuuauguaaauucacacacaguucugaccacgucuagguauauauguugaauaaaaugcaaagguuaucaaauaaggaaccacauaugucuaggccacaaauggcuuaauucaaauuuuaaaaagacauuuuacucuuauuuuaacuuuaauaucagucuuauuacugcuguucuuaauuguuuucuguuuuuuccacuuucugauuguuauuuaacucauccucuguugagcagauaccaauugaauuugguguauccuaauauuagggggauaaagaauguucaguagcaucagcaguaagaauuuuggcuugaugaugacucguguuggaggaauacacuaauuuaaaagccauuaacuauuuuuauauuuuaacuuuaacuugguucuacaggauauuaauaaugcuguuacuuugauuuuuuuuuuuuuuuuuuuuuuuuuuacuguugauacccacagauuggagcuguuugcugagucgucgaaacuugcagucucuaaguaaaaggcucaaagacauguguagaaugugugguauaucugcugcagacuccccuagcauucucagugcuugcuugguggcaauggagccgcaaggcucuuuuguuauuaugccagguuagcuaucuuuaguuuauaucagauuuaauucuuuaugcaguuaaguuuuuaaguauuauauacaauuuauucuucguuuauuaaaagaaaaaaugucuuucauuuucagauucugugucaacugguucuguauuuggaagaagcacgacucuaaauaugcagacaucucagcuaaauaccccacaggauacaucauguacucauauacuuguguuuccuacuucugcuucugugcaaguagcuucagcuacuuauaccacugaaaauuuggauuuagcuuucaaucccaacaaugguacguaauuuguuccauuuugguagucugaagaauaccccccaaaauaaauucauguccaauaccugaaacgugugaauguuaccuuguuuuaccaaaaaaugauuuugcagaugugauaaguuaaggaucuugagauggagagauuauccucaauuacgcaggugggcccuuaaugcgauaacauguguucuuauaagaaggaggcagaaggagguuugacuacauagaagagaagaaagccaugugguggaaacagugggaagcaaagucaaagggagaagaugcuauguugcugacuuugaagauggugaaagagcccaugagccaaagaauauaguucuagacucugaaaaagacaaggaaacagauuaucccuuucagccuugccaacauccugauugcaguccaacgaaacugauuucagacuucuggccuccagaacuguaagaaaauaaauauguguuguuuuuaagccaacaguuugugguaacuuauuaaaguggcaacaggaaacuaauacaaucauucuuucaccuuguugauaucagaacuggugcugugaauuaucccauaaaucuuuacuuuuuaaaaauuuuuugagacagagucucacucacucugucucccaagcuggagugcagugguacgaucucagccuacuguagccuucaccuccuggguucaagcgaugcucgugccucagcuucucgaguagcugggauugcaggcacaugccaccaugccuggcuaauuuuuguauuuuugguagagaugggguuucaccauguuggccaggcuggucucaaacuccugaccucaaaugauccacccaccuuggccucccaaagugcggggauuauaaacaugagccaccaugcccagccaucuuuacuuauuuuaaaaggcaauaguuggucacaaaauauuuguauagguuuacccuugugcuuuugagguaccuguacaugaacucauuuuauauaucucuuauguugauuugccaaaauaauguaauuuauauaaacugccaaaguagggacguagcuuuuccaggugaauuuauagauugcauuuuaguagaagagaaaauaaagaagauuuuauuguuauucugagcuaccuuaaaaacucucacaucucuaaagucacaaguaugguuauuaugcucucuuguuuucguguguuauauaauaacucgaauauuuuacuuaauaaagaacaugguauuauucguaaauacaguaauccuccuuaucuuugguuuugcuuuacaugauuucaguugcccauggguacaguacaauaagauaguuugaaagagagagagagagaccacauucacauaccuuuuauuauaguaccuugcuauaauuguucuaauauucucguuguuaaucucuuacuguaccuaauuuaucauugaaacuccaucauagguguguacguaaaggaaaaaccaguauauaggauuugguacuauccuugguuucaggaaucuauguggguaugggggugggucuugggacauauuccccauggauaagggggaauacuguagucccacuuuaaacacauuuucauuuuguuuguacuauguuugcuuuguauuaguuuccuauugcugcucuaacaaaguacuacacauuuaguggcuuaaaacaacacgcauuuauuuuaucuuacaguucuggaagucagaaguccaaaaucagucucacugggccaaagucaaaauaucagcaggauugauuacuuucuggagguccuaagggaaaauguuuccuugccuuugucaguuucuacaggcuacuugcauuccuuggcucauggucccuuccucuauccuggaugccagcaguauagugucaucacaucuccuucacuggcucuaacccuacugccucccucuuauuaggaccccugugauuacauuggacccacccggauaauccagaauaaucuccccaucucaagauccuuagcuugaucacaucugcaaagucuuuuaugguaacauauucuuagauuccugggauuaggauguggacaucuuuggggggccauuauucagacuaccacaugcuuguuuaugcauaauuauuuguacggcuuuuagcacaauacuuggcacaugguagacacucaguaaauguugguuaaauuaacccauuuugguuaaaauuucauuuauuuugacccuuuccugugaaugaccauaggauauggaaaauggaguuuuaaauuucuuuucuuucuccuguuuagauggagcagauggaauggguaucuuugauuuguuagacacaggagaugaucuugacccugauaucauuaauauccuuccugcuucuccaacugguucuccuguacauucuccaggaucucauuacccccauggaggugaugcgggcaagguaacuguguuacaaguuuuaguuuuucucggccgggcgcaguggcuuacgccuaaaaucccagcacuuugggagggcgaagcagguggaucacgaggucaggaguuugagaccagccuggccaauauggugaaaccccaucucuacuaaaaauguaaaaaauagccggguaagguggcacgcaccuguagucccagcuacucaggaggaugaggcaagagaaucacuugaaccugggaggcagagguuguagugagccgagaucauccaauugccauuccuuaacuuaguaauggauuaauauaugaaaugcaauacuauuuuuccuuggaaauuagcaagaguugagauuaauuaacaguacauucaugcauuucuacaucauggacaucaguacuuugaauugcacauuuuuaagagaaucucuaaggcucuacuuucccugaauccguauuuucuagaccauuuggcauuagucauuuuuuuguaguuuuuguggcaguucaccauagcuuuuuacucagauguaggaucacaguaucuuucagaaucacuauauauaacucuaagagcagccauucauaucagggcugugacaaggaauauaauaaaaauauuaauuuucucauaagaccagauaaaacacugaccaucuacucccccuuuuuaucuuuagcaguuauggaagcaggcugucuuguccuuauauuugaaguaaaaacgaacugggcuucaguuaauaacaccucucuauuugaaauuauauauacugggcugggcgcgguggcucacgucuguaaucccagcacuuugggaggcugaggcaggcggaucacgaggucaggagauugagaccauccuggcuaacacagugaaaccccaucucuacuaaaaauacaaaacuuagccagguguggcaggcgucuguacucccagcuacucaggaggcugagacaggagaauggugugaacccgggagguggagcuugcagugagccgagaucgcaccacugcauuccagccuaagcgacagagcgagacuccaucucaaaaaaaaagaaaagaaauuauauauacuggugauuugauuauuguaguaugcauagguauaaaauuuacccuuuuaaaguaaggaaggaucuuuccagucuuacuuugcauuccuuccuccuuuuuguaacugcaaagaaauuagauaggaaauacauauaacaaaaagcaccaguaaucccaccaccuuaauaaaaccauuuuuacuuuuaagcaaauuaucuucuuuccacauacguuuauguugcaauuuucaauaaguauaaugagguuuuaaauauugcauuuuugcuauacccuaauuuauguccuucccaaaauauuggacauguaagauuuuuuuuuguuauagauaaugauguaaugaacguuuucaugcauauuauuuuuauuuuaucuauuuuuaaauaccaagaaauacauuaacuaauccaaaggauaugcaugugacuugguaguugucccuucauguugccauaauaauuuucacaacacuauuaacugcauuuuauagauagugcuagauuaacaaagcuaaauugaauccaccuuuugauuggggugugguuuucaggacuuaaaggaauauuagcaaaaaaguuaaagaugucauugaaaauuuuguauuuuuuacucaucugugaaguuuuacaaacuuucccgugaacuuggcauaauaauacagacuuguuaaacaguuggcauaucaugcaauccuuaaaauauguucuauuaaugcuuuuacuuauaauacuccuaaguacauagaaacugguuuuuuuucaauauccuucaguauuuuauuaaaucgaugucauaagauaaugagacugauugcuaugagccauucuguguuuauaucugguacuuaguuacacugagugaacuaauauacuuuuaauuuugucuuuuuaagggucagaguacugaucggcuacuaucaacagaaccucaugaggaaguaccuaauauucuucagcaaccauuggcccuugguuacuuuguaucaacugccaaagcagguccauuaccugacugguucuggucagcauguccucaagcacaauaucaguguccccuuuuucuuaagguauugccauuucugucccaguuccuaaauaauucugauugacagccuaaguccugagaaauauagaaguggcuuuuuuaagucuuauagcuugucuaaguucuuaaaugcacugccauaugugacucuuuaaacaagaucacgaaggcacgguggcucacgccuguaaugccagcacuuugagaggccgaggcaggcagauuaccucaggucaggaguuugagaccagccuggccaacauggcgaaaccucgucucuacugaaaauacaagaauuagccaggugugguggcgggcgccuguagucccagcuacucgggaggcuaaggcaggagaaucgcuugaaccugggaggcagagguugcagugagccgagaucguaccacuucacuccagccugggugacaauaucugagacucugucucaaaaaaaaaaaaaacaacuaguuuuuaaauuuauauuuuuagaacuuuauuccuaagucaaacuccuagggcccuuguuguuaguguagauugaguaucccuuauucgaaaugcuugggaccagaauuguuuccauuuuuggauuuuuucaaauuggagaugcucaaucuguuucaacugcauauauggaaauuuagagcugagagaaacuuuauauuaccucugucuaaccuucucauuuucuaggugagcauauuuaaguucagaaaaacucaccuguuuaaagucauaaauugguaauagacucaagacugaaaccugggucuuuuaaugauuauuauguuauucuuugaauuacaucauacugcacugcuguuaugcugcauuauuuuggggaauaaaagauuuauaaucuugggcugggcgcaguggcucaugccuguaaucccagcacuuugggaggcugaggcagguggaucacaaagucagcaguuugagaccagucuggccaacauggugagaccccguuucuacuaaaacuacaaaaaaauuagccaggcgugguggcacgugcaaauuagcuauuugggagacugaggcaggagaaucacuugaacccggcagguaaagguugcagugagccgagaucgcgccacugcacuccagccugggugacagagugagauuccaucucaaaacaaacaaacaaaaaaaagauuuauaaucuuuguaauacuugauuuuuaguuucauuuacuacuuaaaaaaguuuuucuagcuguguguagauugcuguguuaaaaaaaaacugagugguuuuuaaauacaguaaugagacucucagauucaucgugauuuauuacaacaaacucaggcugggcacagcgauucaccccuauaaucccagcacuuuggguggucgaggcaggaggaucacuugaggccaggaguuugugaucagccuggacaacauagugaaauuuugucucucuaaaaaguuuuuaauauuaggcaugguggcaugugccuauaguccuaauaacaugaaaagcuggggcaggagggaggaucgcaugagcacaagagguugaggcugcagugagccaugaucaugccacugcacuccagcuaggugacaggagacccucucucaaaaaaacaaaaccgaauuuguuaguaagcaauguaacaugaaguggagauaagucacaaaaugagauauaaaagcccuauacagaauuauauuacugcugcuaauauuguuccagaauaacaaauuuagaugugacucacuuauucuuuuuuuuuuuuugagacggagucucgcucugucgcccaggcuggagugcaguggcgggaucucggcucacugcaagcuccgccucccggguucacgccauucuccugccucagccucccaaguagcugggacuacaggcgcccgccacuacgcccggcuaauuuuuuguauuuuuuuaguagagaugggguuucaccguuuuagccgggauggucucgaucuccugaccucgugauccgcccgccucggccucccaaagugcugggauuacaggcgugagccaccgcgcccggccgugacucacuuauucuuauguaaaaccaccggaaguugacuguuuuuaauccacaagucaugcuaauuuaaauacuugcugccgggugcaguggcucacaccuguaaacccagcacuuugggaggcugaggcaggcagaucaccugaggucagggauuuucuauauacuaguagucuuuggugucuccacaaaacaaaggauucuuugguccuuugggagggugcuacacaugcuaucuguccucuuuucuagucauaauacauguaugcacacuaaagucugaaaaacagagguaaauaagauaguuuaccuagcauuucccaaacuuauuaauacacaaggaaaggauuauuuaacaccuguuaauaguuuauuaucuuaguguuucaggggauguguucaggaaacacaacuuuacaaaaaguccaagggacuaucuagagcuuuuccuacucaguauuuauuugcagaaaggauaguauaaagcgggcauucacccuuagauacauuguaacaagauuaggacuucugguuaugaacuaucaccuaaggcauaauuuaccauacuuuuuguucacuuuuuuuuuucauauaucuuauuuuaguuuuauacuguaggcaguaaagccaccugguuuguuucucuuugcuuggaaauauaauggguuguuagcuagaucccuuuuuaucauaggaauagaguacugguacuaauuacauuuuaaaaauuuguagugauuugcagugugagacuugcuuauaacuccauaaaucaagaguuuguagacaguugaaacauagcuauuuuugguuauauuccuaaauguacuacaugaguuucuauauguauugcaguugcagaggagagaacaccuaaauauaaaauaguaccuuauacaguguacagaaugagaucuaccaagaguuacugcagugaacaucaccauuguuuuaucauagcuuuuuaauacuauauugacuuauaaaaaaaaugacucauuuaauuggaguguggaguaguuuauuccuuucucccacuauucauugccauaucuaaaugagugugccaguuuuuaccuacccucuauuaugaaauugagugggcaaagcaggcaucugugcacuguauuacuuagaguguucucaguucaaccgaagauagcuuguuuaagguuuauugugcuguaaccaaacuauuugcuuaugcuuauuccuguuacuuuuuucagugcuagacguagguaugucugcguagucauaaagggugucauauaucuuaaggacagacuacucagguuuaacuacucaauuuagugccuccuuaaacauuuacuuugcacaucuaggcaaauuagacuuagcagguaauuagaaauucuuuuucuaaggauuauuguauggucucaaaaacaauaaagcuaaagaaaaggaaauagauucaaaguaaguuuugcacuuaaaaaucacuucuggcuaggcacaguggcucaugcguguaaucccagcacuuugggaggccaaggcaggaggauuguuugaggccaggaguucaagaccagccuggucaacagaacaagaaccugccccuacuuaaaaaaaaaaaaaaaaacauuucuauaaugaauuaguuaaaagagaacaagcauuuuuauaguggcuuucauucauaacauaggacuaaaauguauuucaucauuuuauaagauauauugggagaauaagguaaaacuaaauagcagauuauuuucuguuuggcugacugauugauuaccuguuaccuucuuaggccucuuugcaccuccacgugccuucagugcaaucugacgagcugcuucacaguaaacacucccacccacuugacucaaaucagacuucagauguccucagguacaacucuuuuaccauuaacaguuugucacugcaacuuuaaaagaauauaauguugauucuuauauauuuuucucauuuuuggcaagaauuuacaguuguguaccaguggaucucuagauaaacacugcuauucuaacuugaguaaucuacuuuugagaauaauuuuuauggaaauugcuucuuuccccucaaggacucucuguuacacucuuuuuuaaggugacuuugagucuuaaaugccauaauugaaaacugcuuccaaaaucuagguuggaaauaaauaaaugacuuaugcaguuuauuugcuuuucagguuuguuuuggaacaguacaaugcacucuccuggcuaaccugugacccugcaacccaggacagacgcucaugucucccaauucauuuuguggugcugaaucaguuauauaacuuuauuaugaauaugcugugaucuucauuugauggaacugugcaagaaaagaacaaggaaaaauggauguuucgcugcaggauuaaguuacaauuaucuucucagugaaggucauuugugauggggucuaauucuuauuacuucaacaaauauuguuuugacuuggggggaggggcuauaacccugcuauuuuucauugacucuauugaacucuuuaggaugaugacugaucauacaaaacguauuauaacauuuucguagcaaaauuaaccuuuuuuuuuuccagucacaguauuugugaaaaguaaugagccauaguacccagucauguuaaaugaauauuaaaagcauggagaggaaacaugaggaacaaugaauuucaacauauggcuucagaacaugaagauguucuuguauggauuauaguaucuaguauucaaaaaugccugcaucucuucucuuauuuauuguaaguuuuuaaauguauaaauugucuuauauuucuuaaccucuuuuauaaaaauuuuccuagaagguuuauacugccuucuugcuuuaaagcaauuggucuaaaauauauguaaucgucuuaauuaaaaaguugcaguaggguugcuuuuagaguauuauuuuuuuguaagggggugggugggacaguaaauuuguauugucucgauguacaguuuaacggggauagagggggaauaauguccauaccauuguguguggaggauuuacagcuaagcuguaguugcagaguacauguacaguaaugaaguucacuguguuuauaaauugaaaagguaccaggucuuacagcauuuuauauaucacaucuuuacagaauaacaugauggcaauauacaagugguauuguuaggugguuuaacuuagaauaaaaugagaauucuucaguuauauuuuguacuaugguuuagggcuaugacuaauauuucaggccauuuccggugaaagaaacuuaguuuuacaagaaaaaccauuugcuacugaaugcuuaaacuaauuuuaguguuuaauguuacaugcuuaaauuuuuuucaguuuuaacaguggcauauuuaggcauggaaauauuauuaugaaauuuauuuucaggaucugcuauaagguugaaauuuagcccagcucuaggcauuuuacaaauuauuuuucaagcagucauucuugauuguuugacuuuuuuuuuuaaauuaaagauugggaauguaugugagaguaugcauauguaugggugugugugugugcgcgcaaucaaacugugguguaaauagauucucagugaauucugguauucagacucuauuccacuagugaaagaaccauuuuuuaaacuucccuugccuuuuuuauuuauuuaauuuucuugguuuggagaugucagucccaaacaccagagucuguacuuuucuauaacacagcucagauuaagguagggcauaugccaaggagguucucaccucccuaaagaagggacuugaauuuuagggacuuuaauucaccccuccuucaauacaacuuucccccuucuuguuugcacaugccaagauaacugcuuuuaugcaggcuguacccccuugaaaaauccuuucuacagugcugcucacaaaagagcccaaguucgccuccuaccugcauugcugacuugaauucacagucgccgagucuaccuagcuuucuuggaagcagucuagcaaaauuucuauuuguacguucacuaauuaucuacaaggacaaaaucaguuguauuuacaaaacucuacuucaguguuuguuuuaguuuuuuuuuuuacugaaacuuguuuuugugaauacucugugcuuagaauuaaauaucacuuucuuaugaacaacauaacuucuucagauuguguauaugaaaacauuagcaagucuuguuuuuucuaugaagcaaacacaauuggugacaaagguugucaaucauuucuucaaaauuauaaugcaguucuaauggucagcauauuuugauauuaaauuuaaagaucaccucucugcauuuguuuuuaaauuaugcuaauacaccacacauuauguugguauguuuuguucuguacuuucuuuaaaaaaaaaaaaaaaacuugucugagauuugaaggaaaaugugcuuauuuggaauuuccauaaaaagaguauccuuuuuauacacuuaauagugacuuuacaaaauaaaaguuauauucucaguuguuuaaaaucacuaaccuaugauaaccacaccucaauuugaaaguagauuuaaaauuauucccugacagguuauuuaauauggagccauaaggagggaacccaguacacaauuauuuuuuauuugggaaucagggaauaguucccaaauauacaggauuuauugauaagauuuuuuuucuucccuucauauauccauucaaacucaauggaaaguuauuaaauaaccauuagaaaagcucaguagacuuauuugagaaauuaagccuugugcaggaugauggauuugacuuacuaauguacugucacagacaaauauggguaguuuuguuuaaauagguaagcaaaauauuauacuuuauagcaguggauuaccaacaccuugacuucuuuguuacagugcuaacaucuuuuuuuuugugcagguauccaugauuauuaagcaggguggaaguucaguauuuugucauuuaaaaagauuaguuauauaaugucugcuuccagccagugagaaacaucuagccauaccuuucuuaugcaagccauugaguuaucaggacugugaauuaacacuguaugaauaaauuucuguacaccuuauuguuuggccagaaggccaccaaguguacuuauauguaauccuuaaauuuuaaaguagcuguaauuuuuaaauauuucuaaacuuuucuuaaaccacuaaaauuaagcucuuacuacuuagucaacuauccucagcuguauucguacucaauugucaguauggcacagauuacuguauuaaaauauucuccuuucgucuucauauuuaccuucugagguaauuuuuuaacuuaauguguuacuacaaagauuugcagaucuuuaaucaagcacuauguuaauacuguaauaucagaauacuauguugcauuauuuaaaauguucaaauugaauagauuaaaaaguuuuuaaaugcuauugcaucauauaauuugcuauucauccacuauggcauugcauaucaaucaguuaauacacuuaauguugcaugagugauauuuuggucuggguuuccucuuaagauuuuaguuugucugaauuaaggaaaaauguuuuuaauauacauucuuauuuugucccaccccuccagaaauaagcuggaaaucuuaacuuuuuggggggucuuuuuugguguuuuaaugggcccagaacugugguuuaaauuuuuauguauguauuuucuuuuuuguggaguauaaauuuaaaaacuggauuugggaccuaaaauacuccucagguugauguauucaugaaguuuuaaaacaucuuuaguuuucaaaguaaacuggauauguggaccuuaaaguuauugaguuuaagcuacaaauuguaacgucauuacuggacaugucagcaucaacccucucaaaauagcuuggucacuuuaugaaggggcguuuuaaaguuguuguuuagcagugacauuuaauaugguccaauugcuuuucuuuuuaacgugacaaaaagagaauaaggaacaaacacuauugcugccgaaugccauaacacugaguuguacaaauugugauugaggaaaugaaaagguuuauacuuuuuaaaaaaaaaaaaacaaaaacaaaaaacaaaacuucaaauggaauaaauuauucaugaagccuucauuguugugucuuauucuguugaaaauauuuccauauuaaauuugugcaaaauuaguagcaauauuuuugugucauuauaaauggaaagggacagccuagaaacugauuaauggucuuuuaauuuuucugaaguauuuuauuuuaaaaaggauuuuaaucacauacaaauguacaguauguagaauaauuguauauuuguauaccuaccaauuccuuguaggcuggccaguuagguauugucuaguccaaacaagcuaccuucaaauauuuaaagcuuagcuguauccuauuuuuauuugaucauaagaacaauguucagaagugaguaauccaucaaaaauaguucugcccauguucuguaagcacacauuuaaaauauuuuuguccagacuuaagccaaguaaggacauaccucaaaauuauugugaucauuuugaaauaguuuuugcugcaaaaauuuuaaaaauccuuuaaaaggaguuguauguuguuugaaccgccuauccucgguuauuuucugucugacagaucuuuaaucaagcacuauuauauuaccucugguuuguuucuaucuuuuuuuuuuuuuuuacuauagucuuauguauagcgaaaaacugcaaaucaagcuuuuuuuuaaaggggguauucacuuguaaaaccacacacau
